United States Patent 7,868,149 (PLANT GENOME SEQUENCE AND USES THEREOF) - sequence listing, part 44

SEQ ID NO: 23252 - DNA, 11648 bp, Oryza sativa
atgccccaatggacgacattaaagaacagcgcaattcccatggctcaaagcaccatgacagtcatgatactgctcatgagcgaggtgaaagagactataaaaggcctcggcctgaaggttagttttgatgacattgagagatcatttgtgattttgagcgatgtgctggaaagtgagcacttggcttggaacttaacatattaagatcagcatatgttactcgaacatatgcattttctgcctgagatcgctgccatgtgacatcaaagtgggcatatgctgtggagtgacaggcataaggatgctcatgtttttacccagctgtatacaacctcgcaactgactgcaacgggtgttttgccctcgatttgtactgggggacagtttgggaagaaactcatgatgataaaatctgtgtttcaacaagtattggagtaaatacactggagaaagcctctagttccatttgcgttgagttctttctttctttttttgtttttaggcgaattttcagcgacgttccgtagattagctagggttcaactttgtccactagatgaattgaatatgcttttgcaggctgtctgccccttaactagctcgagaagttggcattggttcataactttgaaatattttagcttgttcaggtggcggtttcttcccaacattgaacctggattctcgaatggaatggcgttcaaatgttctatcgaactatgtgcatggggtgcagttaatgaaatgggttctattttcctcgttttatatgttctatcagattacatgcttctgttggatgatgatggctggataactgggttcatgttcgaaaccaattgagatgcagtactgctctctacatgtgaaaatagaccctcactgacatgtagacccgaggatctacgaggagaaaccctatcgttggaaacaggttgtcttaggtcatccaggaggcatcagccaactttgcatttgtccattaaactactactaaaccattactaatacaaactatggtagcttatgacgacagcttaagtgtcatgtttaggacattgatctacccatctatctttagtgatttttatctcatcaacatggaacaatatgattcacaacctaatcctatgatatgatgattactcaggacagctcgtaggttaataatcatggttaaatttaacatcaacttccaaccaggaaaagcataaatggcataaaatcccgttacatgagagatcaaaatctcagtatgaacatgcagcaaggtgattatcagatcatggtgcaaaagaggaaaaaaaacaatgccacatctatccttggatgccatcttacaagatgtaaacaagacctctgttatatgatcccttagcgagtggatggaatgccgaaaatcctgttatatgatccctcaggcgagttgctggaacgctgacctccattgttctcaccagagtatgcaatcaggaggcatcttgcaattggatgtttcgtgctagaggggaatggcagtatcctcctttgctgcagatgatccaatccagaggtgaaaggtaacaagtgccaaccatgctgagtgacgaaggataatcagctcaatggagctgaaatgaaattttcctctacaatgggtcactgaagtgtatagcaaattagcaacatacttctatacatcaaataatcaacaaatcgctgccaaaacttggtggactatgccgggcctttgtttttggttgatgtcataaatgattcgccgcaaccacattctcccttggaattagggttcataaacacaaactcagacctacaagacaaagaatcactaatggcaatttgcaaaagaagaaaaagaaaaaagacgttaaaataaccatacctaagtggatcatcaatgaaatccattttggttccaatcacgtgcataagagctttcggatcaattagtatcttaactcctttatcttccacaagttcatcgaattttcccttctcatctgagaaataatgagcataaattacaatactagtataagtttcataaattagtcagattaactggatcgtttgtagccaaacaattaagcacagaaataagcccatctgttaattatggcacaaacaagtgactatgggattgaaataactacacattttagcaagatggtataatctcagaagctgtgaagaagaataggtgtcattccaaataaacatgcatacatattccttcagtgcccagtcacaaaagagagacaccctaaaacatgtgcaggtaaaccattgttaatttggctcaaaggtaccttttggaatataaagttcatatatggaatcaaccaacatcctaaaaggctaacttatatgtgctaatgctagagagctgaaaagacaaggatgtgaacaaacaaagccaaatcgctcaatccagttgagaactaatttcattttctagacgcttaagttccacctgatattattagggaagcatgacctttgtagacacaacaaatgtccactggtattatgaactcaagctaataactcttttgtggatagtgacaaacaaatttgacggttttaacacattttttttactcgaaaacgcaagaggcttgcgcttcatttcatcaagaagcagaaatatgtacaacagaggtgatccataaagaaggaaccctctagaggaaaaaaaaagcatcacaaaaagcgatgtgcaacaaaaagacctcctaggagcagctaaccatccaaaggaagcgatcacacaataactcattgagagccctggctccagacatacaccaaagaacactctctcttgctactgcttgcaagacaactgtgatgctgggcatggcattaaaaggaatttgaaaggaatatgatcagatatgacaattttgcatcaagctcaaatatcaggaagcatccaaggaatttaagaaagggtaacaatggaatttacatctgtcttgaccacagtttaacaagagacaaatagcttattcgcatactcaagctaatacctcttttatggttttgacctatcttgtcacaaggctctaaaaggaatttgcaatggacattatcagggagcacccaaataggaatttcaggaagagtgacaatggaatctaaatttttcctcgcaacagtagaacaagagacccagagcttattcgcatatcaagatgataaacaagatctaaaacgtcggggaaaccgaataccagcataattcattgtgtacgacaacccattgcaaccacgggccttgacgccaagacggagataagcacgctgccgtacgccaagcagctggcgcaccctcgacgccgctgcatcggtcagcgtaagggcctgctttcggacagacggccctgccttctctgccatcgccttgaacaccgaagaagccatggcttttctacaggcaccgcctcctttgtgatccgaatccaatttgcttaattaagctgcaaaatcataatggatggagaaagcaatcaacgccaacgagtatacatatatatacaactccagtttacatgtactagctgaaaaaggtaatttcagaaagacataagatgaaattgtttgacatctgtgaggatttctcttggcgtttactacgcatctagtaaccaaccaaaggaccaaataatcctcacctgaatcacctgaaatgattagtctgataaacaggggcatcgattagattattcttttgaccaagaacaagaacgtctgatttgctgtcaaagaaacgacccggttgcctattcttccccaacgagaggaattgcacgaaagatggctaacttctaggtcggtgatgcgggtatgcgcgccacacacacctcgccgccttccccaccccacaggccatccccccccccccccccccccaaaaaaaaaaaagtttatcagctaaccttgtcgccgcgccggcgccagcctcctccgacgcctctccgccgcccccacagggaatccggcggccttttcgccggggatggagcgtcgcgccgcgccgccgccggacgagaggtggtggcgccgcctcggtggatggagagaaggatgcgatggcggatttggaattggcctctattccgctctccgagttttttttttcttttttggctgttttttggttgttttttttgacacgatttctctcttccaagttggtaggagatgtataggtaggtaggtcactctcctcctgagtccgggcggtgctgggactggatgcaatcagagccgtcggatccgatccgatcgacccatatactaaaggctctgttcatttcccatccttccaacttactctcattttccacgcgcacatatttttcaaattggtgtaattttttttaaattttttttataaaaaggttattttcaaaaaatcatattaatatatatttttaagtattttacttaattaatcatacgctaatgagtctctactatcaaacacagcctaatacttcttagtttgtcgagaattgaatcttttttaccttttggtcatttttaaaaacttattttacaaatgacattgacaccaatgatctatttgaaattaaaaaaaatatatacaataggtttttaatgacatcgttattagcatcgaggacatatttatacatatttttttattacaaatatatcttttttgaaatttttataagagtaaattgtacccatagtacaacaacttggtaggtgggtgtgatatagtgcaagaacttaagaattgaacgttcgagtacaatagcttgacaagtgggtgcgttctggtataagaacttgataattcgatattttggtgcatcaatttggctaagcatatgctagatgaattttttcacgatgtcaatatgccattacatagtaatcctacgaatattaccttaaatattgaatttaatctttaagaattatattgcacatatagtttacatccaattatctttaagatttttttgttttctttatcttctcaaatattaaccgaaatataataatttttacatccagtttaattgactttcagctatggattattacgataaaaatataaatatgcttatacaaatccacgctagtatattgtcaaaataattacttaaaaatgaatctatataaaaaaattgcttcaaataattaagttgtcgtataacttcttagtttactgtatcaaaatcgtacctatttgcatttatacaatcatttataaagttcttatactaaattacacctacctaccaagttgttgcactagaacgtttatttctcaaattgttgtaccaaattgcacctacctaccaaattgatgcaccgtggatgcaatttactctttttataaataggtacataacgttgatccctttcacatcagtgacttagcttccacgggagtgcgagggagacaacgccaatatcattggcgacgtcatgttgtgtgaaattctggccaattatgatttggcatgtgtgacccatgaaagttgtgtacgcatgtttaatatcacaatgctagtttagcaatggtggaactaacttataaggggttatacctccagccatatcacttcttgttccgggttcaaccttttacccgaagcgatgatgaaagtgtaagtgggatgatatgtgtatatgggcttgcttgtcggatgggttggactgcatggttctagaggacgggccgttacatattggaacaaggcgctgtgaaaaggatccatcgttggaataaatttttctaggggtatatttgtaaaataagttttcaaaaagttgaaaaatccaggggcaagaaagctcagatttttctccttttaaaatcactcatgctgcacagataataggaaaataaaataataatagtgaaaaaaattgcttatgttttcactgtaaagtatagacagttgcttcccaatatatggctatatatatctggttggatatagaggctgggttaaaaaaagccttctctaaaaaaaaatagacagttgcttcctctgttcctaaatactgctactcaacaccctgcactattatttccgaactatgactactactattttagcgaagtttggtgtatgttaaatataaccatttgattttcgtttattcaaatttgttgacttgaaaattattggtgataaaaattgagtggtaccggtcaatggtgtccatgtaaatggaatggtaaatagccaacaaggtaaataatttttttttctgcgggatcaatttggtccttgataattcagtttttccaaacaagtacttaaaatctaggcaaattttgctataggacatcgcaattgtgtgtatttagctcagggacaccgtgaaagtgaacttttggggggaagagatcccataaacgtggatatttgctgatggacaccgcgccgtctcctctccacttgacgtgctgacgtggcagacgagaggcttttttttgacacggtcggacgtaaatacccctgcgccttatctccaagaacaccctcctcatttctctgctcgaaggtgtttgatccaatcttagagacctctggtgagcttcgtcgcattttatccatgggaacgtgaactacttcctctacctgatctagccatgtccttgcatcctaattaaccgcagatcaagcatatgaagatgcgctcgtcggcgttctcggtgtccagggcgccgccgtgcgtcgcttcgccattcccgtcgactcaagccatcgttgaccgagccactacgccaaaagcatcgccggcatcctagaaggaggtctgccggaggaatcgatccgaggcactgccgttaaggagatcgaacctttcttcctcaagtccggccgccggctctttccttcgattcctcgctcccgggtgagctttggcgcaattcctcacacatgtagcatcctcatatggtctttgaatcgtttccttcctccctttgacagcccgaaggccagaaggagccgacgctgtcgacctgccgttctctgccgctgctggagcatttcaaaggtcgccatcaccgcccatccatcgccgaacctcagacgaccttcagtgaatctccaggagccttgtagccacgcacgcatgtactcactcacatggaaacgagccggagctcggcatgccgagagtcactgccgctcgcgtcgccgccgacaactattccggccaccatattgcacaaaaccaccacctatagattcgcaaggatgccctctccactttctcttttagccgcatcgtcagaaccgccaccgatcgccgccggcgtcggcgacaacgtcgccgagtgccatcggctctgccgctgctctgtctaccgagtgcatgtgaggagataaggcacaggggtacttacgtccgaccgcgtcaaaaaaatagcctcccgtttgccacgtcagcacgtcaagtggagaggagacggcgcagtgtccatcagcaaatatccacgattatgggatgtcttcccccaaaagttcactttcgcggtgtccctgagctaaatacacacaattgcggtgttctgtagcaaaatttgtctaaaatctattatttggttcaactttgttggagatatgggaacgatgatccattgaatgctcggggcaccataggacccaccgtgtacaaagtagaagatgaagtgaagtaacaagtgtcgtcttgagctgttgaagacgactaggggacaaccgttgcctgggacaagcatctattaccttgggggcctgagaaccactacaggtggatcaaggccccgatgactatgccaggaggactcttcaagagaatctaccatattaaggagatttgacctggtcttatgcgctaccttaccatgtcattctgcattaattgcgtagtgatacgcatcttatggacatatcacgggtggtgtgggggtaacgagactgtgcatttctcctcttgcttgcccatgttgcctcgaaaagaggtcgtgtgacgcggcacatgctcaacatctaccccacgggcccccctttcactagcatcggaggctgacgggcgggtccattgacatttgggacaaagacgtcggttgccccgctccatatattggccggtaggtgagttcatcacatctggtcagcctgcttggatggacaactacaagaccaagctagcataccaacccctttgggttgggccccacttttgtatgcatacataggcacctggacccccttgatgtataaaaggaggatccatgccacagagaggggagttggaattggacagactgaaataggctataagttagattcatatatcaaactcagtgaagaaggttcattatctccttgttacaatagggttcatcctcttccacttagaacatatcatcatcctccactgtaacattgacactatctcatagagtaagaacacaggagtagggtgttacattcccgagcggcctgaacctgtataaaccatgtgtactcactcccatacgtgcccagtgcacgagctcggaatgtgcaccctggtcaaactctaaaaggggtatcatgccttcccactaaagaagatcctcgctccgacaaatgtagtcattggacccatagaaaaggccacgtgggtgtgacatatcatactcatatataattatagcaacaaaatgaccattctacccttacacacacacacaccatattaaagaaaaataaagaaaaacaaaacagaaataacgggacagctcaaaattgtttctatcatgagttataggttcttatttttgttttttctttcttttttaatactatatatataataatagaatggttatttgatcattacacttacatacgaggatggcatggcacactcacatggccttttccatggatcgaagaactactttgagccaaatgctagtgactaaactaaccctagagtgaagctttagggctcggctagaaaacatatgaagtatgaacagggttcacaaagccattactagcggttttcgaaaagaaaaacattgaaaaacttttggaaatggataaaattcagataaatgttattaaaaaattagtttacttttttaatttgattgtgttgatgcgaaaaacacacactggcctgggagatctgcttagctctagtgcaggtccaaaagttaatgagatgcggccgtgctagttagtttgaacctgcaactgacaagatatgtaaacagtagatcaaatagccgatcggctgacaagccgatggagtgattccagccgatgctgataccagtcgatagcgatagggttttgagcaatcggctatatgtctaatgtagataatgatataaagacaatcggctgatgataatataatataatataataacaatataaatccaatagaaaccaattggctaacaatgagatggtaaaacaagcactgatccgatggttaaagtatacatcagctggaggtccgatgtcataagatcaaatcgatttagataaacagtgaaacatttgttatcatcggctgaatccaacttatatgtgcaatccttataagccgatgtaacgtccagatacctcatcggctgaaaccccgatgaaacccttattataaccaaagacatgctagactttatgattctaagcacgacttaatagatcaaactcaactgatatagcactaagtatgcaaagaagcataaagtctaaacaatcaagcctttgactaattttcatggtggtggataccttagctaatctaatctagcaagataatttagccgacaccagcataaaccctaaaacaaatctcagctgatacaagtaaattaagattctaaactagattaactaagatatatgataaataggtaggtaaatatatcaaccaaaccagagaaatccaagaggtcgaatgtactgatgcagcattgaacgacgccaatatagccaatacaattgcctgcgccgacggaacgtagggcttaccccttcgccggagatcgaaagccgatgcagccccgcgttaggtgccaagttccgccggatgataaaaagtagaaaagataaaaaggtggcgatgtgccgaattgtgttgatcgtggaaagctcttacaatgaccccgggtgtacatatttatatccatgggtagatactagatcttgtaagacaagaaaaaaactttcctaaaagataaaaggaaaacataaagtacttatgggacactaaacacactttcctaaagataaaaggaaactaacaaatactacctaattaatagataaactgccatgccgcattctccttgaactcggtcacatctggattagtttcctttaatagattaatttccttaaccgaatatagaaggaatctgactattggcgacatgattattctcttaggggcttaccaaatttcattgttaacagattggtttaccttttctattttttttgaatttgactagtagtttactagtttttcaactggagccagctcaaaatttttaaaaattaaaaatataaaagagtggttgtcatctagtgtgagtgcatgacaagatatatcattagataataatattactttgacattatatcggctaaaatttcatcattcaagaataggaacatacatttagtgttaacggagtcgccaaccaccttgattagaaaactctaaaccaagatgggtttcagatattaaattggttagcagagccaattgagggatcaaaaccattctctaggccgatttagatcaataaggagataaccacccgtctcatggatgaatcggaagttttacaggacaaacctacaaaggatatcacattctcacagtgaagatggatgatttacgatgcaaattgataaagatagatgataaagggtaaagtagaaaacatggctaaaaagtaaaggtaaaagaacgatttaattatataggggttggtctagaattgaatctgccatcgtccttataaatgagtttttcttgcctccatagaccttctccatgcctattagacttaggatataagaaaccttggaaccaagcaaggaaccacgagaataaccttaattggactcggactcgaggctgtcggtccaaccagccccgcaatggcggtttgaccgcagttcaccatttggtccaaccgaccatacagtggtggtctgaccggtccccatgtgaaaactccggtttattccaaatctggccaaacttactatgactttgtccttgtgtcaaatttggttgtcacatgcctcaacgtttattttgctctgtactagctagtgatgacacgcacaagtcagcaacaaaccaagcacagcggaaaatgttcaaatttttatatctgtgtaagtagccaatttccgagggtcttaaaagggtaaacgcctattaattgcagaaatattttctgtaccaattcttttcaaaagaaaaatgtatttaaggggtgcatttagggctctaacttttacagatccaaatatggctcaacaaaagatccacgaatgcatatactcaatccttatatagcaaaacatttgattaaatatatagcggatccttttacataggaaagggaattacta

SEQ ID NO: 23253 - DNA, 17471 bp, Oryza sativa
tatggagatggtgattgatggcggtgcgagctggtgaagacaccagcacaggggaatggtgcagccgccggatttgggaggaggaaagagagggaggggggcagcaggaggcggttagttggtcggaacgtgctggcactattgatggccttcagccaactgttcagatcaaggcggcggcggcggctcagtcgggctaggggaggatggcgcccgtgagcgcccattagtgcggtcgtgcttgggatgggaaaacgagaggagaagataagattaactgttcatgaacaaatctcaagacaatcctggatgtacaaaaaattgaccttttttttcaggaagtgggaattagactgtccctataggaaaacattttgttaaatattagttccaaaaattttgagaccaggagtggataaaaactaaaaagtgaccatgctactcttttttttttctgttttccatagttggctggtatatacaagtagctatgagaaaagtctttgatttttttttctgtatcacggagcagccctcccccccccccccccccaaaaaaaaaaaacctctactacaccacaccatttttaaaaatctgatcagggtatttaactccttgagatgagaatctgagagctagagtcctacttttaccaaaacacacccaggctgctccaaaatgttatcaactcaaataagttatgccaaccaatattgtagagaattattaataaaaaatataaaaaaatgtgttcatcacactttcaaagtaggtgtatatagaatatcagttcaaagctaaaaatgtgaaatacattaattgttggcataaacatatggcaaatgatgcatgaagtacatacaagcatttcctcttggtgctaccagatgccatgtaatttaaaccacatgtagtatatcattttcatcctatgttggacgttaggacattccaatgatcaagtaattaaggtaattcttgttcagaatttttctatgcatgtatgcatcttaataaacacaatttcatcaaacaaatgaaacatggttttacacatttgggaacgatttaacaaaaagctaagctatttttgacaagaaattaaaggtaagagaggataaggatggaaggaccaagtgatcagcaaggaagtgatgagtactgcacacaaaaagccacagagattgctaataaagatcatatggaagagatcataacatacatgaatcaaattatgaagacgtggcagaaggaaccattagcactaaaacatcaatcaacaccccccctccaatcattgttttcaaagaaccggtttatgttaaaaccatatatcatgtttgaaacacattaccagtttttaggaaatcagccaaaaaaaagctgaattagattcctcgatcccacactaagttcattgtccacgtgaggtccccttcataccccctatatctccattcatccccctctagccctccctcctcttctctggatgacgtaccacctgctcattctcccttcacccgaccatgccactagttctgtatttttgccaccttcctcccttccattcaacccgaccataggaaatgccacatccagccagcatgagatctgaggtggccagatctagctgttatgagcttgggagtagccagatccgttatccccccaagctcaggcagcccaaattggaaggaaggtaagctctcatattgtagcatcacgtgacatggtctccgaggccctttggcagcaacggaagctctaaggttaacctattgcgtgtgatgccgatggctctaaggcccacgtgtaatgtcccttatccctagacctttagatccaacggtggggaggcaggggccactggatggatgcccaacttggtggacgacaccttgcatgttgggtcttcgattaagaggtagagataggacatgcatggtggctgaggagtgccctcttcagcatccaaagggcggagatgtctatactaggtacatcatgctcataattgtcaagttgattggttttttttcttgaaagcttatatcatgatttgtttttttttctaaatacaaattagcctttctagtcaatacaatgtacatgttgcatttgggcatatggtgttgtagttaagataatgttaaattaaataagtgtttatgttgaactcaaataagttagggaacatgatgataagagggacatgcatatatggaaacattagttgaatacccaagaataacacacttgattgcacatgaagtccgagaacaatccttcggaatatttttattttatttcagttcagcatttttcaaacactagagcacactaaaccagaaagttgcatatgtatatgtagtaaactgaagtgagcgctatgattgcactggtaattaatttctttggaagaagctttagtagttagtgctgatcaaggagctccattatttcttagagttttaacaagttctaccaatttgaaatcccgactattctgaccataagcaaagaaggaaaatgagattcccctaaaaaaaagaaggcaaagtctatcaaagttcggcatggctctcagtcacatcagcgagggtccttaggttacacctgagcaagttctcgacaaaatagcgtatgtcatctttggagttcccctgtggaatgtccaccacaaatgactcaatcactagtgttcctggctggccgtcaatgaccttagagtgaacagttagggtggatgtgtagttctggtataataacaaaaaaaaaattcaactgttagtatttgtgctcctgtccaatagataagtaggcacacgagaataaaaagaaagtaaaattccgtatgtcaccaactcagatgctcttaacctcagccttaccatacaaagataggctttaaatgtcacaatactcatatttgtcaatggcatgcaaaattatactcccttcgtcctagaatataagaagttttagagttggacatggttattaaaaaaataggtagaagtaaatggtggagggctgtgactggataagtagtggaggtatgtgggaaaagtaaatggtagagagttgtgattggttgagaagagaatgttggtggagaagttgttatattttggaacaaatcctgagagcttaaagttgctatattttggaacaaaacattggtgctgcctcatgctatccgaagctattttatcatagtcatcttgataatttattttcgtgacgttaccgtatcttttttgtctggttaaaaaaaactaaaaatggtaaaattgatattattacccctattttggatgcaataatttcatttgatcgcaacattgactctgattaaataagttcctgctagatagtgcccattgtcttttgagaaaacatttcaaaaaaaaaacactccaatgaaattattatgttcctaactggttcttagtagctaagcagagcataaaagagttaataatcagcccaaaaccatttgaattgtcctagagccttagtagtgataacttgattcttgctaggaatcgtgcaaagaatcttggatcatttataattgtttcggtgaaattccattgttgtttttcttgtgttcaaaatagaaaatacataattctgttcttgccaaggcatgtaagataaaccatatatatcatcatcatatatcattcatataaccatatgacaagcacacccacaatgcggaggccagctgggatatgcttttccattgtctgaaaatatcacaaacacaccagaatttgtactgattttgcaagtttgatactggaaattgctggtcaatctagcttgggggcttgaagaacttgaacttcatcccactgctgatgatgctccagacaccacccacacagagagccaggctgaatgcagtgccaagcagcccaagcccccagttcaggtaccatcctgagctgaacctctcaggcttcttgatgcagatccacatgaagcacgggtaggcgaaggtgaccggcaatgtcagccccccaagcaggccggcgaggctggagaggaacggcagcgcgacgctgatgaacagcgagaggaagccgtagaacaccctgaagcctgatctcacccagaccgagcaaggccggttggtccggcccgtgtaggcagcctcaaagctgtcgaaaaccggcatggagtatatctggaagctgctcaggcagttgaacacgacaaggaggaacgtcgcagcaaggaggccccgggggatgtcgtggctgtggaaggcgtagagcgccgtcagcatccctccctgtggcacctgcaggcattggaaaacaacagggagaatgttccaaggactgttaggacttaagagtgttaagtgcagcaacaattgggtctaatgatcaagtagtacttgccatgtttccataggcccagtaacctccgatcgcgacagggaagaggcacattgcaatcagggcatatgcgactttggccccgcgccacatcgggacatgtgctggatgtttgaaagtcgacggcattgtcgcctgaaaaaaattacagattccagctcattcaaacactgaaccaccaaatggtaactgtagagtacaaaaagtctcttgtgaattggtttcttgaggacaaacctgtatttcaagtgcaagattgtgccccctgaatgcaaatgctattattccaagagcattcaaggtggagaacaaagatgaaccaagagaagtgtatgcttgtggttcataagagactgttggaggctgcggttggctgaccgagagaacccaggacatggtacagtatgttattgcggtggtgccaccgatgagtgaaacgccggctatcgagttgagattcggaagctgggaaaggactatggccaaggatgtgaacaccaagtaccattcgatcgtcgaaatcggactcggtgaacagattgggccgcaaactatttggtaaaagagcttcatggtctcccctccaacaaggatcaacgcagttgcactgcctgccgacagataaatagttgggaaaagagatagccacattcccagtttttctcctgaacgaatgaaaaaaaaaacaagagcaatcagacattcttgctgattttgcatttcaccagtcaaatggatcagatcggcagagagaatcttagcaacattgcatgttctgagtttggtgtaaccagaggcaataattacttgagctgtcaaatgcaacagtttgattaaaatgatgacatagtaattaatggtggtagcaaaaaagattccacattttgcattactgtaacatgagggtgatctattatccatcaatggagacagttcaagctatccagatgtgacccaatcatgagggtgttagtacatttgactagccactgtcccaccaaaaaacacaaaaatctcctattggaagagcacattatactgttaggagattctctctatctttctgacacagatcttgttaaggccatgattatatacattgcattactcataactcagtgctactattagcagaaatcatgtcagagatatccagcttggaatagaaagctaattgtaatggacatgcaaaatagttaaagactagagaacatgtctcaccaaatgcagcttgtgcaagctccacatatctgttgtacctccttcctggtacagcttcatggagcttgacaagaatccagagtgtgtacagttgccagaaataagcaacagtaagtgatattattccccagctcctacagtgcaaagaaccatttgttaggatgtgttttcaaactgtacaacagttcagctgaaaacaatgcacttcagagtatcaatactactagttgatactgtgtccagttgcaaggcacaaattggcaccgaaaaaattcagtttgaaatgattgtattgaatcatagtacagttttttctttcagtgctgagcatgctttttcacaggaggccgttgcacgtgctaacaaaagaactcaatcaactcatatataaactgaagattcaggaataaatccttgaaactgaaaaaaaaaaaagatgtttcagatctgtattttcacccctcagtttcagttattttctctacatttgctaaaaagtgttgtaatttttttttgttaaatatatttatcatcaaaacatttcgttcctaaccatgtaagaaatcccaagctggaacaatctgaaaaacaaataaacaatacaatttcaccaccgctttaaaacttttgggactgaatatccatctaaagaatctgatttttttttaaaaaaggaagaagaatcctggacaacaaagtccaaagtgtagcaaaaggggtagctccacacccagagcatgattaaagcaacaatgtcttgttcttggatgaggctttcagtagattttttttttgaatggacacggagaatatgcactgcagtgatggagaatatgtgaaatcttcagtgatttccaaacccaatccagttacatcttccaatcaagaaaacaaaatgcatattacagtctcaaatcactgaagcaacaaagaatcacaagctcaaactgatgcagtaaaatcaaaatatatcccacgcccaatccaattacctcctaccaagaacacagaatgcaaaattacagcttcagatttcgagagcaagatgaacccagaagtaaaagaattacattcgagcagtaaacccaaaagtaaaagaattacatttttcagagaaaccgcatcgcatctgaagaacacagaatgcacacttcagtctcaagtcaccaaatcaagaagaaccataatctcagatcaaagaagtaaaagtagaactaaagaaaacacttccagagaaactgcataacatctgaagtaacacaggatgcacattacatcctcagatcaccaaatcaacaaaaaccataacctcagaccaaatcagtaaaagcagaagtgaaaaagaaaaaaaaactagacagtcagaaaacctgcattaattcacatctgaaactgaaagaaagaaagaaagaaagggaaatggcaagggcgaggagcagagaggaggaagaaactgaagaagcaagcagagggaaagtgcctgaccatccgagggcggggaaggcgagggggaggaggagggcctggaagccgaggccggcgttgagggtgtggaaggcggcgtagcgggcgttgccgctgcgggactcggtgatgggcagccacgcgtcctgcgggttcagccgcgtcaggtgtcccacctcctccaggtaaccccgcagcccctccaccacccgcctcgccggcgtcgccgcgcccctccccgccgccggcggcggcgtcgccgtcccatccggcgtcgacatccccctcggcgtcggcggtatcgacaccacctccggctcgctcaccaccacccccgcacccgcaccctccaccgccatcgccatcggcacactgtctctctggtctgggctttcttggggggtggttcttggagggaaaaggtggcgggagggagaagtcgctgtcgtgtcggagaggagagagaagaaggcgagtgtagtacggtggagtgagtgacgacaatggcgtagtcgaacagctgtagggagaggtggcggcaatggcggtggtggtggtcctgggcactgtttgcacttgcttgctggcttcagctaggctagcgctaggctaggtaggttcgccggacggcacggcaggcggggcggcgcggcaagggtgtgggggtgaatgtgcggcgacgcgacgggatgggacgtggtgtgtgagagagagtgggaaaggggtttggggtttcgggagggggtgtcagagcgggcgcacgtgtgtcgggtgatgagtggcactgttgactttttcgcgctcttctcgctcgggcgtacggacaggtgggaacacgtcgtctactactagtactacggagtacggtgatgtatttatccaaaggagagcgcgttttatccaagctcgcttcaaaacatatgtagtcaacttaatagccaattcatacaatacttatttataaatatatactacacaatcaatatttggtctcacttattatacacaaatgctttgtgctgcagctggctataaatctatatagcccgctgctcttatctcttctcttttatctttttaaaatatgtttacaactgcctacatgctcccatagacacatgcagtgcagggcagtagagctggccaaatgggccgggccaaacgggccgcccggggcacggccgttcctgtagcaggcacggcccggcacggcctgctacagtaacgggccgtgccggcacggcccgtgtagccgggccgtgcttgggccgctggccgagcccgcgggccggcacggcacggcacggctcctgtagcaggccggcacggcacggcccgcggcacggcacggaccgggcggcccgttactgtagcgaaaataccattttttctttttttttaacattagcaaatcattacttttttaaaaaacttttatttccattttttaaataccattttttcattttttaacattagtaaatcattactttttttaaacattttatttccatttttaatttttttttccttatacatttcctttccttttttttaaaaaaaaaaaacactgtgcacagtgcactgctggcggcctgccttcacgggccgccgtgcccccgaacggcccgtgggccgcgggcgtgccgtgccggcacgggcacggccccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggccacctctacagggcagcctcggtgggtgcaaggaattttccatactgctgctgtagctgtacacgcccgtttctgcacggtgggggcaatgcttccaatgcaaagaccgtgaaacactggtttggggagttgggatcagacgggtggtattttttttcccacgggggcgtggtgaaattttcgttccgtggaacgtttgagcgggggcctcggaattgggcgggtgcggagatagaggagggaattcagggtgtgttcggctgcacattacagccgctgaaacgcaaccacatagctgcttgcagtaacacaaattaccatgcaaaatgctttggtagtggcaattgtcgtagtataggtttgttggttgtgattatattaagttgtgatgtggcaaatcttgtaaataatttcactacttttcttaacacattagtagcgataagtaacacaacagccttattcagtaaccatttataaatgacttgagactagttgacaagtatagctaacatgtccatttcatgtagaatactaaattgaatattttcactagaaattctaaatctaaggctacaaaagtcataataaacactggtatccatattttgatcacatacgtaccacctggatgccccatattgcttgggtaacatatctcttataactagtagtattggtatctactcgacactttccaattccatacattaactttttaagagcaaaacaaactgaagaccttactcagcattgactttgataagaaatccaacttttatttatatatattgttttttttgaaaggaaccagcacaagaatgtgcttattcatcgaatatagcaggagaaaaatacaacccctagggataaagaaaaagcaaaaaacaaggaaagctgtatgctatacaaattgtgggatgatctctccaagacgcttggtgcctgccaaggcccacatgccgacaatttatatatattgttggaagtatttttcttgcttgcaccctaaaaatacaagagatcaggatataataattcaagtttcctctgtatatgttgttcgatatgtatttcattcttgcacccaaaaatatgagagatcaatagataatcctgtggcaaatcctagtaccagtgcaaatccaacgatgcataatgtgtttttcatcatcgcacataaatcttaaataaaatattaaacaacgttagttcaaattaaaataatgaaaagtattttttgagacaaaatgctagtaactaaaaccacattaccgtctaaaactaaattctatagttcattctatcatcttaattataactaacattatctaaattctaaaagttttaaaggtaaaagacaacacgatacatgggcaaaaggacttgtacatgggtttgaggtggaaaaatgagtacttttttgtgattttgcaaaaggggtgtatggagtaaaatcggttgatattagtgaatggtagtagtgagggtaaaatattacaagctctagtggcatataaaaaaattagattttagaaaggtgtcacacttgcaaataataaaaactagtatgtgttacttatttgatccggccaatcggcagcgaatgaatacaatagtgacaaggaggttgtagcgggcaacgcataacaacggagacgagttgatcgatcgaccaacagaaaaaatggagggactaagctagcacactggaaacaatgaactataagagagtgatgaatttcaatcctttttagtataggaaaggaaaagaaaggaagatagattggattggaccttagagtcatgaaaattttggtaaatctcatttttgaaaaaaaaattgaatagaaagaagttgggtaagctactaaaatgaaaggatttcgaaccaaaatccttgctaatttgacaaggattgtattccttaattatttctctattttttattgcttaattgaaaattttccaaaaaaagttattagcgtgggggctttggcccccagtcaattttacacggagtgggaattagacccctaaaagctagttttgaactataaactaacaatattataatcaatgtatagcaatagaccatcatgcataatagactttcaaacacagatcggttttgcatcccttttaagtgtagcttgataaatgagttggttcaacgttggaaggtatatgaagaaaggatatccctgacatcacaaattgcaccatgttgttgctcttatctcacatgtttacaagttaaaatgtggagcagagggtatacaacccaaacaagtttggcactctgaacgatttaactcaagtgagcattgtgcgaggccatacattagttacgttaggtacgttatgaccttggcaaataaagtatcactagttgagacttctagtggtagtgtcctcaataagatgtccatgtgtttatctgtatatgttgtatgatatgtatttttttgcctaagaaggtcaaacctcataaatctataatcctatggcaaattctaccaacagcagaaatttaggaatgtagattgcagttgtcattgctacaagcagttgccacatgaatctaaaacaagaatttggataatgttagttataattaaaatcatgaaaactacaaatcacatgaagagggagacatacattaaaaaacacttgaaaaatgtgataaactctttctagatttttgtgagaataagttcactattttgtcttatcatgaaatatttccatattatttcaaaattttagagttgaggatgtaaagatgatgcttataactgttttggggcacaagaaggacatggttacatgtgttgataatcggaaattatcaacacatgtaaccgctatatctactgcatataacataagttggtccatctaatggcctaattgatcaattaatctagatttcttcatctcatgtatttttaatctgttttatgtattcttagtcttgtgtagctgtatttttatattatgtatttatgtcgtttattgattattgtattattgttccttgcattgctaacttggtgttatattgattgcatacaaacataacattcgataaatttaatccatttccgaaccgattccacaccatttctgacatctgaaacaatccgctccgcatccgtacactatccgcacccgctccgaatctgcttaaaaaatatggtctaggatatggtatgaccactatccatccgattccgctccgttttcacccctatgtgtagtcatgtgaaaatagctcacttcaaaatgtaaaatgtaaagcacaattatattgatcagtagctggactcatatataaagtaaaccaaaccataaatcctctcttctactctctcacaatcgctgaaccccaagaaggtcgccacgagctaggacgccagctgctgctcttggccctatttagattccaactttttttttcatccgtcacatcgaactttcctacacacacaaacttccaactttttcgtcacatcgttccaatttcttcaaacttccaattttggcgtgtaactaaacacaacccttctctgctagctcatatccgctacccgacgcctcgcagcatgccgtcctcgaaaagggtgctggaatagggagtggaattgatttggatcagtacgtcaggtggtggaatacggagtggaatagggcctcttgaattacaggattgagaaaacaaaggattttgacatgaatacaactagtataaaatagagaattacaaaacacaaatataacagttttattggaccgcaggaaaagcggttgttggaggaatgtcatgagggcctttggttaacctgccgaaactacctaatccatcaaagcatcggctaagtcctttgggcgaagccgtagggcgaagaccatggggttcgctaccaaccattggacgaagcctgacgataaagatcaataggttcgccgccaagcttggcgaccgaccgaaggctcactaagggcgaaggacatcaagcgaagcataaagccgtcatctggagtagaggaggccttcggctaaggacctaagaaggcctggcggcccatggaggcccttcgtcacctaatgggctggcccaagaagatcaccttagggcccatgaatgtataagacgttttatacccattgtaatgtccctatcataagaggaaccatgtaaattcccctgtactaaccaaactctatagggtatgagcctgtattaggactataaatagccccctagggccatataatggggggatcccaaaaattttaccaattaatatattgctttattattccaaacacctaacgggtttccacgtcctttaatgtgacgcagttgtcattcgacaatagcagtagttagaggagagataatgtctcaaaggaaagttccatgaggttctacctcatagtacattccataggaattttatcgactccttttattcggacgagtctacggttcgggcgcccgatcggttggagaaaaatcaggcgctgacgtcagcccgatttacgtgcaaaactactttaaattgaattttctcttaaattacttatccaaatcatgatccgattgcactattaaattcgttgcaattaaatcttcaaaacaagaccatacatggatatattccgacgaattttttttagcttgttattgaattatttttaaatgttgcacgatgttccactaggaatatcggaattgtttcactaagtagatcgaaaatatttaactcgtttaaatcgggtgttgtttcaccttatataaaaacaatgtttcagcaaatagcgaaaaaatattttagttcactgcaacatttgatccatacatagtgaaatattataagggcagtcccaacctataacactagacatggtttctataaactccacatcattaagaaactagtactagacactactcttccaatgcaaacaccactattccatacttcaatttaatgctacttatctcacatgatgtcttggatgttgtgtagaaaccatgtctcatgcaagacatggtttccttctctttcttcatttattcacttgccacatcattttttgtcctaggtggcaacttatttaatgctatggacatcatcctagtcattgggttgggaatgccctaagtacattaggtgaaatatttttcggtagaacaaaaaataaaacgaatttccttaatagggggttccaaaaatgtggatttttttttgttgcaatggagtatttcagttcactgcaacagtagatctatacacagtaaaatattgtgactacactaggtgaaacatttttgtggaacaaaaaataaaacaaattcccataatagatggtttctaaaatatacaggtgatttgttgcaaaagaatattttaattcactgcaacattagatctatacatgtgaaatattataagtacactagatgaaatatcttttgtggaacaaggggagggacaagtgggtggatccagcggggtgcgtgcatggggatggggagcgaccgattttcccacctccccctgtcgaccgatacagagcattcttgcttttattgaaaggatcatctaggaaaaaaatcccatagaaataaaattctccaaaatttatgtaaggcctggtttagttcccaactttttcttcaaacttctaacttttctatcacatcaaaactttcctatacacacaaactttcaactttttcatcacatcgtttcaatttcaatcaaacttttaattttgacgtgaactaaatacaccctaactttcgtttgaatcaaccagggattaattaagtaaaaagctcgtggtcgcgaggcacacgtaacattcaagacatacacatttatgacgtagtgtcctaaattttgattgaattcattgccagatatgtacctagtagtttctaaattttaatggtcaaagtatctttttagcaatattcaatcgacaaatatgaaatttagaccttgtttagttcctaattttttttccaaaaaacgtcacatcgaatgctttggacacatacatggagcattaaatctctactattataaaaattgaagatgtttccgcggtccgtcatccatgtttgagtcggttataaaaattgaagatgtttccgctgttcgtcatccgtgtttgagtcggttttaattttatgttttggttttaatctatatctcttctctatctctactattacaaaaattaaagatgtttttgccggtattttagtatgtcattcgtgtatgagtcaatttttaagtttgtttacttttggaaatacatattaatatttgagtcggtttttaagatcgttcacttttggtaatacagaaggaatcatataaggaatctgtttaaaaaaacttgcatgctaacttgagacgatcggactcctaactacagctcatgattttctaaaaaaatatatatccaagcgaactcccacagtgaattttatcttagctaaaccatatgacaataataagattaaaatagacttcacccatttcaatgcacggggattttttttctagtatagataaaatgaaaaactaattgcacagtttgtatggaaatcgcgagacaaatcttttgagcctaattagtccatgattagtcataagtgctacaataacccacatgtgctaatgatggattaattaggcttaataaattcatctcgcggtttctaggcgagttatgaaattagtttttctattcatgtctgaaaacccctttcgatatccggtcaaacgtccaatgcgacacctaaaaattttcttttcgcgaattaaacaaggccttactgcatggaaaggaaaggagagtcttgggacactacatgatctatgaaccgaattggtcccaccatggatctgattggttgggtgggattcacctcatctgaaaacctcatattatcagtgagaaggaaattctttactcgtacaacagaggttagtacatatcgtcagaatgtctaattgcttgcctggcgaattgaggttagcttagatggtaaggtcccttatggttgatcctaccgacctacttcctccgtcctaaaaaaacaatctaggaccccttctagtatagtgaattcaaattcgttgtattaggagatatcacatccctatctaggttgagtttttttagaacggagggagtatgttcaatttttagacttagcacatgtgctcatatttataattaattattctttcagtgataggctagaccggtctagtattctgaaatgctcataggagcacatgcttatgtactattatgtgtttcaaaaaaaagaaagcatctggaaattcaaaacaaatgcttgttgagtaaatggttatttaagttaataaatgaggaaggagtttggcaagacttgttgaagagaaaatatctttataataagtctataacccaagttgataggaaacatggtgatttcatttttggtccggtctaatgaaagttaaggagactttcttgaatatgggttcttggattctgaataatggggaacaaataagattttgggaagataaatggttagttaatttgccttttaaagataagtatccttccttgtataccattgtccgaaggaaatgttcttcaattgctagtgttatgaattctgttcctcttaatgtgtattttagaagagcattagtgggtcagaatcttgtttcttggcatgatttgtgtgcttctattgttcatatccaattgaatcactcatctggttgttttaaatggaactttaatcagaatggtatgttcacggtaaggtcaatgtatcttgctttaattaataatggctatattgagaaaaataagataatttggaagctcaagatgctgcttaagattgagatctttatgtggtatttgcttaaaggtgtcgtgttaactaaagataatttggcaagacggaattggaatggttgtttgagatgttgtttctgcatgaaaattaaatctatccaacatctttttattgattgtcattatgcaaagtttttatggagagcagttcaattctcttttggttaccttcctagtagcataacccacatttttgatggttggcttttggggtggacaagaaaaggagcaagtttgtacttgtaggagcttatgcaatatgttggactctgtggttgagcaggaatgatttggtttttgataaatcaccatacatctcttatatgcaggtaatttttagggcaacatattggtttcgatactgggcgcaactacaaaagtttgaagacgacaaagagtttataaaagttgcatgttgcaaacttgagatgacaattatacaactttttgtcaattatggatggagatttacaaatagacttcaataatgtgttctccttattttagtttcgttacttattttgttcattgggcgttttcaatgatttgttgaactacactcttatttgagtgctatttcctctgtttcacaatgtaagt

SEQ ID NO: 23254 - DNA, 29782 bp, Oryza sativa
tgtctagattcattaacatcaatatgagtgtgggaaatgttaatgaatctagatagatatatatgtctagattcattaacatcaatatgagtgtgggaaatgttaaaatgacttacattgtatctatctagattcattatcatcaatatgagtgtggggaatgctaaaatgacttacattgtatctatctagattcattaacattaatatgaatgtgggaaatgttagaatgacttacattgtgaaacggagggagtactatgtaattattggctgtagctctcttgagtaaaggccgggatgttatattcaattattaaaaaaaggaaagcaatctgtctataagattattaagcataaaatgctcacagaactaacacaaaacaactacagccttgaacgatcacttgccagactttcatgataaagtacgcaatcaagcatgccctttatgggatgaggccaggtggatgacggtaaccatgggcccaatggataagagctggtttgggcctaatcctccaatgattgaaagcccaactgggcccaaaatgggcccgtatactcttgctcatggacaaagaccgaatttttttcggatttagatttttatttttaaatatttacagaaataatctatcgaccaaaaaaattgcagaaatagcccctgccgcccacctctggggcggcaagctgacgtggcaaacgggggaggaacgggcggtgacggagggagggttttttgcaagaaaacccttgccgccctctggtggggcggcaagaggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcgataactaggtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgagagaccggctgagaggagtgtaccttctataaaaggatggttaatgaggggcttgagagttgatccacagacaagtgacataacaatcaatgttatagtaagtcgggcaactgagagtttttattgggaactaatgccagttcaaaactctcgagtgtggagatggtatttggaaaatacattgcaacgtgggtggcctctagctttggttccgtttgttcacccgaaggatccaggtgtgcagacgaacatggatgatggcgagggaccaagtgctgaagtaaacgagacttctgtggaggaggtcaacgcacgagaggatgggggtgtagtagctccagtgggcattcaaccaggtggagtggctgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggccgcaatatgaagttcggtgtgttaaggaaaaagatggttgtccctggagagtgcacgcgtataaggggaaatggaaggattattggacagtgtcagttgttaccaagcatacatgttttctacctggtgttcagaaataccacaggaacattacatgtgcatttgttgcatctgagatgtatgtgcatgtcatcgataatctcacatatgaaccaaggtcaataatctgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaaccaggtattgcccttagcatttgcttttgttgagagtgagaataccgacagctggtactggttcctgaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagttttggaagagattagatgagttgacagccaaatgcagtgatcagcgtgcagcggctccatcgaccgccgttgctgaccctcctcaagctcttggacctctcccaacggatagtccaacattggttagaagaactagattagagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagacgacggcacatgtcattgctcttgtgcaaagccgaagctgctccacaggccatgcacccatgtcattgctgccgcagtggagtgtggcataccacatacagtatatgtgtcacagtacttcaataagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcagaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtaacgtcggactaaggcgcctaacgtctttatgtatgctgatgtatgtcggacttcgacacgtaatgttatgttatattattgaactctacatatatgttaaattgcacgtcatcgttatgtaccattagtaacatttgctatatttaaatagcctgtactcttgttgtacataattaatctcatgattttattactatttcataattttgcaagttatcttttgttttacagtactattttttgaattgttctaactcgaaacactatatttttcagagatggcacgtcaggatacacctcagttgttggacccagcgatagattaccgacaccggtctcaccttactgcagtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagatgatggactgtggacaggtccctcgtagcagctttggtcgatcgatggaggccagagacgcacacttttcacttgccgtgcggtgaggtagcccctaccctacaggacgtatcgtacttgttggggctaccgctcgcgggagacgcagttgggccagtgaccacggctgtggactggcaggacgatctgacggcacgtttcgcactagtacagcgcgcaccgcacctcccgctcgagccgttggcacaccaccgcaacaccggacctacgaagaggtggctgcttcagttcaccatgagtgtttttgtaccgaaatgacaatcgtattacatatttagtccgcagttaaggtgcctaacattttatcgactgcttgcaggttgagcagctacaggcggaggccgacgagtactcgtacagccgatgtttggaggcgtacttgctctggctttttggctgggtgatgttctgtggcggtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcaactgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgacgactgacgtcgtgtgggagccctacagtgccgcggctacccaggctcgtgcgccgttgggtctgtccacactctgcaccagggaccaggcgtactggatgactacggttccgatggtcttcgacatctgcgttgagcctcacgcccctttccgcgtgatgcggttgttcggcttccgtcagccctttccagtaccgtttccgaccaccgtcccagctgctgttcaccggtaagatcttgctctacgctttccgttgttgcattaaaatctgcctgttcacaataatttgtaacatctgtcgtttcacactaatattacacattaattcgcaggtactcgcgcaagggtcagcactcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctacgccaggcaccgcgaccaggacttcgctcgtgttgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaacgtttagacgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggcggtaactatttttattactacttctatacatgcctcgcacatataagtgagccgttttacttgcttattgcttcagggtttcgtgcaccgttcagcaccccgccttcctcggctaggccttctgttgtgccccccacaggtacttaaaaaaacaacattacttccataatcaatttacatacattttatgtcttagcttacaagggtcccgttgtcgatgtgtaggtttcgcccacttcgctatgacgcaggccacccacttctcccaggctgcagggtcagcgtcacaggcagccggcacgtcgagtcagggtccaccactggaccatgctgggacctcgtcggaccccttcctgtcttccaccgtgctcttcgacatcactgacttcgacttcgcttcaggctcgacagaggacgtcatcggcccctcacagctgggaggcgcaccgccggtgcagacgcaggaccaggcgcaggccactcctccgcgggacactcgtgctacccgtgctgtgccaccggatcgtttcaccttctcccaggaccacgtgcgagcacaggcccggaggaccaagcgtggtcgcggcgcggggcagggccagtagagcagtcttctttttgtttacttgcttcactttccagtactgtatgcttgtgtaatgactacgttgttgttatatgtgcacgataccttttggcgcatgcacaatacctttcggcgcatgcatgactactttctgccgcaccgatgcagcctcctttatttgcgtgtgatacgagtatttgcccgccatttggcgcatacgaccaatgtaactttcggcactgatcatgcatgtatctttcggcgccaatcaggcatacccaccataccccaccacgttcacatgtcaggggtatcactcgattttttgcgcctatataagtcgccttaatgagtgagccctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatgacttcgaggaatcctgatattcgaggaaggcgcttttttaggtgccctaactatgatcgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaattacggcactccctccatgggaagcccgtccaagatgcaggtgtggtgatcgttgtcaggttcttcgttccataaatcttacaacattgggtcgaaggttctttgtttgtccaaatattcttgacgacgatttcatggtaagaatattttgattacatgattccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaacttagcatattgaaatttctactgtcatgcttccttgtcccattattacatcgtcgttgtgttcaactattgcactacctccctcctagttcgaatctaatatcatctatgtaaccgcaatgtaaatagttgtatcatgttcaaattgtactactatttcttcatgttacataattctccttgtttaagtccatataatgtttctacgacctagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaagtcttttggccgtacttttttcatctgggtcctttgccgccctcgggacccagatgaaaagtacggccgcaagctctgaatgggcggccaaaattgcaattagccccttgccgccctctcgcaattttggccgacggcggcagacggcgcggtcgacccaccgtctgccacgtcagcttgctgcccaccatttgggcggcaggggctatttctgcaatttttttggtcgatagattatttctgtaaatattaaaaaaaaaaatctaaaaacgaaaatggttcgacaaagaccccccgattcatggcggaggggcagtgaccgctgccgaccaccgcccgcgccgccgcgcagctgccgaccaccgtccaccggagttcgcccgccgcggcggcagccggaagaggcgtatccgctgagacagcaagggtgagtttctttctttctttcagagagatagatagagagagagagaggggaaataatcttagcgtccaagatcattgtgcgtcgaaaatcttccccgtctcgtctccgctccctgcggcctgcgccgatctcccatctcgcggagcaggtcgcgtcctcttcctgcgtcctggtgagcatccacatcatctttttctgattcatctcacacaccctcgaatttgcttgcttgcttgtgttaaccctagcttctcttctgtagatctggaagaagctcttaatttcagagccttaaccttaatacagttaacactttgtttgttccccccacaaaagtcccaagttggatcagcccatggcgatctgtatattcttttgatcctcttcgtctgattgtcgatggtagcatgcgttacatgtatactagccaagagcctgtgcgttgcaacggaaaaagaattgagtttctaacttattaaatcgattgagcacatatttagtctaataagtagtagttttattattttccttagtgaacaagtaggtgattttgaaattttgggagagccagcactgaaacggaaaaaaatcattggagagtaggggctaataaatgggacccatttgttaggtcggttgtggtggtgcaaagtatagattgtgagacccaaatattagtggtaagggtggtgtggcagaacgaccaccaccactactaaaattttaagtagtatacagatatatatcgcatttttccttgtaatattcatgcattccaaatgaggtctttaggtggatgcgtttggtaccttagtgtggtcaccaccgtgattcccttctaagctggtgtgttccttctagctggtgcctggtccaagctcgcattatctatcttgtatttatagcaattagttgcttacagtttatctccgttgtgaagtcaaatttaccttgggctaagttcaggcagcaaaatctcaaattaggatgcagcatgctatactgatattgattggttattgcacttgcacatctgagtaattgtccttaagatggcatgctcattgcttaacaaacttgagtgggctgttccctttgttggacagcgtgtccaagaatcccagtatcccatttagaatgagcaaatgtatttccacatgatcattttacacgtctttgctagtttgaaatttatagttattccaacccaccttgcgtggtagatgtgttagatgtgcattatttgaccagccatattgcatccctaacaccacattttcggaaatataaatattcctgaaacagttagcaaactgtaatagatggagctttttttagctgatggagtcattggcaatataacttcaattatgcgctatgtgggcaccttccttgtgtaggctttgatctatccgatctgccagagtaatggtacaaggacagtgtgctaccagaataggggcaagctgtcctaaaaggcagactaacttttaaatgggccttgtggggatcacaagatggttaagaggggatcaggggagttgtgatctaccgaaataattccctttctagataagggatttgggtcaacagttttatgtcagtgatgggatggatggtacagaaataatgggactatagggtttagttaatgagttgtaccctggcagatggaaatgcagaaaagccttgaatactgagggttattatgttattatgaaatgtctcagttcctttgcttcgtgcctttgcatggtacatggagtcatctatattcatctgtaactccaaatggaattccactaccaaagttccctatatattgccttacttttatgcttggtacttcctccagtaaaaaagtgacatatgcactaattttgttcttaaaagtacttcatagaattacgcttttgtaacctttcttcatatatgataactgcatattgtggtctagccatcaaagtagcttcttatatttaaggtaaaagagctctttattactagagggagtaattactatatccatcagtagccatcttttaaaatatgcccatgaatttgtttacacagaacttcatgatacctacctttgttagtaagctaactgctctttctctgcaggcctcttttgtaatctatttatgttttagtggattccaagcaaaatggctggtcaaccaagtggtgctgacaaagaagtcatcaacgagcaaatggttgcaaacatgtatgccaacatgcgctctgaaatgaatcaactctactccaagatcacagagctggaaatggaagtcagtgagcactccctcgtgatcggtgcaatcgagccacttgacccctcgaggcgctgctacagaatgattgggggagtgctggttgaacggactatcaaggaggtcttgcctgcagtgcaacgcaacaaggagggcctcgaggaagttgttgctcgcatgaacgaggcactggagaagaagaagaaggaaatcacggagtttgagctcaagtacaagatcagaatccggaaagcagatagtgacacccaggaagaaggcagcatgaaggaaggatctgcgcagggtgttcttgtaggccctgcctctgggcagtagaagtgataaaattacattgttccttataaactgaaatttctcccttttgagtccagttttatagggacacgcatgatccaatgttctgctgttatttttggcaaatctggttgaatttccatgttacgtgctatgtaccatacatctttgacactagactttatccaatggtattgttatctgaccagttccccagtcttttagcactgtagttctgcagttttgttctgtagtttatgtatgttagctagtctgtggatacaattatattgtgcgcaacatgcaattttgacctcggttgggtcttatggattggtcacattttcttatacgattgatctcacattaaatccaaacacagatggttttgaacattgaatccaagaaatgcctatcaggcgcccatttgaggatatcatgttctactgtggtggtcaaggtggatgtactaagtaatatccactttagttttgataatatcagtaacaatgggataatttgtttctcactggtaatgcgcattattttctctattgttgaagcttgttctaaagtaaattgaagtaattctggttttggttcttgagctctattttaaccatgaactcgaatatcatttgcttctccttgaacttactaaatcatctcactgttgacacccatttcctctctttcttcaggtcttgtgcgctgattgttttgagaatggttgggatttgagaagttacatttctttgagtctagtaatacagcccttaaccagttatcctggtgacataatttatgcacatgtattgttttcccaaaaaatctttgtagtgtaacgtagtaattcacaaagcagagtacaaaatatgcttgcacgagagttcagtttaaagaaggtagcaaaacaaatgtctacaaaactaaccagcccattcggtggcagtgagctatatctaccattgtgatatttgtggcgattatgccaactctacttttctcaaaagaccaaaattttcacaagcacatcatcatctgaagaagcagaaaaaaaaaagagagaagaaacccatttgagcacccccttccctggtgtgctactaaatgcaaagattcgcaatcagtccattcaacatgggacctcacaaggttaatgaacaaaaacttcacactcaaaacaaacacccaattacaaacttcccactgccagacaaaactcatcctggtctataaaagagaaacaataaagattaatcgaggagttgtgtgagcattagagcagtgcccacaaattaaatctttatgtgcatctatatttggtctagaaccatctttagaaactcaaaagagtcccatgagaacgcgaggtattcgggtgggaatgagaggtatttaggaaacaagtgagaagcacttgatgctttactggtcgactggagttttttgaatgacatgcacgcattgtagactgatgggtatagtgaacacaatatttgcatgcggatgtggttgttggagcttattgtctgaaaaatagagagtacaagtacgcttatacgagagttcttactcttaaaaattattatagaaacaatttttacaaaaagtagcagctcattatgtggcaatgagctgtatttcccatttcaaatttttgtgaatataacacacaagataacaacatgttttctgagcataagaagggaaggaaagccggaaaggtaacaggaagaagagtgaggtaattaagagaagggaacagaatgatcggaggccagtgctgctcatgatctcccgagttcgatccgcaggatcgcttggccttccagtgtaaatttgacacatccatcacctacactacatccaaagccaagagacatgtctctccaacacaaccacacaccaactcaacgccttcggttagtcacaagcaacacaagctcaaatcaaacttaaccgaaggcttcaaatcatcgcgttgttagacaaaaggtttctttttccttaaccttgtcatctcacaaaggcttccatcctaggttggagacaaaacatagccctagcatgagcgtcctcatagctagaaacaagataatgacatgaaccttcatgtaaaattcattgatcacctagatgagactaaccagtaaccaaatgtgtactgagttgtacaaacaaaccacagtgagaaacaagctcatagaacttttaacggaagaatatctgtttgaataatcttaattactacaatctctgttgggtccagaatcagtgaaacaacagcatgcgcctcagcactaaattatttcagcaagcacaccagattcgtccaaagaaagaagaacgaaactacattactgcaacatatatatccagcaacaacatcagcagagctatgactcccagctgtagaaacatccagtagttatttagaccttgctgtcggcttcgcctggatcactgggtaagaactaatcccaggcagcgccggtgctcatcttcattaatttgtttcatcttgttggcgataccgtagaggaaatgaagatgagtatactgtcctgctgtgcttgtgctgtctgcttctcttcaatttactgatttttgggtcactccgtcactgtccatgtcttcattttctagataaaatagaacagagaagtggaaaaggaaatgtgtataaaagtgcgcatcagaataagttagaaattgttcatttcgatgatcaagcataagcgataaagtgaacaatattaatgccggccattctgatggagaacttaccaattcgaaatgtttatttggaaactgatagttggatggttggggagtgtatcaacggcagatttaatggttattgcaacacatctgacgatgcaatcactcgtttcttccatcagatcatagttcaaacatttcaattcaaagtcatcgaagaaattggacgtgtgcttgaagcaattgcaattaatttcgacctcaaccttgcatagagcagagaggtgttggatgcctaagtcagaagcaccattcaggcattccaattcgtgcagacgaaaatcaagcttgaggtgctcaacctttggcattgatccttcttcaaactccagtgcagtcccacaggcaccgatagccaaggagaaatatttcaaacttatgaatctgttgtttccatggatgatgatccttccattggtgcctccgagagtttctagtttgagaaaaaccaagctgggtattgctccaaggatctcaatatcttctggtgccatacataagattcctagatgacggtcccgctgtgcttgcgctgtctgcttctcttcaattttctgattttggggtcactcagtcagaacatgcctttactttcttgttgatacgctagaacagaagtcaaaaaaagcaaggcacataaaagtgtgcatcagaataacatcgaaattgtttatttggatggtcaagcatatgcgatacagtgaacaatattaatgcctgcaattctgagggagaacttactgtttcaaaatgttcacattcctcgacatgatatgttttgaaactgatagtgggatggttggggagtgtctcaacagcagttttaatggttcttgctacacatctgacgatgcaatcactcttttgttccatcagatcatagttcaaaccattcaattcaatgacataagagggtttgcatataattttgacctcaaccttgccgagagcagagaggtgttggatgcctgagtcagaagaaccattcaggcattccaattcatgcagatgaaactgaagcttgaggtgctcaacctttggcattgatcctgcttcaaactccaatgcagtcccacaagcatgaataaccaaggagaaatatttcaaacttatgaatctgttgtttccatggatgatgatccttccattggtgcctccgtaagtttgtagctcgagaaaaagcaagctgggtattgctccaagtatctcaatatcatctggtgctatacacaggatacctagaactagtactccaatatttccaagcacacccatccaatttggcaccttggtgagtactagtttgattacaagcttacgaaggctacaaggagaagcaatgtgccatgaatccaacgtaagacaataattttcataagattggtccatgatgcacaaatcataaaggttgcataaagattgcaataatgttcccacacaactatggtaatcatcaagtgacaatggtgactgcagtgttaattttaatgtccttagcttggttagcttactgacttcctggagggccgtcacttgttcagactgagacactacaaattcttttagctcttccaggctcttcaattgtccaatagtcgtttcatctgaaaatctcgtgtcctgattgataaatagacgagctagtcgttgaaggtttgtgatagttgatggcaatatctccacattggtttgtcttatgtccagcgtttctaaatatttcagttctccaattttttctgggagataatccactccatatgaggagatacacatgtacttcagatgaaacaatttttcaatatttgcaaaaaggtcacccattctgtccctatatactaggtccaacacacgaagaaacttgaaatcaaatacagaagtttgcatgcgatttccaaatatagtaagtgatcgtacttgagacagatctaggcttgtcggtatgttgacatcttcttcattgctgttgatgactgacagcctccgaaccttatactctgtagtgcatccaggcactgtagatcctaatgaggtgacaaagttctcttcagtagccttgcatttgatgtagtcaagaatgatgtcatgaactcgacatgcctttgcctgaccatactttacatcaacaggttcaatcaggcttctattgatgagctcattaaaatacaactcaccagttctatatgcacttcgcccttgttcatcctgaatgaatccttcagcaatccatttactaaccaaacgtcgtttgtcaatattataatcttctggaaatacacttaggtacatgaagcaagtttttagatggtgagggagattgaagaaactcagcgataatatatttgacattgtctctgcataaggatcccttgcaagtccataaccaatatcattaagtaccctatgccattcatcaatagcatgctgatatgataacaagctagatatagtaatgattgccaatggtaggccaccacattttcctagtatcttatccagaacatcttccagatgaggataatgtgatttttcataaccaaatgctcttttcaaaaataaccatttggagtcatcgaaactaagaggcttcatctcataaatataaccatcttgagaagagcagcatgatgcgactgcaacgcttcgtgttgtcgtgattactctgctgccacagttactgtttaataatgcaagctcgatagttttccatgcttttgcatcccataaatcatcaatcacaacaaggtatctgtcacaatatatttacatatatttagtaattcgttcttgaaatccacgcagttgataataattgaaaatgttggcagaattaattacagttagctaagacgaaaatactaacaaatcaaatcattatgataagaacaggaaaattaaaaatgatgatttgagtgcgatggattggacagagagatggctcaagcataagataattactaatatttggacacaacgagtgtaagattaataattttatatactcaaatataatagtttggagacctagatagtagccaggattaatatatttatttaatacttcttggatggtaacaatcaccaaatagtaactaaggaaacagacaaagcagcttcccaccttcattggttgtaacgatacacacatgccatattattgctacaatgaaacaatgtacttccttccagcttgtggattgttgcaatctgcaagcttactttttacaatctactagaaaagaaaaggtgcccgtgctttgcaacgggtagagccaatttaatttgtacatatatgtcagtgcataaataatcacataccatcgttttgtttattcatgtgcttatccaaatcacttattaccaaacaaaagactatttgtatgcaaatcttttatatacatattcttagcgattcagaagtaaatgatgtaaaataaagtacgataaaaaaccaaaaagtcgagtttaaaattaagttctaaaatttaaagtttcgcttacaggaaagcataagccaaataatgaggccttcaaacatgagctcgatttgttgtctagctttatcttaagtcaggcaagaattgatgacggacggattcagcaatttcgatcattctttatttcatttggcatgttctttttgaaagtaaaactgattcttatgaattattgtaacgttatccctggtagtacgtacgagcatgtgtggagactgacttgaaatcgtgctaacatgtcccaagaatcgtatcgtgtaatacgaatagaatcggatgatctgagcaacgatgtacgtgatatccacatagactctgcgagtttcattcgcttggtattcatatcacatatactgtctttcgcaattcgctcgagagtcaacaattgttacgcgtgacaggaatcggatacggataatgtaccatagttttgaaaaaaaacatcttcaatttttaaatcacgggcgaggacgacgcaatctcaatcggacacgcggcaagggaaaattgtgcgcatgatggcttcacgggcccaattgggcatgcgaaaaattgcacgtgcgagggcattgcgggcccaatcgaggcggcgcgcaaaggcgcgtgtggaatacagactcaagcgtgggcccgatcgctgcttgtggcaagagacgcgtgaaaaggtgcaagcccaattaattcgcgcacgtctctgataagagggacactctggcataagaaaaaaaggaaaggatttaactgaaacataaaattaaaaccgattcaaacacggatgatgcaccaaaattatggcagaaacatcttcagtttttataatagtagagataagctgaaacaaacaagacttaatataatttcattatggtttgcaaataatatatagtaacatatataatagttaaagctagattttacatcatttcaaattgcaaaacatcgtttattttcaactggagggaatatcctatatataggaaaattgttaatgtttacacaattatggctgtgttcttcccctacctttcccaactcacctccctcgtccgcgcacacgctttttaaactgctaaacggtgcatttttttgcaaaaggtttctatacaaaagttgctttaaaaaaatcatattaatctatttttcaaaaaaaaatgtgtcgctccgttttgcgtgcgcgggaggtgagttcccaacctcacctcccacatagcctaagatatatacatctcatttgtataaagaagtttttgtaatttcattccaaggttaccggacttttctatagggcattcccacgcatgcatatatattaacagtcccatcactactgtaccggctcatatgtgccaatttatttaaaaccagcacctattgaccatttttcaccttaggggggattacccgcgcaagaagcaggtgctgccgtgctgagctgctagatcaggctgtggacgacgacgttaactcgagaagtagcagaacgctggctaatctcaattctcacgacgattaatcgtgcggagagagggaaggaggagataaaaaaagagaggattcttgcctgagtaaagaggccagtcctgcagctcctcctccacctggccgaggccgaccaactgctgctactgctgctgctgctgctgaggcgccgatcgatcgaggccggatcgaggcagcatacgatcgagcgcctatggcctatggggtcggggctgacttccgtcgtttttgttgtgcggtctcaggaggagttgttgttgttgctgctgttgttttctcaagttggaatgggtctcagagaaaagttgcatcttagtagttggttttacgcgtaaaacccggcttccaaaagtgggaaatttaactatttgccactcttgtgacatggcaattaacgatttgccacaccgtgtctatgatatgtgggccctcatgtgtctatgacatgtgggccttgtggcaaatcgttaagcaccatttgtaagagtggcaaatagttaaaagcccctccaaaagttgcacctttatgtgtctatgaatgaatccttcagcaatccatttgctaaccaaatgccgtttcttaatcttacgatcttctggaaatacactcaggtacatgaagcaagtttttagatagtgagggagattgaagaaactcagtgataatatatttgacattgtctctgcattaggatcatttgcaagtccacaaccaatagtattaagtaccctatgccattcatcaatttcatgctgatctaataacaagctagatatagtaatgattgccaatggtaggccaccatattttcgtaatatcttatccaaaatattttctggatgaggataatgtgaattttcataatcaaatgttcttttcaaaaataaccatttggattcattgaaactaagaggcttcatctcataaatataaccaacttgagaagaacaacatgatgcaactgtaacgcttcgtgttgtagtgattattctgctgccacaattattgtttaataatgcaagctcgataattttccatgctttcgcatcccataaatcatcaatcacaacaaagtatctgtcacaagatttttacatagatttagtaatttgttcttgaaggccatgaagttgataataattgaaaatgttggcaatattaactgtggttagcgaagaaaatgctaacaaatcagatcattatgacaagaactggagaattgaaatggaagagtttgagtgtgatggattatatagagagatggctcaagcaaaagatgatcaccaatatttggacaatgtctgcaagattaataaatttgtagactcaaatataatagttcagagacctagatggtaaccaggattaatatatttatttaatacttcttggatcgccacaatcactaaatagtaaccgagcaaacaaacaaattaaagaagcttcccaccttcattgtaacaagagtaaatttcagagaatcgcatatttagtcactgaattatcagattgttacaacattagtgacatatttcagtttgttgcaatgataatggagaaaattgtcacaaaaccgcaagttcacgcagaccccaatgttacttacacattgggcccacatgtcatagaggtggtagacggcgaggaacaagttagcacatgcattgtagcggcattctgtgttggcagctgctaagcccaccactgtgccctagctgtactgtagagatatggtccgattgaaacacccctcatactttgtcattgcacttgagtcaacactcatcaagcttcaaaagagctaagggcaacacgagagggtcgttttccctaacctagaattggttttgattcgtgcattggctgagcggtattccagccaaatcagatcaccacagtgtatggctggaccaaagtagtgggctgagggctgacgtggagtacgtgctaatgtttcatgcaagagtaaatttcagataactgcaagctattttatacaatctataagatgaaacaaacatgacctaatgtaatttcactatgatttaagaacgatagtaacagatatagtagtcaaagctagatcttaaaccatttcgaaacctaaaaaacaccattaatttgtttgcgaatatcctatagataagaaaattgttaatgtttacctaattaagatatacacatctcatttgcatcaagaaatagtatttgtaatttcattccacagttaccaaatctttttattgggtattaagtcgcatgcattcatatatattatcattgataatataactaggcttaccttttattcttgagatgctctcggagtatattaatgagtttcttttcatcattaccaaccggagtacgagaagagatccctactccttcagcaatatcgtttagaatcttctttatatcaggcctttgtgaaactgacacaaaagctgcacaagaaaattggcttcgaattgtgtcataaacttggtttgtaagagtagtcttaccaagacctccacaaccaacaatagagaccacttttagagaccctttcatctccatagctagcagctcaatgatacgcttcttaggaccatcaatgcccacaagtttatcaacctcctcatagaacgccgacagcctaggatcaatgccaaaagtgctagagttgtgtgctaattggtcaaaattatacctcttgtgcctttcgcttgcctcgatcgcacggatcttgagctcttcgatctcattggcaatctcatggcgcgccttcagtttcttcaacttacggaagaatttcctgaagcccatcttttccccatcatggtcaacacgagacataaaatcatcgatgcaatcttccaggtcataggccagctcgcgtagcttgtccctccaatccctcatttctgggttgagctgctggtccgaatccgcgagcatctcgagtgcagcactcatggtgctcaactcatctatcaagaacttgatctgcttgcgcacgcctttgagcttggcatactcttcgcccagcagcttggtgagcttggacaggaggggcttcatcacccccgtggtagcacccacaatagctgttgttgcaaccatttttgctcatctgctgatgatctccctggagtgaggtggtgctgtgggagtggtacaggtttcagattgtgtatatggcacagccaatggcgcctgtttttcaaggaagaagagtgtcttgccgccagcagtgggttaattgttttctgacctctagatccgcgcaaaataaagaattgttaaattaagctaattagctttggtaaagaatattgcacacgcattggacgctgccatgaaaacctatgttactactcctacaagaggctcgtgacgacccagtaattaataatgtgactctgcacatcctgattaaaattattaattaattctatcaagctttgtcggcaggctctagttaccacgcgaagaaacatgagcatgtgatgcgcacagtttgtattatagggcctgctttggagattacctatttcttttcactggtaaaaatctttccacctgtaatttgacggtcactaaaacctacaatcatgtgttttatacttttattaccccttaaaatagtactgtatttgggtatagtaatcaatactaccgtatgatccactgcatcaatgaaaataggtgcaggtgccgtcacaagtaccggccaggttgtagacgacgacatagctagagacgtactgtagcagaaacgctggctggagcgaaggaaatcaggctagatttatagccaactgtaacacggattctaatacgttgtgtgtatgagatgtgggactatatattaatgcttaaaaataactattatatgaatgagctattagattgaccaaagataatttagagctagcagttggttataatattaagcttgctctaaccgtgcagagaagggggagataaaaagagattaatcttggctgaggaggaggtgagagagaggttacgcaggccgcagctcctccacctggccgaccaaccgctgatgcggaggcgccgaccgatcgaggtggttggacgcgaggtggaagtcggggatcaaggcagcagctaggaaccaccatactcccctccatacacatgcattatcagcatatacagtactccctccttataaaatctgacacccatttcattctttggtttttttaaaattctaaatcctatttatagttattgtgtgctaaattaaattgttgatcggaaataaaaagttattctaatacttattggttgtatattcattgattttgccacatggtattggtaattaagttaattgctttttggtattgattgaaaaataaataggtcttagattttgataaggagggagtatatgatttgtgtatcgataccaatacaccctcacaagcgatttgaattaatatcgattaacatgcaacaccgtttcttgtgtcatgcacatgcatcaaggataatttgagcctatgatattgcttgcatgcatgcatggatgacaatctatctatctatctatctatctatctatctatctatcatctatttatctatctatctatctttatatactaaaagtccattaaacttcctacaaacgctctcaagttgccacgtggcgctctaataaattagagaaaatcctagaaattctaagaaaaaagcaaaacatctacccttgattttcacttaaattagtgggtccaatattatacaccgttagataaaattgatcttaaaacaaaccaaataatatgggtcccacctctcctttttctcccgcgtgcataggtataggtcacgtacgtacatgcatgtggacctgttgttcgtacgcctccctccatttttttcctttttttcttcttttttccatttatacaatctgatatatatttgtttaaataataataatttagaaaaaaagaaaataccatcatataactctttataaacacaggtaactaaattagctatgcagactttgaaaataaaatttacaccatattatatgttaattagctctaaaatcaataatgtaagataatttactaaatactattattttcatataatgcactattttaaaataaagcttacacaatattatattgtgtacctatcaaataaacaatttaagatctatattaactaatatatacatgtacttaaacagatagacccattatttaaatcatcggatctattttttattactttggattattattctcaaataattcagtgttttaaaataaaatctacaccatcaccataatgttgtgtacccattaaattaacaatttaatatatatatatatatatatacatatatattaactaagttacatttacactaaaaccggtggacccattatttaaatcatcggatctattgttaataatgtctaaagttctctttttggcccactccacaatgcacatctgcacctttgcctttcgcacatgtgacagagtgtcgtgtttgaggcatcttgggtgatcacgaccgctgcagcgctaccgttgttgttaatagcatgaaaataaaattaaagatgtgatgtagcgagagaagaattaagtaccgtggaacacttaactctgtttaagctgaaatcgagagttgattaaataataattataatgtattgtgttatgttgtatttgcattttgtattatttgttcgtacagttgaaagaaatcattatgttataattgtgagcacaatattaacgaatatcaacagaactcttactaggataagagtgttacaagggagtttaaggccctattttttccctgattccatcttttgaattttcgtttgcacgctccacgctttccaagttactaaatggtgcttttcttaaacaactttttaacttttcagaagtcaattcattcgtttataatctcaaatagctatcacataaatcagataattcatcaatttcagttgtcctatcccctaaagtacatatttttttcatgcgagtcatggtgataagtaaattggtgatcaacgcataatcaaagtcgtaagataaatctgttagaacaactatgaccaattgtaaataggtgtcaaaattaattgctattaattaaacaactaatggcttgctagcaacatatttaatttttctctacatgtatataaacatggacgaagctaaaacgaatatgaacatacatcccatacatatatatattacatcttaatattctaattacatgtggtaagtccactaaaatttcttaaaatgccctcaagatgtcacgtggtgctctaataaattagagaaaatattagaaattctaagaaaaaaagcaaagtatctactacttgattttcacttgaatcgatgggtccaatattataaaccattagattaaattgatcttagaacaaactaaatactacgaggtcccacctctccacctttggtacgcacctatgtacgtgggtacctacgcttccccaccctttttttttatttttccctttcttctttttctccatgaatatgcttccctccctttcttactatatcatgcaccttcacgagacgatttaatctatttacttaagaaaaaaatatgattcaaaagtcgtaagtacttaatccatctcccactcaaaagcttgcgaatggacttttaagataccttaacaaaaaaaatagaacccttaaattattacaaaataacagtatccgaactttagtttgcccttaatctatgtgataatttttttaacaaacaataaaaatctaacctttcaataatatatgtgcccgcgcatacgcgcgggccaccttcctagttagagagtaaaactgataaagaatgtgtattacatatagttgagtaaatttcacaaaactacatgtattttgatttaaggtgttgtatcataaaactacaaatttagcaccatatttatcacaaaactatagatttaaagttaagtatcataaaactgcatatttaatattgaagttatcatagaactacaactttaatatcaaagttatcacaaaactatagcttttagagttcaaatccctagtaccattattatgatggagctctaaacattcatgttttgtgactaaattgcagagaacttgtgctcggatatggttttgtgtttgattcatgtgtaggtgagtcttgatgccttggaagagcattgctggagatggatcgggagtcaacttgggatatgatgacgtccggacgatcgggatatcttgtgggatacttaggctagagatcaatgcacgtgattgatgaatatttcatatggcaaacgacagagatattgtgtgcatatgggatgaggagtttaaatttggagggagtccaaatttggtacaattggaatttgttaagtttgtttcttatttgggaatgtttttctaggggattagaacttcttgtataaggttggtttgtgccttttgtgcttaccttgggtataaatagagagggagggtgacgccttctgatatcgatttttagatagttgagttgtgagaaaagttagggtttcgagtttagtcgagatttttgtcaggaatgttgttgttgtactttataaacacgaatagaagtaatgaagtttcaatctactttgagagatcttgcatgggagtggtggtccaaccgatgggacactggcggtcagaacgacgacatcggcgcagtcagacctacaacactacggcggtcagaccggcggcgacgactagcgacttcgacgcatcgggtggttaggccggagcaattataccggtcagatcgaaggtcttcgagcggtcaaaccgacgcatatactccggtcagatcgatctatatcaaattcgagagtaacttttaattccgataaaagttatggtttttgggttctacaaccattcaccccttctggttggcttaattcttgttgttagatcctacacgggagagatcgagagaaggctatgtgtggctatgggacagggaagaaagagatatgggagttgagaaagaaataagactgagtctgcgagtgctatgaatgtgtcactctgtagctaactaaaccagcattatcaccaccaaaataaaataatattgaattaatcaagcctgggactacacagatatattgctaggaacacttgcatgtacacgtagacatgtatatatgtgtgtccatccccttcacgaaattaagctaatcaaactagctttcagaattaaatcgacacttatgatattactattagttttttattaaactggtattatggtggtcatcaatgccaattcttatttaagtgtgcgggtgagagaagagcagaaagttgtcatatggattacatcatggcgtaccttgcaccgaaaggtagcctttgggtaaagcagctggtaggaggcgaagccagtaaagcaagcatcgcttaatattgtaatgtttattttcccattgcaacacacggccaggtcttttttctagttttatgattaaagttacagaaaactatagttattatggcttatggtatttaaccataggttttatggtctaactattttataaaaccacacgtattcaaatattgattaattgcaacatgtttgaaacatttttttttcaaagtagtgaagagttaaactatcaaccttatcaagaacttaataattaaaaatttcatatacactctaagatttagaatcttaagtaaattcctgctcaacatacatagatgtggggttttatgaaactttaaaaccataatatccgaggttatgtatcaccggttataataccttcttcctttgtcgcacaaaaaacacacctaaagcaaaatgtgacatattttagtactacttattctagtagtatctggacagagagttgtccagattcgtagtagtagaatgagttacatcatatcatatatttatttttttggtacatggagtagggttttatgtaactttaagataaaacatagatgctctgttaaaaaagggaataaacctttaataggaagttagatttttgcatgggaatttttctaaaaatattctatgaaaactttcagtagaaactaaaagattttaaatgttagattttgttagaaaaaaattcaaaaaattatgtaaagattgaaataggaaataaccaactaaaactccgcggtatctcaagctccgtaatggagcagctgcacgctgaaggacagcacagtgtccatcggagttgaacaagatggcagctacacgcctacacatctatgtttcacgattttgcagttggaattagcacctccatcggaggaggcagttggaggggcagatgatcaaggccttgttcgaggcagtcctgatggtcctcttcgccggcggtattgattggaattttgtagcctaaggcacgcaatgctacacgtgcgggcgacaacaaggagctggtactggaggaggtgacatcgttgagctggtaacgagggtatcgggtctggtaccgatgtccgataggtacaagatcggatactgatgggtatcagccgatatcgatgggtatcagatctgatgcatagtaagataccagctatatcgactaatctgcgttcagcagcaggtgaaagagagaagatttctcttgttctccgcgtgcacgcttcccgaactaataaacggtgtgttttttttaaaaaaaaaaattctataggtaagttgctttaaaaaaaagcatattaatccatttttaaaatttaaaataaataatactcaaataatcatgcgctaatgattcacctccttctttttacgcatattctcaatcttctcttttcctattctctcaaacactcggatattagaaaaatctggcaattaattgatagaccctcaacttcacaatggacccaccaaactttccactgtctaactattcgtcagggtctaaaaaaggaagcaaaaaacatggctgaggaggtagcaaagattaattaatcgagaagttgtgcaagcatccacatatacaaatatcaaattgttatctgcatctatatatagttggtggagacgccagaattatctaaagaaaatcagaatgccttgaaaaaaaaa

SEQ ID NO: 23255 - DNA, 2627 bp, Oryza sativa
atgttttctgaacagtacaactcagtttttttgcaactctgttgttattcaagaatttcgaggatatggatccacttgtgatgcgagttcaagcgaccaatgtagaatattctcaaaaatgttgagaatatgacaatgtagaattccaagcgaccaattaaccaatctcctgactatcgtaacagagacaattgagctcccaaactagtcaaatggtaaaaccatttggtggcaatgacctaaatttcccatttttgatttttctgaaggtcattccacaatttttttttcaaaataacagaaatttcacaagagtcatcatccaaagaagcaaaaagagcgagggtttctaatttcagaacagatgtgcataattgcagaaaattgacattcaatcaattcaacataggatttaagtacttaataagatatattacagaacaataacatcgcattaacaatacacacgcaccaaacttttcactacgcggaagcaagaaagatcaaacgacgcggatggaacgaagattactcgagaggttttacatgcataagactgctcttagattaaatttctgagtgtagcacatgtagttgcagcagatgccagaattatcttgagtaagttagagtgccactaaaatgagaggtattcgggtgagattgagaggcctttaggaaatactccctcattccctaaatgtttgacaccgttgacttttttaaacatgtttgaccgttcattttattaaaaaccttttgtaatatgtgcaaaactatatgtatacataaaagtatatttaacaataaatcaaatgatagaaaaagaattaacaattacttaaattttttgaataagacgaacggtcaaacatttttaaaaaagccaacggcgtcaaacattttaggatggaggtagtaagtgagaagcactaggtgcatcccaaatacagaggttctcggatgagaatcagaagcactagtagtcactcgatatggcaacaaagtgtcactagaacggataccatcatctcaatcggaccgtaagccccatctcaatcgggcatggcgtccgtcacaggttagaagtcacagctgtgaagagttatctcaatcgggcaaacggccgtcacggatgaatctatcttaatcgtgccctaattaaagcccgtcaccgatagctttgacccagacgactaatcaaactatagcccgtcacagatgacctatctcaatcgggccacaactagcgttcgtcacagatgacccttatctgtgacgggtattaactatagctcgtcacagatgactctcatctcaatcaggcataagttaatgcccgtcacagatgagtataataaaaaaaaaataaatttcattttttggctagccatgccatgccatcccgcctctcccatgccaatcttttttatcctcactcatgtgcacccgagaagaactttccggtgggtgacttttttatccccactcatgtgcacccgggatgaacttttcggttggtcacccatcccgaaattgctccagggctaacacgcttaacatcaaagttctttggagatcggcttccgaaaaaatagttgtaaattcttggtatgagtattctattaatcctattaagccctaggctaggatgtcacaccccaacatcccccattcatatacattcattcatatacacaaccatcaatatatttaacacaaccacattcacataacatccattttgatcatatatttcatatccattcacatatttcacatattatattagcaaaaccgagttaattggatcaaatattatatttagcaagtattattatgaagaggaagcaaatcagacttctagaaaaaatgaattttgaattgaattttataatactaaaaaaactcaaatgaaaaagctgtcaaaaataaagttgtagaactcattgagatctgtcaaaaataaagcccgtcacagatgagaacattaaatttaattttaggccgattgttgtgtgtcaaatgcaaaaatcataaacaacaaaattgtataactcatcgagatctaaaactattgtatcggttctgtacaaataaattcatttgaaagattcaaattttgaattttcaaaatttgacaacttcgaacaaaaattggggttattaaatgatttcaaatcgaaaagtcaccaaaaccaaagttgtagaactcattgaggtgcaaaatttttattttggtcatttctccatctgactctatttaaataatttgaaatttaaaattcaaagtttgaaaaattcaaatagaattttagatcaatgaacgacttcaactgaaaaagtcatcagcaacaaagtcatcagcaacaaagttgtataactcatcaagatctataacttttattttggtcatttttctatataatattttttgaaccatttgaatttgaatttgaaaatatgacaacttcaaacaacatttaaaaatactaaatgatatgaactgaaaaagtcatcaacaataaagttgaataactcatcaagatctaaaacttttattttgatcatttcttcatacgacaaagtgatagtaacattgttcacaaaattgacatatctcttat

SEQ ID NO: 23256 - DNA, 12768 bp, Oryza sativa
tacgattgcgtgaacaaaaaagtattaattaatttatattgaggtatccatattgatgtaaacctaagttttacgatggaccaaacttacacgcacatttcgctaacaaaggcccgttagttttcaatgatgaaaatgtagttagggcacggagtacaacaaaaccattagtactgattaattaagtttttagtattataaacttgaaaaagaatcaatttaatattttaaggcaactttaatataagaaaggtttagcacgaaacatactgattagcagtttaaaaagtgtgctaacaaaaatcaaggtggaatatcttactctgtatttcaaatcatctcagttctttgttcacaatacctctaccgtccattaacacgatataccccgcttgacctccaacatttaattctagcataaacatttaacatatgtatctttatgctcagttataaactagattagtgcttcaccatatgagcttgggatgggagatgaggtttgatggtgattggtaaagaatgtagcacatgggagtttctgcacgtacgatgagaccaaactgcgtggcaaaccaatgtcatatggatagggtgcagtgcaagtgatcggctgagtctgaagccaatgtggtggaccaaacggggagccctagataatcgggttttgaattttgagatatcaatattgagaaaacaccattttaacttaattttggccaaatacgccacaccaaatgtttagacagggcattaaatggaaaaaaaaatccaattgcacagtttgcatgtaaattgcgaggcgaatcttttaagtctaattgcgccatgatttgacaagcaatgctacagtaaatatttgctaatgacggattaattaggtttaataaattcatctcgcagtttataagtggaatctgtaatttattttgttattagtctacatttaatacttcaaatgtgtatccgtatacttcgaaaaatttacacccaagaaactaaacacacccttaacataaaaactaaacaccaactgaaaaacttttagaaagataaatagctaggtaacttggttttcaaggataaatatccatctttatatactatagtccgaaggaaatcatcctttattgccactgtgtcccgcttaatgtttcttttagaagagctttagttggtcagaatattgtatactggcatgaattgtgtgtttccattgtacatatttatttgaatcttttttctgactgttttagatggaattatcatcagaatggtatgttctcagtaagatcaatgtatctagctttaattaacaatgcttatgatgagagaaacaagtatatttggaaacttaagatgccgcttaagattaagatttttatgtggtacttgcttaagggggttatgttatccaaggataatttggcaagacggaattggaatggtagcttaaggtgttgcttttgtatgaaaaataagtctattcaaaatctcttcatggattgtcattatgcaaagtttatatagagagcagttcagttttcttttagttttaaccttccaactagtatatctcatattttttatgggtggcttttgggggttgacaaaaaaaaaaggagtaaactgatacttgttagagcttctgtcatttgttgggttctatggttgagtagaaatgatttggtttttgacaaatcaccatctattttatatatgcaggtaattttcagggcaacacactggctcctgttatgggcacagctacaaagatgtgaggatgatggggagttcctaaatgttgcatgccgtaagttggagtcgatggttatgtaactatttgccaattatggatagagattcacaaatagacttcaataataaatgtgttcttcttattttggcctggtttccaatgttttttattggtgtgttctttttatttgaattacactcttttttggagtactactttataataattagctgtaactcattttagcatagggtgggatgttaaattccattatctaacaaaaaaaaactgaaaaacttttgaggccaaaaaaaatatcagttgcccttttatcgatgtttttgcaccatttgcactttaaaaagagtgagcatagctgcattgctatggccatcttctcacctaaaactttggctcccatgtccaagattggggagtgcattgacttggctgctgcctccttcctccccctcccccgcaaacaccaacctaccatgtcccttctcccctctcctctctgagctcagctgcatccatccatccaaactactcacagatgccactcttcctcaaccaccctcccatttaatgccctccacctcctcctcaagcccaggattcgggaacctgctagccatttttgctccaggacagtacagccagatgctgctgctgcagctgctgggttgctgcggtggtcaggtcaccccggttcttgattcttgacgaaggatggcaatggcgacccctacgaccaacggcagcttccttcttggatcaggtggctatcccggtgcccagattctaagcttctcctcctcaggtcacagcggcaatggtagagaaatcaatccatgttcttcagcattgctcatatattttttcttcttcttatcgttcaaaatgatgttctttttttttatgttatggattttttttcatgctgttgggtggtgaggggactgttgcatctgttgggggggggggggggggggtgttgcattggtggtgtggtggtcaccttgatggcagattcagttagtttattggttgcttgaccctcccaatggcatcgtggcaagaaaaaaaaggataactggttttaaggtcttgtcaagtgcaaaaggaggagctgtttgcttccccaacttttgcttttctgcatttggcactgcagagatgtgccccttgtcaccaaagatgcagagtcttttaaatcctttggagatggctctcactctttttacacttccatcttcaagtgagagaggtcaggaaagaggagagagctagttcagtagcaaccatgagtgaagctaggagcactagagtagtgtccctgaactcaggaacctagatgctgtttcttcctcaaatcttgcatgctacacagccttacaggcaatgctgttttgcacttttcatcactcatatcatctcatttttcatttgctttgtggtcttgacattgcatttttttgttgtacatcgatccattttttgcagggttggattgtggaagctcagatgtggcaagaatgcagggggttttagcaagggttagggggccattcacaccaacacaatggatggagctggagcaccaggctctgatctacaagcacattgtggcgaatgcgccggtaccggccggcttgctcctccccatcaggagaagcctccatccaccagtgttcccacacttctcctctggtggcattcttggctccagctcctgtaagctattgtgccattagttttggtttgtcccaatgtgatacctatttttaaaatcctggataaagcaatgatacattgggattctgttatggttagtattttggttttgtcttttgagggaaaggtgtgggtttgttaactatgattagcttattggggattgctattagtttattcagggatcctttttgtatcctgcaaaggctttggagtttggatcttaaaaacgacactcacattattagagatttaaatatttagtagagaacatgtgacacttgagcatactttgctaaacactgatggattagtgttagagatatactccctccgtttcgaaatgtttgacaccgttgactttttagcacatgtttgaccgttcgtcttattcaaaaacttttgtgagatatgtaaaattatatgcctacataaaaatatatttaacaatgaatcaaatgataagaaaataattaataattacttaaattttttgaataagacgaatggtcaaacatgtttaaaaaagttaacagcgtcaaacatttcgaaacggagggagtatatctttataggtctgcacatccaaatattaaatcatggttctttcattttacagtgggatgggggtcatttcagctgggctattctgggagtgctgactccgagcccgggagatgccgtcgaaccgatggcaagaaatggcggtgctcgagagacgcagttgtcgaccaaaagtactgcgagcggcacataaaccggggtcgccaccgttcaagaaagcatgtggaaggccaatctagccatgccgcaaaagcaacggttcccgccatagcacaaccacccattggtgcatctaatggcaaattgtcaggcagccatggtgtgtcaaatgagctcacgaaaaccttggctactaacaggtgaggttatctgatcttacatggtttaatcattatgtcctatttggtaatgagataatttcttatgtcttgatacccaatactagctggtgctgctgcagtattgtgactgctgcccaatagactcttacctaatttgatttcattgcactacagtactacacaacagttatttgactcaaaactcttaacctgaaggacagtttttcatcatgtctctagtcttttgtatccagtgagtgagtgaatgcattagggtgggagggagggacttttacttcacaaatttgctcaaacgattttcatttacaagaaatacatatctgagagaacatttttagttaaattaccgtaatttgattgcagacattccagggtgacatgttatattcacaggagggaatacaatgtatcttaggaagtgcgacattatagtgataccagtaatctttttagtggatgtctcataagtatgtttttacttgacactgtttttaccttgtttactggaaattatctaattatttgagtggaacaatgtaggctttgtttttgctacatcgtattatatcatagtagtgtcaaaatgcatctgacaagaaaaaacattctgcaagttttgacataatttgactggttaccttttttttttttacaaaatatgagttagttattttttatgctggtagttgccttaacttttgttgattatctagatttattaatgtaatctgtcttctaacacagatattttttttatttttgtaggatgatgttggataaagcaaatcttattgaacgctcccaggactacactaatcagcaacacaacatcctacagaacaacacaaaaggtgataattggtctgaagagatgtcctcacaagcagactatgcagtaatccctgctggctctctcatgaacacaccgcaatcggcgaatttaaatccaattccccagcaacaacgctgtaagcagtcactctttggcaaagggatacagcatgatgacattcagctgtcgatatccattcccgtggataactccgacttacccactaactacaacaaggctcaaatggaccatgtagtaggcggttcatcgaatggcggaaacaacacgcgagcaagttggataccgggctcctgggaagcgtccataggtggacctctgggtgagttcttcaccaacaccagcagcgcatcagacgacaaaggcaaaagccgccacccgccatctttgaacctcttagctgatggacatactacaagtccacagctgcaatcgcccaccggagtcctgcagatgactagcttcagttcagtgcccagcagcactgttagtagtcctgcaggcagcctctgcaatggcttgctcacttcaggcctggtgaatgcccagactgtccaaacactgtgaaaccgccggtctgatcatcagggaacagccatgaggctatctactgatgtttttgtccccagagcacaccctgtatgatttcctagctcatgtattatttttctttaatctttatcacttcatgctttgagttccctccgtttttaagcgagcggtaatgtggtattgtactatctcagtttcttgtggaatttgttctatgttgctgactgaattgtcataatttttgtcatggctgcttaacctggtctcattctgttgtctgaaacaagatctgaaattccgaatctaccagtgacttttctgaaatcccggatctaggtaaaagatgattatacatatttgcccttaactgcacaaataaatcatcaaagtaaattacaattttaaccttccaccttcccagtgcattggattataggcgatcaacggccataatcaatttcaaccagagaacaagcaatcttgaaacagactaaggccgtgtttagatttaaacttttttcttcaaactttcaacttttccgtcacatcaaatgtttggacacatgcatagagcattaaatgtagatgaaaaaaaaaacaatttcatagtttgcatgtaaatcgcgaaacgaatcttttgagcctaattataccatgatttgataatgtagtgctacagtaaacatttactaatgataaattaattaggcttaatagattcgtctcgcagtttacagacggaatctgtaatttgttttacaggcggaatttgtaatttgttttattagtctacgtttaatacttcaaatgtgtgtccgtatacttcaaaaaaaaaatttggcacacgaactaaacacagcctaacctattggatttacagcaacatggtaactttgctcatagttcttgatttgttttctccctttagacttcactactactgctcagctttagttcactgcagatcaacagttaacctgacgagagcgtatgagcgaaagcttatgccttgctcatcgtcgctcctcagaactggcactgaaatcatgctactctggtgacaactcctgcaatttctgttgaatgaatgaattgaatgaaacaaacctttcctgaagttctgagcaagggaataggaactaaaagcatctttccagttatctgcaggcaccagtgtgtgagtactagtgttctttccaagcattttccagctgtgtgctcattgagatactccatgcaagacttgaccctctccagaattcagagaaagctacaactacaagtgagtactctgtctactatcatcatttctctctttagctagcactgttctcaaagcaatggttttttccttcctcttgctaatcatctacttcctccgtcataatatataacaacttaagattggatttgacatatcctagtactacgaatctagacatgtatctgtccagattcgtagtcctagaatatgtaaaattcggtcatcggttactatataatgggatggagggagtacttcctgatagtgtgatattaccatggcatgcaacacaagcttgggagaaatggataatgattggtttttgccaatgtgccatagcccagaggacaggagctagtggacttcactgtggcagttgctgcaagctgctactgctgctgctgctagcttgcaggcagtgaggaggagcctttgaacagctgtggccatgatgttctgcagtccacagggtaatagagaagcaaaagatatatactgcatgatgcaggagtatgaaatagtataaatgaagtattccgtccggtttttaatatataataatatcgttggcttttgaatatacgatgaaatccttcattttttttaatgattttgaacatgagattaaacctcattgtttcaatttcctttgaaactccaatgcactatctctttcggctccaccatttaggcttcagcttataagcataagaaaaaaataatttaaaacttaattttagagttgcttcttggggaattttttatcatggtttatttttcattatttgcttttaaataactatgaacacatatatataaagtttcactcataaattattttttaattgttaataagatatttcacatataataagtataagcgaaacgatggcatttttctctctctcaactatagtctaatagagtacctttacggcggtggttatgctattggtattatcactgctacaactaatcttaatcattgttaatttgatgagttctactaccagtagaaataaatcgtctctcctctcaactatatcctaatagagcgtctttacaatggtttctgatggtaatattctgcaatcggtattatcactagtagaactaaccttaatcattgattgatcagttctactaccagtataaataattattttactacaaatagttaagatagtactccctccatctacttttgatagtcatatttcaaaatctgaaaattttatttttgaacctattaatgattttctcgaatttaatgcgtgagtctccattcttccatacataattggctgcatgggcattgagaaatgtaaaatattaattaatcgcttatttacgaggaatgactagtggcatgtttaaatggatgataagtagaattacttatccttggtctgtatgttaagatgaaatatgactatcaaaagtagatggagagagtagtataaatagatacggtgcattattagattagcaaaagatgaatagtctagactgatttctactaccagcagatactattgtaaaacatctcattctaataatattttttcctctaaaattcatgtgcgttttctatggaaatggttgattggactaattcctgttttttagttatgcatatgtcatgacatcccattcctgcatttttccctcgttcaaaagtagcccaaaaatgttattcttttattacataaaaaactcaagggtgtatgcgctagtccactgttttataactgtaacatagtttatttgtactcctaattatgaaaacaatttagggtacttcaaaacacatgattgaaaagataaaggaatatgaattaaaatcacatgattttaagaaatgtaaatacaaaacaaagaatttcaaaacacaaaaaaatgtaggaatggcaatttcaattaaatagactgtcggaaaacatacgaattgtacgagagagataggctgaaaggaaattttccaagagtttagagctattactaacttatatctaaaatccgtccattaaaaattcaatggaattttaaagaaaaggatatgattaaatcattttgtttaaaaggctttcctcggaaggcctcattcatccatctcactgggaagttggggtaaaaaaaattattcctaaatataacactgtaataactaatagagtaaattttacttaattttactttaggacatcttttattgtcaaatttttgctttggaacactttttaactaatatttcactttgaatcggatagtcttgcttttatttcactttagaccactcgactcttctcaagtatatgaagttgtaacttataagtagaccattcattcatttaacattgttaaataataaattcggtggagatgagtaaaaaagttgatgctacaaaggtaaaattatccggtccaaagtgaaagtaaagggtgatccaaatcaaaacaccgacaataaaaaaggcccaaagtaaaattcacactaactaataatacccatcagtaagggaggaaacacttgcgaaattccgttcaatgcatttggctggttgcagccttacagctgggttgccacaatttctttgttttttttttaacttcttgcaacaattctggtggattcaaattagggatttcaaccgtacggataccatttctaaaaaaatatattgtttccaattgttattactgtaaaatttagtttttctaatttctaatttctgtctgtgttatgttgaagttgtcactaattcataaatatagaaaatttctgaccgcaccaataccctttctgaaaaataataaaaaagatatcatatctaaccgttttcacccctaattcaaatgtaagggttggaaacttctccaacacgcatgaaaatcgaaggtacttagtacatgattagttggcacggacggaaggtgacggtagtggtatcccgaagcggcagtggcagtggccacgaaactcgaagatggcgtggcggaggcgagacacgagcttggggacaaactgaggtacgacaagggtgctaccgagatcgaagtcggcttcgcgcggacggacggtgtggacgggcggacggagtggcacggaacgaagaaattcgcaataaatatgaaaggcttgctaatgaagtggcaatctaccattgatggcaaatactgaaatttctcgcccaagttccaaagggagcaggacgtctgtagctagctaggaggctcgagcgggccatccaagcacggtctgaggctagcaagcagactttgggcctaattgtggtgggctttcggccgaaaaagcccaggcgatcgatctctctccgtgtccaaaaaaaaaaaaaagacggttattttagaaaatcaaacacacatcaagcaacagactaaaacactaccacaccctttattaatatagagagatcagaaaacaaggagaggagagaaaatctttacctatggacgtgactacgatgaccatagctggattgtcataactagttacctcacccttagtaccggttgctattggaaccactcccatggttgacgtcgcgcaataaagcaatatcgagatgcctcgccgattagtttttgcgctaccggtataggtatgcgtgtgctcgcgctttttgatgcaaggacatgcaactctgcccaaaggagatgcaacaccgcacacattatcactttggtctaatttcgtccttgtattctattgggcaccgatcctagacacaaaagaaaggtatcttcaatagtgcctcaagcttctgaaaactgaaatggctatgggaagcaagcacggtcgtactttcctaatcactggtttccatgcctatccaatgatcaaggactggataaggatgactcgaaagaaaacaaaattagggattctggccctatttatatttcaattttttttcttcaaactttcaacttttccatcacatcgaactttcctacacacacaaactttcaatttttccatcacatcgtttcaatttcttcaaacttttaattttggtgtagaactaaacacagcctctgtttgaagtatacaaagcattttgaatttcaggcattaagcactaacatcagttgcacaagcccaaagccccaaaaccatcatcgaagtttcacacaaattgtactgctcacaggccccatggttttcaactaaactgcgactgaaaattgcgagttattcactcgaaacaagccgcgcctcagtaatcactaaaactgaaactgataaaccacatggcacatgaaagcactagcttcaatgggcaaatgctcctgcaatttccactaaactactaatgaacagaaccctgtatcatcgatgtgagtgatggatggactcgagcagttttcattgaccgagaagcacttcttccttctgaatattcctcaccaagaggccaccttggacgcaggtcatactgtgttaagacaattatcaggcatgataatagccagtcagtcttataaaacatagaacttacactgtattaacgtcaggagtagagtaaaattaccaagtacaagattccttccataacataaatacacaacaggtcgatctgaagtgtgttctattttaatgtaagaaaattagacggcctgattctgagttctgacaatgtgcgaattccatcttccatgatattaattataggaaaacatttggataaaaaataactcataaactgatcttcgtggtggatctgccaccatcacatggctactgatatcataaatattgactagctttgctcacaggccaagcttatttgatcaatccccccagagtgtcaaactgaaggagacatgaggaatataaaggcagctataggaatggggaagatggtgaaaatgtggattgtttgactggcttggatgcaattttgacataacacaagctcacctgttcgatgaccatatggctctaagcttataatatggtaggccgcaagatgaaaataccaccaaaaccaaatttggcaggtaatttgctagttttgagatttgagtattgaggtttgggagtcgtgggtgaaaaaaaagactctggatgacttgatgtaaacgaaattatcgaacttcaactatagtgccaaatgcagttacttgggattaaaaggacatatatgccaaatttacccaaattaaggtcaagaacacgatataatctatccaagtctcacatttcaatgttcgttgaaatgccatcggtttagctttacactcttcctccttatcagtagcaacaccaactgccttttaacaagacctttttttattgtagcagcaaagagttgatcatgtatcaatgcatttttaaactaccaagttataagaagcaaaaaaagctttctgtgcttgatggtgcactttgttttgttcaactcatcaactgagcatattaatttgtcatgttacctgcatatcatcaggctcatcaacagcaggaggatcatcaaatctgcctgcaatgaaatgctcaataccagtccaagcaatcatgacacctgcaaaagaagatgccagaattatgtgcaaactgcttaagaataactaagggaattaggaggaatctgtaccctgtatggaagaaacagtcaaaaataagttctcaacaagtcaaaaggacagaaaataa

SEQ ID NO: 23257 - DNA, 1048 bp, Oryza sativa
tatcaggagtcataaacgctataaccctatatgctagccttggattgtttcaagaagcattagctgagaatagaagcatacaatggtgactatttacttccatttttttttacatatgcacgcagtaaacccaggacggaagtaattatcacaggcagatgccttgatggttaacttaatcacaaccaacatgatataatacaatgaataactgtcagatgttgaaatttgtttacatgtaatttaacctcacattcttgattcttccattagataaattctaggattcaaaaatgccgcaaaaaaatcaaaaaggcgatgggtaatagttgccaatatagccagtaatgtttaccaggaaattgaacagtcaaaatacttagaacatcaaagaaaactaaatatcaggcaaaacggatggtcctgctgccaaatgcagatcagagggatttttttttgcaagaaagaaaacaaattcataaaattaaagtatatagcaaaagaagcatctagtttattgttaccttctgcttgattctctgaccagcagcaggatcctttttatgaataatctcataagaaaccagaataacatctttcaaaggcctaggcgtctcttcaacttttccagccaagaacatgcaaactgtggcaattgtctgtaagaacggtcagtacaaattataagttctctcttcaaacaggtacagatctataggacaacacttaacataggagtaaaattaagatcatgcaatcaaaagtttgcgacacgagaatgcaaggaaaatgagaatagaaaattatttcgtttgatacatggtacaaaatactaaacaatctcaggacaagtaaaacaaactcacatgcactacaatactgtctctttccattggcagtaagaatttgtattcatttctctttctgggtatagctctgagcttttgacactacaatactatagacatagcaagttctacattatatttgttccagttaattccaacatttaaaggcattatccggaagcatctcccactttttcatg

SEQ ID NO: 23258 - DNA, 5842 bp, Oryza sativa
aactacatagaagattgataatggggcaaccactggtcaactttaatctggatcattaatccgtaacctccaccaacaactatcaaatatatgtggtacttttatctcataacaaacagtgcagtcaaaagcacaaaaggcgctcgcctagatgcaaaagcaagcgaagcgcagggtcgcaactaaagcacctagagtagcttaaagcacaatgccgttggtgagccaactttaggcttaagaacaaggcgctcagacgcctgctgccttctttttttctgccagcttgattcaggactcatattttgggcatcttttgttgaaggattaggttattaacttcttagcagaactttattaatgtggcacgctatgtatattatagcagccaaaaactacttgaattgcagtttgctagtctcggaccttatccgttatatatttcttaactattagtttgtttttggtcagctgccagaatcaggcatggagcttcctacttaggggtagacatttatgtttttatattgtgctccatgtgtctaaggcacacactttttaatgctttgtacctgaggcaatataatactattgcgtcttagtgtacttttcgctttaactgcactaataacaacaacttcagtccctataaattaagtaatgaagtccccatagctcttgtgatcgtaaaatgcaaatgtcaaagtatgtacttccccgcgacacaacttctatatctataaaatattgcagttttcatcgctcctacattactatccatacagaaggaaaccattttcttgttaaacatgttttagaactagataaaaaatgcaaatatgtcgttgtaatataaaggctactaactaaaagagaaatagccatccataaaaccacaaaaggaggaacgaaccaagcattgaaagtacttactcgtctatcattttttgcatgggactgacgaaggtaaaaacggtgacagaacacaatagctgtagcaatagtgacttgtggcctaccacagaacaaaaggcagtcattgattggaagtagacagaatgatattatactccataaataagaaaaactaaacaatatgtagtattcacatgaccagaacaatttgcatggcaatcaagggctaaaatcaatgatataaagcacacattctgcttccatattttgataatatacacattcaacaagtcgaaaccaaacaattaccaggtcctcataaatttgaaagagataaaaaaacatcttctgcttctatgttgattatatacacataaatggatctcacatggatgtccaaacaaaggggtaaatagattgatcaagcttattagaacaaatcagaccaaaaataagctaacggcttacaaattacaaccacaatagatatacttcagttaagtttagcatcctttgaaaataataaagtagaaatgcatgcatcatggtaattgaagatcataataatgattgaaaggaacaagttaacatcaacaatgaaaaatataagttaaatcaactatgatcttacactttaagcctcatgcccaaatcttgtagaaaagtacaatatgattttcggaggtaagactctttcttcaaatcaatgccatccctcctggatggagaattctcttctatttcctttctactgaaataccatgaagcaccaagttcaccagtctcctcattcctgccctgggtagttctgtatgggctattttctacaattccatgatgtgatgaatcacttggcatcatagccatgtaaactcgctctcaactatattgagaaaggactgatgaagatattacttctttatctattgaaagtggcctgagcagcactgaacgaaaaagatacagtaagtgtttataaatttactaaggacaaaggacaggataataagatacagtacaagtaatgattaattctaaagtactaacatatggctttatgctcattccaatctgtaagttcgaaatagaaagagcaataggatgataatcatgctttacaagtcactagacccattaataccccactaccagagaaaatggcaaaaagccaagaatacgtctagtagtacacgttgtcgaactatgaatgcagggaactaatacagattatggtttataacattatcgggattatgctgtctaaagtttctaaagcatagaactagacaagtaaaatttaatcagcaaccctcgttacttccctaagatgcaaacctcattcaaaagcataaatcactttagatcaattccaatgtctatgtacgtattggtcctgatacaccaatcaagggtggtcgcctggttaaacagaaagatttaaatcgattattgatttatattatgtttgcaggctaacgaagccctatccccagtgatactcatcacccacaaaatgcatcatacatctcctaaaattgcccatccagtcaggctctttacacgaaacctaattacagtcttacacatacacaaagtggggattcaagatcttgcaaaaacatgacccccaataaacctattcgagcatggcaaacaatcatcgattcattctgacccgcagcctggctagctgcgaaccccccatagcctggctgacgtcgtccacccgtctagctgacgttctttcctattcacgcagatccgcgattcgaccctactcttctcctaaaaaggcgatcttgagcccaatacatcccgcaagatcacaccttgaatcccccatacccccgcacgaagaccatatatcgagccgaaatggcaccaatcgcgacacctagggtttcggaattcattgaaccgcacagctatcgaaaaatggcaagaacgccgcacctagggtttcgattcccctccccgctccgcgaatgagacccgccatcacgagacgcgagaatcgaaacagagaggcatcgacgcgtacctcgtctccccccgcgctagggtttcgcctcctcctcctcctcctccgcctgagcccgcccgcggcggggcggatggcgccgaggcgccgggggcgcgacgcggctccgccccccccccccccaccaccaccaccgagctttgcttgcccctctcgcgcggcgtgcgtgcggccgccgccttctcctcctcgtcgtcggcgagggctgagagggcggaagggggaagagaggaggaggggcggcggcggcggttcgggtgcttctcgcggataaaagcccccgcgttgcaaaaaccctagtctttcatgtgatttttttttggttcccctttggtttcagagtttgtttttctttgttttttttttcctataggttggggttttgattgagaatgataatttattttatgtgttttatatgaccgtagtgatattatatcgattgatggtttggtgttggtgttccgtataaattattattatgcgattggaagttttgtttatctgtttatgggccatggcccatcagcagtgacgcggtgcatgttctatttggcgttacgcttttcttactttcctgataaacttcttctgttttttctacatggcatgtttcggtacatgttctatttggtgttacgcttactttcttgataaacttcttctgtttttctacatggcatgtttctaaagagagtgaactttttttctctagcgctgcatcaacaaagaatggaagacgtcactaccatatggcttcagctctagccactctcttgtgtaatatactttattaagtgttttggtgagcaaatattttgttgcatcaaagattattattcatttaacagaagctttatttcaattgtaacacgttttttccttgttacacaaatattttgttccaacgagattttcgtttgttacattaagtatttttttaaatagatacttttattttctacatatgtagttaaaaagaagtgttcaacaaggaatttaatttcttatagaggagtgctgctcattttgtgtcatagatattttttggctattgctttattgtattgtgtgatatatgaagatcactgatgtaattttttgaaagaaagaaattgataaatggatgtattattctagggataatttagttgttgattattgtttaatagaggtggaaaaaccatagcttggtactggttgatgcatgggcctatcgatcaatttgacaaaatatttgtgctatagatgaaaatatgttatatgctgcatatggcgtcattcctaccccgcgtcatatttttgttgttcctattcttttcatacctcatggtcttctttccatcatatcattattcctatttttaccataaagctttgcgctacctttggaatctttcatgcatgataactgcccctcctagacaaacagtcacatagatggaagtgaatgtgcaaaatccattcatcatatcgttattcctattcttaccataaagagggccacatttgtaatctttcatacgtgctaactgcccctcctagacaaatactagtcacatggatggaagtgaatgtgcaaaatccattggaagcaacattggtaagttatggggtttgtaggcaagtgaatccacctaattgggttcatgtcctcaatttggataggacaaagtataaattttgtgagacgtcctctagttgttaggcaagtgtcacagagacacatcacacactgggatgtattttgatgtgtactatatctctcttcccaagaaaataatttgtaggttgcccaaacaaaacatcaatcggaatagattttattcggtttccatttcaatgtacgactaacccaattcaattttgattcccattttcatttctagatggacttgaataacccagttcagtttatcctatgtaatcgtataaacaaaacggaagcttgtagagacaaagggctctaatacaatcactatttgtagtaacaggttatgttctagatgtttaacaatgttttttggggtatttttttgacaaagcagagttttatgtttaatttatagtattaactgtttcttctgctgtaatttgtcatttaaagcttaataacattgcatcccttgaaaagaaatatatcataactaaaatcaacgtcatgtttgtatattggcttctggactaaaaccatgtgcacctaaggctattttttcaatgaaaaattattcaccgtattattaaaatggcttaattgttctatactttggaaaataaattttcttctactatattatttagaacagttgtttcaagctatttgctaagtttatttcttaaaatatttaatttattcttaatagtctagtgaaaattaataatctatttcacacgaacctccggtaggaaatcaagagggaaagcccgtttctaccacttgaccaaagaattacatttcatttcttttccacttattttgtacagctagcaattctaaccagcaagcaccttctctagcaccaaaacagctatcccaaattcaacaaccataggagtatatgtagcagcttctagcaccaaacttacctgaactcatgatcacatcttctcatcattagctcatcactactcagtactcactcctctagaatcatgtcatgtggttgatgccaaccctgatcaatatcgactgactcttgtcatctctgttcctctactttgtcacctctgtagctataagctgccgtattgggaggctctacagcaagcaagcaagacattgatggacattggacaagatgccatggcaatgcagcagccatggccggcatttttggatccacgaggatactgttgggcaccctacgagatacacaagcgagcagc

SEQ ID NO: 23259 - DNA, 6142 bp, Oryza sativa
attcccaactttccatcacatcatatcacattaaaaaacttttatacacacataaacttttaatttttttccaaactcccaactttcttcaaacttccagattttttcaggaactaaacacaatcaatgtgtatcaacgcaccctgtggtatctcgtactccccctattttaaaatataataacttctatctcttaaaatttatctcaaaatataataacttctccaccaatattattttctcaaccaatcacaatctctttccatttaattttacatattctcttaatagtcatatccaactctaaaaccttttatatgtgatttaatagtatgttcttgtgaagaattcagactgcaacccgacgcagttgggcacgctactgcctgaatgcagtgtccactgtccaatggaggtttttgcatgtacggcatgtaaaatctatgaattaggagtactctgctcaatgaatttatgatttttgtgttaggcgtccggtatgtctataggaaatacatgccactcagtgacataacccgaaatagttttgaattcaggcaaattttaatataattagtatttgctaaaaaaaatttcatcatcaatttactaatcaatattaaatcttaatggagttttcatcgatgagctcagacagctgctcgggctagctagccgggcagtggctccacgtacgtacccccgatgctacttgacttaaagctgagtacttttgagcagctcctcatgataacttttttttttccgttaacactttttaattgcttaatgatatgtttctatataaaagtttaataaaaatatcaaataataaatcctttttaagtttaaaatagttaataattaattaatcactcgttaataatttatgcatgaaacatactagcccaaaccaaattgttgaatggaatagtactaccctaacacttaacacgaggacacatgcagagaataaacctcaaagattgaaagtttgaaactatccttgagatacatatatgactaggggtggacaggaagctcgtggctcgttagctcgctcggctcgtgacacgctcgactcggcttggctcgtttaaattttgtaacgagccgagccaacattttagctcgttagtcatagcgagccagctcgagctggctcgcgagccaaaacgagctgaagcccaccagtggacagcccatcaaacgaggcttagtagcagcccaatcatccacgaggcccaccacagcccttgatatgccaaaccctaggctaaaacaagcacacaagcaggttaagcaacgccgccgccgccacgcttcccacgcgcagacctgcgcgctagcgatgcgtcgtcgtccttcccatccgcgcggctctcgtccagcgcccgacgccaccgcaaacgccgccgcccgcgccgctcttccacggcgcccgacgcggccatggacgccgccgcccgcgctgttcttcctcggcgcccgatgcggcagtggacgccgccacccacgcccgacgcggccgtggaccttccccggcgcccgacgccgcagtggacgccgccgctcgcgtcgctcttccacgacacctctccaccctttgttcgctctctcttgtccagttgtccccaaagctcacgagctagctcgagcttacaaacgagccgagccgagcttgatttctagctcgttaggaagccagaccgagtcgagccgagccagctcgacatccacccctatgtatgacgtatttcatccgtcctaaaaagagccactcctatattccatatgcaagtttagtagtagcgtgaaaatactaaagtgcccccaataactacttccgttccgatactgttgtttctctaaacccaataattacacagcatatacgaagaacacaagcgacatcttgcgaaaaaaaaatccaaaaattcaaaattttcacttgccgaaagaaatataacatctccaatctgaaaaaagaaatgctttggacggtcaaatgcaagaattagcaagaactaactaccaagaacagagattaatcgtttgccttcaccaccgtacgctcgtgcatcctcttgcattagatcctctgcctccgccactgattgcgtcgcatccacccgtagcctccacctccatctgcaaaataacgagatgcacctgcctcaaccaccaccgccgccatattcgagccgaatccgtccgacagtgccatcatctgtattggatccgcctcctcaaaagcctctgcctctgcggccacatccaagctgccgcatcagggtgcaggtgtcgcatatgagctatttgcgaggatggtgggagggaaggaacatgggtagagcggttcatcgccaatgggaggggtaagagatgggtggaaggaggagagcgacggacgagacaagacgagaggaaagaggatgagtcaattctgtttttggttttttttttttaatcacgcttgggtgaggagagagacaaaggataagactgcccgctatcgctgtttctcgatgtatggagtagaaatcgttttttttttttggacaaagcctccaccccagtgctcagaaatcgtttttttaagatggaaggagtgcaagttttatgtataagaaactacgagactgggtttctttcaaagttggaaatttggattgaaattggtacgatgtgactgaaaagttgtatgtgtatcacaggttgatgtgatagaaaaagttggaagtttggatccaaacacagccaagattgaaaagttaatttgaaccagtggaacacaagaaaactcacaagagcaacaagtgcagtacactggtcctactagagcaagtgaagtacccggtaatcggtgccccggccggccggacaccatggcgcaaagctctgactgcctcagccttttcacctggcgatcgactggcgacgcaacacgacggccggcgagaaaccgatgcctcgtccggtcccatccatccatccatccatccatctcgctcgacagacacggggacgcgacgcgatggttcgacgacgacggatggcgcggggaagaaaggcatatatggcgtcgcagccagcagagagcacccacgcggggaaacaatcgcctgcaaaaatgcaaagcaaacctttgcctgctgcgctgcctgcgcgtgcgtgtgtggatcatcgatgctcgacggctcggtgccgtttctgcatgcgtctttggcagatgcgtagattcggcgacaggggtaccacaggacatacttcctcagtcaaaaaaaaaaaaaaaaaaaaaagacaaaccctgatatccgtgtccaatatttaaccgtccatcttatttaaaaaaattatgaaaaaaattaaaaagataagtcagcataaagtattcatcatgttttatcatctaacaacaataaaaatactaattataaaaaattttcatataaaacgaacagtcaaatgttagcatgtaaacccgcggtttgtcttttttagggagtatacgcttcagggggtgcagaatttttggcgcagaaaattcctgttcgagcttgtgaatatcttggccgtttaacgcgagtttcagtgccgctgctgggtcagagatgagttatgccttaggacaaccacaacatgcttaaaaaaaagtaaaaaaggaataaatatattgatgaagtgcaccttacacattgtgtaagccagcaatagaaaaaagtttcttgtggtgcacctcaaggttacaatcggccatagtgaataaataactatttttttctcctctacttactctctctctccccactatcccaaaaaagttagcagccatctcatatttttattttatagtggacctacgttaaagactatatatgttgtgcatcatactataacaaatagctaactatttatggatcataccttaagatgtgtatgcacattatacactgaccttgccattatggtacaagcttttatttactgtaacggatcaatttcgtatgcccttatggtacaagcttttatttactataacggatcaatttcgtatgattagagattgactgagttggtaaattaaggacaaagcacgggctgagtccatatatttgggattagttgggtgtgtgggttgggaataaagcacgtgtcagtctcatataattagagattgactggatgggtgcattgagtataaagtatagggtagatccatataattagggattggttgaatgggtggaatgaggagaaagtagttaggtggtgtttggttggaggggctaaagtggggctaaacttcagttcatctcataaaaacataagtctatgagagaaactaaatttagtttctaacttctaaacacccccttaatcttatggtggttacacacgtacgaaggagcgcacgacctcttgcgcatgatgagaaggacaggatgaatagatgagctgtggagcactgccaacatgctcgaaagtacagttattagtagtagtataaaggactacctatttaattacttctagctaattcaatgagctcaattttcttatcatcttgcatgccagcctatatgttttaaaaagaaatagaagtctcctttaattgcaaactaagaaagaagcccgcgcagatgtgcgggtattttgtttaatgtttatgtcaaaagcgtttcctagattcaaacataaatcactatgtcccggttatatataaatttgtctaatatcgccactacttattattattattattattttattttattatggatacttattatcgttcttttgaaacctgagtgattatttaatagatgaaactgtatttgtaatatcaaaataagaacaatacatcattaatcgactaaaaaaattatctccactactaacctaactgttcatgtcgatctgacttatttccaaatctatgtataaatattccaataatattttatcaaaaaaatatattataacaatatcgcttgtatgagttaataggataatactgttaaaatttgatatgaatgcccatctaacggatgaagccgaacatactaccaaggctttcttcctcgataccttaaaacatgggtcacatatcgacatagtcgtgcccatcaagaccatcgtggagaatagttttaacggctaattcactattagtaccctcataaaggattgcatcgttaagtacccatggtggcttaactcatccaaatgtatgcctttgctatatcatggtagtatagcaagctttattatctatgcttggcacccttttgagaatggaaaaagagaagacagaggtgattacaataatcctttttaaagttttgtggtatatagtagacacaatttgtttatagtgtaaatcaatattactcaaatttcaataatacatatacaatattcttatttgaaagtgagtgaggttatcatgttagtagagtgtatgacatacatccatcaactatgcccgacacatcggaattcctgaagtataagaaaatatattatgggtgttactggattgtttatttgttgccaaaactatatgacaaacaaaaaacctacatatatgaccatagttctcatgatggattaaggggttgtagtatagccatatcactcgctagaagtatttttaataaagtttatcatgtctatgtatcatgtgtgcttctcacttttcaaataccaatcaaatagttttgaaaaattcaaaaaaaaatatttgagaatcgtaatatctcacatattaaaattagataagatctacttgaaaaaaatataactaaattctgttgttttcatttttcatttttacatatgtagattcaaattatttgtcaggtgatattgtacaccataattatttgaaaaattattatgacattaattattatgtgccattatgtatttatcagttagcactaactactataggtcaataatagttcatttaattaaaggaatacatcagaattattgaaattgatatatatttaatagatgaacacttacagaccattgaattcatattacatctttgatctagtttaactgcgtatattggttgggtaatattttttatatcatggaaaatcatagtttagagaccattgatttt

SEQ ID NO: 23260 - DNA, 739 bp, Oryza sativa
ctgagggtttatgtgctaattgtgttcgatcttatggctagaattggtggggtcagttggcataagcactgcattaggggtcaattttagagttcacaaaggtttatcttcataccttggcctgctgatgtgcaatggttaactgaactggctgaatgcacttatttccttaacggggacctgccaaactatatattaagtataaacattacaatgaaagctgaccaggatacacagaaattctggaaaagcctaattgtggccagttttcgaaaatttgatagggtccagaaaccggtttcttttggtcgtgtcatcttgcgcaacctgatttgtgcttgctaagttgctatgagcaatccaaatttacattgactaggtgctgtatattttaagtctttttattcttgttgcactagttatacttatttaactttttgataatacaatttgatcatgacacattcctttctgggttcttgttaaatcagataataatgcatgtctcccttgattgcagaagttagcaatcaaatgttggagctgtatgagcaaaactgtgcagcacaggcacaaccgtcccatggaaatgaagctgaagggagctctgctagtgttcctaatcagcgagtctctgtaaaatccgaggaaacacctcttcctcaccagtcgaaacagtcaagttcacagcattcaacaggtgctccaagtcatcatggtgtcgagcactcaaatctag

SEQ ID NO: 23261 - DNA, 2989 bp, Oryza sativa
  unsure (1)..(2989): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactttctataaattggatcgaaatcattttttatgtgcagagtacatgctgaatctggatggctgtcttgcttctgaattctgatagcattcccatatcttttactttcttgatgtttgttttcccttctgaaaggtggcttgatatgatatttttcctttccagatatgtcaaattctcgggttagctggaattgatttgtttaccccttctgatgtggttgagaaaagaaatgttcggaaagtttgtatgtgcatacgcttgctatctaagaaggctcggacgatgcgcctgactgtaagccctagattcttatgaaaccatttattaaaaataattcaatcagctaatcattgcacaatacacatcctgaaagatttaattggtgtgtttctgctctctggtgacaggtgcctgattttgatattgtcactcatacaatagccatgcccaactacattgttggaggcatccggagaagtctggagcaaccacaatgtagttcatctggttcaagtggttacagtccaagtgccaactctaaggcattaaatcagcaggtaagctatttgaaaggatcagtttttttttttggggagaaaggatcagttttattggcatgttcttgctaattgatcctttattttaagtcaatactatcattgtttaaaacaatcaactcattaattttgatatatatttccagagagtttttggtgcagagaatgatcaacaatgtgaaacacattatgattctgatgaagctgaaagtaagctctctgcattagaacctgaggactcagtcagtgaagacaatatttccacacttttgaaatcgggcaacatgcccaaggaagaaaaggaaggctatggagatagtgagcatggtatgcatgaagagaagtcattgtctgaatcagttggatcgattgatttcggcaatatggaatctgattctgttggttcaactcctttatttcacaaaaatgaatcatattgctgtattgaatctccaactgaccagtgttcaagaactagaacaattaggtgttcattaagttcagaagagtcagattccataagcagtcatttggtagttgacagcagcaaggctaaaaggactcatggcgaacatctcgagcctcttaacggaaatgggaaaagatttgctaacgatcccgaaaaagaaagcgatgccctccaaaaggtcacctttgatcaacaatgtgatctgcttgcctgtgatggggagtctgtatgttcaaattgcgacagtacaccatactcgagtttaaccccaatagacagtgcttgtggcaaattgccagcagtttctgaagatgatagtgcatgccgagggctggaactcgaattccgttgtgggaatgaaacggtacctcctgaaatgccaaacctgtgtatgctagtactacttttaacatagtcatcattttgtctcatgtacagcaaacacgctttaacatttctttggcatccaggacgtttcccaaaaagaagataaacaggtggaatcagaatataaagctgaaaatgacagctctgctcaaatgaatgagaatgatgttcccaaatcagggaaagggatgctaaagtctgttgctggaggaattacacttgtcggcgcagtgttcttcatagctcatctcaggtaatggtaccacagtatcaaattatcgtcgtgtgccgtttggtgtactgaacactaatactcctatatattatgaaattaatccaaactttgctgcagaaggagcaaggacagaagcttcgcaggtgttatagctccattctctgaaaaatcagttcagggcgactcaagggcaaagaaagtagagaaaacaaaggcgggtgccgtgtatcccggggaatggctaaaagtttaatcaagaagaacggacatgccacggtgccacctaagcgcaatttggaagtttattttgcaatatgcatacatcttgtaaaagtaaaatccatatgctaaagaacacttttttttaatcagctactccagtttgcacgagtagagggctttaagaagcgactccactagtatagcaagtgttaatatttattttcttatagcagtccaaagcttacaataatctgtaatctggataaacaagatgcctcaagttctctccatgtacagaatgatccatgaagttgattaatttattataagcagcagccattattcagagtagattttgtactatgatgcagtaggccgaggtcttgcagcgtgcagcactgcagttaattaacgtgtggctgtcgagtttgcctgcaacagctgccagccctgagcaatctctgtgctaaccccgcgcctccaacctgggtctgggttagttttcaactttttcatcacatcaaaactttttacatatataaacttccaacttttttcttcaaacttttaattttagttaaactttcagtttaaatgtggaactaaacacagaaaaaaaaaactagcatatctcatcggggaagagacgaagagtagaagccccggcacgtcgccaccactcgccgccgagcgaagactagagactcacccgatgattggacgggccagcgcacgcgacgaccgtgcgcgcgaaagcgccatgtcgccgtccacaccaagagcgcccccacaccc

SEQ ID NO: 23262 - DNA, 10248 bp, Oryza sativa
ccccccccccccccccccccaaccccgcatgccccattgaccgacgaaaacaccgaacaaaccgagcacaaaccgcagacgcggacgccgagcgaaatgctcgttcttttcgttggtggaatctgcaaaagcacactggaggctggtccggtacgggacaagacaaccacgcgagaggggataaaaaaaaggcgataaaggtaaagctagctaccgcgcgcatccaatgatcggatgcgatccggaggagaaggtcgccgaattccgtcttatccagagatggggaggtaaaaaggagggggatccacctaaccaaccaagttgcgtcgcgcctaaaaaaaatggccgcacgcgctccgccccggcagcaccggtcaattcctgctgcttcctcgagtcaactgctccagcgcagcgccccacccacgccttttacccgcgcgccagcggcggcggcggcggcggcggggtgaggaggtgaagtgggagaggcggcgtggacctgcgacgacctgcttgctgcccagcctgcgagggcaagccactggtaggtagtacgtgcttctctcttcagtcttcactgtctgtgtgtgtgtgaattggaatttggaagtgctggaggtaagcagtaagagaaggatcagatttggagaggctgaatctctgattctctctggtgtttaaagagtttgttcaattcgaattgtgggtttaattttggtgccgtctctcactgggagggatcactggatcacagttgtgctgcttctgggaacgttttggttaattctatcaggtctgtagttcttcatgatttttttttgaatggatgtagttcttcatgatagcttctagaatatctgagtcttgctaatattccttttttttttaatagcaagagaatttagtggtgctgacatactaaaaattagaaggtttatgtgctgtatgggcatgttcagatattttgatttgttaggcaaatttagatatttttaaccatggcgaccttttggtttgggggcataattgggagcttggttttgcttccttttttttgaacggaagttttgcttgtttcatgcgttctctttggaaataataattctagtacgttttgctgtgatgaattcaagcctctattttagtataccgatgaaacaattgtgcatttcaaggcaacttttgcttttcagcataactaacagcataacagtgaacagatagtataataataacagtaactacaaattctgctttgcctatcactcaatcttgtatgaacctcttttcttatccaataatattttgtctatcttataggtgccatactggactggcttgcttgttaactgggttagccagggactccggtattatactactatgatcagttcgtgtactttttttcgccgggcaagtttccccaaggaactcttttgatgctgtaattataactgaagagtcatggatctgctcagcgtcctcctaattatagcatctctgctcccattttcagcatctgaccgtcaaggtttatttacatgcctatcatttatgtagttattcaagctattttggagtgcttccacaatcatgagtttgcaaatacttttgggtaataaataaatttcttttatttccttaggtgatgcactatatgatatgaagctgaagctgaatgctactggtaaccagctttctgactggaaccaaaatcaagttaacccatgcacttggaattctgttatttgtgacaacaactacaatgttgtgcaagtgtaagtttattttgttgatgttttgcttcacttttattttctctccattttgagttaattctatatttacgtatctcttaaacttatatggcataatagttcttgatttatgttccacattcattaccagtgagctccagaagcatctgtttgagcacatgattatgatttttttgatgcacttgcacatgctatctgcacttctttgatgcacgagcacatttcataattgaactatatgaaaatggaaaaatcatacaacatgctgtttctttaaatcttcttcacaccatctgttatttctggcaaaacaacatctagatggttctgttgaccccgttatgcatgttccatatctaggttttttgtttgttccaagttggtgtgcctgatgacagatgccctcctgcagaacattggcatctatgggattcactggagttctatcaccacgaattggagagcttcagtttttgaatgttttgtaagtgtacttgtgttgattgttggaatttctctcagatatttggtggtagttgtgatgaaatagctactgtgatcctagaggaaaccagaagctggtattatgtgagaagtgccaactgttagctatttctgtgcttgctgcccaaagatttggttgtcttagttaccatgtactgtggtcttagactccagtttttgctaaccactgtagtgcatgtcattgcaggtccttgcctggtaataagattactggtggcatacctgagcagatcggcaacctatctagtttgacaagtttggatttggaagacaatttgttggttggaccaataccggcttctcttggccagctttcaaagctccaaattctgtatgtacttgaaccttagtcctttgttttatgaatgtataatgatttaacctgctcacctttttatctcttaaacaggatactaagtcaaaacaatctcaacggaactatacctgatactgtagcaagaatctcaagcttgacagacatgcaaggactcatacatgatttctgttgacaacagtccatgcctgaattatttgactaacatattttttttcttatgattgcagtaggttagcctacaataaactctctggttcaatacctggttcgctgtttcaagttgcacgttacaagtactgttggatcactgtgacttgtatactcatgttttttcaagtttgagctttgagttctgacaaatgttaattttctttacagcttttctggtaataacttgacttgtggagcaaactttctgcatccatgctcatcaagtatttcttatcaaggtaggaagcaattttttccctgttcaacattgcacatctgtcatacagcatccattggatgcctgtcagaattttcgctggaatatgctaattctatctgtttaataggttcatcccatggctcaaaggtaggcattgtactcggaacagttgtaggagcaatagggatacttataataggggctgtgtttattgtctgtaatggaaggaggaaaagccatctacgagaagtttttgtcgatgtatcaggtagtattttacttcatgattttctttctatccattcattcaactaaaccttttcctacagtcttgtttattattttattgaaacaaagatgtaaattatgccgcaaaattttatcatgcgacccccaaaacaaaaacagtgcaagcagagataactcacacatgttggtttatttctaaactatggtttccaggttgtgtatgtcaacacagctatttttactggcagtttcgcttactgctccatgtttaataaataatcttggtgaagtattttggtcaaaaaaatttatggcaaaataagaaaaaaaaagtagcatgcaatatgcaaagctgtcaagtgtttagcaccttcagtaattttctgataaaagatatggaaggttgtttctaaggtagcgtttcaatttacaaatttaggattaggatatgcataggctgcatttacatttagtcaagagtaattttagttaactaatctgtaacttatgtccccaggcgaggacgatcgaagaattgcatttggtcagttgaaaagatttgcctggcgagaattacaacttgcaaccgatagtttcagtgagaaaaatgtccttggacaggggggtttcggtaaagtgtataaaggagcacttccagatggcactaagattgctgtaaagcggttgacagattatgaaagccctggtggggaggctgcattcttgcgtgaagtagagcttatcagtgttgcagttcaccggaatcttttaagattgattggcttctgtacaacacaaacagaacgtctacttgtttatcctttcatgcagaatcttagtgtggcctatcgtttacgaggtactttctataactgatcaataatttgtttcgttcttccaattttatgcttctactactgtactataaagtttctcggatacttcactattgtgcctatggattatgcaactgatacttgtagtgcttttaatttacgcttgttgggtaatatggtgcatgtgcactattgatttcaacatcgcatatgctcactttcttatgtttagattcaatattggaagatttcaatatgtacctcattgtgtttaacgatgcagaattcaaacctggcgaaccaatattggattggtcagcaaggaaacgtgtggcaataggcacagcacgtggactggagtacctgcacgagcactgtaatcccaagatcatacatcgagatgtcaaggctgccaacgtcctgcttgatgaggattttgagccagttgttggtgactttggcctggcaaagttggttgatgtacagaagacatcagtgacaactcaagtccgtggaactatgggtcacattgcgcctgaatatctgtccacagggaagtcatcggagagaactgatgtttttggttatggcataatgcttcttgagctggtcactggacaacgcgccatcgacttctcacggttggaggaagaagacgatgtgctactgcttgaccatgtgagtctactcttgcgaagctggaacaaaattatcctagcctctgatagccatgtgttgacataattgaacgaattttttttgaaactaactgtgccagatagtgcgaaatttcatactgatatagcaagaaaaattataaaaatacagcatgagaggctataatcagcaggaaaagaaaaaaaacaaaataattgttgctctcattgaacatcatattcattctgaagcctgcaccgcttgaatcatcagtgtcatgatcatgcttgctggttgctgctgaaaatgtgcaggtgaagaagctgcagagggaagggcagctgggcgccatcgtggaccggaacctgagcagcaactacgacgggcaggaggtggagatgatgatacagatcgcgctgctgtgcacacaggcgtcgccggaggaccggccgtccatgtcggaggtggtgcggatgctggaaggggaaggactcgcggagcggtgggaggagtggcagcaggtggaggtgacgcggcggcaggactacgagcggatgcagcagcgcttcgactggggcgaggactccatcttcaaccaggaagccatcgagctctccgccggcagatgacgactgcgtacgtcctgatgcatgtcacttcccaatcccagtgttaatagatatacatgtatgtatatgtatggttggctcttagttaccatagggttggttatgtcactaaagaacccatgtcaagcctccatttgtgtagaggaaaacagctagagacgcatgtgttcagagttcagacttcagaagtcccaagtcgcatctgcttggcgaagccgagccacattttctaccatcatacgagaaaagaccaggaattaaccgagcgaagctgtgagaatctaccgtccgattccgagacaaggaggacggtgccaccgtggtgcgtcacagctggtcgctcgcgaggactcgagcacacggtgcacgacccgcggcccacgccggcatcattggctccgcgacgcacgcggcgctgcctgccgtacctgcctccctccgatccaatccgattggaaccaacctggcgaacccacccaccgaccaaaaagctcagaaaaagcgtcggggatggccgatggcggggatcacatcacgtgccgaaaccgggggccacagtacggtgaaaaacaccggaaaaaaaaaaacgtcaaaagactcaaaacccaaaacccgcgtgctgacaaaaactcgctggcttccaccgaccgcttcactcgcagcactcgttcactgagactcagagagtgaggtgacttgaggcggcggctgggagctttgggttgctggcttgctgctgcgatgggctgcgctccggcggcgcattacctcccggggggagggtggcggcggctgctggtggtggtcgtggcgctggtcgtgctcgaccgtgccggggcccgggtccgcgccgcggacgacgacacgggcgggctgagccgggccgcgttccccaaggggttcgtgttcgggacggcgacgtcggcattccaggtcgagggcatggcggcgtccggcggccgcgggccgtccatctgggaccccttcgtccacaccccaggtgacatgcaccgcgagtttacaagaaccgtgcttaactaatcctgctggtaaactagatcctgcgtgagctctcactgggttactgcgttacacgttctcgcgttctctgttcatgttccatttctcctttcaagattattaccggccatggtaatacttcgaggattaattctggtgagcgactcgtggaacaaagcgtgattttggacagttcagctgagtagtggagaatattcgaattttcagataccaatttggcttaacgagtttgagggaatgggggatagaatcagctcatctgattggatgatattaaattcgtggatcattatcttaaaaaaaatcgtgatgttgacattgtttttttccggatgaacagggaatattgcgggaaatgggaatgcagatgttactacagatgaatatcatcgctacaaggtaaatgagatcaattgagactatcttctgttctttttttcttgctcctgtttcacctacatatagtattgaaaggcagttagttttgtcagtcaattagtagatcgcaattttcctgtccatgaggatgctttgggactatctatacatttcctgacaatttttctcaaatataatataatagtaatgtaattacattataatttacatataactacaatgtaactggtatgcagtaactttcatataattttgaaaacgttagatttgctttaatattcatgcaagcggagaagaaaaaaatcacaacgcacacacaagtgaggggatcgcttcgtgaaaatagcatgttatcgtaagattttacttacatacaagttgtattgtagttacatgcagttacgatgtaattacaatacgattcgattacactatattacatttgtcaaatttttgggagaaaatttgtcagcaaatgtatagcaaaactggaatggttttgtttgtgtagttgatatccatatttgttttcaaccttaagcaagcacaaccttatagtgtatttatactttattgggctgtgagcaaggctcaagtttggccttgatctggcgaagcttagctcacagcgccatgctgctttggcaattatgttttcaggaaattagagaatacttactgtagaaaaatcttgagtcaagttaatcaataatgaatttcggcagcttgataattgcttactttttttttctgaaagaagataattacttacattgtcttcttgctagcacaggaagatgttgatctcttgaaaagcctgaatttcgatgcatatcggttttcaatctcgtggtcaaggattttccctggtaaataaaaatatggctctggctatagcatctacttgtactggttagctggatgaggatgaattccactgatgcattttggttatttagatggagagggaaaagttaacacggaaggtgtggcatattacaataatctaatagattatgtaattaagcaaggtataacttcagacatattgttcgacgtttgagttttgccaacataagtatattactgtctgaatatttctatcaaaactaacagggcttattccttacgtcaatctgaaccactacgatctcccacttgcacttcagaaaaagtatgaaggctggttaagcccaaaaattgtgtaagtcgtacatgccaattcttttttttaatgttttcactcacttatctattggtattgcctttccgttttaggctaattatatggtgataaaacatatgatcttgtcacaattctatatctgtataatcaggacttaatttttaataaatacaaggttttctgcaccagccattttttcacttatttttgttacagtgtgcaggagagctgagaggtgttttttataaggtgctatgaaagcagaaatggcttaacagttgatttcttcagaatgatcaaatttacatttgtgaagaaaatgaaattcgaaactatgacaaaatatcaagtttgcattttgcaatataggtgcatataacatatttacttgtcacagtctgtgcaaggagcacgtataatttttcttcatttttttgcagtggtgtattttcggactatgctgagttttgtttcaagacatatggcgatcgagtcaagaactggtttacgtttaatgagccaaggatagtagcagcacttggccatgatacagggacagacccacctaaccgatgcaccaagtgtgctgccggtgggaactcagcaacagagccatatattgttgctcataatatcatcttatctcatgctactgcagttgatagataccgtaacaagttccaggtattttctttctactaaagaataaagaaacagaaacagttagattgactctttcgttgttagtaacatggcaatttatatctcttcaacagttaaaccaacctgtttggattaatttagggtggtttataatgcatacctgctcaaaatgatagtctgtactcacgtctttaccatccgatgggcaacagttatcatcgaaattgatcccacatgctaattttcaacataaagcctttactatggtcaaaatgcatcatcttctttttcctcttcctttaataccgcagatgagtcatgagtgcattattgtactctttactccctccgtcccaaagtatagcaagtttgaacccttggcacggttattaagggaaggggtaaaaagacttgtttgccttctcagggtgggtggggtgtgggcctggactagttgagatgataatgaagctaaggggtagtgtggctagtttagtggtaaaaatcaccttttacaagtactaggttgcagcaatatttgggacaaaatttgaactctaaaagttagattttgggacggagtagtattctattaagctagcttattttaatgacattttgtatgggacatgcaaaatacaatggcagtattgataacaggtcacaaaagcgcaaacacatcttcttgcaaaatatattttccgcacagtctaatgatgttgtaatgatttgtctacaatatttctcactagtaattcaaaggggattgtttatggctgcaaattcagaatatttgtttgcctagtcttgtgaatcatgcatgccaatgaaattggtgaaagtagtttgctgtaataaatgtggccagaacagttgtgcccgaactatctgcattttgggacaatgcaatagcatatgtattttttaagcaaaagtaccacatgtatttcttagtgaaagtagttctaggagcatgccatatatgtcacatatattgcttgtcatgtaaggtcatattattcaatcataatagaatatatgtttaaacatttaggcaagtcagaaaggcaagatcggaatagttctcgattttaattggtatgaacctctaactaactcaactgaagaccaagcagcagctcaaagagccagagacttccatgttggttggtaagaccatagaagtaacatgtgacaaagttaaaggttttgtttgatacaatttccgatgctgataaaaatcaactacttcaattcaggtttcttgatccgttaataaatggacaatatccaaaaaatatgcgagatattgtgaaagaaagattacctactttcacgcctgaacaagctaagctagtcaagggctccgcagattattttgggatcaatcaatatactgctaactacatggagaccaaccagcacctcagcaagcagcaactagctagtcatctgattggcatgtttcatttatctgtaagttcccaacttataattaaggattatataatataa

SEQ ID NO: 23263 - DNA, 1167 bp, Oryza sativa
aaatcaactacttcaattcaggtttcttgatccgttaataaatggacaatatccaaaaaatatgcgagatattgtgaaagaaagattacctactttcacgcctgaacaagctaagctagtcaagggctccgcagattattttgggatcaatcaatatactgctaactacatggcagaccaaccagcacctcagcaagcagcaactagctactcatctgattggcatgtttcatttatctgtaagttcccaacttataattaaggattatataatataaaccaatagagtactcaagatatcattaaatttatccttttctacttaattttacagttcaacgaaatggcgtaccaattggacagcaggtatagttgtttcctcttgccacattcaattttagtttcttatcaatgctacaagattagcaagtgtggctaagacgagaatctcttaccatgcattatttcgtgcaggcaaactctaattggctttatatcgttccgactggcatgtatggagctgtgaactacataaaggagaagtataataatccaacaatcatcatatctgaaaatggtattttcaaactacctatctagttttaattcaaaattttccatgcatttctcaaaaaaatttatggtcatggtaccaggaatggatcaatctggaaatctcactcgtgaagagttcctgcatgacaccgaaaggattgagttctacaagaactacctcactgaactgaagaaagccatcgacgatggtgcaaatgtggttgcgtacttcgcatggtctcttctcgataacttcgagtggctgtcaggttacacatcaaagttcggcattgtctatgttgatttcactactctcaaacggtaccccaaggactcagccaactggttcaagaacatgctgcaggcatcagggcctggctcaaaatctggttcaggcacttcagattctcaagttggttcagcaacttcagcaagccatccagttggttcagccatctcaagtagccatcggctcttgcttccctgttggtttccttgcattttcttttcccttccttcttcatgtttttatccctgtagaagtagcaatttagcagtgattaataagtagtggatgccagcagtatgttcgctttaaaaaatgtgctgcag

SEQ ID NO: 23264 - DNA, 36593 bp, Oryza sativa
tgacaccccaccccctaaattttttgtttaagtacgtgaacctacataagtgcaggatgtagggaaatacatatctccacgccaatcattggatttataggtatgtaatgtgcattctttgccaatgattagagagctccatcatcagtgtcaaagtgataaaccatatctaactgtcgggaaacttgtaggaatataggaggatagtaaggtaaattaaacttctctcttggatcagttgagacttgagagtagggcaaacctagacacaagaggcaactcaacagggatgagtggcccgaacaagcagcctttttttcttccacttataaacttttttttgaaagatttttgtccacttatctcagttctagtcactccctcctaaattttactatcttcttttcaaaatataagaaaaattttccccgttaaccattacttaggtaaaatccattatattctctgatggacgtagtacatataatataaaaaataaattaatactattaagcagatttctatactggtaatgtatttgttcacttgcatccatgtaaaaaggacacaaatattagggaatgatctaatatcaaataattagaagggtgaggtttcgaatacagatcgtctagcccaccaccttgtgaagctagccggaaaactccggggcgtttctctacatccctgtaaattaatcaacgcctggtagatcaaacacatttacgagtgggagaggacagaggaacaagacggtaaatgtgatcgcgctatttattgggtacattgatcccatctatcgattgtaatcagatgactgtggcctcatcgtttcgcctcatcgtttcgcttatacttatacttatcagtcaaaacttaaattttcaaccttaaatttaaaactgattttgaggttttttcattgaagtttatttttcagtctttgcttttaaatcactaagaacacgtatataaaagttttattcacaaattacttttttatttacaaatataccgtttcgcttttcgtttccacaatttgttgcggcggattccatatttccacggacccacgttgttgacagatgggtattctcctctccagggtcaaacaccgtaccggcgtaccacacaccacgaaccccgtttatctactacttccaccatctcattttaagtgtagccatgattttccgtgcacaattttgaccgtccatcttatttaaaaaatttgtaaaaaaaatttaaaaacataagtactatttatattttatcatctcataacaataaaattataaattataaaaatattttaaataagatggataattaaagttggataccaaaacttatggttatactccctccggttccataataattgacgttttggataaggttgaggtcaaacttttataactttgaccattaataactttaaaaatatttagtttgaagaaactagaacaacatatatagatttgtcttttaaagcactataataaaagtaaacatgcatttatttattatatatatattaataaaaaaagatcaaaaatatattttatagtccgtgacattgtttaaaacgttactacctccatcccaaaatgtagctatttctagcacagtactttgtcccaaaatgaagctatttttctacctaccttctcctctcaaccaatcacaaccattctttttcacctactttctcttttcaaccaatcgcacacattcttcaatcattctcacttactttcttaatacccgtgccaacctcaaaaatacttacattttgggacgggggaagtaattaaagagtaaagtctatcaccggtccctaaacttatatcgttgtgtcatcccggtccctaaactcgcaaatcgaccgttcaagtccttaaaattgttcaactgtgtcatcccggtccttaaacttgcagatcactcgtttaggtcctccaacttgttcagctgtgtcactccggtccctaaacttggatttgaatatcatctgggtcaaataggacggtctaaatattttatatttaaaaataattcataactttttcatgtgaactctaatgaagataaactttatatcaaacttgtagcccgcgacacgatctacaactttgtagttgaatttttttttattttaagtcatttttttcccaaaatgtaattttaaaattaaaattacaaaatctataaatatgcaataatattttgggaccctaaacagttttaattcaaaaacttttcaactacaaagttgtaggtcgcgtcgagagctacaattttgatataaagtttgtcttcattagagttaacatgaaaaagttatgaattattttttgatataaagtttttagaccgtcctgtttagggaccggggtgacataactgaacaagttggaggacctaaacgagtgatctgtatgtttagagaccggaatgataccgtcgaacaagtttgaggacctaaacggtcgatttgcaagtttagggatcagaatgacatagtggtataagtttagagaccggtgatgaattttactcttaattaaaatgaaaccgaagcgagtactatttaaaatgtgacggaggggcagtactccagtacatgcacagagccacagattccacggaaaaggtggcgccaccgccacctaacctggccgacaggcgtgaactggccatcatttcccggcccccaccctgccccggcacatcacgcgcccccacgcgattatcactcgcacccatctcatcaccgagtcaccggcaccggtcgcggacgcgtcgatcggtcccgaatactccctccgtaaaaaaaaaataaataaataaatcctggtttccgtgtccaattttaactgtccgtcttatataaaatttttttataatttgtatttttattattgttagatgataaaatataattaatattttatacgtgacttgtctttttaaatttttttataattttttcaaataagacggacagtcaaacattagatacggaaaccaggttttgtcttttttttttttttcgaacggagggactcggccgcgcgcgcactgccaaacctccccacgtctccgataggggagacgagacgagattccatcgcgcgctcgcgacgctccgctccccggtgcccggtccccatcaccgacaatcattgagacacgcacatgcagctaccgctgcagcgctgctatatactcccaatagttggccactgtgcgtgcgtggctgcgtgtgcttgcgctactgcttggtctcactgtgtgaacaactgctgccgccgcctgccggcggtgtgctccggccgcgcgcggtcgtgatggctgcacggcgagcgaactgcgcgctggtgctggtgctggcgctcgcgctgttggcggcgcgggatgctggtgccgcggcggtgcccaagcccaactggctgggcgggctgagccgcgccgcgttccccaagcggttcgtgttcgggacggccacgtccgcgtaccaggtcgagggcatggcggcgtccggcggccgcgggccgtccatctgggacgccttcgcgcacaccccgggtaaaactgcgattagtcgcttgctctactctacttttgctgtcactcagttttaactctgcttcttggcttcgaaactgtgattttcttttttccaaaccgctatggcagtttcggtattcaattacttacagttgcagtacaatacactacttagtgcccaaaaatatatatttcacaaatcacaactgttagtctactatacagcggccccgtttggatccggagggctattaaatagccctccggaatcttgctatttaaaagtattaaacgtaggttaatgacaaaacccattctataacccctaggctattttgcgagacgaatctaacgaggtatattaatccatgatttgctacagtaatgctacagcaatcagccgctaattatggattaatatacatcattagaatcgtctcgcaaaatagactaggggttatggaatcggttttatcggtaatctacgtttaataatcctaaatagcaagatttggaagggctatttaatagctcggaggatccaaacaaggccagcatctgagtaaagtactcaactcaacagccactagatgacagaatggtgacatacggctaaatgattatgacatttgtgaacgacagtgctacaattaagacacagcttgctagaattatgtgccaaattggaatgttgaacagcgaccaattcgatgtggaacgttgaccaatatctgtgcatctttatccttatatactccactacagtggtagctgaatactacttgagttttagtttaaactgacattcttgtagatcttgagccgtcaatcatgtgaattgtgatcaacttgtcaagctcacccataataatatattttttttattttacatttcaatgaacaggaaatgttgcaggaaatcagaatggagatgttgcgacagatcaatatcatcgctataaggtactagtccacagggtttacattaccgtcggtaaccgcgtggttaccgcggttactggccttaccgcggggtacggtaatagaaaaaccacgataacctccttaaattcaaataaatttaaaaaataatttaattttttgataaattttgcacggtttcgtacggtttttcacgattacagcggttaccgcacggtaaccgtgcttaccgccagggcacggtaaacccggccccggcggtttgggaaaccctgctagtacatcacaaagtcctctgcgttggtatgcctggcactaggcataactggttttttttattccatccggtcataaaaagtttgaccaaaccttatcctaaacgtcaaatattttttatcgaatggataaaccaaccatgcaacttttgaaaaaaaaagtagttttgtttggagtcctctagctaatttggtgcttttcctacttttacttccttttggggaggatggggctggggttgtatcttcctttggtaaatagaaagggcatgtgtgcccagatttgtctttcatcagataattgctcccccagatttgctaagtaaatgaaacttctgtacttcaagataacactacagatcacaaaacagctggtataatggcacatctctatgcattaataactgtaaatgctctaaaatatgcgtgtccaaggtcttacattacatgtaagtgtttccattctccattatctaaaaaaaaagtgtatccattctggaacaggaagatgttaatctcatgaaaagtttgaattttgatgcctaccggttttcaatctcatggtccaggatcttcccaggtacattgagtctgactcagattgtagcatgttgccctgataccctgcatcattttttttaatgacaatttgttactgccaaatatgcgcctttggtgtacctagatggtgagggacgagttaaccaagaaggcgtagcatattacaacaatcttataaactaccttctgcagaaaggtaccgcttgatctcatacttgaatcccctgcaaaagaaaaagatctcatacttgaaactttcaaacttccatggaaactgagtgctgtataactaaatatttccttcaaaccaagcaggtatcactccttatgtcaatctttaccactacgatctccctcttgcgcttgagaagaagtacggaggctggttgaatgcaaaaatggcgtaagtcaaattagtaatttatcctagctttttgtctgttaatctattagaactctcgtcatttgttggttattgacttattttagacttggttttaaacatagaagcacacatgataagtatgaatgcttgggacaaaattatcagtttcttaacacaaaaattcctgactaaaattggctccaattctagacaaatgacaattattatgaacgtgaaagttctattgttctgtcaaaagaaagctgcactgcattatgattattggtacctgttgtctagctaaatgcagcatcctgtatctctggcatcactagctgtataagtaacactctgaagtctggattatcttcatactacttgttctgtagggatctattcacggagtacgcggacttctgtttcaagacctttggcaatcgtgtcaagcactggtttacatttaatgagccaaggatagtagcacttcttggttatgaccaaggaacaaatcctcctaaaaggtgcacaaaatgcgctgctggtgggaactcagcaacagaaccatacattgttgctcataattttctcttatcacatgctgcagctgttgcaagataccggactaagtatcaggtattttttctcgacttgttttttagataatttaagctttattgaactcagtcaattacatcaaagtgatacaatcatactaagaacacttctgacctctgcacaacaaagatgcacacaaccaaaacacccacccacatactagtttgaaaagaaagaaaaaaaacagacaattaagggccaactgtttttttttaacggatatctcctactggccagtctaaatttgggaaatataatttcaaaaatgtaggcagctcagcaaggcaaagttggaatagttctggacttcaattggtatgaagctctttccaactcaactgaagaccaagcagcggctcaaagagccagggacttccacattggttggtaagaccataaagaatatcctctcagaaagcctattttttttagataatggaagctttattaatctcagtaaattctatcgagcttcattgaaaaagaattatcattgttaggattgctaacggttgcaatggtccaggtatcttgatccattgataaatggacattacccgcagataatgcaagatcttgtgaaagataggctgcccaagttcactcctgaacaagctagattggtcaagggctcggctgactatattggcatcaaccaatacacagctagctacatgaagggccagcaattgatgcagcagacaccgacgagttactcagccgattggcaggttacctatgtttgtgagttccttgcctcgcctcgccttgcgcttgtacatcagtatcgttgctagacatattctcctaaatattttatcccctaaattctgcagttgcgaaaaacggcaaaccaattggaccacaggtatgcagtaatcagttgtatccttctccagcttcagattcttctagcactgcattctactgacgtgaccaaactgataaattcagaagtaacataactcataaaacctttgttgatccatcgatctttacaggcaaattctaattggctttacatcgtgccatgggggatgtacggatgtgtgaactacatcaagcagaagtacgggaatccgacagtcgtcataactgaaaacggtagctctgaacttctcccatatccctccattcgattttccgctccatattgcacaatctgcgtgtaatccagaagtgatgaacatatcaacatattccatcttgtcatcaggaatggatcaacctgcgaacctcagccgcgaccagtacttgcgcgacaccacgagggttcatttctacaggagctacctcacccagctgaagaaggccatcgacgagggcgccaatgtggctggctacttcgcctggtctctcctggacaacttcgagtggctgtcaggttacacgtccaagtttggtatcgtctacgtcgacttcaacacgctcgagcgccaccccaaggcgtcggcctactggttcagggacatgctaaagcactgagaatgaaagacacgcagactgaagttgaagttgccatccattgatcatcatgttcagttctaggctgccgcttggatggcatcagagctggctatgaactatgtgatggaaataaaaggactgcaaattgattcgattatgcaattcgtgtctatgatcagaattgtggccgtctagtgaacttgtagaagtgtactcttgatgtgtgatcgatcttgagtaatcaatgtttgatcagatttcgccttataatttattagttgatgagatttggcttggtgattttataggaaactgttgtttgaagcgataggtttttgtattaaaaaaaaaggagttatttagccagttttctatgcaaaaattgaactgatctagcagcaacccaaaattaggcagagcgagtcctaaactacaagcgaaacaagctcattccgcggcaaacgcattgtggggcctcagcaagaaccacgtcgcagcatgcacgaaccgagcacgcgccattgtgcatgccagcctcgaccacacacgtacgcccgcgatcgcaagcacaccaccgcgccatcgcccgcgccgtacgttgccatcgcagcaccgccatggccacggcgcccgtcaagatcgtcgtcctcgccgccgcggtgtccgcggcggtggcgctcagcttcttctaccggttcaggtgcgtccacctgccgacgccgtacgtggccggcggcgggcggcggctgatcgtggtgtcgaaccagcaggaggtcggcgaggagatggacctcgcagacggcaacgtgcagctgctctgccacgggtacggcgagcacgaccacagccggtcggtgtggtcggcgcgcgccgacatccccggcggcgcggcggcgcgcctgtcgctgcccgccgtgcgcggcgacgaggtgttcgaggtgctgtgctcctaccgcggcgccaaccggtgctgggcgcacggcgtgcgcgtgttcgccaacccgggccacgacaacctcttctgctcggagcacgccggcggctgcgaggtgcggttccgcaaggacggcggcgtcgagaagcagtacggctccacctccacgccgctgatattcatgggcttcgtgccggacttcgacaacgccagggacggcgcctgcgcgtcgtcgagctgcgtcggcaggacgatcaacagggtgatcggccaggagagctgctgcgacgattcctgtgggggttgggagaaggcatcgcccaagaaatcatcatgaatccatccatgcaacacatgtagatcagtcggtaattacctgactttttgtatcatgtagatgtaatctaatcatacattaatggataggtaaaaaggacacctgaattgagtctcaatccaatgcaatcttggtacatgacaattcggtaatactagcgttctcttttctttaagaactgacgaacaaaacatagggcttcttttgaagtactccaaaaataaatagtctgtcaaaattcagaacttgtggcagttgcgttcctcagtacatcagcataggcaagggaataataggatctttaatcagagtcttcatagacgccctcatcatcagaaagctcatcaaaagaacgaatgtccagctgatagcgcaagatgccaccgatgccaccaaaacctctgcaaaactgtgacccctcctgggatttgttggtaacgaactcaagtgtgcatccgaactttttgtactcgttagcaaaccactccagaagggatgttttgtcctgaacttctaactcagcattggttgatgtgtcgcggaaattgctctgatcagcttcttgctctttgttcagatgttttattgcagtttctccagtagcactgttcttaagcacatatctgttgacatcaaggttttcccacactatcaatgtctcaacagcacccatttcaagagtcttaagggtgtcatcaacgccaaaaacgtacttcccggtatcttgactaatctcttcaaagtacttcccaatcaactttttctcctgtatgaacttcacattcgctagaatttcagctgataactcaatggcttggttgaaaccattttcaccaccataggaaacatcaacaacattaagtatcttggcttgaagacgctgatcaaacatgtcagattgactcagttctgtcttaaaatcagcagaaccagccaaaattagtccagaaacattaggctgactggtagctggattgatgaagaactgagtagcaagttcagccgtctttcggacatagttatgacgcttttccatccgaagccgagcaaaacgcagagcagattgccctcctcttccatgtttctttgggagatctacagtgaatttgtgaaggatctcacgagtattgccactcagtgtgccgaaaagagttccattaccatccataacaataaagccaaacttgtcatcggattccaagagctcattcaaagcttcggtgtggaatttgttgtcacagagatacaacgatgcattgatgggcttgaatggttcaaaatcaatagtgactttcttttccttgccatcttcagtaacaattgttcctgtgtagaggacgagtccatttggcggaaccttgttgtacagcttcagcctctgttgagctgatgtgatggctgccaaaacagattgtcgattgactctactcttgatgtttgaagcagtaccatattcatcacccagcatcttggtcacacgggagacttgatcacgtgggggcataatcagagagatcatgcttgtgccattgcctctagcagactccagtgccttgatcaacttcttaatcttccaaatctcaatattcttgtcagtttcttgaccatctgacatcttgacaaaattaggatgcttgattcacctgcagaataccaaattcaaatattagtaacaaacccgagagacagaattcagagctgtcaaatacaaggaaataacaaaaaaaaaaggttgatgaattttttttagactagaatacactatctagtgtctagtaaactgatcgtagctgctcccttacaaaacaagagtgctctatccaacgtcatccaagacaaagctattagcttatgaaagttgccacgcaataattcttaacactacaagcgttaaatccaatctgcaatttgtatcaatttttgtgtataatataaatgtagtttgtatttaagtggacataagccacggcaacaagccatggacaatcatacatgactacatgactggcctataaggccataacatgtgctgcttcttcacaagtgaagcatttacgacatggtggttagagcaaccataaatccataggaatggtcgccaatgacttgtgctcacaagaaataagaggaaaaccagttccttaaataaagaataggaaaaatttaaaatcagaactatccatactaactgagttactaggtttaacacaaagaaaataaacaatcatatcaaaatgtggtctgcagcaatcatttacttctagctgaaatagaacagaaaaatcattggtggtagtctctatatttataccaacatataatacagaaacaaaactctctccatacttggatggccattttggaacataggagtaagtcataaacaatcatttctaggtcaattgcatagtatggtaaacacaaaaccaagagttctgggtagacagaaccagaacaaggctgagggtcatccaaataggtttagcgactcaaaccacaattttgtcaggtcacgtcctgtgtcccttactcagttcctagtgatcatgagttgtttggtcatttcatattccgtaccaaaatgggcctttctagttctagtttgcaagcaacatggattagatttttggctggtaaagaattactcatcaaagttaaacctagcacatcaagctattatcaaagaattggaactttagtcaaccaatttagcttgaaaaggacagtaaggacaccatccaaaatggttagtgctgatgatgctaattggacatttgggacaattacaaatcagtggcggatctaacatgggacatggggtttcagttaaacccccaaacttcttgcgaaccatcaagctgttattagtactaaggttgagttaaatttctagaacagaagctagggttaacgcaaattcgagaaaaagtgcgtgggtagagagagagagatgggaaagaggacgtgcgtaacggatgcggcggaagcagcaggaggaacgacggcgaccctatgcgctcgctcgcgcgatggatggggatcgacgcaggcggcggtggcggaggatgtgctcaccaggatggatgcggcggaagcagcaggacgaacgattgcggccttcttcgctcgcgggatggatggggatcggcggaggcacagggggcgggggcgggggcgggggcggcggtgggcaagggcaaactgacgaggggtcagggtaactcacgcacgacagaagagtcaaaatggcgagggtaacttagtaatttctcgcatcaattcacccggattgcacacccatcccatctccaacctagctagacggtcgaaatctgaaaaatgaaaataatatccattcgtcctaatctcatttttcagatggagtctctagtttaacccttgagacggtagattttttttaatagaataagattgagatggtggataaataataaatatgtttggacattgtccaattaggcatggctcaccgaatgagtcgtgttgtgtcgatccacgtggtaaggctggagcctaggcatggtctagtgagatgtcgggttatgttgtgttggcctggcacaattagggtacatgtgttatgtggagaccgcttagcccaaatttgatatataccgagaaaaagaatacgaacagaggctattacatcctactgcacaaactccgatgaagctctagtgaggtcctccgctcaccgatagcatattcctcttcctcctcatcaagcactgtcgtggcccttcactttctacttccttcacaccgagctagtgaacgcctaatgaccaacatgcttagcggttgtgctcacaaatgtggttggccacgccaccacattgtcatgtaggcttacatcgatgagcgtctaccactgcttcctctgcctcgagcccctagcttcttctattcttacattctcctttcttcctagctcctgctcggatggcattatggtagtttctcaattggcggttgttcgccagtcgtcggtcatcatcgtgccgcatggaccatgccatgtcgtgctattcctgggccatgtcgtgctgtctcactacatgcatttgtcatgtaggcatgtcgagccagatagcaatccaagcatggtgtggctagacgggtcgtgccaacgcaacccatacccaaacagatcgtgcgattcctggactgtaaacggcacatgcgtgcctgggcggataagaaaagacctagcccatttgacaacctataggaggatttagcaaactcatagtcgttcctctgtttcttcggatgaaatcaagtaagacaactcagacactccaaaataatttgattagtgttaaattaaagggaactttaaatttttaaaaagatattcccttccatgatagcgattacactccaaccaacactaaacttacatgaggttggatcaaatcgaaccgagctgcaagggagcggagacggagcgggagcgggagcgggagacggagcaagggttttacctagaggtagggtgtgcgagggaagataactatctaggcaggtagacggctctcgtctgacgttccccttcggctacctctagggctgcaaagagagccatattcttccactactacactgcaagtggaataataccaataataacgggacaaaaggaagtggaatggactagtgtctagtggtggcaatggttagatacttttcgattgcagaaattttacagctttaaatctaatttctctaaaattcttcgttccaaaataagtgataacccaaagatggatctccagtatccataacagccgaaagatatgagaccagaagcaaacataagtatccacttcacaagtcagattgtcacaacttctgctacatactctatgtgtctaaaaaaacaatttaggctaggcaagaatgagacatagcatagcataatgaatctggacatgatattattcagatttgttgtattaggtatatcctttcattgtctaggtttttttttttatcggagggagtactttgttcgccgacctgcgaacttgggttctatcacagccacaaatccaacatatgccggtggagaatggaggctgactagccccgtgcaaaagtgcattgcgtagtcaacgtggatttgtggatcgcaatcgttcctttccagcgacaaaacagcacaatttttgagctcacatcgcacccgtccacaatttttgagctcacgtcgcaatcgttcctttccagcgacaaaaacagcacaatactggattcgggtcaacgtggtaacgaaagatacattgatcataggccatagcggcggttcattgataatagcggtagcttatcggaaggtaggaattttacagcaatcggtgaaattatcgtcgagatgagatattcagatacacccatggtgcttgctgtagtacagagacggaaaatggaacaaaatatccagaaacggaaacaaaactgcaatacaaattagcatctataaaatgctttacatcgtctatggtctgctaaacattttcaatatgctgggttaataagcaatatatatctaacgcaactaccaaattgatcccaagtactggtcaaacatttgaccctatccctgcacttttctctacttcatctccaggtgtctggccaatacacattcagttccaactagcaaaatataccaaggtgaatgcaggactattcaccagagcttctaatatggctatagtttatcatcctaatacctctttcagactccccaggaggaaagctggttaatctggggcaaagtttgctccctcaactaactcaaaacttcagaaaatgatggtcatctgctattgaagctgccagtttgtgtccgggtaacataggagaggcgtgaagaaggaatcaaaggggcttcttcatcaacccctgcaccttctgacgccagacttccaacagtggtttcatcattagaatccatgaaattgtcaggcttgtatatgtttgaaatcttcttatcctgcaaaaagttgaacatttcaacagttatgtgacttgtaagtacaagaaaaatgagcaatcatttggttttgcctattatcaaagttacgccaagtaaagtattaaacaaaattggaagctccaatactatatttacgtggtatctgatttgttgacacgggagaaccaaacttcatggagtaataaaatgttgtggttaggtggacaacgcaacagccacccatatgatacaaattggaactgcaattgctatagtagtggaagctatggtactaaaaggtaaccatttttagacaataacttggtgttgtgtgacaacaacgcaatgcgtaatagcagttttttttatgcaaccgataacaagggcagagacaagcaaagaacaagataagaaagtcataactggaacaatattgtactataaagtagtgatacatcatacatgaaagatctctatggatgaacatgttcaagaggaagaccacaaagaatcaagatatctaaataaagtaagtgcagagaaagtcgtactctgaccttcgtagctctgtcaggagcgatatcagctggaagttggttcgctctgacatctttcatcttcaaataattgtacatgacaacgccagagagagctacacattaaagcaatactaattaagaaggttaatcacaaacaacatatttgaaataaaagtataagcaaatttcacaagccccggatttatgtccctttgtaactcaaaagaacatgttagtatgttacacatgttaacataaccccatgtttatgctatgcaatggaacacaaaaccacaggttaagattatagatatagattctacttctagagaaaattgaatggataattaccaacagcatatccaattatattgaggcttgtaataatagattcaggaaagataatggttgagagggcaatgagtatccagtccttcagaactcctgcgactcggatggtgactgctcctgttcttccaataactagaaagatggatatgttcaatgcaaatgcagcaactgcattaaagaaaaatatccagtagttgaactgaatttgagaaacatccatttctggcttttcaagtaaaaaccaaggaacaaacaggaagatgaaactgcaaaacagaagaatacatataagaaattgcagagagtaaaatggcacaaacattttagtgacatatagaatatgcaaagcttagttgtatggagacaaaaacagtgcataataatcacagaggctacagaagaaaaaccagtgagtgcaaaagttgaggcagcaaatggttgttcctaagtcctaacaaactactttctgcttctcaacaagaaaccacacatataagtcttacagacagatgccataaacctctcgaatgctcttgttgcctaatacatgcaatctaatacgacgaatatacatttcaaatctgttcttttatttattcattcaaacaactgaggttagaaactactacaaatgaagaacagtgttctcttcataaatgtcataggaaaaccaattgtgttataagttttagtgatttttatttacatgtgtacattacaacagcacttgcacaataaagtagcactagcaccatttggttgtacatattatataaatccaagtcattaatatcactaatggaacctcaagaaaatggcagtttacatgttttttataagagcaaactaaaaaattctctttgtttttcgtacaagtattctgtaagactttaagagagaagtcgttatttcattcaacggtagttggttgaaatcatatcaagcaagcaaacttttcagatatagttgcaatacctgcaaggggctatataatataggcttgtgatagggtttagagttaaccccttcttttgaaggaggacctgtgtcagaaccagcctgagggcttccgcaaaaatgcctgttacttggtataatgttcctatgatattaaaatgaatctcgccatatgatgaaactacgacaccaacactgaccaagaccatgttcaagaaaagatcccatcttaatttgtcagtaccacatagaacagccattataaatgttgccacaggcactgcattacaaagtaacacaaatcagtaccagaaatgataaattgatttacagggagtttcatggtaactcactcaaggccttgagcatctgaatgaaggcgactgaaatatacaagtatgctgtgtttccaaacctgtaaaaataatcaaatcaattaaagtattgttagaattttatgcaagggaaactcattcttcatacacatgattcaagataactttacaggagaagtagcaaatttccaaatattcatatacagtaaatgctgtatgggggttaataaaggaaactaatagtatagttcacatactgagataagatactactgtccggtattaacaaaaatagagtttgcatactgtgccccatttgcaaaaataaccaaagtattagaacacattatacacatacagagcatgcatttgttaattcacatcgcaattacacataatacacaaaccattctattcaagttatggtatacatggcaaatagtacacacagaacagctaggtttgaaaacaatctcaatagcaaaaactttatcaattcaaagcaatcaatcaggtcatcataaaatatcaaaactgcaagtatcatgccatttgtgtaatgttgatagtcagctttagatcaatgcatttaacattttaggcctacatatatcacatacatgagtgcatatgctttcaaagccatgctttctcatacaggagataataaagaagtgatcgaggaaaaaaatgaaatgaaagatggttccatatcttgtctatgtttagcttaccaaagacttgacgcgaagaaggcactaattggaatcacacatgtggcatatctgcattaagtgaaagaaatgactaagaatcaaattccacacagtgaatgacaaagttaagtgctcttacatttggaatgtcatcttgactggtgcaacgacctgcatcaccaacatagcaagatgactccattagctcttacaggaaaaaccaaatgacagcaccagacaaactacaaacttaaagcttcaatacagaaactaccttgcctattcttgcataagaacagtttctattcgacaatcaacactttgtatgccatttggttgaaagttacaacaagcaagtaatccagtgtgcatcgaacatggaaggaggtaataggaaaattggcacaaagaagcataccttaaacacacggacaaggaagaacgttacgactccagaaaacgccatgtgaatcattgtaagggtaataggaaagggaaatttgaagtactttggagaaagtacccactgcaaaaataggaaaaatgagagcattaagttcatagtcagcgtggcctctcataattaaacatctacttacatccaagcaagcatatagcaccgcaaaaaaaataatatgcaaagccccagatctgcattatcagcatccatcaccgacattcgtcaaatccgttacgctttgagcccacattatactacagatgacagtgtgctgtaccaaaaaccctgattcacctaacaaccctaaaatcctacagaaagcaaagcattgtaatagaccgtccaccaaactaacggatatagcaattaaagtagcactcactcatattgcagttctccaaaccacattagaagtgaagtcgttcaaggagcaaacactacacaaaagacactgcgaacaaaatggacctcagatcatcgcattcctcgatttcttctctagcccagagcaaacgcaaaaaagcaaaagcatacacgcaggtagagcgaatcgcaaccggcatttcgaaggaggagaagccctaccttgttgaacaggatgactcccgacgagaggcagacgtagattagcaggtagaggtaggtcagcacgagctgcctgctgatcatcatcgcccccgcctccggcgcccggttcacctcgcgttcctcctggggttcggttcactcccggggccaggcggcttcggcggccgcggcggagggccggtgcggcggcgagtcggcgcggcggtgggggaggagtggagtgggcgcgcgaaccatagatctgggacgcgtgcggcgcctctctcggattggaagattgggggaggaaggaaggaagggatcgagagggggagggggtcagggggaggactgaaatgagatggtgggagacctggcagggtcttttctgcaaaaagtgggattaattagcgcagtgctgtttcgggcccacatgtctgtcactgatccacgcgtttctaatttattgttttctgcttgactatgcggtggttaggatttagggggataattgtcgtggtttgcaggcctaaaaaattgcgtacgggtttggaattatttttgttttgttttgttttgctccctaccttttgcagcgtgcgatgataacactggatggagtaaaatttcataggttagagtgaatttcacgttgaactctatgtattttgttaccataagtctcaaaatatgaaccgtttaactcatattttcaatttaggccctcctttttttcactttgatttttttttctcaacattgttttcatctagtagacgatgatgattttggcatggcggtggaaacaagagaagaaatgtatccaatttgaaactaaaaggtaagaaaattagatccattgtaaaaaaaatggaataaagggaatccaaggtttcttttaactaaagaaggtcgaaggtgaaatctactctaatttaaatatgcgtgtataagactatcatgacgaaactatataatactccctccatgcacaaaagttacacatattactattgtcacaaagaccaaggagaaattaaattacctttgatgttataaaatcaaagagtgaatgcaagcatgtaatcaatgagtatttagatgactccttggattctaataaaacatttaatttatctcttcatctaagtcttgaatgcatagagactacaaataggaataacttatttggaaaaagtcaaatatgaaataggtctaacttttgtggatggagggagtaccaaataatggattgagcaattaatatttaagtgcccatattcaaccaattttatcatatttttatgggaacataaaactaatacataaaatttctaaaataagtagattttctgtaaatcgattttaagtctataatttgtaatcttatggcttatacatctttagtctgcgaaaagtattttaccttaaaagtttgtgacaaaatcgataaaattttaccaaagtataagcagtttgctatattgttataacttatcccttaagacacgacaacccattttgccaataaacacaagacgcaaagacgtgccaactccacagttgatagtccagatcaaaagttttcagagcacatcatcttccacgtggaaaatccacacatgacaacgccatcaggagatggaagaacatgatttttttttccactgtccgtcaacaatagagtatgtgtcacactgactggactagatactctctgtttcggggtgagaggttgggaacctctcaacgtgcatgtaaaaccagtagcgtagctagaatttaaagtaaatgtggtccatttatatgtaatatgttaattaaaatagtggtcaactatacaatttttattatattaactagcacatatactataattttaaatttttaggtggtccatggaccacgatgccacctagctggctacgccactatgtaaaacaggttacttattaacataacatatgattagttaggtgttatctgaaaaacttaaaatatatattaatataatttttataccaactttcatgtatattttttctaaaaaacacgttatttagtagttcggaaagatatgcacgcgaaaaacaatggaataatggttgggaaatgggaagactcccaacactatcatctggccgagttcggttaccacctctccccaacctttacttcctcattttccgtttacacatttttctaaactgctaaacggagtgttttttttaagtttttttgaaagttattttaaaaatcatgttaatattttattttattttatttaactagtgtttaatttatcaataataaacacttcattttatgagtggggaggtggagtttcaacctccgccctctaacaatagaccagtcggcagagcaactcaccccatttccccttgtaattttcaggtccattctgtactgtagtctgttataaaactagccccaaaatcgacatcggtagctaaacgtggaagaaaacgccataggagatccaaaacgatagcgacaccgaggcacgatatttggtaacggagttcagccgtagcctacatctccggggcactgattacgggcactcctccccgatccagcatatacaacgtatcagagttacaacgactcacggccggtcgccgccggcagccgctccctctcgctatgctaagtcaccatgcggttacaacaggcacggccctctatttatgagagaacctaggatagagtccgactcatactctagtcctaatacctattacaactccaagtcctaaactgtaatcgactatgtacacatattcaacacaaactctaacacagtctgcaggctacagccacacactctggatttggttagtctttgtccttactactagtatgactgaagatattctatatatctatgcttaaggccataataatatatcacttcttcgccgttagctagctaatctacatagactaagtagtgtggtcgttgtcaaacattaattaatcttgtagtcaaaatgtctactttatacaacgtacccaacggagaacggaccatcgagcatcgaatgagggggtgtttgaaccggtagaacatccaaaagagaatctattacgctagagcccttttccgccctcactaggaagttggaacacagaaatttcatgataattttataggatttttatcataatgaattctcgtatttagaggaggccaaagaaagaaccatatgaattattatattaatatatttcaaataggcccaaaaaaataaagcaaattaagagcctaaggttctcttgggagctgggaggtcgcaggtttcatcttttccttaatgtcatagtcatagcactgaacatggtattgtctctaagttgtgattcgtcgacaaaatatgagcagaaacgccggagagaagagagtgagttgcctccccgtgaacaattgaattaagcaagcaaatcaagaaagattattgaccgtccattcaattaataacacataaatcatccaacaaaaagtatttcgaggtaccgatacgttacggtaccaaattgttttcgatcattaaatctaacaatgcacatctatccaattagatctaacgaacgggttacatgaccgaggattagactccatacacaattacacacaagttttccaactaccggaattcgaaccagagcgagagtgcagcagacttgcaaaactaaagaaatcactcctttttataataaaaaaaatcaagaaaaatcactcaaggagtgcaacaaaagtaagcagcagtgacgtcggaagcactggcctccgaatattttaccgtccgactccgactccgactcagaaagggcccaaccgttccacataagctaacgaccgggtaccgccacggcccactcacgtccccccgctctctcgtcgtgttcaagtcgcgagcgcgagtttctccgtaagctacaaggacttgacctgggaacccgcctaattgccactcattaatccttttcttttcctcggtcagtttagagtacggattagtagactgaatccactaacccctagcgctgttgcatattaacaagctcataaattcttagccccatacgcatagaaggagtagtgttgcacgctcgcaccggtgcacgttggtggatcgatcgatctccatggcggcgcttcaccaccaccaccaccaccacagccaccagatcaaggcgccggcgccgacttggctcatcgtgaaggctaccccgccgccgagggacggggccaagaagctggccgcggcggcgtactcgccgctcctgctgtcgccgtccgtgtggcagaaggcgcaggacgccaagaagggcaaggcggacggcggcgacggcgccctcccggcgtcaccgaggatcacctgcatggggcaggtcaaggggaggccgaggagatgctcgggcgcgcgccgcggcgaccgtccggccgcgagggccggtagctcgggtctactggagcggctcacgctggggctgttcgggcggcggcggagggggaggacgtcgtcgcgggcgtgctccaaggtcagggacgtgccgacctgctcgtcggcgcagtcgcgggggaagatttattgcggccgcggcggcgcggcggcggtgtgcacgcttgacccgccgttgccggtggtgatcaggcggcccgcggcggacgacgaagcgccgacgctctgggagaggcggcgcggcggcggcgggaaggccctggagactctccggttaacgtagatcgctggctcgctgcagagttgcgcttggcaaccgcagcccgccggtgagtatattgacagaggaggccaaagacaaggaggcaacggacgacttcagccgaaggctacggatgcggatgctaatttcctaaaaatttgtccataataccatgtatgtttacagtttaatcatttctttttgctaatttgtatagttgtatctacttgtatgttgatcctactgtccattttaaaagtcttgtctctacgatttggaagctcgcccctttttttctccccacatatcttctccatccccttcactaaggcatctcctcccaaggtctctaggacgctcccggtggctctgcctccgaaacactcacgtacttgctcccgccatatcagtcctaccatgggtaggatgttgggagcggcgggctgcaatctaagtgaatcattaagtgtattatcatctctgtcaattctttttctctatagtttctacaaatagattattttgctggtttgctgatttttcctacttcagatacaggaacaaaaaaaaaagaagagatatctttgtttccaaggagatgactgaatcgaacccttccaattgttgtatgggaacacatatttgatattcagactaattgtttcgtatgcttgctggattggcattgaattgttaataccatatcatcattcttgacaagtctttactcatgtgcagcactgacaacacatattcacagtatcaagtcgtccaaattagccatgataaggtacagcatagtttgatttgcatagctccttactgtcagcaaagttgttctattgaatttactttctttttagtgaacctgaaaacgtcgataaggggcaccagccaattgctgattaaatttttgcctttgtaaactcatattcagattttcaatgaatgattcatatcaacctatctggttttctgttattaccacaatatttatgaccattaattcacgatatatattggaaaactatctacttcgcgcttcagtttgacaaattcagaccttattatataagctataatgatgagtaataaagggcaagagctgaaattagcatttctatatcatactataatggaagcactaagaacatatcattcagctttgataataattagaaataaaaacatttgtctaagcgaaagatgttttaaggtgcaagaaagaacatacgcatcctcacaataattcgtcaatttaattcagcaagggacagtgcttctcacttattgagttgaaaaaaaatatatatctagaagtgctaaactcatgctggcctcatgtcaaaatggtgttagttcaatttcaattgttagctgagtcacacaggaggaagcaggctgctcaactcaagatggaggaaaccattcttttgtgcgtgtgacaaatatgtagattctataattagcctcttatttgatcctaccatgggtggaggagattcctatataaaaaacttcagtacagtcacagttgttggaaacagaggcacagctcttccgcaaaaatatgctgattgtggaattcacgaatttttgtttgtctgaatagtgcaaaagaacataaacgagataaaggaaccacttaatttcaaagccattgttaagtctgaacaatattattagtataactttcaatagaaggtcgattatatgttccaaataggacatggaactttgtcaaagagctttgaattgatgacgggttggctgaatactttagcactacatatacatgcaatctctaatgttgtactgattaatctttctacaaattcttgaaaattcaaaaagaaaagtgtcaattgctacttggtgtttttttagcaagcactcttttctgaaagatctacaacacaaaaaggggctctcattcatgaagaaagagcgggacgcactacccttgggttttactgcctctcgtagtcctgcctcaggaacttcaggtattctcctttctccacctccttagcgcatatttgatctgataatattgctgccttgctggtatatatcactgaagtatgtctcctcctacaggagaagaggctgctgcaaaacgtacggcagttccaggtccctctgcagcgttacatggtccttatggaggttcaggtgagctacatacttattgcagctaactaagcaaatatgtcatgttcttcttgtggatgatcagtttgaagaagagaaatgagtggattcactgacagcaagacaactacaacactgccgccaattatcttaaaccaacgatcaggtttaataagagtttctttgattttgagtgtaatagttgactgatttcatcttgcctttttcacttgcaagctcaactaatgctctttgttaaaaccatgtttgatatgtaatggtccacgtatacatgcttcttaaacagacatcttcagtcgcgcaaagtgcgaccgaagatgagatgccctgctctccagaatcaagattatcctgaaatcaactgaatcagactaatgagcatgtggcctttaccgtttggacagcaaaggcgccaatggcctcggtggcgagtgcctgcccgagtataattaactgtacaccattttgatctgttgagttaagtaccttctctaaagcatctaattatagtaatatttgttattaagatataaaagaaataccaaaactaattagtacaaataatatgcaaatacatttagaacacagtcagacatggatacatttagaactactcctttcgaactgataatattagtcgttttgaataaggataaagtcaaattttaaaatctttaactataaataatttctaaaatatttatgttaaaaatatggaaaccatatgtgtagattagttttaaaaagtacttcaataaaatcatatatttgttgatattcctatatatactaaatagaaaataattatcaaagctattttttttggataccgtgctcttgtaaaaaaggacaagtataatcaagccggagggagtagttctgtttgtacttcacttaacgtgaaggtgcgctaggccgccagttgggcctgtgctagctttcacaaaagaattaggcccaaaatctaaacaacgcccaccaacgggaacaagacggccgacgaagggaaccgattgaaaactatggctggctggctggctgcctgcctccttcgccgcataggactcgcagtcccggtggatccccaccgaattaactcccacgagcagccggtccccgcgtcatttacaagttcaccccggtagccgcccgaatggggaagagacaagcaatgccggccccgctacactcgggtcgtcgaatcagcgagaaaaatcgacacttgcactgtgtagaagcacacagttttgtgttttctggatagtaggagtatttttcgatctgaaccaaacaagcacataaccaaaacctcaaaacatgtgtagccaagttggctagctttcaccgagtacagtatataccctactacggatattggccgtctgaattgttcttcagctcattccaagacgtcaaatgctggacaaattcatcgatgcacctctcttcgcgctccctgtccgccacgatctcctgcagcttccgggcattggcgaagaacgtcttcccctcttcctccaccacgacggcgcggacggctccggcgacgccgcctcggtcgaacgacccgtcctcgtcgttcctcggcaccgccactccgagcttcctcccctcgagaatccgcgcgttcgggccttggtcgcctaagatcggcagcatgatcagcgggtgcccgaactggagcccctcgacgacggagccccacccgcagtgcgtcaggaacgcgcacacggcggcgtgcgccagtatgctcacctgaggagcccaccgcgtcgtgaccagcccgcgctcgccggtgcggcccaggaaccccgctggtaggacgctgtccgcgtcgacgccggcgggcttcctcatggcccagaggaagcgcgtcccggcgaggtccagcccgtgagccagctcgcgcagcaggtccgcgctcatcggcgcctcgcttcccagcgcgacgtagacgaccgacttggccggctgagcgtcgagccactgcatgattgcgtcgtgcttgccgttcttgctgacgccgcgggcgccgtccggccgtggcgggagcaggccgaacgggacgaccggcttgccgtagaacctcgtcaggatcgtgaacgcgccgggctccagctcggggcagctccgcattgcgacgagcttggacctctgcagcgtcaggctgtagcgggtcatgatggacacccccgaggcgccttccgtcgcgaactcctccgtggcgcgcttcgcctcgaagctcggcgccgccgtgcccatggaccggactatcgcctcgcgctggtccgcgctcgactcggttggcggagcagacgaggccacgacggctgcggagcaggggaggatcatggcgcacggcaccccgcgctcctgagatgccagagcgacccagtgatgcatgagatcggcgagaacccaatccggcctcttgccgccggcgcacgcggtgtcgaggaacgcggagaacggcgcggcgagcccgtcgaacgccttcctgtgaagctcgaacttgtcgaacgggacgtcgctggtggcctcggcgccgtcggggagcccgtcgacgcgcggcagtgggagcgccacgaggtcgacgagctctgccagctcggggcgaaccggcgggaggcgggcgaggttgcgcggggtggagacgaaggacacgcggtggccgcgcgcggcgaggcgctcggcgaggtcaaggcaggggagcaggtggccgaaggcgagccacgggaagatgacgacgtgcagcggcgactgcgaggaatgggcgtcgtccattttcggccggcgcgcaccggtcagcactcaggcgtcagcgtgtgtgtgagaagtttggctctgatgatccagtcatgagtgtatagggagtactccgtatgcaaatcgtgctagttaaaggggagaaaacgaggaaagattcccgaacgcgatgcgtattgtcgagcccagccgagtgcgaggcagccgggactactcatctcctccctccatctactacctccctcaaaaaaaaaaaaaacttttatccagattcattattttaggaggaaacccctccttagagcaggtataatagagtatgataagccagcgatacaagcatccatattatagaaatcataggtggaagagagagaaaaccggagagagaaggcagcgggcgccaatgcaatcgtcgagctccagcacaggaaacgatgcaaagtcctgagaaccagccctcagtcctagtcctagcttttgcccaatgactcaaccattactccatcatagcaagttcaatagtagagttaactgccggctctaaaattcaccacatcatttaagagataactaaaccccagtagatacatcaattggctacacccatgctttaaccaaggcatcctgtcaggtgttggtaacttctgcatgttcaagttctaattttctattggttgtcccgagctgcaaggggccagagtgcctaggcgcttgtgcttgagccagcgactggattgtcgtccgctttgctctctttgctttctctctctctatcatatatgttaaaatattagataagcaggctattagcccactattgtacctgctctcaaagattgggaagaaggaaacaagtctgattaaaataataaaaatcaactgcttagggatgtgtgggtaggtaacttagcagctagttattatacgtatcatctattggtaccatctattacttacgtgtacaaattttcagcccatcaacgggcgatactattaaacttgctcttagagcaggtacaatagcaggctattagccagctgtaaatatattttaataagataaaagatgagagaagagcagcgggctacagatctgtagccagctgtagcgcggactccaagacgcaatgtgtatatgacaggtgggaccatatattaatagtatagtaagtaactattgtatgaattaactactagattaactataaatgaattagagctagtgctggactatactattaaacttgctctaaattgagttattttggtatcaaaggagattttgactttctgagccgtgcaggtcgattacttgcttgtgtgggccggccatcggatgagcgcctcatccacgcgtcatgaatccgcgtcgggagtcgggactgcacgggctgctgtttggaattttttttatttataattttttttattaaaagttttacaaaaataattttccattttgaaaattgacggaagtagtcgcctaccgccgccctcccagagggcggcgaaaatgacgcggcagccggccgttcgctctcgggcgacggccgtcaacgaaatttgcaggcggcccccttgccgccctccgctagggcgattttatactgtgcggggggccgcctgcaaatgggcggcgagagggggcatggaattttgcaggcggcccccttgccgccctgggggagggcgattttatactgtgctctatatttttgtataaatatcaatagttatcaaatctttttatattgaaaactatacaagattaaaatctccaagactggtaaaatacaattttattattttttaggtcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgttgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggctaacccgtcctgcctgtacaggtgtgacctctggctgctctgagtgtgcgcctctggagctcctccaagctgagaggagcctacttccgtcaattttcaaaatggaaaattatttttgtaaaacttttaataaaaaaaattataaataaaaaaaattcctgctgtttgcaccccgtctgcaccagattttttttccgcagattggcagctgcggtagtgacatgtgggccctgggccgcacgttggttacggccgaggagttgcttcttcgggaccgaaacctatgtgcaatgggattttttttttcatttttagatttttttaaaatatttacagaaataatctatcggccaaaaaaattgtaaaactagaccctgccgcccatctctgaggcggcaagctgacgtggcaaacggggaaggaacgggcggtgacggagggagggtttttttgcaggaaagcccttgccaccctctgttgaggtggcaaggggcctgaatgcaaaaaaaccagtcggggccggtcattttgcaggcggccccttgccgccctttggccgggcggcaggcctcgctgcctataaaaggcatgctggccagccctcagccctcattcctcccccctcaaatccagtgaaaaaaaaagaagaaaggggaggagaagagaagaaggggcgaagccctgccggattcagacgccgatttcaggtaatattcatatatcctatatgtgactatagagttaaatattgtgtattttttaaaactttgtttgaataaatgcattatatttttagggttttatctgtactaatctagaagtgcgtattgtagatatcggtaactacgtagatctgctagtttggaatcaatactttaccgttgcattggcatacacaagaagatattacgttgtagatgtttattgcatgaaagagtaatatgatctagttatttcgttgacagatatgtcgaacaaacaaatattccaagtttaccatggcccaggaaacgtccgttacgggccaactggggtagatctgtcagattttattgtatcagaaaggggaattgatagaccggctgagaggagtgtaccttctataaaaggatggttaatgaggggcttgagagttgatccatagacaagtgacataacaatcaatgttatagtaagtcgggcaactgagggtttttattgggaactaatgccggttcaaaactctcaattgtggagatggtatgtggaaaatgcattgcaacgcgggtggcctctagctatggttccgtttgttcacccgaaggatccaggtgtgcagatgaacatggatgatggcgagggaccaagtgctgaagtaaatgagacttctgtggaggaggtcaacgcacgagaggacgggggcgtagtagctccagtgggcattcaaccaggtggagtggccgacgagggggaaactgtcggtgccattgtggatgaaatggagagggaggattctgacaacgagcgtgtagaggaaggtgattcgtcagatgatgagacggatattaatccagcagaatgggctagtgaggatttttctgggctggtcgtctctgaagaggatagtgtgagatgggagtacaaagaaaatgaggttatccagggagcgatttatagtagagcagaagatatgaaggaggcggtaaaacattttgtagtgtcacttcatagagagttttgggttgccaagtccaaccggtcgcaatatgaagttcggtgtgttaaggaaaaagatggttgtccctggagagtgcacgcgtataaggggaaatggaaggattattggatactgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctaggagctcttacgcagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgataggcacgctggcattctgcgagcgatagaagagttgcagtttgggagtatggaacgaggataccctggtgtttgggaagatgtacagagtaggtggtgaatgcatcatatgggagctaatttctttcttcaagcaattcaagaacaaggagctcatgaacatgttcaagaggctatgtaatcagaactaggagaaaaaaatcaatgagctttggaagagattagatgagttgacagccaaatgcagtgatcagcgtgcagcggctccatcgaccgccgttgctaaccctcctcaagctcttggacctctcccaacgaatagtccaacattggttagaagaactggattggagattcggaaattttctcagtagattatgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcagttattttagggatcggttccaagcagttcttccctctataccgaacaacagcattttgtttggaactttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaagccgacgacacatgtcattgctcttatgcaaagccgaagctgctccacaggccatgcacccatgtcattgctgccgcaacggagtgtggcataccagatgcagtatatgtgtcacagtactttaataagcaagcaatatatcatacatggagcggcgagatttatgggttcggcatagctggggagttcacagagactaacgatgaagtactcaatattcctgacccatcgaagctccgaggcaaggctggaaggaggaagactcgtcgcatccacaacgatatggacgagtcggaggctggcagggtgaagcgttgcagcaaatgcgatgaacgtgggcacacctacaagcactgtcctaaagacaaggagaaaccaagtgcggcggaggcaggactatcaggatcagcagcagatggagctcgccctacgggtgaaggcactacctccactcgaccacgtcctaggcgtcgtcgtgccacgtctagctacgtggtgtagttcttatgttctatgttggcatgtggatttgcttgtaatttgtttcaaacttatcgatgtgtttatgttttgtcgtgtaatgtcagacttcggcatgtcatgtctttaggtctcgtgatgtaacgtcagactaaggcacctaatgtctttaggtatgctgatgtaatgtcggacttcgacacgtaatgttatgttatgttatgttatgttatattatcgaactctacatatatgttaaattgcacgtcatcgttatgtacccttatgtaacatcctgaaaattcaagacaatgaaaatcacgaaaattttgaactttttaaaacttttgcatcatgctggttgttatgattgctattgcttgccaaaccgtaaatgatcaccaagaaagtaaagaaaagaactacatttaagcaatagatatgatttacgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctatgtatatataatagaattacgggagtatttaattcgatatgtagatcgattttgcaccaagttcctaattgcatttagggattgaaatttgatatattaaacccctccatataaaataaactaacatataaataaattgagctaatgtgctattgtgttaataacggtctcattagaaaattatagaatctttaataaaccttaaatattggacaatattaaattttgggcaaattcacatttgaacacttaatacggtcacctaaatgcttaggagtaaatacaaatttaatttgcaacttttctcaatttataaatcaaccaaaaccctaaaagaagaaaaataggaaaactttgaaaaatatataataataataagaattaaccctaattaaaaattcaaataaattatataaataaaatatgagtaatattaatctagaataaatccattggttggaatgacacaaatattgggtaaacttcatttatacaaaatctaggatttatagaatcaaatttacacaagaaataggctaaaatggggattaaataggaaaagacactattcatcggccgccaggtgttcgatgtggtcccctaacccagcccctccgctttccccctctctctgtcgcctgccaccgcgccgacgtcgccatcgccgtccctgccccgcgctgccgtcgccgtcactgcctcgcgccgcgcgccaccgctgccacgccgccccgcgcccgcgccccacgccgcgccgcctgcccgtcgcgttgccgttgccgcgccgcgcgccgtcgccgtcactgcctcgcgccgccgctgtcacgccgtcctgcgcccgcgcgtcgcgtccgtcgtgtcgccgtcgtctcgagccccgcgccgccctgtcgccatcgccgcgcgccgagccccgtgccgcgccgcgccgtcccgtcgccgcgtcgccgtcccgtcgacgctccgccgtcgtcgtcgcgtcgcccgtcgccctcaccgcgcgccgagccgtgcgccgccccgagccccgcgccgccgcgccgccg

SEQ ID NO: 23265 - DNA, 21552 bp, Oryza sativa
caggctcgtgcgccgttgggtcagtccacactctgcaccagggaccaggcgtactggatgactacggttccgatggtcttcgacatctgcgttgagcctcacgcccctttccacgtgatgcggcagttcggcttccgtcagccctttccagtaccgtttccgacgaccgtcccagctgttgttcaccggtaagatctttcactatgctttcagttgttgcattaaaatctacctgtccacaataatttgcaacatctgtcgattcacactaatatgacacattaattcgcaggtactcgcgcaagggtcagcagtcagctggcgactggcccgccaagttggcgacttttgttgaggactggttgctcgcaaccgaggaggtcgtggaccacgagggagagccacacactgaggaggcgtaccaggcctacctacgctggtaccagccacgcacccgtactagggtcaccttcgctcccttggagcagcagccccacgttgtgagcactagagacctctacgccaggcaccgggaccaggacttcgctcgtgctgtgagtaccctgcatcacaccattcctttatgttttcatgtctttctctttatcaaattttacgaatatgtacgaacaaattaaccatgcaggtcgacgacatcaaccgggtcgtcgactatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtagagacatgagcgccacattgccatgatgttgatgacatgatttgtgaaaggagaaataaaattaaacaactattttcgactggggcggacggaggatttgggtggtatctggaaaaggctagtaccgtccccggtcaattaaggaccgagccatgaagttaagcatgaaacgaccctcgtacaaccgcacttctcgtatgggtatagacctagcggagtagatagccgagcggaggcagtatccctgcatagatggttcacccctgagtgaggcaggtgcgctacggtgggacagccgttgaggtagggccgagaggcgtgccctacatcggtgtcgccattggtaggactgccatgagtgtgtgagagagagaacttaacttgagccataatttaatatgtgtgtgagacttctctttcccgggagcgccagaactcctctcactgctagaaacatggacgcctagagtgcatgaggatttaagttcatggagcgggtactgccaatgcgaggttatcaaaaggctttgccgtggcgcgtctcatgtgttgggacgaggctcatgtgttgggcagtcgcggagtgcgggtaaagtgtacatccactgcagtgtgagtaaaccaaatctattcgaatagccgtgctcgcggttaatgagcaccgggacatgtattacacttggctagactctaaattcttaacttgtgttggatgggatattgcatggtgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggaactaaaatttgatcagtctatgataggtcttaggcttgtgaaaatatttgcaaaacgcagctttatgcaaaagaacctgaaaccattccttgaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttctgctgttgttctctgatagttgttggcctacctggccctaatgtaagtatttaactcttttagtctaaattcattcgtgatatgttgtgatccaactatgtatgtgtgtaccaactactgatccagggattggtacggataaacacagaagatttccgatttccaaaatcgggggtctacaccttagtaacgtttgataaatttaaatagcctgtactctagttgtacataattattctcatgattttattactatttcataattttacaagttatcttttgttttacattagtactttttgaattgttctaacacgaaacactatatttttcagagatggcacgtcaggatacacctcagttgttggacccggcgatagatcaccgacactggtctcaccttactgcggtgcagggggctcagcttgggacgttccgggcacggacgtgcggtgagctacttacggttcacgactcctttgtcgagaggtacgaacagtgtattactataacttagttgcgctgtactaatttttataatgacatattaatttgttattacaggctgcgtgaggccagagacgcacacttttcacttgccgtgcggtgaggtagcccctaccctacaggacgtatcgtacttgttggggctaccgctcgcgggagacgctgttgggccagtgaccgcgggtgtggactggcaagacgatctgacggcatgtttcgcactagtacagcgcgcaccgcatctcccgctcgagccgttggcacaccaccgcaacaccggacctacgaagaggtgactgcttcagttcaccgtgagtgttttttgtaccgaaatgacaagcgtactacatatttagtccacaagtaaggtgcctaacattttatcgaacgcttgcaggtcgagcagctacaggcagaggccgacgagtactcctacagccgctgtttggaggcgtacttgctctggctttttggctgagtgatgttctgtggcggtcacgggcacgcggtcgacaagggactcgtgcactaggccaggagcatcgccgacgccgcggtaggcgaggtgcctcagtggagctggggttccgcgttgttggcggctctgtatcgtggcctttgtgaggcttgcacgaagacggatcctagcgcgacctttggtgggtgccctctctttcttcctatctggacagctgagaggattgcgatcggtctgaggtggaccagcacgcgtacgaggagtcactgtacgcggagcgaccagaggtcaactaccctacgatcggtactctgtggtgccgtcgtcaggtacatcacatcgatcttctcgtattgttaagttaattgctaagttcattgtacatcacatcgaacgtctcgtattgcagcaccgatgggctcacgtccaggttaggcggtcgtatcctgagtttgttatggagttcgaccgccttctgccgattgacgtcgtgtgggagccctacagtgtcgcggctacccaggctcgtgcgccgttgggtcagtccacactctgcaccagggaccaggcgtactggatgactacggttccgatggtcttcgacatctgcgttgagcctcacgcccctttccacgtgatgcggcagttcggcttccgtcagccctttccagtaccgtttccgacgaccgtcccagctgttgttcaccggtaagatctttcactatgctttcagttgttgcattaaaatctacctgtccacaataatttgcaacatctgtcgattcacactaatatgacacattaattcgcaggtactcgcgcaagggtcagcagtcagctggcgactggcccgccaagttggcgacttttgttgaggactggttgctcgcaaccgaggaggtcgtggaccacgagggagagccacacactgaggaggcgtaccaggcctacctacgctggtaccagccacgcacccgtactagggtcaccttcgctcccttggagcagcagccccacgttgtgagcactagagacctctacgccaggcaccgggaccaggacttcgctcgtgctgtgagtaccctgcatcacaccattcctttatgttttcatgtctttctctttatcaaattttacgaatatgtacgaacaaattaaccatgcaggtcgacgacatcaaccgggtcgtcgttgacggttcaacgacgatccaacgtttaggcgcggggattccggtacccgtagaggagcacctgacgacgtacacgcagatggtggagtcgatgcgctcgattctccgagtgctcacctgtcgtgcagacgacgttgctcgggcagacgtagctgtacagcggccacccgtaccgactggtccccgtccagctgcgcacgttcctaggccgactccccctccgcacggaggtaagtatttttaaggatttttctgcacatgcctcgcacatatatgtgagccgtttcacttgccgattgcttcagggtttcgtgcaccgttcagcaccccgccttcctcggctaggccttctgttgtgccccccacaggtacttaaaaaataacattacttcgacaatcaatttacatgcattttatgtcttagcttacaagggtcccgttgtcgatgtgtaggtttcgcccagttcgctatgacgcaggccgcccacttctcccaggctgcagggtcagcgtctcaggcagctgcatcgacctcgcactcagcgcagttctggcagtacaccgggactttgtcacaggcagccggcacgtcgagtcagggtccaccactggaccatgctgggacctcgtcggaccgcttggtgccttccaccttgctcttcgacatcactgacttcgacttcgcttcaggctcgacagaggagcgtggtcgcgacgcggggcagggccagtagagcagtcttctctttgtttatttgcttcactttccagtactgtatgcttgtgtaatgaatacgttgttgttatatgtgcacgatacctgttggcgcatgcacgatacctttcggcgcatgcacgactactttctgccgcaccgatgcagcctcctttattcgcgtacgatacgagtatttgctcgccatttgccgcatacgactaatgtaactttcggcgccgatcaggcatgtaactttcggcgccgatcaggcgtacccaccatgccccgccacgttcacatgtcagggatatcactcgattttttgcgcccatataagtcgccttaacgagtgaggcctcacaatcttccagaactcagtcacattcagtactctcttccccacttgcttcattacaaatcctaccggctttcgtcaatggctagacgccggggtgttgaggatccgaactggcgtagcaatacttgtgtatacctactaccaccttggtgccagcgtcctctctgcctatgcggtgatcgatgccaactaatggcttcgaggaatcctgatattcgaggaaggcgcttttttaggtgccctaactatgatcgtgaggtattttattatctgcatatgcttattcattccgtatgggcaatcgttttattcttcgtaacactactctattcggcagacccgcactacggcttacgcatacatcgagtgggtcgatacagaaaatcccgttctcgacctaaccacttgtttacaagaaggtcgctggtatttcgcatccaaaagtactgagcaatacttacagagaaaagcggcttatgaacgacaatgtcgtgaacaacagagcgactggcaggtgctaactatagcactccctccatgggaagcccgtccaagatgcaggtgtggtgatcgttgtcaggttcttcattccataaagcctacaacattgggtcgaaggttctttgtttgtccaaatattcttgacgacgatttcatggtaagaatattttgattacatgaatcctttttttctcacaacatttactaactttgctcgctttaaatctattctttcctcccaggaaccaccaaggagatgtcaatacagagaatgtatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatgttacataactctccttgtttaagtccatataatgtttctacgaccgagactgcgataggcctatattaattatccgagtactaatacgtcgaataagttacaaaataataccttacttaacatatgaaattgcgaaacaaccaacttcaatacatttttataacaatattaacatgttttaccaataaatacttctttatttattattaacataacatagaaaaatcgtttggccgtactttttgcatctgggtcccttgccgccctctactggggcggcaaggggcccaaatgcaaaaagtacgagcgcaacctctttatggcggcaaaaattgcaattagccccttgccgccctctgtatgggcggcaagggggttattgcaatttttgccgacggcggcagacggcgcggtcgacccgctgtctgccacgtcagcttgtcgcccaccactggggcggcaggttctagttttgcaatttttttggccgatagattatttctgtaaatattaaaaaaaatctaaaaatgaaaaaaattctgtgcaatggcagaggatggtaggcatggtgcacatgagcgaaacctatgtgcgatggctgctttcgtcgagccactgcgcgattgcatcgcgctctcacaggtgcagttgtctgttttgggagcgtgattgtggtcttgtagacgggcatggccgcatggccgcaagggcatacattgccgacaaaacatgagataacttctgccaaaaataattgaaaaatataccgttaaaattttcttttcttagaaatatatgacaagcaaaaaggttttagaagagagaatataccgttgtcacgagggagtaaagcaaactcatgacgacgagatcgtatggtgaatctgcaaagtggcgatgacaacaacgatatcgcgggactttggactatttgccactctcttcaatagcacattctcaaatgccatcttccctaataactctaattatttgtgttgaaagtatgtcatgaggggctttgatcgaggatgccaaaaccaccacacctatgaagtgctgctcgacgatcaaggggttcgactggggtgaagccgagggggcaaggccgaaggacgaagctagaagggttcgccaccctgtccataggacttgtcgtcaagtctctgtcagaggcgaagccggaggggttcgaccatgagctagatgccttcgccaaacatgcctgagagtgcgggatggcccaagaaggccattcgccacacatgggctggcccacgaagcccgactagggccccatagctaggatggacactatgtgccctcactaatgtccttatcttaagggtatcaatataaattctcctatacacactaaaccctagtgagtatgagtctttactaagactataaaaggccctataggggcatgtaataggggatccaaaaaaatatcatcaattaataccttgttttactattcaaccactccaccgagagaaccacgtctttcgacgtgaagctattgtcgcttcgacaacaatttgccatcgtgattcatcaaattgtttctattttgccacttttaactgccaacacactaaaagaaacagaaaatgaccttactgctcctctcatctcctctatcttttcttctttcctcatctctcctatgttattcctctcctacgtgagaatcccatgtactgttgcagttggatggatggcgcgagcctccgcgatttgacggcgaggtctttgacgagcgaggatatgtcgaggtcacctcgaccacaagcgagatactcgcgctggagcatacaacttgacccatgccggctccctccccccctcctaaacatccatttgcaccgtttctcccaacatcacaggatctatgcgaagggcctgcaaccaagatgtactaccttggccccgatgacccattcgatgaaccatcaaccattgtcgcatccattgcttgtcctgctatccggttcatccatggcgctagccgtccctactgcttagcttgtctcacaccagagattggttcatgccatgccagagaggaagaaggtagaagggagatgaatgagagggtaatgaggttattttcttatagttttgctaagttgtcagtcaaaaataacgaaacagagacaacttggtggatcacgatggcaaataacaaaagttattgggaatgataacatttgagaatgtgacatcgaagagagagtggcaaatagcccaaaatccctaacatcgtgcccgacaaatgcgaagtggttgtttgcggaggtggacccggtgacgtcgccactacgcgctttgagtccacgagagtgtgggcccctatcatgtcctgataaatccaccccgaattaaaaatcactttataaaagaaaagaatagaaattattataaatctaaaagaaatctcaagcactaaacctctgtaaatattttctgctttaatgaaaatacattgctaggcaaatccctagcagctttccaggtgattttttttttcaaattgagcttggagtatttttcctaaaatctccatgttcaaaattggtccctcgatttttacttgatttctagagcaaaagaaataattttaaagcaacaaaaaccaaatttgtagttaattaaaatgaaaacctaaaaataaatctctccttctctttaggccatttccggcccaaagctcttagttgctctttcggcccgccaccggggtcctcttctctctctcctccttctcgggccaacctcctcttaaataaatactctctccgtttcacaacgtaagtcatatatatatctagattcattaacatcaatataaatatgggaaatgctagaataacttacattgtgaaacggaggaagtagctacttgttggttttacaacgccgtaatcttgttttgggtttttttttcttgtaactttccttgtaagtatttttttatgcttttgtaaaattacactattgggttaggcctggtagtattccctaaaaaagttttttttgttttttaagttaattaattaaacttgttcaatataccggataaaaaaatcccttttttctttgttaacatcaattccacatggacgcaatatatagtctgccggcctaatgaagcgatcaaacctccagactccaaagtccaaactcacctacggcctagctttgacagctacgtatcctatacgaaccatctcattattatgggaaactactctaaactcgttgttatgaattttttttaaaaaaaatagattaatacgtgttaaattattatactaacatgcaagatcaaattctatttctatttctatgagttgcaactgaaaaaaatttgactacaaatatacgttaactagatattatttaatttgtctttttcgttgcaacttatagaattcaaattttaccttgtatgtgtatagagtgatttatcgtatattaacaatttatcttgttattttttaaaaaaaatcataatcatttgaatcatatgtaaataaggattgagaatttagaatccccttaccattattaccagcacatcaacgcccgtgctgccgcacgctgagcaccgtgcacgagcgcatcgttccgacgttccctttctttcgtcgtggactccggctactcctccgctgccgccgccgccggcggaatgcacgtcgtgatctgcccattgctcgccttcggccacctgcttccgtgcctcgacctcgcccagcgcctggcgtgtggccaccgcgtgtcgttcgtctcaacgccgcggaacatatcccgcctccctccggtgcgcccctcgctcgcgccgctcgtctccttcgtggcgttgccgctcccgcgcgtcgaggggctccccaacggcgccgagtctacccacaacgtccctcacgacaggccagacatggtcgagctccacctgagagcttttgacgggcttgccgcgcccttctcggagttcttgggcaccgcctgcgccgactgggtcatgccgacgtcgtccgcacctaggcaaacactaagttctaacatccacgtgaaccattcatgagatggaagaagagaggcagaaccattgaagacatacgcacatgatagaattgcagagaaactcgtcccgcccaggcaccccggcgcccagcggtcgcctcctttgcccaatcactcctcattcgaacacgctcgagcgcgctgcagagaagctcgtccgctcctcgcgccaaaacgcgcgagctcggtcccttctcgcctttacctcccctccccttccttatcgcgacgtttttcggtctctgcttggtctgcaaatgggccgaaagcagctgaacatcgcgcatgagacgaatgggaggaggacaggaacgcttccactgaacttgtgccgttggatgtggaagcaacggcgatgcggaaagctacgtccctctgacgtagaatttaatacgtcgcgcagtaatgaagcaatcagcccgatcggagcaagcttggtaaacctccaaagtatacaaagtccaaacccacgggcggtactgcccatcgcatcatcaggcgtccgggcggtattcatcggtcgcgcccgcacatcgacgcccacgccgccgcacgctaaacccgcccgctcggccgctccacgcgcgcaccggcccccttcttccgtcatggactccggctactcctcctcctacgccgccgccgccgggatgcacgtcgtgatctgcccgtggctcgccttcggccacctgctcccgtgcctcgacctcgcccagcgcctcgcgtcgcggggccaccgcgtgtcgttcgtctccacgccgcggaacatatcccgcctcccgccggtgcgccccgcgctcgcgccgctcgtcgccttcgtggcgctgccgctcccgcgcgtcgaggggctccccgacggcgccgagtccaccaacgacgtcccccacgacaggccggacatggtcgagctccaccggagggccttcgacgggctcgccgcgcccttctcggagttcttgggcaccgcgtgcgccgactgggtcatcgtcgacgtcttccaccactgggccgcagccgccgctctcgagcacaaggttgcaccaagtcctactaatagctcaatctttgcactaaccttaattacataattccatcattgatgctacgttattcgccttaggtgccatgtgcaatgatgttgttgggctctgcacatatgatcgcttccatagcagacagacggctcgagcgcgcggagacagagtcgcctgcggctgccgggcagggacgcccagcggcggcgccaacgttcgaggtggcgaggatgaagttgatacgaaccaaaggctcatcgggaatgtccctcgccgagcgcttctccttgacgctctcgaggagcagcctcgtcgtcgggcggagctgcgtggagttcgagccggagaccgtcccgctcctgtcgacgctccgcggtaagcctattaccttccttggccttatgccgccgttgcatgaaggccgccgcgaggacggcgaggatgccaccgtccgctggctcgacgcgcagccggccaagtccgtcgtgtacgtcgcgctaggcagcgaggtgccactgggagtggagaaggtccacgagctcgcgctcgggctggagctcgccgggacgcgcttcctctgggctcttaggaagcccactggcgtctccgacgccgacctcctccccgccggcttcgaggagcgcacgcgcggccgcggcgtcgtggcgacgagatgggttcctcagatgagcatactggcgcacgccgccgtgggcgcgttcctgacccactgcggctggaactcgaccatcgaggggctcatgttcggccacccgcttatcatgctgccgatcttcggcgaccagggaccgaacgcgcggctaatcgaggcgaagaacgccggattgcaggtggcaagaaacgacggcgatggatcgttcgaccgagaaggcgtcgcggcggcgattcgtgcagtcgcggtggaggaagaaagcagcaaagtgtttcaagccaaagccaagaagctgcaggagatcgtcgcggacatggcctgccatgagaggtacatcgacggattcattcagcaattgagatcttacaaggattgaagcatctcaggatgtacacctgcaacagtgcaactacaaaatccttggaataaaatgatttttgttttgtagtccacttacccaaaatatgcaaaggccgaacggtggggaaaattctaatcctgatttttttttcatttttgtttttctttgttatttatcaatttgataccgcccagacaaagttgaaatttaattgtaaaactttttatagtacatggaacacgcacaacatactcatttcctgtagagtaatgctccggtgcaatctacttgcagtattctactccgagtagaattaatctcgaccgtttattttaaagggcaggtaagtaatctcctaatatcgtttaggggtaattttggtttgggatgttttcttcggttcgcatcgcatcaggtccggactccgtcgcatgcagacacctcgctattcctcccccggcctcgccgccttgtccgccccctccgtcaccgtctgtatcccccgccgtcgccgccttgtccgcctcctcagtcgcatcgtccgtctaggagcggacgagcgtggcagcgtccgagcgagcgacgatcttgagcaggagttctggtggtagtaaaaattctggcatgggcttcggcggcggcatcacgcacgcacgcaacgtcatttgcgtggcggcatcgtctcagctcattcgtcttcttgtcgttccgattgtttcatggattacatggatcgattaagatcttgcacgaccaactccgacgaggatgacatggtgattgatctatggattggaaaacgataatacccctacgcgaattatttttcctggatgaaaacacccctccacatttctacttccactaattctggtgggagtagaactagatctcagccctacaattaaatatgatcaagggcccaaattactttctactccgagtagaaaacaccggagtaggactgtttcctgtatgtgaaacttttttcgagattttccaaagaaaacattcattattcattatctggcatctcggagagggcgagaggcaagcatgatgcaagtgtaccatgctaataatactgtacttaggagactactgactactccacgcgggcgtcagtcgtcaaagttcataaatagccggcagcggaacgtctgattctttaattggtggagaacttaactttgcactcagcttgacaaattgtacaggcaagatatcaagatcacgggctttttcatctccaaacgatcacaatcttaacttaaacaaaccagggtggaaggtaggcaaagaagaaaagtacaaagttgcattgtgaagttgcagtaaaaaaatgtcggatgacatgcagatacagcaaatgcttgacttcctcggtggcggtgccggcctgccggcttaactaaagtagttccttccctgattggatctttcaaagtctccacgactccaaagtgcaaacatatatttgagcggttcagcccgtgctaaactggaaactgttttttggatggacgcccacctatttattacatatcaactaaacagttataatttttttaaaaaaaacaagatagattaatatgtaatatatcattcgacaaacatgcaaattcaaaatcgacttctataaattgtagcgaaaataacaaatttaattgtgaattaatttgttatttaattgacatgttagagtttaatacatatactagttagagtttaatttgttgtttttgttacagtttagaaaagttaaatttgaacttgtattttttggagtgatatattacatactaatctatattatcgttttttttaatttttttataactatttagttaacatgaaatgggtggacgttcatttaagatattagaatccatcttcatcccgcgtctgctcgatgatatccatgttcttgaaatagaatccagattgctctacctctgccttgcgtgttacaggaagaaagctgctatacgttcgaccgacgcgtacgactcaacggcggaatacacgacgtgagccagcagcccagcactgacttggttatatggtttgctgctcccactgtcccacagtcccacataatccacgtggaagcacatcaaagctcatatataaagcccaaacttcaggcatggaaaattaaatcaaacaaaaccgttgatgtagatgtttgtaaaaaaaaaaagagagatgaaaaatttagaggagaaagggaggagactaacaaagttcagcggcgaggtaggcgaagctgcgaggcagccgcccggtcccctccccactcgcggctacctggcacctctccgacctggcgtggcggcggcggctcccagctagctccggcctggcgcgggcgagggaggcgaagctgcgaggcggccgcctagtcccctccccactcgcggcggcctggcgcctctccggcctggtgtggcggcggcctggcgcgggcgaggaaggcgaagcggcaaggcggcgatgcgaccacgagggatttgggcgtcgggcggcaggaaacggagagcgtgggctgaaaacggaggctgcaggtgggccggcgcagcagaccgttcgattagatttcaacgctccagatcgctccaatgtcacaccatgccatgccataacaatgtcactgaatttgaatccctaccacacggtcatcaccgccggcgacagctattccttgcttgcgctgaggtctgctcgtcgtcgtgtgtgttcatgtagggaaaaggaggatgtaggaacactcagaaaagtaagaatggaaaaggaataggaggcgctgacatgtggatcctacatgttgattcagcatgttagactaagtcaatgagccatgtcagcaagaatcgctttcaaaaccaccgagtgattttgtatcagttttaacaatttggggttcaagatatacggttaaaggttacaaattagattagacctatatttgagggagtcaaagtggacttattctcacctagcaacacttgagtttcccaagtcaatcctctcattttctacgtgcacgtttttcaaactgctaaatgatgcatttttttgcaaaaaaaaacctatacgaaagttgctttaaaaattatattaatccatttttagaaagaaaataacaaatacttatttaatcacgcgctaatggaccgctccattttgtatgcaggaggatttgttcccaactgcatctaccgaatgcagccttattttgacaggtaaccaggaaggcagcaggcccggcctgctcctggcccaaaactcgttgtcctaataccttcacgggccggacttgggcacggattttcggcccgtacaaaatgggcttttcttctacgcggcccgatcagacccggcccattcccaggtctgccgcggggaaatcgccttcgggcttcggcccctttgcacttttgcagaggagcaaagcttacaatagggcaacccaaaccaaaccctggccaaccccacctccaaccccccgcgcagccgaaggaatcctcgacggcgacgacgatggccgccgcgacggagaagacggccgaggagatccgccgcgagctccaggagctccagcgccagcaccgcgaggtcggtttctctccctctctccctcccctgagagaccaccctgtactcagcacgatctcctctccccgtgcgcagatcagcgagcgcctccgagacccccgcggcctccgccgcggcgcgcccgccgctgcaggacccggcgggccccgcccacttcgcggattccctagaccagtacggcgtcgcgattgcgtctcctcttccctttccctttattttgtattcgtgatttgatttatttccgtgttcttgtgttgcaaggctgtggatttggtggaccagtctgcgcctaagcggaggattctatctgcagtggttaaagtatccgcctaggctttggttttttattttccttagtcaaacttgtggtttgtttgtcgataaccctaatattctgtgcatttgtttggtgtcatgaatggaggtggaggatactgaagctaaggaggatgtcaagaaggaagcggaggcagaggggccggagggcggttcggctgctgctgaaggcggtgagaggagggatggtgggttcaggagggatgggagccagcgcatgccgaggagggtgagtaggctggaactataggggattgcgggttgagtttgcttaactgtattgttttggttgcaggagtttgatatgtcattgccagaacctctcccgagggaatttcccaaggatgaggatcaaagccttgtgaagaggaacaagaggatgctggggaagcttcttgtcggtacattagaggtaaccgattcaatagacatacaaaggaacaatccatgggtcaagcgataataagatatcaacagttttcagtgtttcctctccaactgatacacacaaaagaaaattttcagtatttgttaactagctttatcttgggtatggcaacctgtcaattaggtaggaatttaatggaagtactagtggcaagccacccttagtccccttcattgtgaatatttcaaatcagtgtaattgatttttccttgtgcttggtaatccagaaatttcagcaagaggacaaaaaactgtccaacacagaggcttatatgcgcagatcagaggttcagcgaaaggtactaacaatttctcttggtcttgggccaatctacatttaagcatgatttagtggctgatgtcagttgcatccactttattcacatgatgacatgtgctaattagaaatttgattttcatacatggaattatgaatgtaatattgctgttggaatttaactattgtgtcccgtgccatgacccatgaatgaaccaaacgatctcaataaaacacatacatcaacagaaaacgtcttgtctcctgatactacatcaatgaaatttagataagtagaatgcatttttcaagcagtgttatgtttttctgttcctgtggtcctgaaaatatctattcccataggaactatctagcgcacattcactttatacaactacctttttgttgctatatgcattgccctagtagaactttggacagtaccatgagttgaatggaccgtgttaaattctttttattaccattcttttgctggacttaggctaagtgatcttccattattgagatatcgatttcattctctagggtctcagttctttctttcaaagtaatctcgcatatactatggtctagccttgattttattctcgctattaggtctgatgtagcatggaatattgaaaaagattgcgtgaatgtaggctgatcaaaaggctcgtgaggaaagtgaaaggttgcggcagcaagagcgagagcaagcaatagagaagcgtaagcgtgatatggtaagctcacatcagtgtttatgacttgcatttatttatgattggttcacctgagttaaattgatgagtttatgttgcaaatggtttcctgatatgctcttgaatagatgctgcgtgctcgagtagctgctaaggcagaagaaaagaggttggagctgttatacatgcagtgggctgagcatcacaaaaagctgtccaatttcttaaggtcgctttacttctttgcatcattctgcacctttttttatccatgaatggggtccctttttgtttccttttgttgtgccactttgcaatatttttatctgtatttatcttactcttttatgaactggtcttattgtgtgctgcaggttatttttattcctggtccaaaagtatccatattgacaattaaattgagggaagatgcgtttctgattgtgcaaatcttgatgtttgatgttcataggggtttctatatccattttgctaaattacacattagtatctttttgaacattattgttgtttgtcaggacaactgcggaaccaccaatttactacatgccagctaaaccaataattgatgatccggctattgctgaggagaacaaggaaaaggtattttctgccctatataagtcaaagtaaaaacgctaagtttacaaatttttgaaggatgaattgcgaccctttatacacacctccatctacatgcaacttgggaggcagaacactacagatgtacacaatgaggacaaacttgtgcctactacaaataataaattgtctattttgctgctgtagtatttgtgtggcatagctaatttcatcatagggcaccatcagaatgccagttgcctgcatatatccagtcctgttggtttctgctctgtcatggttcaatcaaacatcaaataagtacaacggctaactgatcagccagctatgaaattgctgcccccctcccccgcattatgattattttggtgacatgatataaaatcttaccaaaaaatgcatatcgaatcagtaaatttctgggcacttgaaagtacgtggtcagtgctatgaatttgtcatattttacaaagctttatacttgaagtgctctggtggtttgggtgggactggctgtattcgataactgtgcatcaatgctcttcctttgcatgtatggagcatattgatctaacctttcacgggatagtccttggtcaagtgcaacatattaagagaatgccacttccgcaagtcaatactcatctttcacattttgccatttacatcatatgcttgctagtttcctgggcttccttttttgtacaatctggggcaaccgatttttctttgtcctcttcatccatcatgaactcatattcaatgttgcaggcatttcaagaatggaaatctgaacgcagggctgagctaactcagtttcaaaagcaagtcgaagaacagtacatgtctaatgttgagaggcagttggaaaggatgcagaatgcgcggaatgcacggaggggtaatggtccttcaaacatgcaagaaatggacaaggagctggacacgcacagggcggagcatggtccaaaaactcgacgagttcttgagggtggcaatgacgatgaggatgatatggacgatatggccgtggaagatgagctgatggatgaagtccttggcattaacgagccaatcagcgatgagcaaaccaagccgtctgaagaagctgctgatggtgttccggtgtctgaggaagtgcaataggtaatttgttttgtattgttgcgaggtaggcatctaggagttccacatttgatatccttcagctgccctcattttctgacgcttgttgtatgtctgttgacgcttgagattttccccgctgttatcaagccatatattgttgcgggatgtattgccgttgagcgatatactctgttaatcattgcatcctttgcgtttatagtataaatcgagcaatttactgatgaatgttggcttgcccagcgacaggggttatcaaactgtcttaagattaccatgatggttgacatacgaaagtttagaactattttctgaaaaaaaaaatcacagttgaactgaaattcgttggagcttaataagaagcttgccgactgtaaagtaattccaatgggggtatatgttaattctttacaagaagatctagatgtgtggccgcatcgctgctatttattgttcagtctcgctcagggaaagccttctccaagaaacttgcaatatctatttactgttcaatcttgctcggggaaaaccttctccaagaaacttataaatcgtctcgaatacaaatttggatcaacagctgatatcgaaagagggtcgaattttagtgatttgacagcatgctcaactcttttggacacattatactcttgtagtatgtcgatgataccaaggtataggacaacatcatactcttcaatggtgtccctgttttctacttctacgttcacgtcctcttgcactttccgagctcgagctggcatattcacccctagctgaacacggaacctgaaaataacgaacaaatgagtcagaaacagaatgcatctttgtgaaaacaaagtaccacgcagaccatagtttcagaaaaaaacattgacggcatgtaaaacgtgtgaatatgtggttgggattttctgcacttatgatatgcaactgcaccaacggtaagtttaagttagtatagcaggggcacaggtgcaaaaaagtgtaaaaccaccgccgtatgtgcactaaagaagacaggcaatgtatattactgatatttctttccaaatatatgaacacacacttgaccttgttttaccatgcacaaaaatgataattcttttgacacagcctattcaaatgcacgagctattatatgctctacatctatgaatgcttcgagaattcacacttaactatcaacttgcaaacgtagatgttgcattgaatagtcataaaattatcgtgttgtctggtggagctgccatggttcacccaacgttgagttgtattgtgaatgtttattttaaagctaaagggttgatataaaagttcaaaaaatcaaataatggatccagtcaccaacaagttcgttgtactttgtactctagaacacactgatatactaagaaatctttcctgaagagtgtgatagttatactacgcaatttatattctttcttctatgcatgttcagattgtgcagcaacaaatatacccaatgctaagttgaactttgaaataattaagtacaagtcaatctaccttccagtgcctggcaaaacaagatcaacttcttcataaccaccttctgctgccctaaccatgcttcctcttatgtgcgaaccacgtactgctggacctggctcatcagcagcaactagtagaaatccctttgaagaaattgtctcctcatgatgcagtgcaacactacctgattaaggtgaaaaaaagactaagatattaccattaggcaacaaatggaagtcaaaagctgaagataggcaattggttgatgtaatgatataaagaatctggtgtagtcctgacttcagatttagtaaaaggacaaattttcagaggaa

SEQ ID NO: 23266 - DNA, 4152 bp, Oryza sativa
taaacggtaagttatggaacctggacttcaagccaatatagacaaaaccatgaaagacgacagtaagatgttcagaaaaaagaggagcaagaaagtagcaatttgcctgaaaagtgcctccctccatggtttatccacgtgaaaaacatatgataggtcaaggtcctttagtgttgtgttctcatttatattttgcttctttgttgatcggccttgtgtagagccctttaagtcatacttacgatgaattcgcagttcagtacaaaacatatttcccatgacaacaaaacggacctattaacaccatacatagaattaatatagcaaatgtgtacaaatagacaacaacattcaacacaacagtatgatatgataatgtacctttcttccaggtttcagagtaatcctgtgcacgccaaagaattttgtaatgagcgtattatcataagctttgacatgattgtaatactttggaagcatcttcaatagtatctgcagcacgtattacatcaaaccaatctgcagtaggcatatcttatcacttaacaaggatatacacggtttttagcacaaatctttgttgttcttgtaaagctcagttttagtcatttttaattaacaaataacactattgttattgcaagaaaaaaattgagggtgggtcataccttcagctcagttttcctcaatgtttttataacaaaacgttcatcttgagaaagatagaaaatgctgccacttttcccaggtgaagaaagctcctttagactatcaccaccacatatagacatcatgtaatctgcagcatcgatatgaaacatttctcgaagattcctggtagagtaaattatgagctaataagatatggagaaaattacaagaacaattgacagaattgatcgaactttcaagtcgatgcatttctaaacaatgtctgtatcatcctgcagtgttatctgaaaatatgatagtgatagcatatatatacataagatcatggttgcaatttcctacagttaacaagggaggggtgaaccacagaggagcaaccacccatgttcagtacagaatgcgtgaaccacctatgtaatacaatcagatgatataataaaagaacagtatgaagtactagactatcgcacaatgagaagattggaaagagatataccggaagaccatcggacaatagtctttccaaaagaaatcgacagagtagtgcggaggggtatactgggatccctcacaagggaagtacatttttattcgtgctcgaggtccaaaatcatttgaacgaacttcacgcaaaggcacaggggtaattttacctacagtatacctgcatagaagtactgtatagtcaaatggggtaatcattaaaaagaacatcaactagttacatgtcgtgaggtaaacataaaaaataacataaaaaaaattatatttcatgaggtaatcgatgtttttcataaaatatggctattataccatccaatcactattatgataagacaaataacatgctagtaaaaaattaacagatggctcgtgactagatgcattatgacatactccctccatatcaaaatacaactacttatgtcatttttcaaaaagagaaggcactttttcccgaaagaagaaactacttttgttgtcactcatagtgagaacattctaactggtggttaatttttccccactgaaatgattattgattcttcagtcactaatttatgcttgaattgtcaaaaaagagtttgctttacacgtatgtatcgatctaaatggaaggtgcccttgtcctaaatggatatatccagaacaaaccagaaaatataataagcactgagtgtaaccctccaaagcttgtatagcaacaatgatgcattcatacaatgaagcttacctgatgccaagttgcaagttaagcattagataatagctcctatggcccttgtaaatagtctccattggtcctttagcttgtttctcccagttattttcttgtgctataccgctctccgacattcttgaatcttcgttttttggttgttccatgataagcactccttgtacgtattcccgttcataaaccgaatctttatcaacttcactgtcttgtagacactgatcatcagctgaaaatgatttacttgatacatcttggcatagatggcttccagaattatcatcgaaaactggtgtggtaccatttgaaatacgtctgggccgatgaagaaacctacgcaacctccaattcttgcacagtttttgcaatagaaataacagtccaatagtgatcttttcattactagaacttgaagcacttgtaccatcatgacttgttagacagtcagaaacttcaaggttacaaggaattttgcttccaggttgataaaatgtaccatggccatcctttagtcctctatcccatgtaccaatgtagcaagccccagatgcatatttgcagtaacctttgccatgagccaggccattgagccaattacagtcaagagtatcaccatttatccactgcattaccccgctgccattcattttgcctgatttccatcttccaatgtatacgttgccatcagcccatgtgtatttaccaaattcatcaggtaaaccttcattccagaaaccttcataagtgtcggagttagagtaaaccattgtccccataccatgcttcttgttcatcctccaagaacctttgtaaactgagccatcaactcccttgaaagtgcctgctccatcaatgaaacctccacggaagtcaccttcataggatgcaccagaaggccactgaattagtcctctcccggtcattttactcttgtcccactcaccatcataaagagctccatctgtccacatatactttcccggtccatgagggactaacccatcgaagctccccacgtagatgtccccatttggaagggtattacccctagccagaataaaaaatatatatgagattcaaattacattgtgtggtgcttgcaaaactaaattgcccaatcgtaaagcaacgcaattagtgctggacagctggagagtgggggcagtggatgattgcaaactttgcgctgattttaatgtgcttttcaatatgtgggaagaacacgatgaagcacttgtaattcctaccaagaaaaaaaaatgaagaatacgcagagatagacacgagaattatcacacctctggatgctccccttgcttgtctctgctcgggccatgtcaagattttaccagaatagctcagaagccacaagatgcattccagaagatctgaaacaaggcagcaaaaactatgatccagtattcgagcataaccaattctgaccgaaaacaggtttaatctcccagatacatcgaaatacatcgcagacataacaactctaatgccttcagcaaagcagatttccgttaccacgtacaactgaaagcagttgcaaactttgcaatcacactagcccagctcaaagtgacaaaaagcaaatagagaaaactaaatatcctcttgtactgttcaagcaaaccggataaacgctgctcccagaagagcatcatctcgagctcgcatcaacaagacagatcaagctacccagaacgactcctggtacagcgcaagcggccttccagatcaccgcgccaatccaagcaagcaagaacgtacctcagctgcagcagtagcacaacgaggaaggagaccacgtggagccccggcatccgatccgcctccgccgcccccgagccgagctgagctaagctaagctagcaaatgggatcacggctcaagcagcagcgaggagggagaagaggagggcaatcaatcgaggaggaggaggaggaggggaaagggaaacagtgcgaggaggaggaggaggaggaggcgtctgggccccggggggaggcaagcaaatgggaatcgcctcaccaccacgttgcgggttcgcggggcctttgctggcgccgaccaaatccccccacatccagctccttccccccgcgccccctcagatatttttttctctactctctccactcctttcggcggcggcgctcgcggagagagagagagcgacgcgaacagaggcagagcagccaggttggcgcgcggcgagggggggggggggggggggg

SEQ ID NO: 23267 - DNA, 4194 bp, Oryza sativa
gggcccttgcggtggtggtggtggtggcgtcggttgcttcgtgggcatggagcgcgcggttttaccggcggcggatggcgacgggggaatctgattctcatctcgggggcaggttgaggttgcgaagcggatccgtttagaagcgagcgcggtgaaagatttcccggttagttttgagtttacattggacatcccaggctcccagaaccgtattttagctgggttttaatttgagtttttttgaacgacttaatttgagtttttgaagtttactcatgcatagtactatgggttaattttggataaaattgggggtggctgggttgagtgggcccgtggctctacttttggggacagtgcattggactgcagttttttctgggctattggcctactccctccataaaaaaaaaaaggtaaatctagaacgggaagtgatatgttatagtataaatttagacatatgtatatctaaatttgttgtaataagatgtgtcacataagatactaggttgattttttataggacggagagaatattgtggtgtcatgttttatgtggttagtagaacatgaaagccacatatcgagatccagtgcagttttagggccctttgaattagaggaaaaacataggaattttagaagattttaatcgtataggaaaatttcctatgaaggcctttgaaataaatgattgaatcctatcaaatcctttgaaattcctatagaatagataatcctataaagattttagaggaaatttagcaagagcttcaacctcttggtaacttttctttcagtctatctctctcatctaattcctatgtttttcctgcggttcagtcaactagtcattcctgtgttttctgtgttttgtgatcatctgttttacacttacatttctattaaaatcctacattttatctattcctatattttttttcaatcatgcgattcaaagggtcccttaactagaaatgcacacaatctcatccatccaaattttcaattgaagacctagattaaatgatactgcagcattactataacagttctatagtgaatgccctggataaactgtgtcatattgaatttggacctgatttgtatccaacagctctagtgcgactacttaagttatagtcacactaaaaactgcttaggaactggatccgaaagccacggtctactatggtgaaaacaacagtagtaataatctttttagaaagaacacaaactacacactacaaagttcccctgagaatgaaacatgcagcacactttgagaacataattaaacgagggttaattggatccatgccatcgtaatatcttcgactttgaaaataatcgttattattcgcttattaagagatatgatattacaatttaattaaagtttgagatatgccacgacgtatctcttcaatgcaattataaaataacctggaccaaatcatccctcgtagaaatccttcaccttcaccccctcttccttcttcctctctcttattttatctgggatctagatgaagtcacaccaccggcgatggagctagcggcggagtgagtcctcggtggccggtaggaaccagagtttcttgtgtcgcttgtgttgtggcaccatgaatgatgagagttgagaacaaagggagtgtccaaccggtgggttggataggatcactagatcaaatggtgggagagatgacagagattagtgagagggagaaggaagaaggggtgaaggaaggaggaagagtaatctaatctaaaatgttttataattgtattgaaggggtatgtagtggtatattttaaattttgatcaattataacggcatgtctcaaaataaatgaatagtaatgttatctttcaacatcgaaaaagttacaatgcatggatccatttaactcaggaaacaaaaacatgatctattactacagaaactctttgaaaaaaaaaagagaagacaacgaagataagtgatgcgggtgataatcgttctgctgcgagagtaatatgtatgtgacgcgactagtaccggcatccaatcaaatgcgttgtttttttttttcaaaagagaacaaggtgatacgggtgaagatccctgtaccacgagagttatgcataagaaaaatcagcaacatgacaggcactgatatccaatcaaatgtgcttagcattttctatcaagtgtggtagcatacctgatctttttggcaattaacaagaagcctcttgttctttggcaactttagtgtacatcaaggaccactggtgaagaaaccatttttcctcccggttcgtaaccctcatttagtcccggttattcaaccgggactataaatttgggactaaagattgctatcttcagtcccgagtgaaataaccgggactaaagatcgatctttagtcccggttgttaacaccaaccgggactaaagataggggaacaaccgggactaaagatgagataacagcagtctagatgccccctcctttttttttctttttcttcttttttattttctcccaaatcaagtgagatgcgtattccaaattaaaccccaaataccaaatcaaggtaacatcccaaatctatatcacaaatctttaaagttacttatacacacaaatcaaatatatcacaaatcctaaaataaaattgcacacaaatcaaattacatcacaagttctacaaaattcatcgcaaatacatcacacacaaatcaatacattacaggatcatgcaataaatcacaaattctaaaaaaaaattcacagagacgccagccggccgttgccgcctcctctccacgccggccggccaccgccatgccgccgctcgctgccacgccgctggccaccgccgcgccgcccgccgcgcaggccgccgctcgctgccgcgccgcacgccgcctcctcgcctccacgccgctgcgcctccgtgccgccgcgcagcccgccgcctccgcgcctccgcgccgccgcgccgacccgctctcgctctcgctcgatctggatagagataaggcagcgctctcgctcgatctatccaaaaagaatgagataaggcaggaaagaggaagagagttagagaggaaaaaaagagatagagagagtttgttgtgtggacgatataagaagataagtaatagggattatatagtacgtgttagatttttatttccggttagtaacaacaaccgggactaaagttagatctttagtcccggttggttccctaaagaactaaagatgatctttagtcccggttggtaacaccaaccgggaataaagatcatctagtattgttgttcttataaaccgggactaaaaatcgtttttactcccggtttttaatggaaccaggactactatggatttgggtcaaccgagcaaagatggtttctccaccaatggacaaatagcgcctcaaatcactggacaagtagatccaacttaaatcaccaaagagacatagttacattatgtggtacttcctccgtttcacaatataagtcactctaacattttttacattcatattaatgttaatggatatatataaatatatatgtctagattcactaacatcaatatgaatgtgggaaatgctagaatgacttacattataaaacggagggagtactttagaaaacttcattgttcacacgaaaataagaaatggccagattaacaaaaaggatatgatggattataatgtgtgttgataaactaattgggattgtctaactattcattgactttttttttgacaaaaatcaaacagatttttttcagccctttgatctagatccaatgaaaagaaaaacataccaataggaattatttcgactgcaccaaaaccaaaaacaataaaacaacaacatgggccacaaaactagcccaaaaatcaagatgaacatatcatatcaatcacaaaactcagtaattcaactcaaaatctatacatcaagaactgagcagccccatgtacaaaaaatgttattattgcaaaatttaacataatcaattgtaatcctccgtccgtcccataatataagggatttagcaaaaaaatcaaaatctcctatattatgggatggagggagtatgaaattagccattgtgatttgatgagtgggatttggctagcttgttggagtgtgttttttatttgtaatata

SEQ ID NO: 23268 - DNA, 2803 bp, Oryza sativa
  unsure (1)..(2803): unsure at all n locations
tttttatagaatcatgagctgcaattaggagtctgattttcatctcaagttagcacgtgagtttttttaaagagatttcatatacgtcatacgtctccttttgtatttccaaaaacaaacaagtttaaaatccaacttaaacacgtatatgtattttcaaaaacgaacgaacttaaaaacagattcaaacacggatgacatattaaaataccgataaaaacatatttaatttttataacagtagagattaaaactcaattaattatacgttaatggctttctcgttttgtatacgctgatttttttttcgtttcatatatctcaaacactgtctctgctactcaaccaacaaaaatgctacagtgagcacgaaggtaaaaacggcaacgttgccccttagccggaaacacccgtcttactggcgaaccgccggcaacggcgacagcgcacctcgctcctacaccctctccgctgctcgcaccgcacaccaccacccatcacgaccagtcgaccacctccccccgccgatgccataccgctcagccggccgtgaggtgtgtgggccgtgtggcccccgtgggccacaccgaacgcaggcagtcaaaagcaaagcgctagctgtagcgtggagacaaacgcgagggggagagaaaagaaagaccaggggggacgcacccggcacccgcaccggcagcagcagcaagcaaagccacgctagttgtagtatactaggctactatagcaagcacccgccgtgcggttggatttttttttctcctcctccgcttttgccttttccgggtggtggactggtggtggcggacttgacggctccccactggctgcctccctgccgtgccgcctgcctctgcgcatctggctggctatcttacctcccttttctgcgccgcgtcctcctctctctcctttcccctagggctctagctccaccgcctctcggccaccgccgctccccgccgccgccgccgacgacgcgcgaggtacgctacggatgctcgtgcttctcttctttcgtttgctggactattcagatctgggatttaggtttcccgtcttctccgagtttgttggaccgatcgggaggctagagcggtggtcgagatggggggagtgatttcggatgtgtgctatgctgctgtgggatgagagggttgcaaccttggctttagatggtgggaatgggggttgagggtggattggaaatgggaatcggagtgatgatcgcttcatcttagctgatctgcagggtctagtagtatgccaaatgtgttcatcgtcatgcggctacagtttcctaattattagatgctttctgtttcttttaaaacgagctgcagcatgaactttcagtgatatgtttgattgggtcggacaggacagctcatatgtatgtttgtacttctgtagggagtgtggtgaggactgatgaacttctaaacattgggtatggatggatgtgactgcatcgagccactatggccaactgatgagctcctcatcaagtatcagtacatctcggacttcttcatagccctcgcatatttctcgatcccgttggaactaatttatttcgtgaagaagtcatccttcttcccatacagatgggttttgatccagtttggtgcatttatagtcctatgtggagcgactcatctcataaacctgtggactttcaccacacacacaaagactgttgctatggtcatgacagtcgcaaaggtttcaacggctgttgtgtcctgtgcgacagctttgatgcttgtacatattatccctgacttgctgagcgtgaaaacaagggaattgtttctgaagaataaagctgaacagcttgatagggagatgggcttgattaggacacaggaagagactgggaggcatgttaggatgcttacccatgaaatcagaagcactcttgatagacatacgattttgaagactacacttgttgagctaggaaggaccttgggcctggaagaatgtgccctatggatgccatcaagaagcggttcaagtcttcancttttttatactctccggccccagattactgttgggtcaactgtatcaattaatctttcctgttgtcaatcaagtgttcagtagcaacagagcaattataataccccacacatctcctttggcacggatccgacctcttgcagggagatatgttccaccagaagtggctgcagtgcgagttcctcttctaatctttcaaactttcaaataaatgattggccagagctttcagcaaagagctatgcaatcatggttctgatgcttccatctgatagcgcaagaaaatggcatgtgcatgagttggagcttgttgaggtcgtggctgatcaggttagtgctgtttcttttgctatggttacttataacatgggtatttataggagagagagcgtgatatttaatatgtttcaaaagctgtgtgctcatgatctttcaatcgatagacaacagtcaccaattaacctaaaacaacacatattcacaactatgatctgttgatcaatgattcatggaaaatttcaaatatcattatattattccaagagtttccctttttttttttgaaaacaaaggatactgagaagcagcaagcaagctaaaagtgccctctttacttttttatcaccttagttatattcataaatatgaatgaggcagtgttgtaagcaagtttttttaatcatctttctcttttatttcaggttgcagttgcactttctcatgcagctattcttgaagagtccatgcgtgcgcgtgatct

SEQ ID NO: 23269 - DNA, 1001 bp, Oryza sativa
cctgttgtaagctttgctcctctgcaaaagtgcaaaggggccgaagcccgaaggcgatttccccgcggcagacctgggaatgggccgggtctgatcgggccgcgtagaagaaaagcccattttgtacgggccgaaaatccgtgcccaagtccggcccgtgaaggtattaggacaacgagttttgggccaggagcaggccgggcctgctgccttcctggttacctgtcaaaataaggctgcattcggtagatgcagttgggaacaaatcctcctgcatacaaaatggagcggtccattagcgcgtgattaaataagtatttgttattttctttctaaaaatggattaatataatttttaaagcaactttcgtataggtttttttttgcaaaaaaatgcatcatttagcagtttgaaaaacgtgcacgtagaaaatgagaggattgacttgggaaactcaagtgttgctaggtgagaataagtccactttgactccctcaaatataggtccaatctaatttgtatcctttaatcgtatatcttgaaccccaaattgttaaaaccgatacaaaatcactcggtggttttgaaagcgattcttactgacatggctcattgacttagtctaacatgctggccaggagcaggccgggcctgttgccttcctggttacctgtcaaaataaggatgcattcggtagatgcagttgggaacaaatcctcctgcacataaaatggagcggtccattagcgcgtgattaaataagtattagttattttctttctaaaaatggatcaatataattttgaaagcaactttcgtataggtttttttttttgcaaaaaatacatcatttagcagtttgaaaaacgtgcacgtagaaaacgagaggattgagttgggaaactcaagtgttgctaggtgagaataagtccactttgactccctcaaatataggtctaatctactttgtaacctttaaccgtatatcttgaaccccaaa

SEQ ID NO: 23270 - DNA, 11098 bp, Oryza sativa
  unsure (1)..(11098): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttctcatttcatcgaaactggctggcaaatctcaagttgacttatgtaaccttggcaatgaaacgaactgtgattacgccattacggcatcggctgatgccccctctgtcctctcaccacaccaatcgccatggcgtaacatgcgacgagcacaccacagtcaccgtggtcacatgctcacagcctcgcaggtgccacttgagagcaagtcttgaaatacagaaaaataatgatttaactacaaaatttcgtgcagctagaagtagaaatggggacaagttttgcagattttctgacagcaactctgcaagattgatcttcccggaaataccggctgaacaataaaaggtgccttttttaaaagaaaaaaaggcctattttacagcccaactgaagcctagcccgtgggtgttacgcgggagaatttttatttatatatttactttaaaaaattttaaaaataattggaaaaaaaaacgaaatactccatctgtcctaaaaagatttaaatccaacaaaactagacacacgtgtctaaatttattgtttttttttaacagatggagtatactctaacgcatgactgtgtattgtaaaagtcgccctttcaaaaaagaaatccttaaatattttttttaatttacagtttcacttcccgtccgttttagttactagtaatgctgatggatcttgttgagctctgtaattttgatgtaaagttttattttatccaacttcatttgacatatttgtaaagtggcaaactatatagaaaaaatgcatttaagtcccttcctgacctcttggagagcggttttcgcaaaataaataaaaaaataaaaaacgtctttacagagagagttaggggtatatttttaatttttgaagacaaaaagaattgtgtacataaaacaatccagtttactcgtgaggcccatattagtaggcccagaacggggttgggaggacgcggcccattacagagcagagaaatcgcccccagtttttaatcgatatcaagttcatcactcttcttgttttcaagttcatgctgaaattactccaccgagcagacagcagagaaatcgatcccagatgacaagcaagattatcgcacaataacgtcttgtttggtaacacaatgaaatcatgatgtaaaaaaaaaggaaaccaataaattagaggaaaacggagacccacagattatcacatttcttgcattctgattattaatcacctcattactcttctttaaccacctcgcttctgctcttcttgcccttggcggcggcgtaggcggcgccgtggaagtcgaggaagagcgcgagcagcgacgcgttgaagacggcgttgaacgcccacccggccatcccctcgcacccgccggcggcgaagtgccgccacagcatcaccgccgacgccgcgaagctgaagaggaactgcgcgatctgcagctccgtgacggcgcgcttccaccgcggcggccaccggaggccgaggctgcagcagaggtagtagccgtacatggcgacgtgcacggcggcgttggtggcgagcgcgatgggcatcagcgactgcctcgtggcgagccagaggtagcacatggcgatgacggcggcgtggtggtagacgtggagcagcgtcagcgggcggcggccgaggaggatgagcagcgtgtcgccgagctcgtacaccttggagaggtagaacacgtgcgcccagaagaagaccgggcccgacgccgccgtggcgccgccgggagggaagcagaaggcccaccacgcggagggcgccgtggcggccacggagagcacgcacccggcggccatggcggcggagagcgccaggaggaccgcgctgtggagcgcggagaccgcacggagcgcgcgcgggtgcggcgacgggagcgggaccacgcggcggtggaggaggaacaccgtggcgaggtaggcgcagatgacggcggcggcgaaggacggggtcgaggcgggcgtgcggccgggctcccaccggaaggaggcgacggcggggtggtcgaccagcgcccaccgggcgcgccgcagcagcgcggtcgccgccatctcgcagggcactgtgcacccacctccccgacctcgccggcctgtggagcgcactgtgtggtggtttgagtgacacgtcgagcctacattagcgggaagcttgggtatgggtggggcgctttgtgcgacagtgggagtgggcttgggtagtcgatgctgccaggctggggcaacatcagcccttctaagggcctgtttggcacagctacagctccagctccacctctcctggagctggagctcagccaaacaatttcagctccaccaaaattggaagtggagttgggtggagctctctcacaaaatgtactagagttgtagagctgtgtctaggcagctccacaacttcactccagactcaactcctggagttatatttaggagttggagctgtaccaaatatgccctaatgtttcgatgcctaaacgtgagtatgtacgtctaaatcagataacaaaaagggagtgaccaagtaagagcatctccaatagctttctaatatgctaataccaatcccaaaggataaattttaggaatttggtctaaaaccatgtcgccaacgtatgcctaaaccagctcccaatttttcagtactcccaattccggctcagcctttagccagatcttgggctcctcgcggagttcccaatctgagcaatcgttgcaatttaaaatgcaagggcgaacctaaactaaaaacttgaaactacatgcttgtttggcacaactctagctcaaactgcacctcttctagagttggagctcagccaaacagttttaacttcatctaaaatgggaacggagctgggcgaagtgctttcacaaaataaactaaagtaaagagatagaggtgggtttaggctactctacaactacactttaaacccaactcctaagataaatttaggagatggagctctaccaaacatgccatacatatttaaatccataaacttgcagaatgtattattgccagtcgtaaatttgatatggcccatcacatgggcactaaccccccccccccccaccacaaataaataaataaaaacttgagatgaaagtctatctagcaccctgaactttaacatcggacattcaaccccataaactttgcgataccattcatattagccctaagatggttttagattgtggttttgtatattttgaaagcttaaacgaataactttgaataactaatataacatatttgcatatcgtcggttgtaagtcatcaatttatacttatacattgatatcatactattaatatattggtagttgtttgtaagtgagagctaacaaggggtgaaaagaaagattcaggtggagattttaatatatatgtccaatgtgtatgtcacgtgatcaaacgcatccaatatatatataaattagataaaaacaactatgcaaaccaccttaggggttatataaatggtactgtaaagtttagggaaggttgaatatccggtttcaaagttcggggcaggggagggggggggtatttggactttttccctcctcttttttatccttctcatcctcttcttcccttgaacgactcatggacggtgataaacgaggtgagagcttgtgggcagcgaccgacgacaagctttaacggtagtgacttcatgtgaaaacgctcgaggccttgtggtggctagggatgagctcgacggcgccaagaaggtttcaggcagcggtgaggctgatgaggtgctggggtggatgcttagagggaggggatggttagagctcaaggtttgcagggagcttgttagcgcatggccaaatatgagtggaggctcatggcaaagtatttctacaacagtacaaccaaacctcatctttatctgaataagagttctccagggcctccaggcacccagacagagccccatttgctactctgaggcaaagaatgaggttctgcctgccacccataacaatatcagagaacatacaagagggtactcttattcagataaactaccatatcataattcagaaatcaactgtggtacactcatgggctcattgcctagaactgaacactgatacactagaagaattaaaatccatacagggctcaatatgcgtaaatatcaggaaacaatcagcctaattcaactgaataatgttgatgcacattcttgatgttccggccaacaataagctttgagcttcagtttcagaacagtggcaataccagcaaagtttctaggcattatcttataacgctacacaatacacattaccttttcccctatgatcatattcatatatcatctcaatttctcaagatcctgtgaactagtatccatctttctttgctgtaagaatacaccatcctctattcatagagatttgacatggcattagcaccacaaagaagtgatgtaaaacagaggtagataggtccccccaagttatcatccagtatcatcaataacacgaaccaaaatttcattccattagagcacaaatctaagcgcatgttcccaacagaatccatcaagcattacaaacatacaaaggatttgacataagaacatcacctcgagcacaggaaaacccccgggaaaaagctcagaagcagcagtcgcagtcgaaggggcagagcggggtgccgccggcgtcggacttgccgaacccgagctcgtcggcggagtatatcgccagcccgtccgccgtgcgccgccgcggccgcttctcctcgacttcgtcgtcgtcgtccgtgtccctgcccttgctacccttcttagccttattgctcttcttggccccctcggacctctccttgggcttcttggctcgcacagattcctcctccccctgctgctgctgctgcttgcgcttcttgccggatgacttggtggcctggaagatcttgtcgatctcgttggtcgccttcttcttcttcggcttctccgccgccaccgccgccgccgctttctcctccctctcctcctccgtgggtttcgaaggcttaggtttttggtcggaggacgaggccttggatttgatagaaggattaggcccggaaggcctcttcttcttctgtgatttggtggccatcggagtctcggagaatatgaagtcggaattcgcagccgccgccgacgaggaggagaaagattgcggtggctttggggaagggaaggaatggcggcgagaagggtttgcgagtggagactggacaggaagcttgtggagttgtggagttgtgggccttggattgggctcgttccaggcgtcgtctgacgctgaatttaaccagcccatctgacaggaggaaatttacctgaaacccagttactgcttttcatcatatttgttgttctaaaactcgtaaaaccccgctacaccgagtgaatttactccacaaacctttttgttcgaattccgatgattcccttgtttctttcaaatgattcctttgtatctttcaaataaagatatttgaaatagtaaaatgagaacaggagcgatataagttgaaaagaaatcggcttgagatggaaagagagaatatgtcaacttgtcaagcagatgtatcattatacagactcaataaacgaattcttccaccatttcacatttcataatttatgagttatgacgcttctgaacaaacagttcagaacaaaccataattcacaatttcacatatgtacaattgacaaggatagtttttgtatgtacaaattgctgatcatcgcgcatgcataatttcactgctttcacacttcacagtgccttcatgacgaatttggcagacacgacagctcccttggctgcaattttcagcacgtggcgactcctatacaacctgcacaaaataaaaggcaacagtcaaagaaagaaaggagatatctccgtatggacggtactgttgcatcttcaatgtcatttagctaaatcctactaaaaatagatcccctgaagaaaatcagcaatataacaaaacaaattaagataatgaaagtcaggtttgcattatgaaatggataggaacctcagcattgaaaacagaaataaaccaaaaagcagattgtaacaagacgtttacttgcaaaagcgacacaaatttagtatggagacaactttaccccactattgtgattccccatgttgccaatatgtaaagcacttttccagcctcccaaatactcatccatttccacttatcattaagggtgctcaatgccattgcaacagctgcacagatgttaaaagttagaacatgctacacagaattgaacagcacgtaaagcagactaagactctcaaagacagaatattttgtcaaagaaacttagtcatgtgatcaagaaatcttgtttattgtctcagtgcaatgaattactggtccaattaatttcatttgtgattggatgtgttaaaggggtcagtctcccataacatgctccaacattgagttcaccaagtactcgactagaacaatgcatacaaaaacttgttgtgataaccatatccacaccataatatagcactgttgtttagatccacaatgttggaaattagtaaatcacaacactatttcaaacagcatattgaagttcaagttctttcttggtcacacacacactgactcattgttttgaaccagttacctaagtaacagagtttagatgcaaataaacttcatctttatcaaatttaaagtaacagcatggagataagaagttagtatacccttttgcagctccactggtgatattgactgaagaatacagaacaacaaatagttagatcattgaggtagtatagagagtattcatcaattgttgaaaacaagataccttggactttggatcttcaagaatgcacctagcaataaaggaggtcataccatcaataatgtcatcatcattaacaagtacataattttcattatcaattccactgatttcctccatatttgccccgggtttatcacaggcaaccaagacccaagatccattcttcccgccaccttcagtgtatggaatatctgcaatatccagttctggttttgattcatcaatcaaacaaaaggttatttacattgttgttggcacaatgtaacgcaggaaacaaatagtcataaaagtatggttcacaaataaaatcgcagtgtttcacacagatgtacctgtcatgttatcaggagatagctctgtttgttgatgccttgactcatctcgaattttctcaagctgagccaagaagctagcattgttaactgctgctacaagacgattatgcagctgcatcatgaaatcacatccatgaaaagcaaaatcggtcagacattaaaaggtaaaacaaattgaacagtgatagaaataaaagctggataagggcatgtaatcacacaactgaatttctaagtcataagtgttttggtccatgcatattatcagtcagcaactcagcatcattgcatcacgaattaaacttaatatgtcctgttacaccccctcaaatggcatggattcgaatgattgttgttaaaaaaacggtgacctgataaattcatacaccgcaattcctgccaaatttcggatgctcgtgtttttatagtatctaacaaaacatcatctatgatcatgtcaattctcagaggattaaggttaatactcctaatctgaaaacataagagagcaacagggagttgcaagaggctcacatcggcagggcactcctgggaaacacagggctcgccttggagctcgcggaggatggagaggtcgtcggcgaggcgagcgcggaggataacgttctccgcccgcagccgctcggcctcctccccgtccaccgccgggggggagacgccgtcgtgggccgggccgtggccgcggcggtgctcgatggcgtagcgagccacctccgcgatctccacgagcgtgtgcgccacctccagggggatcttgtgcgccatcgccgccgccgcctcgatcggccgccggccgctcgatcccctggcctcgccgacgacgggaccgcgggaggagagggacgagaggaggacggcgaagtaaaccctagggccaaacacgcaacctgagcggagcacgaaaggattgtggtaaaccggggacaacccgtgctgtgctctgctcaccacagaagaaaagagagagaaaagaaagggttacggagtagtagtactaattaataacgggattcggtcacgttcacgtggcgccaagctgtgtctaaggagaaggaaatagaaaagattaggaagatacgtaaaacgaggtaagttattagcgtatgattaattgagtattaactattttaaactattttttaaaatatttttattataaaattttttttataaaaacgtaccgtttaatagtttgggaagcgtgtgcgtgaaaaacaatgtccctttctcacctaatctcctagaactaacgcacccaaatgtcacagggaccatcatagtaaaaatttctctatgtagaaagtggaaacgcactgaacgtgaaaattgtaggaaaaagaaaacactgtcgccacttttgcttccgtactccgtaggtccgttaacatccaaaatgttgtgcacaaaatagcgaatgaaaattttggcctttttcttctaacttacagtactggatatggagggtaaatgacacgtgtaaattttttattagttaattttctgcggaacaccatacataagcatacactcacatttattttagaaaaggttttgttacccggcctctacaaccaaccaaatatatgtagcatttttaaattaagaacttagcctattaaataagaaacttagccctcaaataacccgaatattttaaattatgaacttaactcggcctctacatccaactggatatatacttcctttttaaatcctcaaataacccgggtacttttttacatgtacatccaaccgaatatatgtagtatttttaaattaggaacttagcatatcaagcagagaacttagcccagcctctatatccaactggatttttaaaccctcaaataacccgggtatttgaacttagagccttgggatgctactcaagtcactgtaaccagattatatgacatttcacacactcacattcaacctactactatgaacaccttaacagatacatcgtctagaatcaaaagaatagttagttgtagacgcaagcacatgtattaagtttggaacttgaaattgagtggacatactccatcacaaggaccctttctagatgagctacgctaagttcacgacacggatagctgttaaacaaagtccaaaaattacatgaaaaaattagaggaaaaatttggacatgagaaaatagctttacttactactcccttaatcataaatgatttatattaggataacatttgataaaaattttaaaactttaaccataaatttcaaattaaaataagttaaatctaatagctttacaatattaggatatttcatttcaaggtgattttttttctgttttataaactgagcatttgagatgttattgatagtcaaaattttaaaagtttgatttaagtttatccaaaacatcaaatatttatgcctagaagtagtatattgtttagtctcttttttttttcttgccggcattatgaagcaaaattagtgatcaataagtattttgtggtagggcaaattttgaatgatgaactccactttcagtgttcggaatacaaccaaaatatcaagctaagtatttgtgggcacctgtgtctgcgttttgcaaaaaaaaaaaaaaaaaatcaagctaacattgtttgtttgttttctctaacaagctttgcttgtcgcttttgaagaaaattttgcttgcttggattaattgcgatcacgtcatatcggtgatacaccaatgcactccaaagtaatatcatagacacaggattcttaataccactagatcaagctttgctaacctgtgaagagattaaagaaaacatgagcatgttgttgggagaacatagggcaataagggatggggtagcttttagagggaaataaggattttgtccttaaaaaaatgagaaatgatttaccttcaacagcgaataatatgggagcgtatcctatgcacacaggccctcgcgtgtacacaccgtgtacaccaactaaaaattatcacaaaaaattctagaaaaattcatacatatactttcaatagtattacatctacgtgcaaagtcgcatcttcaaattcattctacatagaaaataacaaaaaagataaaattctgacaaaattgcaaccttaaaactgtcagatttttttttgttacggttaaaatataatgaatttgacgttaagattttaaccctaggtgtaatacaattaaaagtatgcgtataattttttttctagattttttggtgacattttttaagttggtgtatgcgtataattttttttctagattttttggtgacattttttaagttggtgtgcacgtgtgtacacatgagggcttgtgtgcatatgatatgttgccgaataatatgacagaacaagcaatgagctatcagaaggtcacacgaacagcccagaatacacatttcgctgacagg

SEQ ID NO: 23271 - DNA, 628 bp, Oryza sativa
gatcaatttacagtagctcatatacttttctgataccgagatttcagagaagcctgacctttctcttcattaggagcatttggcaccggaccaacaaaatcagcatccccactgcttggccagactagaggaatcagcttctgctgatatgcattcgtattatcgcatatgccaagctggatgacaaacgttactgtgcagcctcttcctgttccttcgctatccaaccagatgtgccctcccatcaaagtaacaaacctgagataggatttttcacattttcagttaagtcgccgagtttacagtgagggagtgagtatatagcagcctcagcacaaattgggttgcagaaaaaggagctgataggtaagaaggtggtgatgtatagtaaactacctcttgcaaatggcaaggccaagaccactaccactgtatcctctgtttcctccaggctgagattgagcaaactttgtaaatacttgaggtagatcctgagggctaatgccacagcccgtatctttaatctgcaacagaagaaataacagatgtcataaaacagtaaaaaaaaaaaactggcaaacagttacctgactgtacacaactctagtttttctttatcaaccagtaa

SEQ ID NO: 23272 - DNA, 563 bp, Oryza sativa
gcgcattttgtgcaccttttaggaggatttgttccttgggcataaccaagaagtgctactatccttggctcattaaatgtaaaccagtgcttgacacgattgccaaaggtcttgaaacagaagtccgcgtactccgtgaatagatccctacagaacaagtagtatgaagataatccagacttcagagtgttacttatacagctagtgatgccagagatacaggatgctgcatttagctagacaacaggtaccaataatcataatgcagtgcagctttcttttgacagaacaatagaactttcacgttcataataattgtcatttgtctagaattggagccaattttagtcaggaatttttgtgttaagaaactgataattttgtcccaagcattcatacttatcatgtgtgcttctatgtttaaaaccaagtctaaaatagtcaataaccaacaaatgacgagagttctaatagattaacagacaaaaagctaggataaattactaatttgacttacgccatttttgcattcaaccagcctccgtacttcttctcaagcgcaa

SEQ ID NO: 23273 - DNA, 495 bp, Oryza sativa
caaaaagttccccagcatctttttgttctcttacaaggctttgatcctcatccttgggaaattccctcgggaaaggttctggcaatgacatataaactcctgcaaccaaaacaatacagttaagcaaactcaacccgcaatcccctatagttccagcctactcaccttcctgggcatggcgttggttccaatccttcttgaaccccccatccttctttttaccgccttaagaaacaaccggggcggccctccggcccttttgcttcgggttcctttcttgacatccttccttaggttcaagtatcctccccctccattcatgacaccaaacaaatgcccagaatattaggggtatcgacaaacaaaccacaagtttgactaaggaaaataaaaaaccaaagcctaggcggatactttaaccactgcagatagaatcctccccttaggcgcagactggtccaccaaatccacagccttgcaacacaagaacacgga

SEQ ID NO: 23274 - DNA, 7163 bp, Oryza sativa
gcaacccaagacgcggcgacgtctcctgggatgcgcgggacggcgcgagggccgcgcgtaggcggcggcaacggcgcgttggccatgcggaggtggcgggttggaggcgcgaccagcgacgctgggcggcctgggtcgccgttggtgggcggcgaggtggcggcggagcattggcttcggcgaggccgccgttgggcttggcggcggtgtggagcgcgctggcggcggggtcgtctttcccgtggttggccaggcggtcgctgtgttcgaagagctcctccccttctttgtggggagcttctaggcacggtgaaggcgttggccggtctaccagaaagactcaggttgccaaggcgaggttgttcccggtccggtcccataggtcggattcgacgtggaggctgaagggcggcgtggcggaggtggcctgggtcagcgtgctagggcgtggcggcggggtcgtcttccttgttgtcgaccaggctaaccctgtttggcgagctcctcccctctctgcggggagcttcttgacaggctggtggcggtggtcagttgacaaggaaaactcaggttgccgaggcaatgttgttccatgtccggactcccttaagttggattcaacggggaagccggcgggcggcgtggcagaggcggcttgggtcagctacctggcggaggtggttggtgctgtggcagtcttgtcgttggcaagactggaagccggccggcggtggggcgtcggttgggtgtggtggaagccatgtgccgccgatgtttagatggtggtttcggattgggcaacggaccatggcggtagggggtaccgagcgaaagcttagcccaacctttgggccaacagtgactacgctttcgggtcgctttcgggtgtggtaaccctcctgagggcatggttgaggtacccctcctcccttggcaaggagctctgggtgaaaaccttgttccgtttttgggacggatgacgacggcgtcttttggcgtcgcgaccttcctgagggcgtcgttttagagtcttcgcgtcgtggtggtgttgttggcccggtggcgatcggtctcgcatagcgacggccggttcggtgctcggctcccctctctgtagcgtgtgtttgcggttggcacttggttcggggcgtgtgctctagtgcacatccttcctcgacaaccagctatcgatgtaaaaccttttcttgtaaccttttcttccaatcttaattgaatgacctccttcggtctttccggcgaaaaaaaagtggccaacacgacaagttagcaacacccagcacctgaccgccgagagtttccgcactccgctcgcctgcgcggtgcaccggtgacactgtaccgaaccctgcgcaacccaatcacgtaagctcaactaaatttggcccaaccaaatgctcgctgctagtactagtacaagcgataggggggtctagaatgctcgctgtccatatattagatagataaactggtgagattttacagtcgacggcttgctgctcagcacttgcgctatatagaaagagaagtaatcaacattacagagaaaaaaacgtgcagattggtggcaggacacatattagttcatccagcaaaactttagactgtcacagacaacaaacgctatgtcacacaatgtatgtatagctccctctttgggatgtggacagcggacgtacagggttactatcagatactgcccaatgcaaaaactacaccagtacagaaaaattacagtggaacgcatacatctgcatatgaaaaaaatcgtcacactgaaaagaatcgaatccgacagatttatatagcaggaaaggtggtgctggtgatggctgtgttgaagatggcttatctgctgattcggtagaaggtgcaccattgtaacggtgatattagaatcaagatcacttgtcgcgtccgtcatcaccggtgctgctattttctcggcattgtctgctgcttctagctataccctctaagtgtttcagcaggagcaccttcaaatgtaggagctccagaggttccttgagtcagggagtgccctgcattatcgggtgccttgaatcataggagtgccatgggccattggagaaccttagcttctacctatccatcattgacccatcgatcagtcctcagcttcaggggtactatattgctaggcaggccaagttttcgcaccagatcttttaattgcaacaggaggtgcagatagaggaggccgaaaaacactgcagcagcatcagttccttaacagttggtgcgtgatccagctccttctgtagcatcttattccgcgttatgactaaattcctcaatgatagacgaccatgggctgaaaagtgaaagatcctttgtaagtgcttgataatacatatatttgagcacatttagtcaaataacaaatgaattctttagggcaacaacaacaacgaacagattgaataaaaaacacttaatggtttggctaaactcatgagagaggattggaaaatatgcaaatccttctctctctctctctctctctctctctctctctctctctctctctctctcttaaagaaatcaatgcacatcctctgtatttctaacaggttcatggttcattggtctgctcaagccatacgccctaaaataagtctaagcacatattcctattgacattttactgatcatgctatagcttgcttaaacatacataatcgaaatatgaataaagacagtgtatagcacataacttatgagatgcaaacaaggaaacataaggttttatcatgtgcatgcatgaacaatttgccactccatattccacaaaatgtgatcaaactggagaaggaaattacagacacttgtgtgtggtacaactctctaataatgacacttttgcagacgagatcatgtgggtgagaacttaatttctttatcacaaaaacagtcattgacaagaaccaaaattcttaatggaaacatccaaatcttttgaggaagtagcaacgctaattaaggaagacctagacttacggacttttgccttcaagcctccctaatttcctttctttctttccctccgatgtatccttaagttgtattctccccctgatctaagcccctttaaaacgttgtaacaactcttttttgccctttttccttctaatataaccggcagccctcctgtcctctaccgtttcaaaaaataatagaaacttactactgataaattttggtcaaagtaacataccgacagcctagtaagttcatggtttccaacatggagtgccagacctcgtagaatttctccatgtaaaagcacgctttatagaagtcgcagcagccaatctcagcaatgctagcctgtctggtggactctgtggcatcgataaagtctgaaaattcgttgacaaacttcaagatcgatcccttgcatgccatctgccatactttcttgcttagctactggtaaattaagggtgtgtttagttgggaaaaaggaaatttttaggtgtcacatcggacgtttgaccggatgtccgaaggggttttcggacacgaatgaaaaaactaatttcaaaacttgcctggaaaccgcgagacgaatcttttgagactaattaagccgttattagcacatgtgggttactgtagtatttatggctaatcacggactaattaggcttaaaagattcgtctcacgatttcccctatgactgtgcaattagtttttctttttatctatatttaatgcttcatgtatatgtccaaagattcgatgtgatgtttttggaaaaaaaatttagggaactaaacgggcccttaagaaagtgtgtaacatcggtagcagtagtttcttgtcccacatcctggcaatggtcattgtcaaaagcatgcaagtgtccttttcaagtcatttagtactttgcagggtgagattgaactccaacctgaggaatatcagcagaagtttgaattcatgaagaaacacagaatagtttctgtcaatatcaaccagtacacgtaatttcacaatacagtttaaatagaagcatatcaacataaagcaactgagaaataatatgcacctggggatgaaaacggagcggatacggacggataatgctcataccatattcgttttcatattttttttaccggatacaaaaacgaatacggataactcgaatacggatagctcgaatacggaaacaaatacggattatctcgaatacaaataagaatcgaatatgatcggacacgaatacggaaacaaatttttctcggaacacgaaaaccaactcaacttctaatagaaacaaatatcaacatatataattagctcattttatataaaataaggtataatttataaatattttttaaaatttaaataatattaatagtatggactagtgttaagagataaactactattaaaatctataaaggtatattgaaggttatagagttagaaagaaatggggtatatctcatgggtcctgcggatattcgaatagcactgttcaccggatatccgaattattatccgtatccgacggaaaccctgataccatattcgtattcgtatccgagagaaaatatccatattcgtatccgtatccgaaatatccgagaattatccgatccgaaaggtatccgtatccgtttttgtccggagcggacggaaactatccgctccgttttcatccctatatgcacctcttggatattccaggtaaatgatgaaatgcttcaacagcatatccattcccagcataaacttagttaggtcatcggtgctcacgaccaagtctagtggccctgcataattagttttgggagtattacatatttacgtctcgcactaaaaaatgtcaacaagatgcaatgttctaagaataaacatataccattcgcgacactaactggattgacatatcctgcaaggcaccgacatcctataccaggatggctgaggataaggcatgtgcgcacatatacctacaaaaagggagtgtcaacagttacaacccgatgtaattcaagataaccataagaaaaaggtaacacccctttttcttctttgcaaactttattccataagaattcgttcatgaaatgagataattaaaagttacacacttacctgtcaacaagtcagagaactccatctctgacactgacaccaatcacaacaagggatacaattggtcatttcagctcaaggggaggtggcttactgtaacagatacccctcctccagcagcagcaactctagcatatcttctatcatccatttattttctgaaacacgcccggcgattcttttttttcttgaaacactggatctccgcaatctgaaacattgccaatgaggtggtctaagatgaaagtttggtaaaaataacttacccaatgtgcaatttaatataccaaagagagaatgggttaaccagcttgattttgactaataagtaaataatgacataaaagctataatagaatttttgcaaaagggcgatatgagactacaggtcacataagtaatattgcacaacaagaccacatcgatcacattgcatcaaccaacaaaaaaatcaaagatattcaggaagcacgaagcccttacatggatatctcaaaggcaacaaacacacctatacatgtataactggaaattctaagatgacctttatttggaggaaaatggatcatctgaagcaaatgatgacccacttcccccaaaacctgataaaggatatagctgttgtgaactgattctacaagatttagggtgtgtgctaagcaaagcacgtccaatgcaatctaattatctgcacgatcacaaccataaataccattttattgaagcaaagcagtactgagtaccgacaatagcatgcttaactagttaactggagaagataatattctactgctgaacaagctgaaaaattaggtctccaacacactgatcaaccaactaaatgctcaaaggtgaaagcaaagaacaacttatccgtacctgttggagccgtcgcaagaatccgtgcgccacttcagtgatctccgatttctgccgccgcgttcttgatccagccgtattcgccaagaaccccgcttctatctccgacttcggcggggtgattcttcatctccgatcttcggaaccgccttcttggcctctggtcgcgttcttgaggttgccccgccaggacctcgtgcgctccgaaacttctcgccgttcttgttgtactcgtgcattcttggattccggccgccttcttgccgccgatatgaacccttggacgccttctttgtcgtcgtggtcccgtcgatgctggggccgccgccgtcgaagaagccgtcgccgtggacgttgggggcgccgccgtcaccgtggacgctggggccgccgccgccgtggacgctggggccgccaccgtcgccaagaagcagtcgccgtggacgctggggccgccgccgtcgccaagaagccctcgccgtggacgctgcggccgccgccgtcgccaagaagccatcgccgtggacgctggggccgccgtcgtcgccaagaagccgtcgcggtggctgcctctccccgaaccggctggtcaccatcttcgcctcttgggtcggcagttcgacccgcgttgttgacgcatatgctatctcacggcctcaacacgtaaaaggaagtacagaattgggttcacatagtccgacccatcaaacgacacaatgttcaagcgtccaaccacgaaccaagaaacacaagaaaattccacggcaccgacgatcggcgctcagcgctgacactcattgagcgaaatgtgaacatgtaggtcctcgctgagcagggaacctgttaccgcaattgcggcaaacgaatggcaagatcagacgatggtgctctaaacgatagtggcgccacatgtcatccctcgtgaggcgtggtactgtcaccgtctcatcgtcgtcagaaagaacacacaccctgcacaagaatcggtgaccacgagcccacagagaaagcaccggtggtgctggtgccccagcctggatttttcacattttggtccttttaaaaaacttatttcgcaaatagacccctagaaaaacttatcctaaaaatggtcctttttggggcgcct

SEQ ID NO: 23275 - DNA, 11704 bp, Oryza sativa
aaacttctctcctcgaaaacacaatcttgcaagcggaatttggaggttttaatatcgccgaacccggcaaagctagagagaatcggatgtaacattttctatagatgtccgtgcatatattatttgcctgattccgagtccgtatgagaaagttacgcctattttattagatgacatattttgtccgtttcggtagagttttggaaaattctacaagtcacatattttgtccgtttaagtttattttttatacggttggttcctatgttctcctaagtgtgaaaaaaatatcaaaaaaatgaaataaaaataaaaaaaattacatctctatgtactgtttaacttatatatgtcatttcatgtggttatattttgaattagattaagtaatttcatatagtggtagagtgcattatgtttaacatgctgatcaaagggttttactaaaggaattatggtctaattttagtgaaggtgcaaagtagactgagtggtatgctagctattttcagacttagttaagtggtagttcgagtttaaattttttttgtggttggttgtatcgtgatcctaagtgtgaaaaaacatccgaaaaaataaaataaaaatgacaccgttgcaacttcatacagagaaacaggaatggaggcggcggcgccagcatggctggcgccctcctcctgccacgtcggttcgcgtgcgccactgtggcatgaggacggcgccagcctatctggcgccgtcccggtggatgacagcgccatacactgtggcgcacaaaaaatgaccatttctaggataacttttttcaagggtctatttgcgaaataagtttttcaaaaggaccaaaatgtgaaaaatccagctgccccagccccctgcccgttctccatgtcttcgatgtgatcacacgtgggggagaggaggcgttgacgtgggatgaccagtgggagagagaggaggggttaatgtggggatgacaagtgggggagaggagaggatcgtgttgcctaattccccttttataataggtgagcagataactatgtgcgtcaagccgtcgattaatgtaccgttgatgtacagttgcttcccgtgtactttaacgtgacagaaaaaactacaacaccagttagctcgattggatccaaacaaaatatttataataacaaaaataacttacatatttggactccatctttagcacatgacaaataattttagtaccgaaagataaaaagatacgggggctgttcagattgatgtcattttcagccatactattttttttaaagttgtcaaaaaaatatctacgtttagtttgttgccaaatttggtaaatatataaaaaatcttaccaaaattttgacaatattaccattttggctacaatctgaacaggcccataaaatatcgagagagcgaggtcaagtaactcaattgattagtttctgtctacttaagtcatacatttggtctacttaagtcatacatttggtacatatatgcttgtatttacgattcatttatgtgattttttcggtccgatttttatccggcgtacgtcgccacctccgtcactccgattttgctgcgcaatgcggcccacaaagtctggagtctgtgcgccaccagcctgcagatcgctcctatcgctacaaatcagacgggggagttgggactcctctctgtctcgcgtcggcgagccgttgacacagtggttccagggcgcaccgtacagcatggatggagcaatggagagtagtatcaggcgcagcagattcttttttcacctgaagatgtacttcagcacttaagtctttacggatgtgtataaggcaagcgattaaataaacaatggtcacagctgatcataatagtgattattttttaaaagtatacatatatatggttatcaaattcatatactctgtatttatatgtttttcaataatgaaattttattttggcctttatttcaaacataaatctatatccatatatctttatctatacctaattagaaaataggtaaggcttccgggtcgcttggttccggcgtacgattacgaggatgacggcctggatctcgggaatcctgtcgtcgtcttccgctgttgtctcggcgccgatctccatcgtcgtcgtcgatacggcggcggccatgaccagtattgtctggcacccgtcgttcgcgatcgttgtgatcgtgatggttgtcgtggtcccggtcctcgtttgagcggtctcctcgatttatgttatcatggcaccgtgaagagacatgacgccgagagcgattcacgttgtctcgtgtgcgtcgtgcttctcggcggccgttgatttgatctcggagatcgccagtgccgcgaggtggaggggtagctcgttgaggtgattccctccgttccggatcttcaccattggcctcgccagttggtggctgctcctggtgtgctgcggtagtggcttcttcaaacgcgttgctgaggttagtcaccgattcccgtagtcgttctgtccaacgctcgaggtcaacgttcagaacgggatcgtaaggagttttcctcagtatcgcttgaacagccctgatatgctgggctagagtagttgattgattccccacttctgcgttggcgtgcgctgacgtgccaacgtcatcgatagccaatacctcccacggcgcgctcgttgtcgatgacccatagtcctcaaggagatgtaagaccgatggttcatgaggatcgatatcgattaccccaacgaatcgatctgaagttagagtcgctccttgttccttgctgttatccctgatggggacatatgacttaggagacggagctttcatggcgccgagaaagactttgcagctcgagaggtcatgattctttgtcttgtgaataggacaatagacatcctgagttggagaagtacgttgaattccatgttctttgcaggcgcgaatttcaacacggacgttgaggaaaacccagcaatcttgcagagtgtgtttcttggttttgtggataggacaccaagaccttgtggcttcggaagtcatctttgtcgactcgtggttcatgtcggaaggacaaggtttgaccgtatcagaatccttctcgagcttagatgtcatcgatattccgttcttcgtctcgatgggaggatttttcgacatggaatcgccttggttcgtagccactgcgttctcgtctccagtcattggaggactggttgagatcggcgtcgtggtgtaaaccgggaagacgatttcgccgacttgagtccataccagcattgttgaagcagggagtactgaggctagtgctgacgttgttgtcgacgaagctggatgacatagtagtagaaccttgagtaccaaggccccctacctggcgcgccactgtcgacgggtgatacccgtagaccagatatagagggtattggggtacgttggtacaaggacctacgtagtacgacatcaagcaaacaaaagacaagaattatactggttcaggccccttgataggtaataaccctaatccagttgatgtgggattatatggtagaaaacacagattacaaagggaacaagggaacttgtcggatccggcgagattgtagtcgagttgtttcgactagccctcgacgatttggctcctcgtaggctccggcttcataggctgtgtaggttgtgttggctctgagattcgatatcttaaaccctccctagggggtcccttttatatcgcagatctagaggtctccacgtagaactcggacgtatcagaccctatacgatacgccaacgacccagttctgcccgagtaggattcttcccgtctataaattccgtgaaaggtttccttacaatatacaggaaatattcgcatgcgcgtggatatgacatatcgatatgtaacgtatatcgaagggcaaagggtatgcctaacccgtaaccctgacaagcatcattttaattgcttatgactgtttattaatttaattctagataaactaaaccaactagaaatttgcctacatatttctcatgatgtgtatttattttatgaccaacgttgattataaattcatataggttttatttatattcatgtttataaattatttatgcctgacagtgacgtaattcatgaattatttctgtttaactttgtaattaattgagccaacacaaattaattattttcatttatccacgtgtttcgtgttttacgtgtcgcataaaagatttttaaacacttgattaacaacactaacccacacgccctccgtccccatactcactaggtgttcatcgcgtacgcaggtcaaaggaaaaaaaaaatcagggatcagagatcgaatcaaatcctaatcacatacagcgggcaaaccacaaaatcgaatgtcgattaaaaacccaagcgacaaatatcattcaaagtctatatcaaataacacaaaaaaattaaaccaaagtaaggaaaaagtataatatatagcgatccaaaacgtttttacccgttgcaacgcacgggccattttttttagtaatgataaaattataatcggatagtagcgcacacaggtgcatcaataactttttccacattattaatttgatttagagaaaagaaatcatagcatcgaaggagtaacccaaatttgtgggggccaacttttcatgtgtactcctggtaaaggcatcggcttcatcaccttagccttcaagtcaaaaactccaatatcacgtggcatttgtttacggtcccaaaaaaaacttaaattgtcttcagtgaagtagatgcaatctgcacctaatccggggatcctatcactcaaaaagaatgttgccgagttgctaccaatgaagattgacgcgccaccaaaatcatgcacctctctccactcgcttcctctaggacgctcgtcaagaataaatgcttggaattttactgttggatcgggtttaagctcaggctccggctccggatcatagcggtagttgtggacttgtgggctgcattgtaattgtccttgtcattttcctcctcaatagcagtgacatcgtcatcgctttcagagtcacatcgatcggtactatgctccctcaaaatgagcatcaggtttccgttcggtgactcggctaggtacttcctaatgtagaggggcaggccgtcttcgtctcgggacataaactgtggagcaacgtttcttgggttaaatggtgttgtgacgtcatcatgttcccaggtttggactacgccatctaaggcccctcacagtgctcctagctgtagcgtggcttagtactgccacgtaggtttttttcacccgtgtcgctcggccacgcttctctgcttggacgctcgtgagtaaactaggatgcgcaaaaccaagcctggaaaagggaccgcgcagaggaatcgaggggaggcgctagcgctgtgggcgtcattccctcgccgcccggtgctctcgcgcgggattcggccggcgaaatcccctattcaccctcccaaaatcccctcccgccacaacattatttctcccgccacagataggattggaagagaaaaagcaagaaaatcttgaagattggaagagaaaaacagatcggattcacggcaaaatcatcacagaaaaatcatcacagaaggcggtgccggcgaattccaccacaaaccaccactcaagtcaactcaaatcaccccaaaccacgctgaaatcaactcaaatcaccccaaaccaacagatctggacagtgcaagaaaagaacagcagcgacggctcatgctcctcttcctcgcggcggcggcggctgccgggctcgccgcggcggcctgtgccgcgcggctccgccgctccccggggtccggcggcgctgctcgaggtcccccttcggcaaggtcgttgcggtggaggcttgccccgctcgagcctttcccctcctcctctgccgccacacgaggccagcgccgcgcttttgcccgccatcagccgcttgtctgctcccgtctccggccgcccgtcggcgacgcatcgtccactcccgccgctcccaccgctcccgagtccgcgcgggaggagaagcgagcggcgcggtcgacggcgaggcgcacggcggcggcgtcctcggcgcggtcgccggattcgcctcggccaccggagggaggggaaggaggcgcaggggagaagcggagcggcggcacgggaggagaagcgaagcggcgcgggaggagaagaaggcgatggcgatggagtggaggaggagaaagtcgctaggggtaggtggggaataaatttcgtcccgtaccccgtgtctacacgcttgggtaacgctgcactgtgggttcggttttcttcacttgtggctccatccaattaagccacacatagtatgggtgcttgcactgtggggtgggtgtctttgggccaacttttttggcgagagctacgggccccatagctcgcactgtgagaggcctaaggtgaccatgtagaattgtcctcggtaaacgatcacatcttcatacatgtgtcgcgtttgcaagggcatccattttgcatcacgcccacgagcaagcacaaccctgttccttggacaatgcatcatcatgataaagtattcaccagaactagggtcccacaacgggacggctttaaggagacgagatgaccggatttcctccgcagaaatctcaatgtcggagcaccatccgacaaacctggtgtggccctccggccagtaggtttccacgaatgaggctactttaaacaagaacctagcttcatcaccgtcagttcttggaagggcatcaaagtaaccggtagtggtgatggatggcagcgagtgttgagtgccggagatggggttaaggaggtgcagcccgcacttgtcatctgttgtcacaagccaacccttcgccgagccaatccacatacggctttggatggcaggggaaggcagggtgattgagcgacgccgtccatccgagaaagagtagaagtccgcgacggctagatgttggggggaatcaccggcggccggtagcatgagccaaggcggttcaggcttcggatgaaggcggaggttcatgccgtatccgccgcccgcttccacgtcttgcagacggcgccaaacttgatccagtctgcgaggactaggcgggttacaaatgttagagtttgtgtcgaatatgtgtacgtagtcggttacagtttaggacttggagttgtaataggtattaggactagagtatgagtcggactctatcctaggatccctcataaatagaggggcgtgcctgttgtaaccgcatggcgacttagcatagcgagagggagcggctgccggcgtcgaccggccgtgagtcgttgtaactctgatacgctatatatgatggatcggggaggagcgcccgtaatcagtgccccggagatgtaggctacggctgaactccgttaccaaatatcgtgtctcggtgtcgtcatcgttttggatctcctatggagttttcttccgtatttagctatcgatgtcgatttcggggctggttttataacaagtggtatcagagcctgcgggaggtccatggtagaggcgcgatggaggtgctccacaccgcgtagcctgctataatgcccagggaggggcattggcgcaaggtggagcacggcggcgatcaacggagtcttgatcggtggatcgaacacttctggcggcggccggaaccgtcgatggctgccttcaacagggagatgactagacatggtgctcgggttgatggcggcggaagcgattggcgatccaatcggtgggtcggacacttcgggcgggtggcttggactttccggtgagctactctcgatagggagacgtgcggccgcacgctcgggttgattgaagctggaggcaatcggcgttctcgatcggtggattcgaacactctgggcggggtggcccgggcctttcgatgtgttgagttcgacagggagatggctagacgtagtgctcaggtcgttcggcggctgggaagacggcatgcgacttgtcggcttcggctcgcgactagattgatggcgttcaatcgaaagtcggagcgggtggatcctataggttgttttggaggtgttgacgaggtatttgcgtgacaaactgctacggagaaggcgcacatacgaaaagcaacggaatcaggcagaagggcagtcaatttcagaccgtcaatgcgctgatcaatcatgttagcacagcaataagcattggttgcaactgaccggcggtattcgtcaccagcgaggttcagcgggaggctaggtggctgcgctagaggtcgtacgggtgcgtggaggctgaggaggtcacggagatggcggtgtgcacgtgttggtgttgaagccgggaccatggaacgtggccagagcccgagtagcaggaagtcggattgcgcaggactcgatctggagaggttgtgacatggaaggagtcggatatgtttccaactcggatgcatagcacaacagagaaatagattgagggagagacctagtcaagcacggaaggggaatcggacgaggactacgattcgttcatgaatcggactcgatttttcccaaataaaagcagcagaggaccacaggattgcaacaacgcaatcgaaacaaatcatctagcagagggcgagattcgtacccgattttcgcagaggcaaaggtggtttgggcggcgaggtcacgggcggctggagacgcgtcattgcaggtaggcggcgcacggcggcgtggtactcggcgacgttcgtcgcagctcaggcaggagcttgcggcggcggcggcggcggttcccggcgaggaaccggcggcggacttcggcggcaggcgctcccaggtggcaggcggcggcttcccaaggtaggcgacgcggcggctcctcgcggggtcggcgcaggtgacagcggcgggaggcggcggcgccccaggcggtttctgaggtggggggcatggtgcttcttgcggggccggcagcgtgaggagcaggaggcggcggcgcatcgggaaaagcggcgcgggcgcggtttctgggaggagcgaggaagccaaaggaagaagggagacaggatcgatctgtttttctttgactggtggttgaccaagtaaaagaaaccggtccggttttttggagaaagaaaaaaaaaccggttcggtccggctggtactgttcgagttagtcggtggggtcgattgaaccaaggcagatcaatttaacagggcaacagctgttgagttgattatcgtcgatggcggtgacggtggtttccaaatttgagatggtgaagttcgatggcactggaaatttcgttctctggcagatgaggctgaaggatctgttggctcaacaggggatatccaaggctcttgaggagacgatgccggaaaagatggatgctggcaagtgggaggagatgaaggcgcaggcagctgcaacaatacgcttgagtctctcggattctgtcatgtatcaggtcatggatgaaaaaacaccgaaggaaatttgggacaagttggcaagcctgtatatgtccaagtcgctgacgagtaagttgtatctcaaacaacagctgtatggtttgcagatgcaagaggagtcagatcttaggaagcacgtggacgtcttcaatcagttggttgtggatctaagtaagttagatgtgaatctgtatgatgaagacaaggccataattcttctgtgctcgcttccaccgtcgtatgaacatgtggtgactaccctgacgcacggcaaggatactatcaaaactgaggagataatttcgtcgttgcttgcacgagacttgagaagatcaaagaaaaacgaggcaatggaggcttctcaggctgagagtttgctggtcaaggcaaagcatgatcatgaagcgggggtgtcgaagagcaatgagaagggagcacggtgctataagtgtcatgagtttggacatataaggaggaattgcccgttactgaagaagaggaaagatggcattgcaagtttagcagctcgtggtgatgattcagatagcagcagtcatgagattctcacagtgtctaacgagaagtctggagaagcgtggatgttggactcagctagttcctatcacgtgacatcgaagcgggagtggttcttttcatacaaatctggtgattttggtgttgtttacttgggcgatgacacgagttatcatgttgttggagtggacgatgtcaagttcaagatgtatgatggaaacgaggtgctactttcagatgtgagacacgtgccgggactaaggaagagtttgatttcgcttgggagcctacatgagacaggttggttgtatcaggtggattttgataggaagaccatgaatatcatgaaggacggcaagactgttatgactggtgagagaacaagctcatgtttgtacaagttacaagggaatgctgttgcaggtggagtcatggaagatgggtatgctggtgttgctgtgcacgatcctgaaggcggcgagcctggcgtaagctctacgggcggctcggcgtgagctgcggcagaaccaactcaagtcctggtacacggaggttcgagcaaataacagattcggattggcgtggcatattcgccaaggtggagtttgttagagtttgtgtcgaatatgtgtacgtagacggttacagtttaggacttggagttgtaataggtattaagactagagtatgagtcgaactctattctaggatccctcataaatagaggggcgtgcctgttgtaaccgcatggcgacttagcatagcgagagggagcggctgccggcgtcgaccggccgtgagtcgttgtaactctgatacgctgtatatgctggatcagggaggagcgcccgtaatcagtgccccggagatataggctacggctgaactccgttaccaaatatcgtgtctcggtgtcgtcatcgttttggatctcctatggcgttttcttccgcgtttagctaccgatgtcgatttcggggctggttttatatcaacaaactcgatcaaaatgtccgtgggaagtttggtccaatccatggaggagggagtcgatgaacacgaacacgtcgcacgagggagtagttaccaactcaccacagagatatataggccgtgcaactatgcaaagccatccgaaacggaaacgtcgtaggcagggttttccgatacacgtacagacaaacaaagcaaacagacctggatcgaaatcttatcgcgcagtccaacacccgagttaatgattttcgcgccccgctagctcgcccgcgcggtgcaccgctgacgctgaacatgtctcctttctcccgatcccagcgctgcccccacgcgcgcgcacgtacgcgtaagcccaactctttttggcccgtcctcgaccgcgcgcaggcatgctaccgacgccggatggaataagttcacttcatgaccctcaaatgtgatcgaaatctaaacgataaccctaaactacaaaaccaaaatcagatatctcgacccccaaaatcctaaaaccggtacaatttgactccctgagcggttttaggaggcggttttgctgacgtggcgccacgtggtgcctatgtggcaatattgaccgaatgtttgttacacacggcgttgacgtggcacctacatggcggtagaa

SEQ ID NO: 23276 - DNA, 9091 bp, Oryza sativa
gtccccgcacgccaccggccaaagggaagaagaggagagaaagagagagaagggagagagggaggaggaaggaggactgacatgtgggccccgcatgtcaatgggcccatatttctttttgtgtgaatgactaataggtcccacgtatattttttatttctaccgtcacgtagatgccacgtcaacgccacgtgtaacaaagactcggtcaatattaccacgtaggcgccacgtggcgccacgtcagcaaaaccatctcccaaaaccgctcagggagtcaaattgcaccggttttagaagtttgggggttgagatatctggttttgtagtttagaatcatggtttagatttcaattatatttgagggtcatggagtgaacttattccccgcctgatagctcgcgtcgcgtgtcccgaggcacgcgcgtgcgcaccgccgcacagggcctgtttctcagatgtgcgcgaggaggagcggtgctgtgtacttgtgtgtgctgatcgcgattatattgcgttgaaagaattgttagaagaggataacactactactacagtagtcaatcgtggtagtcatgcactacactgaagtgactgatcactgttgcttgcatgattggattgactatttagatgccgagtagtaattcggatatctcatcgaaccaggttacaaaatgcatgagagcaagttgtttaatagtatagccaaatactggctccaaatcaactgtagtcaatttaatagtcaatttatacaatagtaatatataaacatatacacaatagtaatatataaacgtataccacactattagtttatggtcccacatgtcatacatatatttcgtcttggagcccgtgctgcaactggctacaaatctgtagcccactgctcatctctatcttctttcatctactcgatatgtgtttatagctggcatatagcctactattgtatctgctcactaccacacttgagaactaccctgtgggctgttatattttctatgggttccgcaaccaacccacaggaatatgtatttttgtgatggttctacttatccctacagaataattcatttttctggcggtgcggccctacaggtaaatgagactaaggagaagagagagataaccctaacattcgcccatcccccagaagacttcggcattttcttccccaccgctgccaccctcccatcctccgccccctcactggatctcgcccacgacggcctccgctcgctgactcaagggagcatccaccttcgccgcacctcctcgccctaacgccagggagcagcgtcggccacctccccgcgcctcgtcgccccgacgtaaggaagaagcgccgacacctctcttgcccttgtcaggtgaggagcaccatccccgcgcggccgcgcccctcgtcgtctggctttggccggatccactctcccttcatcttatgtccgttcgggcgggcaagcgtgaacccaccgagtatgcggcgcagctcggacgcatcagatctggcagcccctggcacaggcggtgccagatccgtctacgagggccgaggagagtgggcgatgcctccttccccctcctcgatgtccattgcctcatcctcatcttgaaagataagcttttttttttctccaaattcttgttatcctgccatggcttcagatccgtgctccccaccgtagtggctacagattgggaataggctttccgatctagtgactagagatattgggttcgacttgctaagatccggtgatgcctttgctttattataactagccgggtggcccgcgcaattgcgcggctagcacccaaacaaatcatatattttttaatatgattttacttataatttattaaatagccatctcattgtcttaagactttgaaagaccaaatcttatcatccccgtgtttctaattatatagttttttaaaagtcacaccagttgctaccccttatgtcatcttcttctttatttgcttgctcgatctaccactatttctattcattctccttggaacctttaaaaattggatcttatagtttttagagtttattatcacgttgggtttcgtttttataatttctagacatccagttaaacattgccattatactcctctatggctcgtccactgtctcttctatttattgtcattgagatttttaaaatcgaatataattatcgtttagattcatttttactttctagaagtcccgccaaaccgtcagcggctttgccattgtacttctctacggctcgcccgttgcctcccttttttattgtcattgagattttaaaatcgaacatgattatcattattttttttactttttagaagttctgaacctttaaaaattgaacattatagtttttagagtttattgtcttgttgggttttattttttataatttttagaagtctcgtcaaacgatgccactatgctcctctatggcatgtccgccgtctactctttattgtcattgtgattctaaaaatcgaacataactatcgttgggattcattttttattttctagaagtctcatcaaccatcggcggctttgtaactatactcctatataccccacccgctgcttctcctttttattgtcattgagattttaaaaattaaatatgattatcgatggggtttattttttttactttttggaagtcccgtcaaccgccttactcgtttgcttcacggcctgcctgtcgtccctccttttaatcatcattaggattttatttggtgttttattaacagtttttatatgtcgtatcaaccaccaccacgctactcctttataggcctgttacttaatttatctcgtcatgtgttttagatggtcttttctttcaatagtctttatttttatcacaaatttttgttatttataaattgtattcctaactgaaatcttatttttctttttctaattcagaatttatttttttcaaattttaattaatatcgtattgtgttcttttaatttttttattttttattttcaatttcagttgttttaaaattttattcctacttgaactctcttttagtttttctaattttagatattattatatttttttattctgaattttaattaatctcgtattgggttcttatatggattcttcttttaatattgcttatttttaatttcaaattttagctaattttaaattgtattcctacttgaactcttcttttttttcctaatttcgggttttatttttatttttatcctcaattttaattaatctcgtattgggttcttatatggactcttcttttaatattccttatttttaattccgaatttcacctatttaaaaattgtattcctatttggactatccttttcttttttaaattttagattttattttatttttattttgaattttgattaatctcgtattgggttcttatgttgaaacttcttatgtggtgtctcctttcaaagttgttttaataatatcatagattttagtagtcaaagctttgtcattaaaattatgcattagttcctatatctccttatttctcatcttatttttcgtggctaatttattgtctgtagctagttgcacaaatatctcctcgtttaagtctggttagtgtccagcacaagttgctcatttttctcgattggttgaagcatctacttgagtcgaatgttgcattaaactagttagtttgctcataaccgatttgttgtgcaattttgagatggaatctgaagtgatttggggtttgaggggagtacaacgtaggtgatacatatgcttgactttgtcttgtggacttatttaactactgcaaactatttttttttcacttggcatgctcttttttgccaatttgctaacgccattgctgtccttgaaggtccttagcgtgagcaggcttggcgtggcctaagcctttattcctcttctgacagaatcacaaactgaggtaaatcacaaattaattcatggtacattctacttgtatactgcatcattgctaatcaattaggaaaaagaacagaagtggttgatcctaatgacaatgcagttactgaagctgttgtgaaatatggcattaaactagttaatttgctcatgaactgattttttgtgaaatgttgagatggagtctgaagtccaatgttggggttcaagggttgttctatgtactggtgaagtggtgacacatatgcttgaccttatcttgtggacttatttaactactgcaacagattttttttctcttgccatgctattttttgccaatttactaacgtcactgctatctatagtatgcactgaactgaagctgttgatgcaccatatattaatgtactgcttgtttctagaggtagcacagtgtacttcaatgtttttgtgactcgggaaaatttatgcatgtcagaattgtcttcagaatttctcaattgacacatcctaaaatacttaatgccttatttttcttgttcctctgaatatgtcagtgaaggatatatagtttgtgcaaagcctgttgcttaaaagccccctcctcaatatgtagcatttcaaagacatacaaaagatgataaaatagctagagcttaaatgcttggaagagggataagttatctgcatttgctgtttcatctacttgtattattggtactggaagttgtaactcccataactcgtaacttacagtggtgataaaagattcttgttgaatgtaaattggttataaacttataagttacagggctgaaagtttgcttgtattttgatggatgaatttgtgtgcatgtgaattgctgtgtatatatatataggaaacaactccattgctataatgtgttgagaaagtattgttcagtaatccatattgacatatgaactgcattgttggttttttttttctgccttgaagttaatttttctgacggttctacctttgtttttctgacggttccacgtcaaaattatggggacaaaaacgtgacggcagtggattttttctgtgttcctccatcagaaaaatacccacagaaattgtttttctgtagggaaaccgtcaggaaaatggaatttttccgtggtgatttttctgtcggcaatttctgtcgattcacccacaggaaaataatttctgacgggaaaactatttttctgacggtttcgctcctacagggtaggtcccaaatctggtagtggctctgataccgctatattcgaagggcgtacccagccttagctaaatcttatgctacttggagttctagaacaaacagaaaaggtgctgaaattaatttgaagagagagtggcacagcgcaaaaagcctgaaaggccaaaatgatagccacattcgctgcatggccaacttaattggttagggccacgtaatcagcttgggaaccactgaaacccatttgacagggcaccagtcattacggtctcctggttttcctctcttccctatctccctaggacgacggcggtagacatagagaaggacgacggccaacggtagaggagctaggcaatggcggtgggcctcgatggcatctcggagaggggcgatgtggagggagctcaacttggacctcttatcacgtctggtgagagatgactcagagtaagccctcttcagcaactagagggtaaaaaaaagaggaggaaacaacgagcagccggcggcaaagtacatccgttgcgctccccatcgccgttgccgccactgcgaactttgatttcccaagtccctctgccctgatcctcctttgcgccctctcgagctcgtcgccatctcactcatagccgttagtggcgccaacagtctttcaagcggatcttagcagacgaagcgcatgcagatgacgactgaccatccccattgattccccttatcgttgtcagcatgcaacctcctcacgcgcggctagatgaggttgctcacgagctgcgatgtgactcccaaccccgcgtgacggcataacatccgatgaacacccagacaacgagaaggccaccatggctagttcgttacgctctatcgccgcaacagtccatgtcctcccttttcatccccttcccctacctcctcctttatgatatcctttcctttttttggcgccgttgtccctgagccttccctatagccactgccctggagagatggtgaagaaatggggaagaatgtaagggccctgacataggtttcatgtggtctcacggccattttgactacagtcaactcaccatgtgagtgaaaatcggtcaaaatactgtcctgcgacctcgggtactctggttgtaagttgtgggatatgttatatctggtattaccattcaattacacgatgcaaactcgaagttaaaatgagggaccaaaagtgcacttattccgctgaagtgctgaacattggaccgatctcctttgtgcgtcctaaccgatccaacggctgcccacgcacacgtacgagtaacccagttttatttcggcccaactggtgcccaagtgcccgaccgcgcgtaggtttgctattgccgccgcggatagctctcgtggccgccacggaacgaggtccgcgcgctcgcgattgggctggcagatggatgcctggaagcgttggaagtgggctcatatattaggagaggaacatacaagtcaatagtggtaggcatgcacactgaagactgaactgactgatctgaactgttgcttgcatgattggattggttgtttagataggagtacttggataccttaatcaaatcatactacaacatgcatatggtactagagttctagagtactctctgtatttattttgcgatggagggagtagaaagcaaaggtgttgagattttctttagaagagagagtgccacaacaatgtcttactttttttttcagattattcattggattatcaaaacggattatttggtatatacttttaaaaagaatatgttttctacaaactttttctactatattgcttagatcactcgttttaacttttaaactctttttaatttatttttaaaaatattttggttaccccttaaaacccatcgcaataagctgcaaaataatctgaaaagtacggggtgggtttgaaagtttatactttggaatggcaaccacattgctgcatggccatcttgaggagagataaagactcaaagtattctttccatgaggttctacctcatgttaaatttcctctaatattcacatgggaagaggcatttcataggattccataggatttattcttttgattcaaaaggctatataggaaaaaaaaatcatataggaatgaaattccctaaaatttttatgaatttcctttcaatcaaaaggggtctaagtttgctagccaacaatgagatggctagctactcatagacttactttgtacggcaaacataaccaaaaataccataattagaaccatctcgatctaagctctagcgagctacttcaaacctttcgccactagcgcgcagcatgtcgttcttgttgctttcctttcgtagcccttgggctacggtttactttcccgggttatacggctcatcagagttagcagtggggcataatccacaaactgccttgttgatcgtcgaaatcacaaagaaacacgcaaaattctggcgtggcggccgcggggaaccgtactgcatgccggcaatacggcgaagaagcaccggccccagtaccgtgtggatgcacggcatcatacggtacgaccgaccccgccgggggctgcgctgatgaaagatgcgcttaaaccgggggggagcagtatcagcatcagcagaacgtgacaccccggtcccgcgcgtcatagtcgatccaaaagccccccatgatcctctcgccagagcctggcaccgggccccacatatatcgcccgcccaatcgagcggggccccgaaaagtatcaggcacaggagacgcgatgcgttcgctgatctgaaaaagataaaaaggaccaacgtacgcatgcaaccgcgcggaggagaggaggcgagcgtgcagcggggcagagctaaacacgaacgaaagcccggtggtggcgagttggcgactgagcgcccgtgtacgtcgctggattccccgacttgtcaccgttgcaggcttgatgtcccccgctgcgttcgcccgacggcgggggccgtccgcacattaaccgcttgtgtaagtgagctttatgcgcggtcgtcggaagctagctagcaaacaatgccttgactgttgggggcgctttgggagcagctggcgcgcgcgtggggtcttctccggcgaagcagagcggacaacgtgtggagttcccaggagagatcgagcgagacgccgagacggacacggtcacgcagctttgctgctgatgtgggggcttcgttcactgcgtgcactcggtccgtggaacagtggattagataagaggctccgacgcgagctgatcggacaacggcgtccggctctccgaaaggccggctggagtggagtggagtacaggagggttcagcacagcgccaggccggcttaaacatgaattctgtgagaaaattttgtcatcgatcttcatctcatctctttaaacgtgtattaagagtagttatacctacgggtgtttgctgcacaggcaatgaggtgtatgtgtgtgcatctttctcgaaaaatataaatgtactcgtgctgattttaaatataccatgtaagttgtttagacttgtgttgtgtatatgaattgagaaaacaacttgcttactccttgtttttacatttctgagatttacgagggggatactaacatagtaacatttagagtatatttcattttgaaccacttttaataaccactggtagagaaaccatctttggtcggtcgacctatatccacaatagtcccggttccattaaaaaccgggactaaaaatgatttttagtcccggttaataagaggaagatctttagtcccggttgttgttaccaaccgggactaaaaatcatctttactcccggttgattccatgtcaggctgtgtcagggccctatgac

SEQ ID NO: 23277 - DNA, 10929 bp, Oryza sativa
ggattttttttttgaaatgtgaatctgtgatgtatttttgtgtgagatgtgaatatgtgatgaattttttagaaccctgtgatgtaatttttttaagagtttgtgatgtatttgaatatgatttgtttgaggatttggagatgttctgtaatatgtgatgatttggatatgggaggggatggtgtgaaatcaatattcaatattaaaagcagaaaaaaaagaaaaaatatctttagtcccggttggtgttatcaaccgggactaaagattctcccatctttagtcccggttggtaacattaaccgggactaaagattgatttttagtcccggttatttgaaccgggactaaagattctcccatctttagtcccggttggtaacattaaccgggactaaagattgatttttagtcccggttatttgaaccgggactaaagatagcgatctttagtcccggattcgtagtcccggttggaaaaccgggactacagggggttacgaaccgggactaaaaagcatttctccaccagtgaaccgaagtttcatcatggaccgccaagcttatattttcacttagcacagttaccaccactctttacactttaaactagggtttacaagttagcacaagaacatcaaatgtaacaggtatacaacatcctataaaataaatggaattgcattatattactgcatatgaacattcaaagataatatatatttcattactatgtatgaacattcaaagatcatatttcactgcttgaaaattaagatatcaacgcatgttgttcaaccttgtccaaagcgtgaacgattgtaactatatgctgtgatgttacgtgaaaagataaatctagcgtagtctattgggaaactttggttgataaaagtagctcaaagtgaaatttactctaacatttatctgcaaggacatacaaggaaaaaagttgcaaaaatgtcttaaagtaaaaaaaaacagcttacaacttggaaagagtcgagaacttatgttcgagacaggagagtcaaaaaaattaatttagggctttcatggaacaaagaaaaaacataagaccttttaggattgaaatccaatggaaaattttcataggtgctcatttggaagaaagaaatgagcacttgagattcctacgaaattcctatggaattggcttgaatcataatttattttaaggatttctatcatgaggttgggcctcatgggaaactttccttgtgttatctctctcgaaaaatcctgtatttttcctatgaagcatctaaataacatatttcacacaattcctgcattttaggaattatttaaaattcctaagatcaactaaacatgccattttgattcttacgtttttcatgtctagtgtttttagattcctgagcattttttttcttttttgccgataaccacctattaattcaatactcaacagtgacacaaaatgccagagctggcaaagtggagtagctattctatgcaaagatttttccaaacattctctccggttataaacatttgacgtggttgactttcattcatcttattaaaaaaatttatataaatattatttattatgttattacttgtgtgtctatatatatatatgtatttatttatttatttatttatttgcacgaaatttttaaataaaatgaacggttataaaatatttatggttaaagtcaaccgtatcaatatttatggtcaaagagagttcttcgtgaaagaaagaaaaggaaataagctctccaagaattgcatgcaatttgactttcggcactacggtcataaaagaactggagtagtgatcatttttgctacctgacacctcctaggctcctagcagaatctttaattaacacattgcctaaattttcattacatatggcagggaaagagctacagtaatgtcgttactcgttaggccagccaggctcatcgatctcccaacgaggcaatggcttggatgaagctctacagtaaatttgagcagtacatatctacagtattcactgccactcagccagactagcggagtggtgccgttctcaggctcacggtcccggtatggtcgattcttacgggcgatagaagtcgacagtatactaaattgcattggactgactctgtgtttctgtcaaaagctctatatatatggagtagtgtaactcatgtcaatctaggtgtctataggtggtgcgaaatccgcaatttactaacgcgacgctgctgcaaatttgtaaagaatatgataagcagagattggaaagtcgtgagaagggggggcagaggcatggacgcggtccagggaatggaacaggatggcgcagcgcagcggcaggggcgtcgccaggcaggcaggcaggcaaggccatggcgaggagggcagcagcagcagccgcgcagtgctgtcactgctgtgcttgagagacccacacacacccgataaaagcgagcgcgaaagcgagcgggcgaggtggacgtaacaccccccctctactaccgctgcacacacctgcacactgcctgcctccctcccgcgcgcatcgctacgacgagccagctgccagccagccggccggccggggaggtctttcctcttttactccctgttccttgctcgtatagttaacagtagtacgtactcatgcacggctgccagtgccacagcctctctccccacgggccgacggcgagctagcgcgcgcgcgcgcatcatccgtcgcgctcgcgtatggttggcgtggcgcatcattcatcagtagtcaacagtggcagcgccgcagcagcgagcgagtggcagcctggcgcagggccgcagggggggcatcaaaattttggcagctgcgtgcatgcgtcaacaatcgtatacacggccgagtacagagatgacatgggcgcgtcgtcgtagcgtggatccatgatgatgtgttatattccggggaaggaaggatgattggatgcgatgagcgatgtgccaatgtcacgccgcgcgcatctcagcaaattcagcatcgtctccccctgcacgattcggacctgtcttaaacggtttagctatggtcaaaaccaggagtagtttatttagggcagtcccaaccctctatataggatggtgtctatagtattaactacattgttatgtaggactattaacttatgtggcactatattaattaagagagagagtgaagagaggaagaaattgggtctcatgcaagacacaacttcaacacgagaacctatgcactagacactatcaagttttacattgagagataatactgtcttcataatagatgaataataaatatgattggtagagaaaagagatgatgtatttattaacggtccactttaagaaacaatgagttgtagagtgtagtttctattgtgatgtcttattgacatggtaccatagacactgcttatggacactataagttgggactgcccttacatgccacataatgttatgtgatgtcatgctgctgccaggcaggtataaagacatgagcaaggccttgcttagtcctaaaacaaagaattttcacggttatatagattacgtgtaaattatgagacaaatcttttaagcttaattataccatgatttgataacgtggtgttacagtaaatatttactaataacggattaattaggtttaataaatccttcttgtaattttctgacaagatctgtaatttagtttattactagactacatttaatatttcaaatgtatatacgtatatatgatgtgacaaccaaacctaaaaatttttctcatctaaataaggcctgaaccaaccggttgaattggtgttcaatgacggtgcattgatcgggctggccgtgcagtaaggaaattaaaagcagggctagctgggaagaaaggcagtaagacaccgtggacaaaagagtaatagcatatattgactacctccattattgttttctactggcatcgatacacatcttttactttatcgttgtttactttattacaactaggaaggatggaaagatgcgtggatatcttatttattatttatataaataatattagaagagttaagtcatatctcatcatataaatataaaaaaaattatagatttcgtctcataagaaaaaaaatatgttgtaaaatagatagtagactttaatataaacaataaaaatgtttcttgtattaaaaaatcactgttgatcaggatacatttaaactcatctattgtcgccgttacttattagcattatcgctaaatgccttttgaataaatggaactgcatatgtaccaccaaaataagtctaatgcatcattaatacataaaaacattcatcttcgctgcatacctaaatgtttatgtcaacacttaatttttaatctataaataagtaatctgaaaatattgcttctattggttaatggatagcaccgttaacaattagatatgaatgccccctctaacgggtgaagctaccaaggctttatttctcttttgccttcatacataggttccgtatcgatatactcgtgcctctcaaggccagcatggagcacacttttaagacttagttcactgtcaatatcttcaaagacgattgtatcgctaagtaggaagttgagcactattgtcaatggtaccctccactaggactgcctcaactcaaccatatatatgccccatgctatactcatggtaacgcaacaagcactatcatccatgcttgatgcccttcaggggaaagcaagaaaagataaatgtgatgagaatagttctttccataaaaagtatatatatttttattttttagacacaatttgtttgtggtgttaattcaaatttttatggtacagatacaatgctctgttttgaaatgagcaaggttgatccttaaaatcgcaatatttaaccatgataagtcatcaacaatataactatgatggagcggatggttaatggaattttttttatataatatatataccttcccacatctaactgtatactggtgccttacatgcatggccagtataaagtcagatttggtggataagagatttttgatatatttgaatgcaagtaccatgtgccaaaggaagtcgttttggacagcgatatggtctccaaaactcaactttgacttcttgtttctataaaaatatttattgaaaatgatatatgcatacttttatgaaagtatttttcaagacaaatctattcatataatttttacattttcaaactcaacaacttgagagctattcatgatttatattctcaaggtttgacttaaatattgtcttaaacgacttcctttacaagtacggagggattacaaataaaagtagttaaataagtaaatattccactgtattttcttatggcaaagctatcgatatcatttcaaagtgacaacacaaatatttttgttatgtatatgttgtgatcgaagttttttaaaggtatgcatgaactcacatgttctaaaatgacgacaagacctagagagggacaaatagaagttttcaccagaagatcgatcgacaaagagcaattttcacaaataatttatcagcacactaggtagctccaataatgcaggatacaaccatctcagattcacaaagcaaaccaaattattggccccaaaatacatccgaaaagtcataatatcacacacatctaagctagccatggaccacgagccgggccaacaggggggaaggtaacatggcaaccaaaggttgttaacacacacaagaagaggaggatctttcggaaacagctcaacgaatcgtgcccgagatgcagaagaaggccggacccccgggctagctatttactggcgagtactgtgttgtactacacatctatagtagggtggggaagggaaaagacatggacaagaacatgctcagatggctacaggaagttgatagtaatgccaatgtggacggcgcgggggccggttgatgaaggcaccaccagccgttctttctttggacagcatggcccctaaaatccaccatgcatgatcagtgctgtttaattagggttcagccgctcagaggaccagtaagcaaaagttgtgggctttaatttgctttagcaatcagtatccctgctaaaagtgtgcaggttatgtaaagggtagttaaagatgtatataactacatgttcacaatggcatgtcacatgttcacaatggcatgtccttgtgaccaaggagaatatcatagaacaacttcaagttctattatatgaagtcttaaataacatgtgatacactatacattgttcaattgcatgactcggaagatacgcttgttaattagtatatatagtgctaaactaaaagatgtgcttactagtgtagtggaaaaaaaacatgtggttttaacatgtcaacatgtattatattctcggatagtattcacctcattattatctgacatcttatacactctatattgtttgattgcacaactcgggagatgcgcttgttagtgcaatggtaaattaaacgatgtgcttgcatgtgtagtgggaagatgtgtggttttagcctgttggtatgcatcagattctcggatattattattattattattattattattattattattattattattattattattattattattatcaagtacccttttgcacgagtttcattatatgaagtcttaaataactcatgatatactctatattgtttgattgcataacttagaagatgcttttgttagtgcagtggtgaattaaaagatgcacttgttagtatagtgagaagatatgtggattgattagcctatcgacttgcattggatttgatagtattcacttttgtattattatttgatattaagtatttttttaattgtataatgtttttctattgcaaattcggttcctttcatgccatggttgcccattggcgtgtaagctagaatcaacaatcaagttcagccatcaacaatctgccggtggtcaagttgctatccctactcttcccaacttgcacacgctccttacctgactcacgctatctttgaattgtcaccaatgaacatgagttggttgatccggatccgaccattagcttatgatctatgccttgactgatatcaaactaaatgttcttttagttcggcaatacgtagttgttgttatgatataaaactagtggcgatgccaccgctcgataaattctgagcagtggctcggtctcatctgtgaacacataatataactttggtgttatcacaatgatggaaaataggaattttatagttaacatattctatagttagatatggtcgggctctaaggccccctttgattcaaagtaaattattttttctatatagccatttgaatcaaaagaatggatcttatggaatcctatgaaattcctatggaatgcctaatgccttgcaagttttggagaaattctaacatgaggtagaacctcgtggaaactttcctttgagtctttatctctcctctaattcctgtatttttcatgcgttccaatcaaacaaccattcttgtgttttacaattctctgttttacacttacattcatatcaaaatcctacgtttttcctattcctacattttccaatgttttaaatagcgggctaaggcatttagcagtttgctttttaaacagctatagcggcagctatagctagctaaatggagctatagcggctaaattgtacatgagagcaaatagctagaatccttctcaaacagctacaacgggagatagcgcagctatagcgggatatttaaaaccctgacgttttctcattcctgcgattcaaagggttctcgaactccatcattgtgtgaaaccatgaaaaaagaaagttgtagcagtggctacaccaaaatcgcttgagccatatatgaagaagagtccctttgatttggaggaaaaacatttaaattttgggatttttatcttataggagaatttcgtatgaaagcttttgatacaaaggattgaagcctatgttatcctttgaagggcccatttgatttgaaggaatgcataactctgtagagattttgaaggaaatttaacaagatcttcaacttcttggaaatttccctttgagtctctctctcttatccgattcttatgtttttcctgcagtccaatcaaatggtcatccatgtgtttttcctgtattttgcacttacattcctattggaatcccgtattttttatatttctctatttttctattcccgtgatttaaagaggctctaagagatatatagagcctatcatagttggaggcgatgaataagaagggtgaagtaccataaaaagtactcctagtgaaatgctaaattcttcatcagtgtttacctagggggtgtttgggagagaggagcccccctagtactacaatctgaaaatggagctagaatctatcgcagggagggcagctgtttggctgagagataggttccatttcttaaggaaaataagttccacttcatgctgggattaaacaagcaagttactacaactgtttagagataaacatcgatcatgccttcaagcaggaaccaggaatcttactttgttcacgttaaaaccaaaccagaagcacagaaaggtactactatagcagcactcctactttaggagtatatatgcagcaaatcaacattcagaaaccagccaacttttagaaaacaaacctgtagggagtgagaaatgtggccccgcatgttttgccaagactgcagcaaaggcagtaaggcagtgaatcagtgatggaaagcaaagcatgcatgcagcagcattgcgtttttacttctcactgataaagacattatcagcgcttcaccgctgggacagcatcgctgcggcagcctcatccaagcccacctctgccgctgccgcagcagctgcccctgcgcgcccttcactgcgctcggctcccgcctctcgcgctgcctgtctcttcctctcttgccatctcgcccacttcacttcttttactgcaaacgccagtactatgagcaagtaataatgtgataatttaagggcattcatacccctctgcccaaaataacttcacctttcatcgttttatttgttctaaaataattttatctttaaaacgatctaatatatattatattagagtttatgaaagtgagaaaaatacattacgatttgttaaagtagggataattgtattgagatttgttaaaatggagatcattctagtatttttcttttttgacttatattggctgcaatagaggaaaagtaaagttattttaggatggaaataatactgcttatagtgctagctttattttttcatagcattgtttgatacttcctattttagttcacgtattttttttaatttacatataaataaaaaattacaaaactaatataaaatccatgctccctcctattactcatttactccgctggtctctcttctcctattcactccaactcctccctctctaccgccaccatcactacctcttccttctttagccaccaacacctctcccctcaagctatagcaagcttcttcgacacaaattgaaggtggcttagtaccgggtggaccttattttaccaatttaggctgagtttaaaaaaggggagatagagaagattgggaagatacgcaaaatgaggtgagtaattaacgtatgattagttgagtattaactattttaaatttcaaaaatagattaatatgattttttaaaacaactttcctatagaaaatttttataaaaaacgtaccgtttaatagttcgggaagcgtgcgcgtgaaaaacggaacaaactatctcacagtctcacggtggcgaacgcagccttagacatgagacgagagcatcacttgcagcccaacaaaggaagcaggaagggggcgccttctgtggcagttgaggaggaggtagattggcgatgtagcacaagaggatctcattgttccctcaccatcaccggccatcccgttaagctcactgaacagcctaattttatagtcacaacctcactatcattcgttgctacatgtagcatggtgtttcaaccctctaagaccctgtttagatgggactaaaacttttaagtccctatcatatcggatgtttgaaaattaattataaatattaaacgtggactattaataaaacctatccataatcttggactaattcgcgagacgaatctattgagcctaattaatccatgattagcctatgtgatgctacagtaaccattctctaattatggattaactaggcttaaaaaaaatgtctcgtgaattagctttcatttatataattagttttataagtagtctatatttaatactataaattagtgtctaaatacagggactaaagttaagtccctagatccaaacaccacctaaggtatcgagtacaaccaatgtagggagtagtttttacggtaatgacaacccgcaaccatgcagggagggacaacacgtgtcattgggagacacggtttcagtcgaggggagctagagcgtcgatatggatggttggaacaacttacaagtgtcaaaagctacaaactatttttatcagttttcaaataaaatttttgaaaatcacttacactgttttatttttttaaagatgaatattttcgtcacgtacagtacacgctgttttggccagggttgattttaaatatttttattcagaagaaaacaatagaaaaaaaatccaaagctgctggggtcagctcagctcgaaccctgctcccctctgccgctctctttatccaacaatatttgtaggccgtagccctggcctcccctctgccgcctacgagagacacccccac

SEQ ID NO: 23278 - DNA, 5068 bp, Oryza sativa
gcctctcctcacccactccgctctccgctccattaaacccaagcgagggacctcgatcgcctcccctcctcgcttccctccccgtctctcctctttcgaccgcgttggaagcaagcgcggcggcggcgcggcgagctgccggtggggggttgcggctatggtgggcatcgacctcaacaccgtggaggaggaggaagacgaggaggagggcggcgccaccggcaccgtcacggcgcctgcggaggcgagggcggggggcgcggtgtgcctggagctgtggcacgcctgcgctggccccgtggcgccgctgccgcggaagggcagcgccgtcgtgtacctgccgcagggccacctcgagcacctcggggccgcgcccggctccggccccggcgccgcggtgccgccgcacgtgttctgccgcgtcgtcgacgtcagcctccacgtgagtgcgctcgccgcttgctgctctcgcgcgagcgcaatgtgttcgaggtattgattgagagagagggtctgctcctcccgttgtgctgtttgcaggcggacgccgcgacggacgaggtgtacgcgcaggtctcgttggtcgccgacaacgaggtgcgtttgcgtgcgtgctgatccaaaaatgggatgaatatctttgacattcggtcagtgctagtagctcaaacgaacattatttctgggtggttttttcaggaagtggagaggcggatgcgggagggagaggacggcgcggcctgcgacggcgagggcgaggacgccgtgaagcggccggcccggattccccacatgttctgcaagacgctcacggcctccgacaccagcacgcacggcggcttctccgtgcctcgccgcgccgccgaggactgcttcccgccgctggtacgggacgatatcgattgggacaagctacctcaccgtgatctgtttgattgcttgtgtggtgactctgttcagcttggcgcctgcaggactacagcctgcagaggccattccaggagctcgtggcaaaggatctgcacggcacggaatggaggttcagacatatctatcgaggtgattcgccggtttagcctatcttggtgactgggatatcagccgtactatcactaactaccatatatatgtcatacagcttggttgttaggcttctccctgggaacatgggattaattttcttaatgcgtgagagaacctagtaacctacgggctgtacagtcctacatcttcctatagtacatcacaggctgtttaggttgaactactgtactttgttcaccgaataacgcattagtatatatatgttttttcttttagtaagattatccaggtctcctttttagatacatctatcatgtctaggtattggaagcgagatggctgtccagtttagacgaaacaagcaaaccaaactgtaacttggctggctggatgagataaaaatgagcaaactatgctattttttctcattaggctctgctcacttactctgggagtgttttcaataaattattttaatttatgcatagactacctatttctacagctattgcgacataatctctaatagttaagctaattgcaatttggaggagtcttgagaaaattatggtccatgaatatctcataggtctgcctctaattgttacaggccaaccacggaggcaccttttaaccactggatggagcgggtttatcaacaagaagaagctagtatctggggatgcagtgctattcctcaggtaggcctatagctcatgtgctcatgaaccactaactcgaaatgtactaaagcttctcttttgtaatgatctccagaggtgaagatggagagcttcgattgggagtgcgccgagctgctcagctaaaaaatgcatctccttttcctgcacttcataaccagatctcaaatactagtagtcttagtgaagttgcacatgctgtggccgtgaaaagtatttttcacatctactacaatcccaggtaataaagtactttcctgattttttgaatatttaaatacctgtacctgtagatgttatttgcacaagtaaccatcataaaaataagtacaagtcacagatgcacataatattgcacatactgtacttttccaaccagtcaaataatcaaccatataataagaggatgtcggacagacagacacagcaatagcttgtgatagaacaagttatacataccatatgagctagagaatattaatatttattccttgtttcctcatgtcaagttcaaactccagatcatataagttggtggcatgttttcagtcatccagaaaatttccaatgctgacatttttcaaatgctcattgtttatatcatggaactggacttgtaattttgtattagaattgcaacattgtaaagtttagttccggctttttctaatccaaccttttggtatgtgaatagtagtttcctggctgactttgctgatctcgaccatgtagaatattgtgttgtttttaccacatttaatttgctgaatatatttgttttctcggatatactaaatgatgccacattgccattgcatgtgttcctcgaaagtgttgaggaagtgcacattgaagcagcaatatgatttaagaggatgtatctaattttcttgttttcaaatggtcatgtgtggtttactgctttactttcatgtgtggtttagcaatatagatttcagaggatgtatctaattgtcaccattttgcaataatcgagcaattttaacaatgttttgtgctatttctaagatacatcagataaaaaaaagaaggataattcagttccattgtagtgataatggtctttctttcaaatgatattcatgcatttgcaatgtgcaacttctgactgttcttctgcatgctatgtcctaatgtggatatggttaaaagtcttcagagttacagattttctttttgtctgcttctcttgttggataatgtcttgatgtcagttcctgcctttaataagttgtactcacaggttaagtcagtctgagttcattataccatattggaagtttatgagaagcttcagtcaacccttttctgttggaatgcgattcaaattgagatatgagagtgaggatgcttctgaaagaaggtattatccaacagttatatttcatgttttgcgaaatggcattacaatggtaaagatatttctagctcgtgcttggtttttcataaagaatttgtttttcaggcgtactggaataataattggaagcagagaggcagatccaatgtggcatggttcgaagtggaaatgtttagtggtatgcgctcttatatataatactgctttgcacagatggatgccagtagttctcttatttgatgttttactgcctagtgggtccgtgtctttcaaatagcagagtgcttctctgtattcagcattcaacattttgtgttccatgtcttagctttttatctgttgggaagttatagtttgtacaatccaaaattttgaatagatttaatggctcatacaagggtaaattacggaaacaaaggcatttaacctttttatgtgaaataaactagcttaaagtttatttttgtgaacttatgaaagtattggtcaagatttcagtgtttgcagcgcatatgtaaattcgtgtttgcagcgcatatgtaaattcttggtgtacttcaggttctatatctatgtttttctgaacacacaagtttagaagcatttgatatgatgaaccctgaaaaatagcgccctgcacttctgcttatcagcttataggatagaatatagaggttgaagggcatactttacatgccatagtgggcagggcatcgtctttactttgttaaaattttctccatttatattccaaatctttatcatgttcctgatttctagtattgtattgtgatggtgacaggtgaaatgggatgatgatgtggagtgccgtcggcctaatggggtatctccttgggagattgagcttagtggatcagtttcaggatctcatctgtccactccccattcaaaacggctgaaatcatgcttcccccaagttaatccagatattgtgcttccaagtaggttccatttacaagtcaaaggaatcattttctgtgctgcatgttccctgttgaactcacttttccttttcccattttggcagatggaagtgtttcttcagattttgcggagtctgccagattccacaaggtcttgcaaggtcaagaattgttgggtttaaaaactcgtgatggtactgttaatacagcttctcaggcgactgaggcaagaaattttcagtacactgatgaacgaagttgctctatcaacatgagtaacaatatcttaggggttccgagacttggggtgaaaactccaagtggaaaccctgggttttcctaccattgctcaggctttggggaatctcaaagattccaagaggtcttgcaaggtcaagaagtgtttcgtccttaccgaggagggactttgtccgatgcctgtataagaggttctggcttccgtcaacctgatggcaaccatgcacctggtgcagcatttaaatggcttgcaccacaaggatgtgatcatcatgggataaccacatcagttctgccgcaagcatcctctccatcatctgtcttaatgtttccacaaactagttcaaagatgcctggccttgaatacatatacggatgcctggatagaaatgagaatagccgacattttaagattggacctacacaagatatgacaagaactgatcaaacattacgactctggcctcatcttatttcaggcaaagtgctagatgagtgtacgagaaatgagaagctgcactctccagtcagtggtgctgagcatgaatcaaataacaagtgtcttaatacaaatggctgcaaaatctttggtatatcattgactgaaaaggcccaagcaggcgatgaagtggattgtggcaatgccagttatcattctcggctccagtctttaaaaccacagatgccaaaatcattgggcagcagttgtgccacggtaagtgctcaatgaaatgttcttt

SEQ ID NO: 23279 - DNA, 15978 bp, Oryza sativa
  unsure (1)..(15978): unsure at all n locations
gttgtaatgcacttctaagttctaagctttgaacctcttaacgttgctcctattttaagctcccgttgtaatcggcatttatgttgcctgacctacttgcatatttttcaatttgtccgttaagacagcccttttagagggcttgcttatgttagcaacccttaatttccaaattccaagtatggcgaccgttcgaggggtttgtttgctcctgggacgacatcggtacatgacatagaatccattggtgacaccagggcacatcagaattaaggtgtagggcgaaacaatagaagctgaaagagcgatgctccggtgctttgatagcagtagaaataatcctaagggtacattagtaatatgatagtgatatggattaggggtaactttgaatattttttttttgtgtgtgtgtctcggtcggtctttaggtctgtcgtctccgtcatcgatcccacggtcgctttgtattgctcgctcgtccatcgaaaaagcgaaaagcaaaaagcgtcgctcgcttgtcgatcgtgactgagtcctcccgccggttgcacgtgtggatcgcgagtcctcccgccgatggcgaaacacttcggcggcccttctctgtgcattctccttcacgttctccattcatagctggcaacccgcttcgccgccgtacgtgcgcgcaggagcgccctcgatccaggcgggggtgccccgttcggaggctgctccgacgactttcggcgttggctgcgacgacccctctccgcgtgcggggcgagattagcgacgacgcccactttggaggattcgatccgttccagcggcgggtcctagtggcccttcccgcgtgctcccaattctatggacggcggccactccgatcctctggagccggccggttgcctgatcccctccgcgtgcgcgtgagacttgtggtggcgcccaattcggaagctacttcgatccattcctatgtcgatttcgcagtactcgtcgtgcgcgcgagacttgcacgaaccaccctcgccatcaccgtctcaggttaccccgccgtcgctgatccttgattcaaggacgttcgtcggctctatcaagtttaggtaaaaaattgtggctttctcttagtttgccttaaccttctccgctattaattacagttttcttcccaaaagcaaaaaaaaaaaattggggctttaatttaagcgatggtagttttatagtatattggtactcccttcattccaaattaatttatcatataaccaaaataaaaacttccaaattgatcataaccatgaccccttcatttgatatgtagcattattgcatctatgcatgtaaattgagtctgcattcatgcatgcaggcatttagggatagttaaaggttcgtttcttgtgcatgtggaaagttaaagtatgcatgtttctttatttttcaccaccacatactcacattaaataaaaaatcaacccccacatactcgtattaaatgaaatatatggtagttaagtctacctttatctcgatgaaaaactcatataatcatccatatggaatggagtgagtatattggtattgacagtctgatcacagcgtgtgggctcgcttgttctgtgcaatgtattctaggagatacattttttctgtctagtgaagcttagagcacacaaagtgatatagtaatatgagagtactaaccgtcacatgtatctagtgctgtgtctatgcatagcaaaattcttcacgttaacgctaaaacactgtatttctgatcaaataatttgcaagatgcctaagctgcataaaagcatcaaaagcagcatacttcagatgacacttgttctaaagttcagaaattggcatcttacaacttacaagctgaaattactgaaaaacacttgcatgttcattctattatcaatctgaacagcaaagtgaaaggacgatatatgaaaccttacagtttgggatgacgcagggcaggaagttggcctcgtcaccgacgtgcatctgcttgtaccctggctcgtactcgcacctgtaccccatgaaccccatcgccgccatgcagttcctattcccacatgccaccgtcttgcatatcaaccctgctctcaaccattccaaccaaggccgtgtttagttgttttggcaaaatttctttgacgtatacggacacacatttgaagtattaaacgtagactaaaaacaaaataaattaaagattccgcctgcaaacagtgagacgaatctattaagcctaattaatccgtcattagtaaatgtttactgtagcaccacattatcaaatcatagcgtaattagactcaaaagattcgtctcgcaatttacatgcaaattgtgcaattggttttttttttctccacattgtgtccaatcatttaatgtgacgaaaaagttgtaagtttgagtgaactaaacacaacccaaatcatcaaaaaacaagacgatggattgaagaaaaataaccccttttccacattaatcgggaaaaaggattttactaatttacatgggcaatgagagagataaggttgtggattcaaagcaccgctcttgcccgacgcagcgtgtgcctctccatggatccatagcaacgccacacaacctaacaaccacaactcgccatcgacttcccaaaccccgaatcgcgtacctcaccaccttgcctagggtttcatgctcacaagggatcgaggaagataatcgagggacgacatgggccgaccctcgaggcttgtcgtgatggagcggccaacagggatgggggtagggcagggcgaccgtcgacggaggaatggtcgagcctgctacgactgaggaggagaggaaacggggctgggcgacaacgcctgctagtgctatgattggtcggtgctagtcgacagtagaggtggcagaagggaggagacgctaagcggggatgagaatagggggagcgacacgttcgtgtttgggcggcggcatcaaacgacttaggtggtgtttttttctcctgaaaataaagatgaagatgaagattaagtttttttttacataaaacgaggtggtattaacgtatgattgattgagttttaattgttacaaacttaaaaaatagattaatatgatattttagagtaactttcatatagaaagtttcgcacgaaaaacaccgtcagtttgaaaagcgtgccataaaaatcttaatcttcatcaaactcttcttagaaaagagttgctaggtttagttgctgataaatgacacttatactccttcactccagctttttctagataaaagtttccatccacgtttctattattgataactatggtggtagtagagataaatctgatcccttcgatcaaataagattaaacagtttaaattgctttctaatacctgtagagatcactgtactatgcctgtttgttgctggaggtttccaagcgaaacagtgtgcatggaaaatagatctatatgatttcttttactacattagttattttttttaaaaaaaatgaatcaatatgattttttaaaaaactttcgtatagaatttttttttaaaaaaatacaccgtttaacagtttggaaagttgcgcgtggaaaacgaggcaaagggagttgggagcgagcagttgcgatttacgaacagagcctaaagctgaaaaggatcttgaaagtactgctctttcaggcagcgctgctctgaaaatacgatagggtgtgagaacccgggtttatttaaccggtatgggaaactggtgagaacactttgtacacgctttcacagcaaagacataatgaggaaatgagtatacacgagtgggttactataaacatattttaaagagataaaaacaagtttaatagtatagccaacccatttatataatagttaagtataaaaatatacatcattaatacctggtctcacctgtcatacacacataacgtcttgtattccgtgttgcaagtagctacaaatatatagccaactttcttctctcttctcttttcttcttgttacgtggttatagctggcttatagcctgctattggacctgctctaaaagaggagagaggagagcagtgggctacagatttatagccgactgcagcacagactctaaaacacagtgtgtgtatgacatgtgagactagatattaataatatagtaagtagctattgtatgaattagctataaatgatttgaagccagtagttgactgtactattaaacttgctctaactcctagccttcttccttttggttgttgacgtcgaagaatcttcaaagtcgaacacccgtgctctgaatgcatccaggttgaccaacagataaagctggtcaagcagctttcagagaccgagtagaatacctgtggacgcaggaaacgagttactccctcgttttttaatagatgacgctgttgattttttctcacatatttgaccattcattttattcaaaaattttattcaaatgtataagatataaatcacacttaaaatattaaaatattatgagtgataaaacaactcatgacaaaataaattataattacataatttttttaataagacgaatggtcaaacatgtgagaaaaggtcaatggcgtcatctattaaaaaattaaaaaaccggaggtagtactatttattatccttcactaatcgaacaaagagcaccgctagtactgctttacgctgctttaatggacgatgaatgccatattacgtgaattaggccccctaacacctttctgtaaggaagttcagaaaacgtttcatatgcatgccattatctcttcttcagggaccaacttatatcgagggcgatgcgctaaaataatccgctacgttgccctggtttgtctgtgcatttttcgtacttacaagaaggctgctttctcttctttatgccaactggcaatggcatcctccaatccgctcagcaccaaaattcacgcgtctgttagacacgaaacaatggaaaattccagaaaagaaaaaaagacactgatatgtgtgcctacatataatatgtcagacacgtacctcacaaaccagccaaaccaccgaaaacaacaggacaggaatcttcgccagtcgagtccaagctatcatccaccgccaaatagatatgtttaaagtatgagaagggaagacttccgtctccagttgcggatcacatggtagcagtagcacagagccaatgatatcaaacaagagagttgtcaaagaaaaacaaaacaatggcaaagtttctctatctgatcatcctttcattcttcctctctcttttggtgttctgcacttctgcttcaccccggctgacattgcacaccggctcatctttctcggtggaagattacaagcatacattcctcacatcaccgaattccaccttctcatgcggcttctacccaattgggacaaacgccttcaccttctccatctggctcaccaacacggcgggcaaaacagtcgtctggtctgcgaatcgccggtcaccagtgaatgggcatggatcgaaggtgttgctgcatgatgatggctacctggtcctgatcgatgtcaatggttccacggtctggacgagcaccatgagtgcaggcgaggggtcgacggctgcgctgctggagagtggaaaccttgtggtcagagattcaagcggcacaatcttgtgggaaagcttcacttccccaacggataccttgctacctgcacagcaattgaccaaagacacgaggttagtatctggataccatagcctttacttcgacaacgacaatagccttcgtcttgtatacaacggacctgagttctcaagcatctactggccaaatgatgattacaccatgttccgggatggcatcaaagtcaagaacaactccaggcttgcagtcctcgatgacaaaggcggtttcttctcaagtgatgctcttacagtacaggcttctgattttggtctcgggatcaagagaagactgactcttgactatgatggcaacctacgtatatacagccttgacgcatcagatgggagttggacagttcacatggcaagccatagtggagatgcattatgtgcacggcatgtgtggaaagaatgggatttgtgagtacttaccagaacttcgttgttcgtgtcctcctggattcgagatggttgatccacagaattggagcaagggttgtagaccgacatttagctataattgtgggaaagagaggtacaagttcattgagattccccaaactgatttctatgactttgatcttggctttaaccagtccatctcatttgaagagtgccaaaatatctgcttgagcacgtgctcttgcattgctttctcttaccggctaactggaactggtgtttgttaccctaaaggcctcctgttcaatggttacaagtctcctgcattcccaggaactttatatcttaaagtgccctacagcacaaatttacaggcctcatcaacacaatcagctctcacatgctcccctggcagtcaggagattgcaacaccttcagatcacccaagatggctatatttctatatattccctggagtattcggagccttggaactaattttcattctaacagcttggtggtttctttccataaggaatgacattcagaattcagcagagggaggttacatgatgataagaaatcaattcagggggtttacttaccaagagctgaaggaagcaacaggaaaattcagggaagagcttggaagaggtagttctggaatcgtatacagaggagtactcaaagataagagggtcattgcagtgaagaagctcatcgatgtcacacgaggcgaagttgaattccaggcagaaatgagtgttatcggtaagataaaccacatgaatttggtcaggatatggggcttctgctcagaaggaaaacataagctactggtttatgaatatgtggagaatgagtcactggacaggtatctgttcaataccatgggtactgaaagattgctcgtgtggaaagatcgtttcaatattgccttgggagcagcaagggcactggcttatctccaccatgactgtcttgagtgggttttccattgtgatgtgaagcctgagaacatactcttgacccgagatttcgaagccaagatagcagacttcggactatcaaaattgtataagagagagggctccagcttcaacttctcacaaatgcgaggaacaatgggctacatggctccggagtgggcaactaatttgccaatcaatgcaaaggtagatgtctacagctatggagtggtgcttctggaaattgtggctggacagagaatttcaagtcatacaaccagggaagggaaagttaccaagttaaagcaatttatcgagaatgtaaaggaagctcttgctactggggatactaagtgcatagtggatggtaggctacatgggcaatttaattctgagcaggcaatggttatgttgatagttgctgtatcatgtcttgaagaagaaagaagcaagaggccgaccatgcatgaagttgtcaaaagtctcctggattgtgaagagtaaattggtcatttttgctaatcaatgaacctgaaagcagtagggacgaaaagcagtaagagaaggagtaagcttggcattgatagcaatgttttgcaaacatatgtactttctgacccatcaaggaaaaggataaggcattacttgtagtcctgtgtcatttagccaataaccatattttgtccttttcctgtgaaaatcaagataatgcagtgtttagttattgacttattttaagatttatcaggaattttatgtaatcttttaaaaaaatgtattttgtttttttcttttgttcttgagacatacaattgtaggtaaatctctcaggttctttaaagacagataagccgaaataaaaggggtatctagtccctgaagcactaacatagttattttcaattaatcagttccatgaaggatttagctggctattattgtaaaacaatgagatacaaaatttccatccaaaattcacaactttgtagcttgttctattagcaatagattataaatttatgtgaactatctttgtcaataattcaatttgatcaacagcacaaatgtaatttggcaaaccaaactgttctttgaggaaatgtcttatgttgtactgagtttttctctaatctttaacacaaatatgcgtacaatgaacaaaaaggtagatgtatgcaagtatgtaactcatgttaacttcccaccgcatgaaccatctagatcaacaacatcttgtacaaatatatgtagttcatgtcagtttcgagtcttcgactaaccataggctgctaatgttacccgctgagttaccaaatgcagcaacgaggcagagcaaaatcacgcatcagactatcagagcattgcataacaacgaagagaagagggaggcgtcacctagacggtgcctgctgggaccacgatggagggggtgtggggggtggggggtccaaacttctcgtcccctgcgcccaagcctctctgcctcttccatcaccggcacggtgtgggggattccgtatcgcctaccaacacctccaccacttgcctcgccggcatgtcgcggaggttggcaggatcgggttcaacgcgggggcctctcgtaggcgtacccgtccgtatctcgctctcgccgccgctcggaagcggtcgccggcgtcattatcggtctctctttttttttatttgacaccgtcattaccggtctcctaacaattgcacagaacaacaacatgccgcacgtgcgtatatatatatatatcagatcgaacggttaaaagacaacgggcctgttcattcatttcgataccattttcaaccataccattttttaccaaaattataaaaaaaaaatggctacgtttagtttgttgccaacttttgtcaatacataaaaaatcctagcaaaattttagtaaaaccagatatcccacgtcctttaactaatcaaaaccggtcacaaaaggtccctcgacggttttgatcccagtttggtcctacgtggctgctgagtcagcgtgggacccacttgggccccacgtgtcagggtaatccacgtcatcaccctccctttttctcctcttctctctttctgggcgaggcaaagcggtgggtgcagagggccagaggctagcaacgcgaggcgggaaagtggagggcggccggcggcgcgacggtggccggtgcccgacggcggctgctatagcgggaaacacggcgacgcggcggccccaacggtgatgtcatcgactgcgtgccgacgcacctgcagccatccggttcgggatgaagcagccacgcgccgccgacatcgtccgccccgactccaccaacgatggctgcaactcctgctcgcgcatgccgaggcggcctctgtgctggcgctcctcctgcgcgcgttcggctgcccttggcgagcggcgcacaccttggcctcagcctctgcttcgcgggggccgcgccgtaggccgtggacgtgccgcggctggtgctccacttcgacagcgctgggtcatggagtagcagagctcgagcacggggcagtgctacagagctcggggattacgtcgtagttgaacccgaacccgagatccacgcaccccttcagctcctctaggtcgtcgttgactcgtcggtcaagctcggcgcgtgccgccgccgccgtcacccccgctcctcgccgtacacgcgccgccgccgaagacgacgacgccgcagggctcctccttggcgaccaccaccggcttcgtcccccgtggtcacgccgcctcccgctgtacaccgcaccacacgtcttcggcctcgacctcggccgccgcttccgctccgctcgtggcctgctaccgtcgtcgccccgctactccgcccgcccttccgcgttccaacacggcgagccatgcccggcggcgagaggaccatcgccgcggccgtgcaaatccggcagctgagcggcgggatccatacggcagcggcggaggaggaggagaccgggagattggccgccgcacgctgctcctctcccgcgagccgccgcgcgccgctcctcttccacaggccgtcgcgcgccgctgcctcctcgtcggtgaagactcggaggaaatagaggtagagaggggagaggtggacgccgccccgctgcacaccgccgccttgccgctcctgctcgcccgccgccatcctcgccgcggtcgtttccccatccgccatgccgcgccgcttccccatccgccaccccactgcgcgtcgccgccccttcgctggccgttgcctgtctcctccccatgccttcgatgccgcccaactccaaggcttcccccaccggccgtgcgaggagctcggccgggctgctgccgccgtcggccgccgtcgtggcgccgccctcctctcccgcctcaccccgccaaccggcctacaggcacagagagagagagaaagaggagtaactgaggaagagaagagagggagagtgacttagcctgacatgtggggcccacgtggggtcccatgctgactcagccgccacgtaggataaaaccggggttaaaaccacttaaggttctattgtgaccggttttgattaattaagggatgccggatatctggtttgcggtttggggacaattttgtaactcgatgacaagttgagggaccttcggtgtactttttctaaacttaataaggtttattttggctataatatgaaccgtctcaacaaatgtggattgctaccattggttgtgattcagttatcgggcagcctgactcatgagtcatgatgggcccagcccacctattgggggtgatcggaaaaacgcttctctctttcgagtagccacggccaccgccccgccggcagcttctcgccgtgtctgttcctccgtgagatagcatcaatggtggtgaccttttggtctccctcctgatgatgtcaagtactttgttggtccttagctgtttggcatggttgatttgatgatttgaggtgtgtttggttgactgtcatgtatgaatgggatatggccatccatatttagttggatatggcgattcaatttttgtttgttttgtagagatatgatgatccaatttcttatttggttggagggatatagtatggatgggaaaaaccaaaagttagtggggtccatttgtcatatatacttttttatcaaaatataatcatccgagatcttgttttaaagatttaaatataacaaatataatggtgtaatcaaatcataaattagataaacggtttaggataaaaaaatcatttggaagttgcttaacagaaaatcaaactaaccacaactaatcagaataggacacatcacccaatccaaaactggatggcttcatcgagccaaatcatccggatgcactcatctaacttattgagggaatattccctattccggaccgctccatttaccttgccctccaatcaaacaccacagaaaatcgagcggccatctcccatctagactcatctacctaaccaaactcaccatgcatcagcggaacggcaggaactctgcctacaatattcaaagagtatgcaaagctatcagctatggcacgtttagaaccaacaaaaaacaactaggacacctgattatcgtgagtaaaggaaagcttgtccaggtttgccgccaatcgtctttctccaaactttgtttcgtgagtcggcggaaagtccaaagtcgaaatcccgcgtccatgtgaatgcatgcatctagataacaggcataccaggtcatagagattccatatttccgtagaccaactcatgtatcgaggataaatgaagtggctgcccggtgttggtttttttgtcctttaattctgaaacaagggaaacttcttaagaatctcacacatcgcagttcagtttctatagaagtcctatgttctgtttagttcacactaaactttctctcaacttccaactttccatcacatcacatctaaaattttcctacacacacataaactcttaacttttttttttcaaactatcaactttccccaaacttcttctcaatttcaggaataaacaccgccctagtaaaagcacaattcttgcatcctattttccgaatggtattgcaataagtcagtttttcttctgtaagtcaacacaatccactaattctgaactaccatactttgactagcttcggtagtcatcagcgaccaaaagaaaggagagaacccaagctttccctttttcaaaataaaactttacgcagggtctcagaaagacattgtcactagtattttttacttaaaactcattccacaccacagtccacacaatcaaaacaaggaccctatgattaacaagaaaggaacaagagaacactacaaagtgatcagtaagaaacaatgcagaaacttttggcgtcatttaccagttttcagaagcgtaaatgtttgtgggggaagactgaatgagcctaacgctcttctagtgctatataaatacagaagaaatgcaccattccattcttccatgattccatcgaagtcacaagccaatcacgtatcttacacacttccgcacctgatcttcttccatcgaagtcacaagccaatgaactattagtaactggaagactgaggaattttgttctgaacaacattcctatgttgcccactcataccgtgccggaggtggttatctttaataccgatttcaaggccaagattctagcttgccattgggccacgtggcagcctcaaaatttagctacacacctcagaaatccttccacgtgtccatctgtatagttctatacctttctccagcttattggcacacatgagccacttgaactttgagataaatcttatagggaaaaagtgtcaagtagaaaaattacagattctagatgcttccaactatctagctgtttgcaacatctaggctccaagaggcattaaactgtttcattgaagataaatcataactgttttggggtaaaaaaacataatccagtaaaaaagaaggtgcagatgaccggctattacaaatacaagtgaggcgacggagagaaaagtggcatcgaggaagacagcataaatatatggtagtgactgaaatttttttactaggagtcggaacggatatatactagcaacttccaatgaaacatactacctccgactccgacttttaataaatgataccgttgactttttatccaacgtttaaccattcgtcttatttaaaaatttatgtaattataatttattttgttgtgagttgttttatcactcaaagtattttaagcaatatttatatcttatacatttgcataaattttttgaataaacaaatggtcaaacatgtgtttaaaagttagtgacaccatctattaaaaaagcggagggagtatatacggatttagtcctctttggatttttgtactataatttcttctttcgaaatttgtatgaaaaaaatatagaatagatttttatcgacaagataattatgaagcaaaagacttaggagtgtttttttcctcttactattatggattatgaagggcatgcttcacaagcttatggtttattatttgatttgttttaaatcagtacatcaactttataatatttaatccattcatttaagctctgaaataattgttatacaccagtttcatctatagtccatcatctatcgaaacttaatgctgcaggagcatcgtcaatcgaaacttaaatactgcaggagattaggctaataggatgatatgcaaaatagaatatttgatgaaaatcgagataactcttaaaaaatcctgtaaaattttcatattctaaacacaccttgaaaaatttacacgtgttatctagcgcgccatactaaaggtgtgctctacgacgtttgacgtgacttttaaaaattataaaaaagaaacctaatgagaccataaactataaaaactacaggatccaatttttaaatgtttcaaggagaataaatataagcatgtagatcggggaagcatataaagaaggtgtgacaaaaaaagtaaggggtagcatctgacgtgatttttaagaatcataaaattaaaacatgaggatgataaggtttggtctttcaaaatcgtaagacaatgaaatagcgatttaacaaattttaagtaaaatcatattaaaaaatagataactctgtattgttgttagccgcgcagctagttacaagtaggagtagaagaaatccgaagagcttgctaaactagccacgaggacacgcttataaccaagaaaaaaaaatacttggcagacctgattaccgtgagtaaaggaaagcttgaacaggttcgctgtcaatcttttttccaaacgttgtcggtgacaaaaatttcaaagtcaaaattccgtgtccatgtgaatgcatgcatctacagacttacggttataccaggtcatagagattccatttttccatagaccaacactgtgtttagttccacgccaaaattgaaagtttgaaaaaattgaaacggtgtgacagaaaaattgaaagtttgtgtgtgtaggaaagttcgatgtgacggaaaagttgaaagttcgaagaaaaaagttagaatcaaaacagggccactcaggtatcttcttttctttaggactacactcaggtatcgagtcctgaattctagaacaagggggaatttttaaaaatctcacacattagagttcagttcctataaaagacaaggaaaaagaacaattcttgcatcacaaatggtattgcaataggaaattatttcttctgtaagagtcaatacaatccactcatccagtaccaccatacttagacgagctttccataatcatcagtaaccagaaaaagaaaagggagaacctaggcttccccttttcaaaataaactttacgcggattcagaaagatattttcgctagtatttagtcctagacaaagctcgttccacaccacagtccacacaatcaaaacaaggaccgttctcattgaaaaaaaggataaagaaaattatcaaatgatcagtaagaaacaaatggataaacttttggccatttaccagtcttcagaagcaaaaatgcttgtggaggaagacttaaatgatccttgaccccagattagaatagcgctcttctagtgctacataaatacagaacaaatgcatcattcccttccttcttccatctctgaagccaatcatatatctcatacacttatgcacctgatgtaatggaaacaattccctgcctcatcctcttttcgtcactacagattctggcattctcttctgcatcaccagagcatacactgggtaccggctcattcttatcggtagaagaatatgagaaaccatttctcatctcacccagcaatactttctcctttggtttctacgaaacaggtgacaacgccttctccctctccatctggttcaccaatacagtcgaaaaaaccgttgtttgggcagcaaactcagaatcaccagtgaatggtcatggctccaagctatcctttactcaggagggtagcttagtcctcagcgatgagaagggcttcgttgtgtgggatagcaagacaatgctaggacaggattctcgagttgctctacttgatacaggcaatcttgtcatcactgattccaagggtagtgttgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23280 - DNA, 293 bp, Oryza sativa
ctcttttcccgtccacacaacaaactcctccctctatctctttttttcctctctaacttcttatctctttccttatctctaactcccctcctctccttccttttttccttcaccacagtgcaagcggtctgcgcggaggcggcgacgcgggggacggcgcggaggctgcctgcgcggcagtcggcgcggcagcgcgggggaccgcgcggcggcggtggtgggcggtcggcgcggcggcgcgggaagccgcgcggcgatgccgggggccgcgcggaggcggcggctgcggtggg

SEQ ID NO: 23281 - DNA, 2694 bp, Oryza sativa
  unsure (1)..(2694): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtggtgggatccccataagtaaatttctcgatgctgttggatgaaaattatcatccatgcagtgttcaagactccttaaatgtaacccatccaagtctcatctaactgtatgcattctgagttcccatgatagcattttgggttcatattagatggagcatgagcaccaaaaacaaattagaaatagtcaatatacccctgccagttgtagattcaaatttgaatctgctcctttttttaatatatatagacctttttaaataatttgaaaccgctacgaagttcttctttctgaaatataccatcaacgtgttcctctgtttcaagataaaccacaatgggccaagactaaattgccccttcttccaccctctccccttagtcctgacaaccttgtacaaacggccccatgcacttgacgtcacccttgccctcctctatatgctctcctggccgaaccaccactatgcctctcactaactcatttaagagactacaacctgcctcagtcatcccctctccctcccagtcctcccctccctgcttgtggtaacctcaccatgaatgcagagacaaaacaatgtggaagattcacacaatgtaaattaaaaagaagatagctagaatacagaaaaaaggtaatttttcatgactaactactacaagaatgagcagtagaaaagcaaatgcacaaaatgtctattttcatgtactacaatgtgcaaagtaagtagttattaggaggctgtgcaacgatggcaatagagaagtgtagcaatgcacagggaagatgataaaataaaaggtaagagacaattgatgacaatgagttagggtggatagtgttataatcagggatagaactaatgtatatttactagtatatactattcaataaaggctaaaaggagccatcaggctcactttagaggtacagaattaaccatgttaatcataggcaaagagaaagatttataccattgatcatggtgggttcattaataacagtgtacattgatcgctgcagatgcatgaactgtctagctctccaaaatttcacacaaagtttcagctagttttgttaaacagcatggtagcttttcagtttatttaaaaattcctgcaatatgtcctttttgctaaattagtcattgggaatattaacactttataacatggtcttgctaacatagaaacttggcaactggccaaatactcaaaattcacctttgcttttgaaacattatttatcaatcaatcatttttgtgcatcttcgtaacaagtccagttgattttctttatttaactaaacagtgtccatcccataacatcctattgcgatttccctacttgcaggaacaacaagcaattaagtaaacaaaattatttgatttcaacaactgcagagcaaaacacagttggcttaacagtactataaaaaggtgacagcctgcaaaatatatatcactagcattcaagtttgaagttttagcttaatcctacgaagtgcagggttttgggatgcatacctattggtgcaccgaaggagccagggggaagtggatcaaagtcaattccgagcaccggcccgtcatccctcagtggctccccaagctgcgactccacagaatgaatcacccggagctcagatggcatgagctgcatcgatgccaccggtggtggcggcagcattactggtagaggttcataatacctccgcccaatatctggcgcagataacctgggcactgctgaggaccgccctgcaccccttcgcgagtgaactgggggcagcggcggctcatcatacgggctactagcaccgatcagtagctcgccacttgacagcggcagtgctggtggcggcaacactggcggaggtgccatcaatggcaccgctgcagcttcttcctccctccgttgccgctttgtggggggcttccgatccttcagccgccggtgacagaaccacatttgcagctgcctgtctgacaagcctatcttcgcggacagctccgcccgcaaggtctccgacgggtactgctccactgcaccaaaccaaaatcacatccccaaacaccaaaacctcaattccccacccaaaaatcctccaaaaaaaattctccaaacttccaaagcctcgcaaaaccatcagaatccacgcacctgcatacgtcttctcgagtacctcaagctggtaggggctcttcatcatgcgcttcaccgtcttctccccggaaccagacgcgcccgtgctacccgctgacacagccgccgccgccgccgcggccgcagcgggaggcgccgg

SEQ ID NO: 23282 - DNA, 5061 bp, Oryza sativa
gcgccgcaccgtccccgtcgtccatggccgccgcggcgatcggagactacctccccgcaaacctagatccaaactcctcctcccgaggccaccgccaaacaaaagcacggaaaaactcccacacttttcctcctcctccagggctcgctcgcgacaacaatgaaatgccgcgcccgctaatatacacgccagcccagtaaaaggcgatccgatgtgcggctggatctccgctaccaccaacaccgatcgcagcaaaaacagcggtaataattccaacttgaacaccacgaacaaggccaaaaaggcggcagccacagcagccgctgaggcgagtagtagtagatagatagggatataatgaggaggagattggggaaacagcaggaacagcacggcaacagggagaaggaggaggagagcggctgctaccactactactactgccaccactactcgaactggtggatgattattcatgcgcctccgggattgggttccgatttggaacgcttccattctatgcggccgcgcttaacacacacactcccctcgctcctataataaaaccaaacccttttctttttctttttggcctcctctcctcaatccaacttccctttttattttattttcttttgcgtgactttttttctccttagcaccggtacgagttctgacgagaggaatatttggatgggcagaataattagtggtggagtgcttggatttcttgggggtttgatctttgggggttgcttttgtgcttttgacgagcgcggggacgttttctggtggggggaaattggcgccgtatggagggtgacgggtttgttggtgttggtgcgcgaccgcgcgtgttcgtcgatcgatcgatcgatcgactctctcgtgcagtacgagggacggagggagggaggcgttcgttggacgaagcgtgggggctagattagaactcgcgcgggatcttctgcggcggatggacttgtggcaccgggcgtgtgcacgtgacaggggactgtgaggcctgtcagtgtccgggctgatgtgcttggcgtactgaacagggtttttgtttcctggtgtgtgacaagggcagtgatgagttcagacagtggatttaacggggggatatcaacttgagtggatgggtgagtgagacttggtcgcgagtcatgatggtgttggtgaatttatgtgtgtgtcaactgttaactgtgagcagtagctccaagagaaaatttccgctgtcaacatgaatactccatcaattcaaaatgcatagtaactccgtcacatgaagaacgaatctatgatcgaatgtattatccaaatttatagtattagaatatattattagattaactttatgttattagtttggtgttaaattttgcctaccaatcatttgacaactttaattgtatatactacctccgttctaaaataagtacagtcgtatatccgtgtaccgtccgtctcatatgtaaaatttattactttttttaaaaaatagtcacacataaagtactattcatatttataatctaataacaatataaatactaatcattttttttaataagacgaacggtcaaacattggacatgaacagtgtaaaactacacttattttgggacggagggagtactagccatttagattgatgctaacttatgccaaaatcaatagagttgatatactcttgcctaacaaaaaaaattggtagtacctaaacttacatctcggtagggttttaaaccaaacatgccctatgtcttaaagcggaggaaataagaattatggtatcacacgtgaaagggagagttttcttcaatacctatgctatacaatagcaacttaaaaaataatactcccttcatccaaaaatataaggcattttagatagatgagatatatcctaatactacaaagttggatactcccttcatccaaaaatataagacattttggatagatgagatatatcctaatactacgaagttggatagagagccatatccttataaatatggatggccatatcctatacaactttgaccacaaaccaaacacacccttatattttggggcggagagaatactattatgaatattagtagtgttcaacacagcggcccctagttccaactgaagatagagatgtagaacagaaactagagtaaataaacagagcaagaatagaaaaaaaaagtaaaatccataggctcaagcatcaacggagcatagcattcaacaaaaagtggtgtttactagttcaggatggtggtggagttgagtagccggcggtgtatagatgattaatggcgactagtagcatggagatggcacgttcaaagcaaagccaccaacaagggtgtcactaattcgagcatcgagagccttgacgcataggggcacaacaactggacttgggggaatcgatgaattgaggatatggacaaattgcgttggccagtagcagtgagttgggaacccaattcgtcctcctaatccctagccatctctgggtagggctctcaggtttttcccgcccactctaatttgggaaagatagagtttgtcaccttgtaaactactatttcgcaccccgtctagtcacctcggcacttgcctcgtcactttcgtgccatcgtgtgactaggcctactaaggtggtgtttggttggagggactaaagtagggctaaactttagtccctctcacaaaagtataagtccctaccatagggacttatccttttgtgagagggactaaatttagtccctagttcccaaacaccctctaagtgttaaagttgaccaccgaggtaatccaaccgcctagctcactactagtaggcaaaatggggcatcaaccccttacctagcgccaaatcaccacctagatatatttttttaacaccagatattaaacctttattgaaaacttttattggatttcatcagtaaatctattcaatcattttgtgcaaagaagttagatggaacatattgatacaaaggtcatagaaatgtatgtaggctacatttggttacatgtgtagagggtggctcgcacgcatgagttgtatgagatggatgaagattaagaattttgtggcacactttttaaactgctaaacggtgcgtttcgtgcgaaaactttctatataaaaggtgctctaaaatatcatattaattttttttcaagtttgtaatagttaaaactcaatcaatcatacgttaataccacctcgttttgcgtaaaaaacttattcttcatcttcagaagaaaagaacaccaccttagagtaagtataaaaagatgatgtaaacggactatataagttgccacatcagttgtgtgctgaattggagaagataaaagagaagaacgggctcaaccaagttttgtgagaaaaaggtggatcggttatcaatggtgttagtatgtatgtatagtatcatggtgaaaggcatgaatcctgttgacatgtttcctccctagcctcccaaggttttaatctcatgaggtgtactcgtcactcttccacggtcattaggaatgaaatatcattaccttttcgatagtaaattgcacagtgaactatatgtttttatcgatgtgatagtttggactaggggtaaggcattatttttagcttggactatatataagtcttcaaaaggtttcaatttggacccttattctccatcctcccgtatcaatactctagattgtcatgctggtgagctggtgttgagctcgcgatctttttgtagtgtctcctgctaccacatctatgacccactccattgtcgtagccctgaagcatcgcctcatcaccaccattctcagataactcccactgtattgttcaaaagcggctccttatgttgcagccatggagcaccaccgcccgcctccatcttatccctaagcagcctcgccatgcacaactcccactacaatgaccttggagcgtcacccattgtcatagtccttgaggactggtcttgccttcctttttgtccccatgctccgactatctaagcttgacctttatcagcaccatttcatcctcatgctctggccatctaagctcgatctctatcgctctatcggcaccatgagccatatactcaagctcatgcttgatctctacctagggcctcgtgctcggaacttagccaagcctttctcattaacacatcaaacttgaagagcgagagagaggggaggggaagagaaagggaaggctagagaagaaagcgttcaaactaaaatatttggtaaacttaccatgtccaaaatgaaaatgttattgtacccataagtgtggtaggctaatgcagaggccatgggcacacttatgctccaactcctcaatccctccccccccactcacctcctcgtctccacttctccccttgtgacttctctagccgctcttgtgccatgcgcacgaagtgcttaacgtaatgcgccgaacaaacgacagtagaagctggtttggataagacggatggtatgttgcgtgagcatgccttcgctaggaactcgcttgtgccttgcatgcgcgggttagaacgcacatcattatctatcttcttgatctactagttgacaaaccagggaacaggagaaaggaaaacacaccatggctttctcttaggagaagatcaaaaccaatgcagatatgcaagcctcctcgccacctcctttttctactccgacgcctcttaatgtcatcacctaatggtgggtgtggcgacaatggggatgtgacgcctagcctttcgtcgagctacctcccagggcttcttggtcaccgcgccacaatcttcaatgttccagcaccatatcgagttctctctaccaccaactctagctccctcctcacgaccctcctcttctccgcctctgcccactgctagcaaaggccaaagggtgataccgtcctaatcctgttgttggatttctaatgtttgaggagggggagggggggtcgtcgacacccgccgctccattgcagtgacctacccctcttgccagttggtg

SEQ ID NO: 23283 - DNA, 26335 bp, Oryza sativa
  unsure (1)..(26335): unsure at all n locations
cgtagactatggtggatgtgttggcgctatgattcgatgatctaaaccccttagggggtgtgccttttataccgtgaattacctcagtctccaagtagaactctgagacaacgaataaacccaatcctctccgagtaggactctagtaatcacttgcccatgaggatattttccatgatatcttgtagatttccttatcacataagaaagtacatcgtatgcacgaaggtataccgcaagtcgtaggacaggaggtatgtcttatccataaccatgacagagataaattagactacctcattagtttaagaggtatagtctacgaattgatagccactaagacctatgtttttgttaaacttttgtgcttgtaagaggtttggttgtttctatcttttctttgggatttgtgcattatatgcataggctaggtatgggcttcgttgtatcatcttggtgtaattaactgagtctgaataaaacttccattattaaaaaaaaggacaattcaaatatttccctttttcttaagtcattgacagcaagatgagaactatttttcgtgcttttttaatgttttatatacgctacttcttggttcttgtcagtttcatgtttcttattatccctcccgcatttattttcctctttcatttaggagtaactagctgggtggctcgcgcaattgcgcggctagcacccaaacaaaatcatatcttttagtacgattttacttaaaatttattaaatagctatctcattgtcttaagattttgaaagaccaaaccttatcatcctattgttcctaattatatagttttaaaatcacaccagttgctaccccttatgttatctcgttatttatttgcttgctcgatctatcactatttttatttattcttcttggaacctttaaaaattggattttatagtttttagagtttattgtcatgttgggtttctttttataatttctagatgccccccatcaaacgttgccattatactcctctacggcccgtccactgtctcttctctttattgtcattgagatttaaaaaatcgaacataattatcgtttgggttcatttttactttctagaagtcctgccaaaccatcagtggctttgccattgtactcctctacggctcgcccgctgcctcccttctttattatcattgagatttttaaaatcaaccatgattatcattgtttttttttactttttagaagttctgaacctttaaaaattggacttatagtttcattttttataatttttagaagtgccatcaaatgatgccactatgcccctctacagtccatccgtcacctactctttatttgcccctctacagcccatccgtcacctactctttattgtcattgtgattctaaaaatcgaacataactatcgttggaattcatttttaattttctagaagtcccgtcaaccgccggcggctctacaactatactcttatacaccccgcccgctgcttctcctttttattgtcattgagattttaaaaatcgaatatgattatcaatggtgtttttttttactttgtagaagtcccagcaaccgccttacttgtttgcttcacggtctgcctaaagtccctccttttaatcgtcattaggattctatttggtgttttattaacaacttttatatgtcgtatcaaccgccaccactctactcctttataggcatgttacttaatttatctcgttatacgttttagatggtcttttctttcaataatctttatttttattacaaattttagttatttataaattgtattcctaattgaaatcttatttttctttttctaatttcagaatttatttttttttaaaaaatagttaataccgtattgtgttcttttaatgttttaattttttattttcaatttcagttgtttcaaaattgtatttctacttgaactctcttttgatttttttttaatttttgatattattttattattttgatttttctaatttttgatattattttattttttttatctcgtattgggttcttatatatattcttctttcaatattgctaatttttaattccgaatttcaggtaattttaaattgtattcctacttgagttcttcttttattttcttttgctaatttcggatttatttttatttttattccgaattttaattaatcacgtattaggttcttatatggactcttcttttaatatttcttatttttaattccgaatttcagctatttttaaattgtattcctatttggactctcctttccttttctaattttggattttattttatttttattttgaattttgattaatctcgtattgggttcttatatggaaacttctttcaatattgcttatttttaattctgagtttcagcttttttttaaattgtatgactctccttttcttttttttctttttctctgattaatgtgggaatttctaacccccacaacgaacgtagtgcctccttttggcccgcgcaattgcgcggctagcacccaaacaaaatcatatatttttcagtatgattttacttaagatttattaaatagttatcctcgtatttctaattatatagttttgaaaagtcacaccagctgctaccccttacttctgtcatatccttcttttgtttcctcggtctaccactatttctattcattctccttgaaacctcttaaaattggatcttatagctttttgagtttattatctcgttgggtttcgtttttataatttctagaagtcccgtcaaacgctgccattatactcctctaaggcccgtccactctcttttctctttattatcattgggattttacaaatcgaacataattatcgttcgggtttattttttttactttctataagtcccgccaaaccgtcagcgggtttgccattgtactcctttatggctcgcccgctgcctcccttgagattttaaaatgcatcatgattatcattgttttatttttactttttagaagttccgaacctttaaaaattggaccttgtagtttttagagtttattgtcttgttgggtttcattttttatagtttcagaagtcccgtcaaacgatgccactatacacctctacggcccatccgccgcctattctttattttcatcaggattctaaaatcgaacataactatcgttggaatttattttttcttttctaaaagtcccgctaaccgttggcggctctgcaactatactcctatacaccccgcatgctgcttctcctttattctcattgagattttaaaaatcgaatatgtttatcaattgggttttttttttactttctagaagtcccggcaaccgtcttgctcgtccctccttttaatcatcattaggattctatttggtgttttactaacagtttttatatattgtatcaactgccaccactattcctaattgaaatctttttttctttttctaatttaaatttttttaattaataccgtatagtgtttttaatacttttatttttttttattttttgaatttcagttgaactctcttttatttttttattaattttggatattttttattttttattctgaattttaattaatctcatattggtttcttatattgattcttctttcactattacttatttttaatttcgtatttcagttgattttaaattgtattcctattttaactttttttctttttgctaatttcgaattttttttatttttattccgaatattaactaatctcgtattgggttattatatggactcttctctcaatattccttatttttaattctgaatttcagctatttttaaattgtattcctacttggacttccttttattttataattttggattttattttatttttatttcgaatttgtattaatctcgtattgggttgttatatagaaacttctttcaatattgcttatttttaattccgaatttcagctatttttagattgtatttctacttggactcttcttttctttttttctttttctccgattaatatgagaatttctagctcccacagcgaacgtgatgtctccttttaaagctgttttaataatataatagatagatttattaggtgactttttatatcgagatctatcagttccatttgtttttttaaggatatccattttgttctcggtatatatcgcctataaaaactgcattcctaattaccggtgaaatataagtacaaacgaagaagcaccgagacattgctttacgaactacaatgaagatttacgtgaaaacatgtggaacattacatgaacatctgttggtgagtttgatgttatttttgattattcatcatagtttttttatctatctatttgtctacttcgaagtcccaaattgctccgataagttatttctaccaattttttctcccgaacaggaagggtattgaatatattctccggtactttaggtggccgaaagttacgggcttttatttcttttaccaggtcgagaaggaataagttcaccgaaggtttatcaacttaacagcgagatttttgagatcccttaaccacaaaatcagaaatctccattcctaaactatacaaaaccgtgcaaaaaaaagtccctaaacagtactgatctaattttcccccgtttagctgacgtggcatatggtggaacccacatatcagcgcccttttctcctcttttctttttctttttttttcttcttctcttttctttgttctctcttctcctcttctcttcttcccccgagcctgagaggccggcgggcagggtggcgacgggcaagaacggagggagacaaggtcgccgctgccgctcggagggaggcgacgtcgccgccttgggtgcctcttgtgctgctttgacggcgggaaagacggggaagggaagggagaggagctggggcagtgcgcagcgagggcgctgcggacgacgtcgctgtgggtgcgggaccacggcgtggagctgcccgagatggtggtgcaggcggggaggcggcggaggaagccgcattagcatcagcaacaccaacaacagttggctagagggacgccattgtcgccgatgagtgaagctcgggtggctcgaccccctctctaccctctcccgccgatgacgaagcccgcgggatggtggcggaggtcacgggacgcagaggcgacgaaggggaacaacgcgagtgcgcacaacgccatgcccaggacgagaagggggagcgcgcggagggacgccattgccgccgacgagctcgcaagtgaagctcggccggcgcgaccccctctctcttctctcccgctgctgctccacccaccgccgcccccctctcctccctcgcaggctcaccggccacctcttcccccctctccagccgcccactgccgcgctcgccagtggccacttcgcccacccctgccccctctctcccaggctccctctaccgccggcggcttccggagaagagaagagaagaggagaaagaaaagagaaaagaaaaccaaaaagaagtgtgggtcccacatttttttcttctcacttacatgtggccctataattttttttatttttttttgctaactaggatgccacatcagcgaaactagagatccatactgccctgggaccttttttacacggtttcgtaaagtttaggggtggaaatttctggttttgtggttaggggatctcaaaagtctcgctgttaagttgagggacctctggtgaacttattccggtcgagaaaggtccttaattcccaagcaggccctaattaattttcagctatggccgaaataggcccatccttttctttgacatttggccggcccgacaaatgttcggtcacgcaactgcgcgcacttgctagaggtcctcgtgttgccagggcagggcagcattccgccgaacacctctgtcccgcctcgtacacgcaggctttgcccatcccgccgccgccgccgcagcccaatgccgccggccaccccctcggcgaccagatggcccaagaccctcaccgccgaccacctccaccgcctggtccgcgcggagcgtgacccgcgccgggccctggcgctcttcgacgcggccaccgccaggccctcgtccgcgtccccgcccgacgattccacggccgccgccgccgcgcccgtcctcccgtcgcgcgacaccgtctccctcctcacgtcccgcctcgcctccgccagcctcctcccgctcgcatcctccctcctctcccgctcgcgcgagctcttcccctcgcccggcgagctcgagcccccgttcctctccctcctccgcgcctactcccgcgcccaccagcccctcgccgcgctccacctcttccgctccgcgccctccgccctcggcctcccgcactccgcccgctcctacaccgcggtcctcgccgccctcgtcgctcactcccacctctccctggcccgctccctcctcgccgacatgcgcgccgccggctttgcccccaccaccgccacctacaatgtcctcgtcaaggcccactgctccgacgccgccgtccccatcgacgacgccgttcgcgtttttcggaacatccccaaacccgacgcgtgctcctacaatactgtgatcgatgggctctgccgccgcggccggctgccggaggcccgcgacctgttcgcggagatgattgcgaatggcactgcaccaacggtggttacttacaccactcttatccactggctcgcgcgggaggcttgctttgatgatgctctgaaactgttcgatgaaatggctaggagagggatcatgccgaatgtggtaacatacagttcactgatcgatggattgtgcaagggtgggcgtgccgcctcagcagtggagctgctggacaggatggttaaggagaggaagcttccaaatacaatcacatacagttctgttattgatgggctctgtaaggagggctgtctgggtcaggccatggagattttagaccggatgcgtctccaggggaggaagcctgatgctgggttgttcggtaagctaattgttgggctatgtgatgcaggaagggctttggaggcttcaaattacctcgatgagatgaattttgctggcatccgaccaaaccgcttgacttggagcctgcatggcaggataaatgatgcagtggtgacagcactgtgttctaagggtgaagttgtaagggcttttcaggtgtaccagagcatgcgtacccgtggaatttctaccaagccaacaactttccatctccttgtcgagtgcttatcgaaaaagaacaatttagagaaagctgctcatgttgtgcgtgacatgttatcagagagatgcatccctgagagggaaacatgggatacgattgtacgtgcatattggagtaagaaaaaggtaagacaagaagctgaggaaatgtggagccagttaaccgtttcaaattgaaataaaggtacagactacactccactgatacatcgtatgcgcgagctgttgccaagcaaacattgtgctcagaggtcatatacttcttactctttctatgctgttacacaagtgggagatttgttgtcgatagatcttacattttggtgttcacttttccaggttatgtaatgatatctgtttttttttgaagttacgagcagttggcagtgttcaggtatggtgcgatgttgttttccatagtcccatacatcttgttcattactccctccggttctatattaattgatgttttggacatggttgaggttaaatttttataactttgaccatcaataactttaaaaatatttagtttaaagaaactagaaaaacatatatagatttgtctttcaaaacactataataaaagtaaacatgcatttatttattgtatatattataatagaaaaataaggtcaaaggtatatcttgtagagcgtgtcattgtccaaagcgtcaattaaaatgaaaccggagggagtacatacgtaaatatactaagcattaactttaattgttcatatatgtggagtttggtgataaatgatcaaaacctgtagctcaaactattgcatagcaagctaggcagttaagtcaaatgtaattattgacatattgtacaaccaatgttaggtagatttattgggaaagtgaaatgttagctaggttattgcactgtttcatattttcatatgtcgattttattctattcatttttctttcattttcttatggactgctgagtagcatatcaattgttcaggtttattgcacggcaaaagaaaatctctacaatgtgaacctccctggaaatgcacagtttctagtgatgttttccatcggttccctccataaagattaaatcaaatatgtttattactttccacttgcatataataaccttgttttccaaaagaaattcactgtacttttgttctgatagctttctttagagtttatgctgcttaattgtcatagtgaatcctctgcttatgacatgtctaacatgcttaatctatgaattcacttaatggaacaggctaaacagcatcgcaaaatatggaattatggatcttcattctattggctaggagtataaccatgagaaaaagtcaacagccaaaatatcaagtattgagatacatgctactgtatgtttttctgtctatgttgaggggattacacctgtttgatcaatcaacatgaatttgagcgagcaagatctttgattaccagactgttgtggagagtggaaagccaatgtcatggtgggtggctgggaagctgacaaactgcattctgccaataaccactataatagtcagcaatattatgagaactttctttgcttactcttacggtattggattgaagcaagacaccacattttggtctaacagcgctatagaaacaaaagtcattgctgaaacagttcaatggacaaagtctagaaattgtattcattcaactacaacgtgtggatcaagaggtgcttgattgtcgatgaccccacaatcccttgaatgcgacaaacctatagcgcgcattcccttccttatccctgaagctatctgtgaaactgagaacaaagcagggcaacgcacaaagaaccatcatgttaccatttgatgaatgtaacattgtcactgcaggggccttgtgctgccgttgccaaggttggagccaggaattggaagacagggacagtgtctgaaggaagaaatttgatgttcttatgtctgggcgattgttttctgcatgggctcatgttgctggtacgatcaaatatattcaacaaaagaggattcctctgatcctgccagcaattccatgttgtggtgacggtggtgtggagcagacatagtagctgtcctcttcgtccagttcgttctatttagcgttggtgatcttttgttagaggagacgcaactagggattttatcaatggaaaaggaagggatttgaagggaaggaaggtaatggtctgttactctgtttctgtttgttgtccgtttatggatgccttcttgcaagaaagatgcaaaaattaaatgaactgggagttctgctggcaagaaatgcgagaatgtttggtgttccagtttctcttttttgagctccaacagttgtagacgcacattggtaacggaaagaacagttttttgggtctaaaattgttctgtggcagttatatatacacgtaaatagatgttccctcctagccgtgcttaactggattatgcatttggtttgattcttttcatctggtatgaagaactacaatgccttgctcatagatgtggatccaccgagccatgcatatgtcagaggcaaaaatgggctgatccaaactcatagatgcaaagcccagcccaatataaggctgcaaagcctgcaaagagaacatcgatcatcctcgacaatcttcagaacaacagcacttcttttttcttttttgagaacagaacaacagcatttgagagtagagacaaacctgcatgcatgcttgcctcacctaggcgaccacataaagaccattggaacaaaacagtttaggctcctccaagtaaaacactttccttgagacaaatcctcctgcatgtatgcagtggtcctcctagctgatctctgagtgataaccaagctgcatctgcaattctcaagacatgaggcgacagtgtgctactgctaccaggagtctggggaacattgtaaattaaaagctgccgatcatcagaggcgacagcatacggctttaatcatgtgattccttctttccatccctttaaatttgcacatatcatggcatgatcatgcccggagctttagttgtagccaatgatctagtaaaggtcagagctttgtatatctgcataccgaattgccttggtgtgcgtgtgacgccccttaattaactgtttttatcctctgaaaaagcttcagtgtaagtaacatttgtcttgtctcttggcttcactaggcgagttcagttcttcgtggtagcttagctagaggtggtatcactcacatggatacatcaggttcagttaggtacatgtactctatcgtgcgatatatggaatgcatcagaagcaagtccagtgtcagtgtcacacgaagcaacatctaatcgccaatggtcgatatatgtcgttgtccatcatgtaccaaatcacatgaaagtcctacaaaagcaatccctgtattcgtagtaattaactgctctctagattttttttgggggttaaaattctctcgaataaaatatgagagactgtcactgagaaattactagtaatatctttgactgccaatgttcatttcataccgatcgttcattcattccttgatgttgagaaaagtactctgaaatatcaagagaaatgagaaaaaaaaacgtgcctttttctagctttctgcgaaaatttaaggcgcatggtagagtcagagagcaagttggagaagtgattgcatccttgaagtctttgtgcattttcatacccatctgttgaaaaagtgtggtaaaatgtcaaactccaacataattccgattctctcggatcgaagtactgcctccgtttttcaacatgacggagctagctatagatggtgagacttgccctacaagttaaattaaatagtattagtagcagtggagtacctgattagattacactacttaccaacgacgcatatacctctccaactaatcgacgacgcgtatatttgttgtagtctaacgcaaagattgtcacagtcgaacaatagggagacgcttgcatgtcaagatacatatggaccagttatttttaactcttcgagggagaagcagatacgtgcacactttgtgctttttatatgccctcctgagaagcacaatgagattatatactcagattaaacttttttttcttcaaccaaatatgcatggagaaaatacatgtgaaaaataatattattggtgtgtagaaataggttgcaaatctcgttgaagaaaacgaataatatacctcaactgttcttttttttggttttttttgggggggttgaggaaagggtgttaaattattttttcgtaggctgtatattattttctaaaaagtattaaagtttaaactttgaccattaagtaaaacatattcaaggtactttttctgaaactaaagcaattcaaggtactttttaatacactaaatgcacgaatctggctaattattgatcaaaccatacaacattaaactttcaaaataaaatatacattctcccatctattgccccatctggtgtactaatttgacacatgtcgactatgctaaaaggtagcctaaccatgtactcatctacatctatctatctatctatctatctatctatctatctattctttactaattagacactttgagagagaagtctaatgacccctcgcaaacaccctacttctatttttttccgctcacacggttttatttttttcttaattaagtttatatacacaaggtatatatatagaaacttttaaagtagaaacatcctttaaaagacatttaaatctgagtgatcatacatttaacataatatttgaatttcaatcttaaaataccagtaattatagtccatataatatcctcaagggttggcgactaacacgttgtaatcagcctgaagttatgcttgtggttgtttgggtcactcccttattttgccaaacttcaccaccctttctaggatataccacttccgtcccataattaatatagcaatctagtgtcagatatgacgcattctataactatgaatttggataggggcgtgctggatgtgacacatcttataactacgaatctggacatgcccctgtccagattcgtagttttaggatgtctcatccagtacaaaattgccatatatggtacatatggagtatatttgtttcactatcaaagttatggcataccatagtttttcaattcaaaggcccacatgtcttacacccatcttttagccaaaccttgtctaagaggtgtggccatcaatttatgaccacacctttggctaggttttgtaaggaggtgtggcaatgtttgggagtataatgctataccttaaatacccttgttaattctcacctacttcatttgtttcacattataagatgtttggattttgaatatagttatgcatggatccatatatgtgcttcatatatgtgtccaaattcgtatagatgttagtggatctaaacgagcgatggaaatgccaaaacgtcttataatatactccctctattcccaattgatcatcatctaacttttttggggttattcccaagtgatcatcatattattatcattacataagtctattcgttatctgtgtatgggagtaaatgaatattggtgcatgtatccctgcacataatattttacaaccaaagtgatgtcttggtttgttattagttagaaaatagtgagaattgtccacatgcatcgagtttgttaccaaagtaaatataagtatatgagagttatggatttttctttttttttttgatcttggtgcgctcctataatacgatgattaattggaaacggagggagtagtgcctagtactacttatactccctccatactcataaaggaagtcttttagaacaatgtttaagtcaaaccttgaaaatataaattatgaataactcttaagttgttgagtttaaaaatgtaaaaattatatatatagatttgtcttgaaaaatactttcataaaagtatacatatatcacttttcaataaatatttttatagaaataagaagtcaaagttgtattttggaaaccgtgtcactgtctttacgagtatggagggagtattatacttaattaactaatctctgattcctgtcaatctgatccaggggcatgacgtatcgcttagctcatcgcgaccggccggaccgatacgccgaagatcaatggtcccaaatccacgccctcaaacttagatcgaccggtccaaatcccgcaggtgcgcatgttcacgcacgccacgacgcatctgcacatggcccccaaacgcccagatcgatcaacgtacgggacggatcaatacacgcgcggacgcgcctcgtctcgaccggtggatcgacgacgtacgcgcgcgcccccccggctcggtcgttcaggagtccttttgtcgctgggggctgggctctatacactactatcatcatttctctcttccaagacactctacggtgacctcatatctaaaagtccctctctctcccaaatccatccccatctcacgcggtcacgcacgcgcgcgcacaccgcagccagcccagccgccaccccccgcgactcgatccatccgcgagagacgactgactgacaggcgatcaatcgtgctgccaagtagtagggtgttgtgcgtgttgcaggtggggcggtgtggtgtggtgtggtgtggtgggacgtcctcgcgatcgaatcaggttgccccatctccactccaccctcctcctcctcctccccctgctgcacacgtacgcttttggccagccggtctaattccctctctctcatgcatctagctacctcctctctgtccctcctttgccttttcccccaaccctctcctctctcatctgtattctattgcgaaatagcttagggtattcgcaatcccccagtttgatagagttatatcgatcgaacgtcatacacaccataaatcacagatcgaatggaataatattaatcaaagtgtacgtgtatagtttgtttaccaactgattggatagctatagagctagctaaccgtgttgaaacgatgaacagtggttagtatatgtgtgcgtatacgtatttcgcagcggctacctgcacgtacatgcacgcacgcacaccctgcgcgcaccgtaccagccggggtctcgcgcgcgcggaggagaatgtaggtcatcctgccgcctttaatttaaaccccagccaaagtacacgcatttcgcgcaaccttctcctcgaccaatcgcttcgtcatgcatttcatatgcgtttggtgtacgggtcttccggttaatcgcaagtgtaggtgctttcttgcaacgcaagcctttggccatggactatactatagtagtagtacgtacgaccagcgctatagcagcagctaagctatattaacaccggccggtgtcatttctgacgtgtaaatgttaaccgtcaaattggtgtggtgtgtacgtgtggtggccggacgtccatatctcgatcgggagatgtacacgcagcaactcgcgcgcagagaatccggcgcctggtttgcggctcacgtatacggtttgcattagcaagcccagacttgagggccaagcaacaccgcatcattcgcccggatcgatcccctgcgttctatgattcgctctcgctgttcgcctagcttaattagctatggagtttgattgattgatttattgtcagtttatcatccgcgcgtgttgccgcacacctcgcgacgacgacacacatgacacatatccgtccatgcccatagctgtcaaacgctcattgttcagcctgttaatcgatcgctttagcctttcattttgatctcctagctagctgttgcacgtacgtcccctatagctagctcgatctctctctaatcctagtctcttgctccttttgtggagtgttctttctgtagttgttgcctgcactacacagctgatgcactgccggttctgcctctgcctgcctcgccagagagagagagagagagagagagagagagagagagagagagagagagagagatcagctcgtggcgatcttcctgggaagcgccaaccgaaaagttggtgtgagaattgatgtattctcctccggaaacacttttaatcacctaggtagatacacccatttgttgtatgtcaactaaatgtgtatgaaaaaaattcaaaaaaatttgacaagatagattcatatgtaatatatcaccccacaaatatgcaagttcaaattcaacttctataagttgtaacaaaaataacaaatcaaactctgattagtgtttagaatccaccttcattctcctccttggtctgtaccagatggagatagaaaatcagtagccgcgcgcagcagctgggccgggaaggcaggcagggaggattaggcgattagcagctagtaggagtagcttttaacagggacaagcttcctatagctcccctctcttttctctttgttctccctctcgtcgatcaggccgctttgttccctcctctcctcctttctctctccctcctcccgcgcgcggggtctcgccttaacgtttgccgcatatgggggcgacgagcaaagcgtaggccggagggagggacagggagagagagagagagaggctttctggctcgctctctctgcacgatctctcgtcttgttggattatacagccatgacatggtgcaacagcttcaacgacgtgcgcgccgtggagaacaacctggccaccgccgccgccgtggccgcggccaagaagcagcagcagcagcagcaggtctcccagcacgtcaacctcatcaagacctgcccctcctgcggccaccgcgcgcagtatgagcaggtagctagctagagcttcctccctgctcgatcgatcgatcggtctcctgtgtacatgttggatggcattgagcatggtgtagagtcagttgcaggcagcggcggcggcgacgatccaggacctgccggggctgccggccggggtgaagttcgacccgacggaccaggagctgctggagcacctggaagggaaggcgaggcctgacgcgcggaagctccaccccctcatcgacgagttcatccccaccatcgagggcgagaacggcatctgctacacccatcccgagaggcttccaggcacgtataatatacttacatgcatgcttttcctacgactcatcgacatatatcgaatcagttttagtttcatcagttcatgatctacataagtgcatttgtctcgatcagctagcttgcatgcttaattacattgtgccatcagctatagcaattgcaaagatgatcagatctggacgggacgtggaaactataggtgctgtccgtcacggaagtactcctgacaaaacattttcttgcttggttgattctcagtttaaaattccctattttgatataaagttttactggtcgtttccaatttgatgaccttgcttcatatatgtcaatcatgcgtagccgcttagtatttgtaacatccacactagggtatatacatgtcgatcgtccttgcgtttttcattaatttcgtgtatgtccgatcgtgtgttgttgcatttgagcacgataccgtataaatattgctaaagtttgcctttgaagtaattgcttctcctacttgcataaaagtttatttcacattgaaaacgagtgattgtgacagcacagtgcatcaaaggtccacgtcatgcaggatacacgcaacatcagatcaaagggagaataaactttgaaaagacttgttgcaatatgaactggtttttcccttatccttttatattcctagtatttaatttgcctatatataatggtgtatttgcatgggtaggatagtcattgtatatttgtgcaataaggctatgtttagtttgtgtgccaaattttttttgaactatacggacacacatttaaagtattaacgaagactaataacaaaacaaattacatttgaagtattaacgaagactaataacaaaacaaattacagattccgtctataaactgcgagacaattttattaagcctaattaattcattattagcaaatgtttactgtagcatcacattgttaaatcatggcataattaggctcaaaagattcgtctcgttatttacatgcaaactgtgaattggttttttttcatccacatttaatgctacatggatgtgtctaaacatttgatgtgacggaaaagttggaagtttaaagaaaaatttttgaatctaaacatggcctaagaataactgacagatactttaaattattatgagtgcctttcctgcttttggaaatataatattatattcttcaggggggttgcattccattccacaggataacttgtactattttctaccatagtgatagaaatattgcaccaagagacattatagtgcactgatcatattattttcatggaactctattttcatataagcagttatcaataataaaccacgtgtcaccattgtactatatattaatccagtagaaaatgatatattacaaatacttttatctagcaagaattaattatgattaaaaaaccaatgcaagtggctctttatgtcgtttacaacgcaaacattttttttctttgttggtgctggagctagcggccgttcgtggggtattctcatgggaatattggtgtggtagtctgttagacatatgcgtgttgagctggaaaacaatgtgcatgcaggggatgctccttccatggtacaaagtaattttctttacatttcatagattacagctgacctaaattaattctatctgtaagaaaataattaagccgacaaataaaaatgtgttatttagttcnnnnnnnnnnnnnnnnnnnnnatatacattttatttatattacaccaaatttacctagattcagtggctgagccaagatcaagatccacctcgcgcgaaatgcaaatattttttttactaatagtacttgattgcaaaaattctatcggggttaattgaccttacagggtcacagcatggctccactactatctacattatattataagtactccataatgtggataaggattttctgaagtttatcggtgagtaattctttaaattcaaagatagtttcacccttcagcgccatatctccactaaaccactttaaattcagtccgttgtataaaaagtaatctatttttgatagtttatggttaaataatgtatgaagattctaggattgtctatcacacttttataaaagtttaaggttgtagttaacatgcataatcttttcctttttttacaacctgggaaatttcatttctatgttaagagatgcaaaacacaaatacgcccccacctcctctttaaatataattttattcggtgaaactttaaagtttaaccatcaacatctctcaaatatgtatttaatttgaaaataaaaatcaaaagagcagtttttttaagtacttttacaatactaaatttttgttacacattattgttatactaatagaaaaaaaatagtcaaagctatacgaacgaataaagttggtagtgtaatactccctacctcagaataagtttatttttgtctctcccatttattttaaaataaatttatttttgaacactcattgcactagagtttgtgaaagtaaataatagatgcactggaatgtaggtaaaatgaggaataattgcattaagatttgataaagtgagggtatgtctttttgttttatattggtacatatgggatgagtgtaaaataaatttatttttggaacagagagaatatgtattgaaacaccgagcaagtatttttcttatgatggaaaggacgcaaaaaataactaaacaataacagttcagggggagagagatagaatcagagaattgctggagtcggcccaaaaccatcattaactgggcccattcgtcatatagtttgactgaatggtcttatgctgcgtcagccgtcagccgtcaggacattggaactggtcaactggatactacgattacgaagccactcttgttgtgttgctgacctgctgttgcatgcatgcacgtaatataattgattacatttgcatctcttaactcattcgtgagagcagtggcagtgtggcactctaccatattaaccgtactgttctctttctgccgctgttaatttcaggagtcggcaaggacggcctgatccggcacttcttccaccgcccgtcgaaggcgtacacgacggggacgcggaagcggcggaaggtgcacaccgacgagcagggcggcgagacgcggtggcacaagaccggcaagacgcggccggtgttcaccggcggcaagctgaaggggtacaagaagatcctggtgctctacaccaactacggcaagcagcgcaagccggagaagaccaactgggtgatgcaccagtaccacctgggctccgacgaggaggagaaggacggcgagctcgtcgtgtccaaggtgttctaccagacgcagccgaggcagtgcggcggcggctcggcagcgacggccaaggacctctccgtcgacctcgtcgccggtaacaacatcaaggctagcaatgctgctgctgaacaccaccataacgacggcgtcggcggcggcggccacggtggcaacaacagcagcatgctgaaggaagctgcaggcattgtagatttctacaacccagcggcggcgctaatcggctacagccaggcggctcctaacaacagggcggctgcttctgctcatttgacgatgcctaactttgaggtgcacacaggaggtgcaggctttggcccctgatggatggaagaaaacaaagcaaattaaacatatttgactgatgatatatataggttagatggagagggcagggcaggtatatgatggcaaatgtgcatcatgcatgctagcatggtgtaatttgcatcgagtgaaaaaaaaggagtttactaaaccgtctacgtacgtattactggacaataaggagtgtgtcgagtgagttgctgcacagatgttgaagcgtaggggggtcgatattcttacagtgttcattattgttacatgtgtacacatatataacttgacattctcaatttttttgtttaatgatatatatatatatgttgttctatacaaaaataatgttggaattcaatattgtacattgatcgcttaaatataaggacttgctttttcataaatataaaaaaaatgttatgcatgtgtaaagtatcatttttcttattatttagctagacaactagtaagaatatcccagcccaaacaataattctctattgaatttttttcttagtttgacaatctatgtataggtataggaagtaatattttagtatctagtttattaagaaacaaattaacccacaaattcaagacgataaaaagatccacattcttccacctgacagttaaaaccaacatttcccaccagccaagtgagcccaggtgagctaggctcatgatcagagtagtcactgtgggagtgtgttgcaatcggtctcatcgtctttctcgtttgtaccaacaacatcgccctcactgtcagagtcatcgtttcgatcgctagtttccgtcccctgacttagctagaggaccaggttatcttcctcttgttccgtaagctgtgggagcaaagtttcttggaataaatgaggtatcgtgccatcgtcgtgttctgttccctccatattagaatataataagcattttagagttagacacggttattaaaaaaatatatagaattgaatggtggagggttgtgattggttgagtagtggaggtaggtgagaaaagtgaatatagaagagtgttgtgattggttgggaatagaatgatggtggagaagagggctaaaagttgttatattttagaatggagggagtagattttatggtgaccatgtagaaccctccccagtaaatcattattactttgtacttatattgcatttgcatcctcaagcatttattttgcatcctcctcaagcaacactagtttctatgaaaaaggtttttatgtataaaatttctatgccaacttttatgtataaagttcctattgtatactgaatgttgctattaagaagtttcatgtaccaagttttttaatttttagctgggctaaatgtcaaatgagctcagaactctgcgtacgcactcttgtaacccgttgtgggcctaataggcttgaagtgaggccggcacatgggctagacacgtttgcaggccattgacacaacatcccctgccgtatctgcctctcgctcccacgtcttgaacacggcgctaaacttgatccagccttcgatgacaagtggaccaccaaatatatcaaaagagtaaattgcgttggcggtacaaaaacttggcaggtgggtacgattaggtgcaaaaacttgaaaaccaaacgtatactactagaaaaacgatttttcatggcgtcgccctataattttcgctggtggccgtacgcgaaaaccgccagcaaaaatgtaacgagtgatggggggctacggaccgccagcaaaagtatattttccctggcggccacgctaagagatccgccataaaaaaactctatttttcgaggcggagcacttaagcgtccgccaagaaaaatcgtgttttcactagcggctactaacacctccgccagaaaaatcgtgtcttatctccacccactgcgtctcctctgtccttgtcacgccccgaactagtcccgaccggaactagcccgtgacgctccaaattaacctgttaatcgataccagtcccaggaaacagtgctggtatcacagggagacagagtatcacagcaacagaggtctctttattaaagagtagaagtatagtcatgttgggctgcggacagatcccgagctcacaactgcattacaaaaggaaagcggaagccaggacttggaccaatcatcacaggcacgacttgggaactaggccgaaaccctaaaactcatcgtagccgacttgctcctggaagaactcctcgtcagcaggatccacttcatcttcttcagcaactggggggggattatttatatagagcaagggtgagtacgggagtactcagcaagccaggggaaataagtgtttaatgcaggcttcaaggaaaggctgttatttttgcaatttattttatttgaactcttttctaaaatgattaggtgagtgcttctcaaacgactcggatgagacagtgcgtctcgtccggtcggagtatgtgcaatgtgtcactctttaggattgcaacaaggttggcacccggccaacagcttttcaaacggccacccgggccaacaacttttcaaacggccacccgggccaacaacttttcaaacggccacccgggcctagctgatcccgtcagctgctgatttttcaaacatcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcattttgaaagccgatacaggtttaccatatgccaacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttatcttatgtttggatgaaattccaaggaaatcggtccttaagtgcgagagcgggaaaccgtacacccggtacgttccccggtccgcggttctggaaattcatttagttcgcaagcaccgacccaggtgtcgggttttccaaatctttcgtaaaacccaagttttacccaagttgttattcagattataagtttgaaggcgtccgtcgatactcgcacaggatgcacgaatatcaagacgcaactaggtggttacaaggggacatgctgtaacaattaacaaggaaaggatcaaatgcaacaatttaggtaggtccgccaatctgccttgcagacggaacaatagattaagtgcgatcctatcaatgcataatattttgcaagcaatataattagatttcaaatataggctcaagatgttcaaaggtggcttgccttgctcgagatctggagcttgatcctcgaaatcctcgcactgcgggtcttcgggctccggaactacacgcgaaacggaacaactcaacaaacggcgaaaataaagccctattaatgacctctaagcgtgccattagatagatctcgagatttgaggaattttggaagttgaacggagtcaaacggatttacgggtgggaagatattgaatttctaagattattggatttttggtctaacggaaaaaggatttaattaaatcctttttggaaaagaaaaagaaaagaaaggagggagggaatatagacttttctcgggtggctagggtgcggcccaagagatttggggcagctcggccgagcttaacggaccggccggcccaagacggcccaagcgcgcgcgcgcgggagggaggagagagagggagccggtggaccgggctcaccacgcgtggtcccgggtgggacccgcttgtcagcggctcggctcaccgtgcggagggtgcgcacggcgcacgcgcgcgggcggggttgggacgcggtgcacgcgcgcggctcgcggtggacgcggatgcggcgggcccacgcgcagcctcacggctcgcggtggaacgcgcgcacggggagggaccgaccggggtgggctcgacccggtctaggctgagctggcgccgacgtggcgcctacgtggctgccacgcgggccggcgggaggtagacgacgacccggccgcgaatggacggcgggtggcggcggcgagcagcggagcgaaccacggtgatacaggcaaaagcgagcacaccgggcggctgcacgtgacaaggggagacgagccaacggctcggattcgtcggaggttgctcgacggcggcggattgcggcggcggcaaccggcggcgggagaagagggaaacggcgacgaggtcacgagaggtcgattcccggcggtgagagcatctacgcggcgtcgggaactcgacgctagcgtcggattgggcggaactacgccgagcgaggccggcgacgagcgggtgctacggagctcgggcggcgacggcggcgagcacacggcgagcgacggcaacagtcggggcggcgccggctaactacggggaggctactcgagctactaccgaaatctaaggggaggagatggagcgaggaggaagaacggagggaggcactaccgtgcgggacggggcgctgtgacgagaggccgacggcgcgggagtaatctctccggcctcgggccggggaagaggaaggagagggcgcggccggagtcctcttccgcgtccttgctcgtgccggctcctccgacacgcgcaacgacgatcggcgacggcgaaacagagggcggcaatggcgcggaggcgaaaatgagagagtttggagggggagggcttgggcttaaatgggcggcaatgtcggtttgggcgagggaaaccgacattgaacggtcaaggcgcgagctggcgctcggcgcttgcagccaaagcggcggcaggaggatgacgccggcgaggaggaaaaagggaaaaaggagggggagaaaggggcttgcccctttgccgattcgggaaaaaggggaaggggagcgggagcgtcgcggcagagggaggaggggcgcggctccgtcccttggcggcttgcgcgcggagtggcgggggccgggcgatgacgacgacgatgacggggggcggcttggagcggagcggcgacattggcgacaggcgcgtgcagaggctgacggcggcggcgaccgggcggtcgaccattcggcacgcgcgcgcggcttgcaacgggcggcgtccgcgcgggcgcgcgcacgcgaacacggcgcgcgggaagcggcagcgagggagcggtgagggaggacttggctcggcgcgggcggcttacgcgtgctggctcgcggggccgagcggaggggcgcagggcgcggctctcgcgctcgcgcgcggcgcgcgagggaggggcgctcggcgcggcgacacgcgctcgcgcgcgcggcgcggggcggagcggagggagagagggagagagcgggggcgcgccggggaaagcgagagagagagccgggagagagaggggaagatgggccgagggaaaatcggcccatcgaccctgggggaggcaaaatggacttttgcggaggaatttgatttggagggattggattcggaattgaactcgacgatagatcggggattgagatcttgagatggcacggacactagacaacaagcaaagaaacaaatttcgcaattagggtttttaagagataattttcccgctaggcgccaagacggaacgggcgcaacagtcctctccacccacctctccctctcctcttctctccacccacctctccctctcctcccccttcactccccactagcagcggcgacgagcccagcagcagcagcacgcggatcgaggcggcgcccgtgcgtcgcgatgcggcggcgctcgtgcagctcacggcggcggtgcccgaggcggctcgcggcggatccggcgacgggaccagatccggagcggaggagcacacggatcgaggcggcgcacctcccaggtctctctctgccaccaccacacactctctctctcagatctggcgcacgggccacgatggaggctgcggcacggctctgtagcggcggtggcgaggtggaggcggtggattttttttaagaacaacggatgaattttt

SEQ ID NO: 23284 - DNA, 10866 bp, Oryza sativa
gatggagatcgccgcccggccctcccctgttcgtcttggcggcagcgcaaggagcggaggagacaacgagatcgagacagttgatttctttttcttttacacgatatactcgactactccgccctttatctcaatatcaataattttttttgctactctcactgttctaaaataagagttgttttgcacttttcacatccaatttttgaccgtttgtcttatttgaactttttttttataatttgtatttttattgttattacttcctctggttcaggttataagactttttagcattgtccacattcatatagaatttcaggttataagattttctagcattgtccacattcatatatctatatcaggttagaaagtcttataacctgacatggaggtaatagatgataaaatatgaatagtattttacgtgtgactaatttattttaatttttcataaacttttcaaataaagagaattgcatgccattactttcaccccctgacacgaaatagccatttataaaattatgaattgcaaatttaccactgaaaacaattgggcagcgttaggctgcagcgcggtggctgcggcaggtgtcgacatcgactgtggtgcttgcggtggcttgtggcgatagctgcagcgggctgcatcaaagcaggtacaatagcaggttattttctttcttttgaggaaagtccacgggagatttggctggcagggatgtaatcatcgtttcaacctcctagacgaaaaccttgcatcctgccagattggtagaacttgtcttgacaaaatttgtacggggagatgtgttgagtagattggagcaacgtctacttctcctttttaaaaactttgcatcctgtaggagagtgaaggttggttttttggatgggataccattgcttctggatcttgtttctataccttatttgttgatctgcgggcctcggctgctagtagacgagtagttaaaagaggcggtgaaataacgaggactagaaaggtgatgcttccgacttgaaagaagatgaatgtcggctgggttgggcctcccaagccaatcttcattggagaaaccacctcctgtggtaatctcggcgaaacctccaagcaccaagtcccttatctgacatgctgctatcgatgggttagagctctaggatatgttacactagatacaagaggggagcaagctaatttagcataccacgatataactaatctggcgacttgtagtaagtggctaactttagtgcatcctcctggttggtccttgatgtggcttgtggctatagcttgcgattcaaagaaaattcaaggaaaaaaatatatgtaaccatatatgtagtggaaactatcattggattaaaaaatgaacgcctgagtaagattttactcatggttgactttgagaataatttttttacttttggtgatatggacaaatctcagacgtctatttttaagatccaacagtaatttctaagttttcactatatttgtggtttgcaatatatatttacccataattcaatacctttccctcgtaatttccactacatatatagtatttttacatgcagatgaccaatcaagtaaaacttggagactgtaagtgaggtacgagcagataagaagatcggagtcaaacatcttctcttaacggggaatgaatttccatcttatcggtaaaagtaccattccgtaaaaaactagttacatggttttcagctgttacaaatacaaataaatgaggtatatcttatcagttacactgaaaatattattatatttttaaacatatttgatatatgacctgaattgaattaaagcttatttgaacggatggttagaaaattatcatttccactgccacgaaaaatgttatgcagtagtaatactaatctactccaatggcatgctcagattagcaagatggtaatattgttaaaattttgacatgatttttatgtatttactaaatttgacgataaactaaatatatgtatttttataactttattagaaaatggtatgattgaaaatgacattaatcatatgccctaaatttactgacgtcttgtttggcaacttgagggaaggggattgggagtttacacggaattgatggtgagattaagatgtgaatttgatttttcatcctagtctcttgtttggtagaggtggtggaaattgatagggagtttagttaaagattagatcattaatgaaaacggatggctgagatttgcttagacgaagtaaaggaggaattccctcccaattatctgcccctacccaggtattgaaaaggagggagtttattcctcaattccccatcccatcccaccaaaattcccatatctcccaaccaaacaaaacagttaatagccttatccctctaaactaccaatcccttctgaaaactccctccaaccaaaaagaccgtaaaaagaaaaccaaccaaacagaccgtaaaaagaaaagaaaaggagagagagaaagaaaagggataacgcacggcgcacttcgaaacccctcctaaaccacgcgtgacccaatcgcaatggcgacgccgccggaatccctctcaccggctgcagcggcggtggaggatgattgggaggaggcgcgggggctgctgtacgaggcctacaacgagctgcagggcctggcggcggagctgggcggcgcggcggcgcccgcgccagcggtggtggtcgtcggccaccagacggacggcaagagcgcgctggtcgaggcgctgatggggttccagttcaaccacgtcggcggaggcaccaagacgcgccgccccgtcgcgctccacctccgcttcaacccgcgctgccacgccccgcgctgccgcctcctcgccggctcgggcgcgggggacgacgaggacgaagaggccggtgtcgccggccgcgcaatgccgctcgccgacatccaggtaccgtgcgcacacgtgttcgtggaaatgccagtgtcgtgtgttgcgcctatccgttccaatctgatggcatctctattatgacagcattattcatgtaattgctggtgtcatatgctagcaggaggttttgtggtgctaggaaatgatttatttgcgaaattggtgaaatataaaactcgtttaagaagaaccaggaaggggggaaatgagggcatgaggtgtatgaatgtaatgtaacgcacttcatttgtttgtgtgattatcctttctgtagctatgttatgctgtactaggctagcttaactaactctatctgtctactatgaattcaatgttgtggtttcggctagtatgatatcggtattaggtaacttaatgaatgagatcgaagggagggagccgtgttactgatattttcttaagaaaagaggattctagcctctatgggctagtacaccaactatgctgataaccgctagatgccaggagtctaacctttgccgattaaatgatgaatagatgctatattcactataaagggtagttatgtcaatactcaatataaatagttttgacgccaaactgatacgagaattttcccagttgttaattatttattattgtcaacctgaaacatcaatattttattttagctgtttcatttgtaagaaacaaatgttcacttgttgatttcattattatcaacttacagcttagaactcagagaagattcaagttattggactgttcttgcattaggtgattgacattttataggaatatttactttcaggcatacatagaagccgaaaacatgaggctggagaatgatccttcccaattttcagaaaaagaaattataataaggatagaatacaagcattgccctaatctcaccattattgacactccaggcctcatcctaccagctcctggccgtaaaaaccgagttttgcaggtatttccccctattcttgcttgctgtcagttaaggctgattcttttcagcctttaaggtcttttgtttccactgaaacttcactttctatgaccctactatgaactcctttttattatattaatatttaataaggttatccattggtaatcttgcgacctgcagagccaagcttgtgctgtagagacccttgttcgtgcgaaaataaagcataaggaaaccataatactttgccttgaagattgtagtgactggagcaatgcaactacaaggagagtggtgatgcaggtttgcactttaaaactagcttttcttatcaaaaggtgctcaatgacattctcatggtctcttgtgattccacattagttgtaccttatttactgggttactatgtttaaacaaaaggcgtgcttactatatcaagttcaaacttcaaacgttcaacacacaattattttgttaacctgtaagcagtgccagtaagctatgttttgtgtttccctttttcatactgcaggttgatcctgatcttgcaaggactgttctagtctccacaaaactggacactaaaattttacagtttgcacgagcctctgatgttgaagtctttcttcaccccccgacctgtgctctagatggttccttactgggggattatccctttttcacatcagtgccttcggggagagttggctcctgccatgaagctgtattcagatcaaatgaagagttcaagaaggtgagacatcacgtgccagtatcacttaacatagagatttatgttctgccaaagtgttcgaataattttcttttgctggcaagtttgatgggtgttactttgttaagtcactgtgagttttgtaagcaatatgtgggcaagccaattggtcatctggtcctatttgctgtgaaatttttacattatcaaggaagattacctgattattaaatgataaattagaaacaattattaatttgttttatatggatgcaaatctacattttaagtattgtaggttccagaatttaaaatttgcaggtaacttttagaatatagttatatatgtgaaaaacccatgtaggtttaaatatttttgtaggcagttgggttttactccgtagttaactattctggagttacactatatgtttcatgatagcttgtggatcttgtaatacatggaaatacccgatacttcccaaactctataaatggctacccttaaatatgctcccatatttctgcgcacttttatatgatcaagacatcacaggaagaaagtgttacaaacacataatcctacttcactactgcttatttcttagtttcagtaatgtaaatagactgatcacccttaaatattactgttcgggaaggacatttgaaatgtgacgaataacttctttgttgaacataaatgctgccagcattcttctctgttgtcacctgtttagtcagtttcagtatgctttttcgctgatatgaactctactaatctggtaacttctgtcttaccttcatccttgaattgcctctaatggttactttcattctgcaggccatctcattgagagagttggaagatgtcgcatctcttgaggacaagttgggaaggggacttacaaaggaggagaaaaacagaataggagtgagtaacttgagactatttttggaagaattgctgaggaagaggtatccttgctcattatagagctggcatgtgtatgttttttaattattcttcgtatcattgctttgaagtaatgcatactaatatggccaaggtacattgagagtgttccattaattattccacttcttgagaaggaacatcgtggtgcaacaaggaagctgcgtgaagtcaatcaagaaatcaggtgattcatgatgcctatcattcatagcacacttaaaaggatggattaatttcctccttaaattacttgtatttgtttccatataataaatttttctttggtgaagttgaaagcttataacgaaaacaaggctcaaatgttttattcttactgggaaaatcgctgccaactactagcacctaattgcaaataactgtcctggtggactatattagttgacattctagtaggctagtagcaccctcataaagattcaagaaccatcacgctaccatggtttatgttatctttcttcagtcccaatgcagtgctatcagatgcaaccttgaggccgggagctgcaacagtgcaacctccaattccttggcttctatgctatgcttcgccaaaacattcaatcatgagccaattacaagtgaaaattattccttgctttccagattgaccaagtgtagcagcagtaaatttattcactacttatttctggaatcacttacaaagttgagtgacagcctcaaaatctcaaccaatttatctccggaatagatccgatttatctgaaatctcatgctaaattatttgagcaatgccagaaccaaagaacaaatgatgaatattacacgggatattacaacaagaacatcaactgaagattggaaatttgttagccatacaatgccaaattgaaatttaactttgtactaagccttgccctgatgggtttgtttgagtcttcttagattcttttccttcttaatataatgatgcgcagctctcttgcacatttgattaaaaaaaaaagatccatcccaggcatcagcaataaatctttactgttcactgagtgaaatttaagcctcctaatattgaatggcaaggctggaagaagcaaaccaatgaccctcccagaataaaactcaaacatgttatttatttttcctttttccccttgtgtgcctttacacggttccaccatatatttatccctgttgttaaacatgcctgatataccctgctgatggtatatgtatctggacagtgatttggatgaagcaaaaatgaaggagaaagctcgcctgttccatgattcattcttgtcgaaggtgcttactactctgaaacatatattattgttgatgcagatagttggatactgaaacttttgcaatgaagaaaagttcatgcgttgtcacacatatgcagccaatgcccactggatctattgctcagcagctggttgaaataaacctgaatactgatttactgtttcttgtttcagttatctttgctattgaaaggcatggtggtggcaccgcctgatagatttggtgggtgttttatcttgtgcggctcggtaccagaaaacttgaggttcttcttagttggctgactttctgattttgtcaataatttattgaaactgttattggagtgtaggagaaactttaattaacgagaggataaatggaggaacttttactggaagtgagaatttcctgatcccaaacaaattgatgcctgtaagttctgtttttttcctctgtattgaagatgccctactattttctgtaggttcttattttgagcctttaaacaggatgtaatgattcttcactgtagataaacattttaatagattgtatctaaattggtggttcttgacgagcctaaagtttgttagcagtgacagattgatttatgtagcagtagagtcatttttctttcagataaagacaaaaagtctaccatatctatcgtcttttcagcctgttaaaacaaaattatccactgagtgtttgacacactgtcttttgaatatgcactcattataccttttcttttcttagaatgctggaatgcgtctctacggtggcgcacaataccatcgggcaatggctgaatttcgtctggttgttggaagtattagatgccctccaattactagggaggaaattgtcaatgcttgtggtgtggaagatattcatgatgggacaaactactccaggtagtctcattccatatatcaggcatactttgactatatttatatagcacatttactcattttcaactttttttgttaggactgcttgtgtgttagctgtggcaaaagcacgtgacacatttgagccttatcttcaccaggttggttagcttacctcatgggtgggcacattaataatcacatttagatggtcctgttcagctttcatgattgttattccacacttgagctactggaatagtacttgcttttgtgtgattatgtcaataaaatcatcaaccgatttttttcatgcacgtcccatcattttttggatcaagttcagaactagagtgtgccagggttccacagaaaatgtgtgaaatcaataaaaaatgtaacatgatgtataaacaaatttagtaattgaattaatttgttgtggtctgtatgaggggtgatatttcctctgcttaatccctttctgcgattaaaatctatccttaattatgtgcagctgggttttaggttattatacataatgaagagactgattccgatatctgcttttctgttggaggtactaattaatcctgaagttattcagttcaactagtattctgctcttttcttttgtaataccgtgatagaattccaacagaaagatggtgagaactgtagcagccatgatgtacttgtgaagcgtgtcaaagctgcatttgataggtttgctgaatctactgagcaatcatgtcgtgaaaggtaatactgtaagagcatccttgatttcaatacctttataattgtttcccttctagtgtacaactcttgttcaagtggtcttgcaaactcagttcaacaaactctttgatatcaaatgaaatgcatttccctagttgattattgtgctatcaggcatacagtattttatggtgttggcaaactagttagtttttttttaatagtggttctacttagaaatgtatcagctgaattataatatcattgaataataaagtgcaaatgaagtgaactgaatgagttatccgtatctttgtcatgtcttccctcctttttgatctcatggcattaaattttgtgcgttccagagcatattcatatttgaaaaatgtgattttagtggtttgtctcatgtaaatatgacacagaatttagtgttgtgtcaaagtaaaactttctgttattgtccagatttctcctgaatcttcatggcatgatgcattcatgcatattgtttgtacctgatggttcatggcatgatgcattcatgcatattgtttgtacctgatggcatgatttatctgcatgttgaaatgtgtaatgcagatgtatggaggatttggtgagcaccactcgttatgtcacttggtcccttcacaataaggtacagttattaatattaatcagaactagtatctttcgagggattcgtcgcattcctaatgatttgctacattgtatagaaccgtgccggattgagacacttctttgattcctttgttgcacaagagcaattatccgtgaacacacttactgcccactcgactgggctgcatgagcaatcctttggcttgaatgacaataagcaggataggccaaagggagacttcaaatcaagtaattcttcagaagcaaattcacccactgttgcatcagagactaggcttgttgatctcttggacagcacactatggaacagaaggctggcaccctcatctgaaagacttgtgtatgcactggttcaccagattttccatgggatcaaagagcattttcttgtcaccacagagcttaaggtctccctgcagtaaatcctgcactccttaacgagtatatgaagtttattgtttatatcttgttttgctcatcaaaattgcagttcaattgctttctcctcatgccgattgttgacaaattaccggcgcttctaagagaagaccttgaatcagccttcgaagatgatcttgacagcatatttgatgttactcagctgcgccattcacttgggcagaggaagagagatctggagatcgaattgaagcgggtactagtcttttgcgtattttttttttgcacatcaagcattactacctcagtattcttatttgcaaatttgctggtttcagatcaaacgcttaaaggagaaattcgcagagataaacaagaagctgaattctctccaggttagacagtaagctactctaggagaagcagagcaactagctactctagtcgagttagattatttctatgctgtaataataataatcccttagtgtgtaataataatagtctagtgtgattatgacttctttgttggatcttttcatgtgtaaatatacatatattaacccttccaatgtcgtttcccttccttgcaaaccgactaacaaagaacttttacgtgatgtttactgttcaattattacccttactttgctgtgagatgggttcactcaagctgaagcaaatgcaaatgaaaagctgcttatggtcacatcacatgcatggtagcgactgtttcaacccaaatccatcaccaaaaagcagcaactcttcttccccttgctcgcaacctctcaacccatcaccctaaacataggtattacccaacaccacccctctctctcccgcgcaaaccatggtggcttgctccccgcattggacaccgccaagaacgcggcgtcgtcgacgacatgaccggcggtgacaaggaccaccgccgcggcggcagcggcggcgggaaggagaccttcctacgcagcctcgaccgcgtgccgtccggcctgcacatcgacgccgacttcccctccgacgacgatgacgacgacgacgacgaggaggtccgcgtcttcttcgcctccaccatgggcgaccacaagatgtacagcttccgccaccatcaggccgccgtgctggaggaggaggaggaggacgacgacgacgacgagttctccaagtatgacatggacgaggacatgtcgatacaggagcggcgccgccgtcttcaccaggggctcggcctcgccagcagccgggacctcgcgctccggcgacat

SEQ ID NO: 23285 - DNA, 93003 bp, Oryza sativa
cggcgaagcccatcacgcggcgccggtccgacggctgcctctccgcgcgggacggcggctcctgtggaaagccaccccgccgtcgtcgccgtcggtgcgtcgtgttcgatccttgccggcccggcacgccggctgcgacgatgtctccctcgtcgagaagtttcgaaacgccatggctaaacgtgatctccccaccgccgccgtgcccccgacgacgccgccgccggcggcggcagcggttgcggcagcgccggtggataaaggccgcaccgacgacggcggcggcaaggaccgcgacgacgcgaccaagaaccaggagagcagcaaggaggtcgccgtcgtcgcggcgcccaaggatgccgcccccgcgtcgaacacccagaccggcgtgcagctggggctagaggagatcgagaagttcatcggcaacacccccatcgtgaagcacctgatgcggcgcggccagagccagcatcacagcggccagctcgcgtcgccctccggcggcgcgccgcccaaggccgagaagccggcgggcggcaagaagaagggaggctggctcaagaacatcaagtccgtcgccatcggcttcatcgacagcggcggcaacagcaagtcgaccacatccacgaccacctcctccgccggcgccaacgccacctcgtcgtcgtcatcctcggcgtcgtcgacggagcggctcaaggtgcaccaatccggcaagtcgtgcaaggagctcaccgggctgtacatgtgccaggagatcatggcgcacgaggggtcgatctggagcatcaagttcagcaccgacggccggtggctggccagcgccggcgaggaccacgtggtgcgcatctggcaggtggtggaggcgaactccccggcgtgcctgccgaacgacggccactcgggccccctcccgccgcatccccccggcgccgcgccggcggacgggacgtcgtcgtcgtcgacgccagcgctgtcccagctgtccaagaagtcggtgaaggggaagagcggcagggacacgctgccggagcacctcgtcgtccccgacaaggtgttcgcgctcgccgaccagccggcgtgcgtcctcgagggccaccaggacgacgtgctcgacctcacctggtccaagaccgaccagcttctctcctcctccatggacaagacggtgaggctttgggacaccaccaccaaggcctgcctcaaggtgttcgcccacaacgactacggtcagcgtcgccattgattcgtttctttgtttcgaaatcgatatctcttgacaataatccatctcaagaattgaattgaattgatttgatcgatcttgcagtgacttgcatccagttcaacccggcggacgacaggttcttcatcagtggatcgctggacgccaaggtgcggctatggagtatccctgatcggcaggtcgtcgactggaccgacctcaacgagatggtcaccgccgcctcctacacccccgatggccaggtatctactctcgctagtctaatataaagtgaattgtccgttttttctcatcagcttaagctttttaagttgaactagttggtgcatacaactcaatattcactgtcatttcatcttccatagctcaacaattccgtatccattttacttctctttttttctctgaattctgatgtgtgaacaattcgaatcaagggcgccatcatcggctcgcacaagggtagctgccggttctacaagacaacaggtagtacagtacattctctgttcttcattgactcatcagatgatcagactgacatccagttgcactgaagtgatcaatttgattgcggatttttttgggttttgttgcagattgcaagctggatcaggaggcgcagatcgacatcgagacgaagaagcgcaagtcgcaggcgaagaagatcaccggcttccaggtacatgaacacaatgcatcacactttgactagctgctgaaatttaagagcttggcaagaacatggcctaattgttcatcttggccatggccatggacacctcagtttgctccggggaacccctccgaggtgctggtcacctccgccgactcgcagatccgcgtcttcgacggcgtcaccatggtccaaaaattcagaggtgcgctggcggcggccatggatgagaaaatctcagctctaattgaaaatcagagagatcaattaatggtggtggtgtccgtggtggatgtcaggtttcaagaacacgagcagccagatctcggcggcgtacacgtcggacgggcggtacgtggtgtgcccgagcgaggactcgcacgtctacctgtggcgcgcggcgcgcggcgcgccgccggcggcggcggccatcggcagcatcggcggcatcggcatgaagcccaagacgtggtgcaccatccgctccttcgagaacttctactgcaaggacgtctccgccgccgtgccgtggccgctggccccctccggcgccggcggcgacgggtcgacctccggcagctcgccgtcgcggcggcagggcggcgtgtcgtgcaccgacgacgtgtgcagcatgccggcgaagagcggcgagctgggcagcgccgggacgccgctgacgcactccggccagctaggctcgccggcgccagaaggcggcaagggcggcgccgacggcaatgcgtggggattggtggtggtgacggcgagcttacagggcgagattagggtttatcaaaactttggaatgccgttcaggataagaggccagggtaacctgttctactgactactgaacaaatgctgccatgcgtatgaacatttttgatgattttattttttttcgtaatttttttatccattttcagaactgagaagtgtgtgtgcttagatctagtacatgtgcaatatgttcagttgactaccatatgtaggtagtagaattatggattaatttcgccatgtaacaagttagtgaattagtgggatgtacatccaactctacaaaatgaaattcattacatttgtctttgtaccaaatttgcactacacacaccataattatatagcacatgatactgctgtgtaaaaacaactagattagcaatatacttatatatttttagaaatatcttaaatcgtttaaaatctctgatggctggttgacattggccattccattcttcaacatcttcctaaaatcctagtggccgccatcggtttcctcttgaccttgtcaatgccgataaacataaactttcctcatggttaaaggggagttgagagaaaagagaggaggagagcagtggctttccagtttccccactaaacaacaacgctatccgaattcaaatcctattttccaaattcaacaagaattatactacgttagattgttttgaccaagacgtgtttattttaggctttcattcacttttatattttatcaataaaatacttcccattggccaccaaatgtgtggcaggggagaaggaaaaaaattaatgagggcaagattgaaatgtgtaccccgggacttaaggggatctatgttatgggggaaacaaatcctccaacttaactgcacgctgcagttgagtcactgacatgtcgatcccatttttctatagcccacatgtcatggtttaactgcacaacagttataggatcccttcccaatctacattatagtggggagctactagtaacgataaaatcagtttgtgattcaatagcatgaacattgcatctgaaagagtcattcacaatgcatcaaatgcatcaacttggtatgttggtgcaatttggtacaagaatttaaaaaatgtgcgctctagctagcgcaacaaggtgtgtgcaatttagtgtaggaactttataagttagcgtacaagtgcaacaacttgcaatgtgtgtgtgttttctatacaacaagttaagaagtcatgcgataacttaattatttcaaagaattttttgtaatatacattgtcagggctatggataccacatacccaatagtaattgactaagctcggcggaacccaccatataccaagtcttatatggaattatacttcgtatatagaaggagatctggataaggcatggcaaaaaagagttctacatggaaactataaagactactcggattgtatccatattggtctccttagttctacttgaatagggggacatatatgggtataaatacaagaccccctagggaggggaagacaagtccagacaaatcaagaagctcagttagaatagacacaaatacacaccgccagacatcgacatcaaagatcagcctaaacaaacccaatctggtgcgatcagtggccaacaaaagggatctagcgctatctccgatctcgtcgagtatgtattcgaggaggaagactaccccatcatcgactacgagttggtgttccatgccgccaagtcaacgatgactagataagttatcccaaatattgtacttgtttgattatgatgaataagagcaataccggctccggtcaataggagtagggttattaccttccggtgaaggagcccgaacttatataaaaatcatttgtctctatcacttttaccttaatctcgcatataccatggtaccaacaatccccataccatgcaaatactgtaattgtgatctaaaacgtcaacaacactgattgtatttagcttattttggattgtaagtactacttcagtgaaatccagaagcaagtaaaacacttgtttctcttagctagaagaacatctccggtccacctccaccatcaccggcaacagcttgcacctgcggcacaaggtgacaaagaagagacgccatggatggatggcgagctcagctcagctctgaatgggggaaatggcgaaagaatgtggtatgtagtgaccttttcttgagcttggagaaaaaatggtcggcgtggaggaggtcgtatgatctagggtaggtgctgaaggactcgcaccagtcatggtacatgccgaacagccctcgctcgtagatgatcggcagcgtgtccggcgagtccaccgacaccacgttcatcacccacacattcatgtccttcaacgctgccgcgaacctgatcaaggaagaagatgacaatgccattgatgcgatgcgagatgagatgtttggatgagagtggattttaaactgtcgagggaatgtccccttatttactttttttcttataaattcaatgcaaatagttgtaaaacattataaattttttttgataataatatagaatataacaacatctatcagtacataaaaatcaagttaaatgcaacctacagataaaaaattcgggtgtaatatctcgatgagtgagctgagtttggatttaaaattttgtgaagtgatatatctatatatcctgtatgggtgttgtcaaaaaaattttaagatttttttttataatcgtttgaatggttttttaaaataaactggagggatcaagatagtttccaatcgtgtagtggtgtcgtacccgccgtagacggctagcttgtccatgacgttcctgacgttgctccagtcgatgctgacgccagcgaggtacgagctattgacgacgtggccccagtgccacatcccataaccacggagtccggcagggcgtaccttcctccagcctactacactctctcgaaagaagagaagattcatttgctgacatgtctgagtggtataaaggttccatctagttactcatcaaaaattaggaggtttgtttcacttcaagaccttaaattgatagtaatgaagtcgcatgattgccacgttcttatcacacagcttttggtgggcaggcggtgcatgcacgcccgcagcgtgatgttccacgtggcgtcggggtcatcgtcggcgtcgcagagcggcagctccgtctgctgtagcgaattctgtccaattcaaaaaaaaaagaattatatgtgacgcggtaaaaaaaatcgaatcctattatatgtgacacagtactatatatctctatcctctctatctctttctcttctctactacttaaaaaattgaaacgtttccgtcagccgtaataacgaaaaaatgacgaaaaaaactttaaaacaaagaaaaaagaaagtccgattcaatttacttccgtcgtccgtgaaaatcttatcttatcttaatctcaatctttccgaggggaccgagcggcgccctccgttcctgcctgcgcgatgaaacgccggccaaagcaaaaaaaaaaacaaaattgagcaaaggaataaactagattgaagttcccaaaattaaaagaggataaacaatattgaaactccccaaactcaaaaagagggaataaaataaattgaaatttcccgacaaaattccccaaattcgaagggccctaatttcaggtaagaaccctaagagtcaaaatccaaatcaattaagataagggtttgggttacttgccggacttgaagcccctaagctcaccggagctttccgggaagggcaccaccgcaccttcaccctcctcacagtcgcgtcgggttccccgtgcgcgcgctatcctggagcaccccttcaccgtcccttgccgaagacgggaagcgtcggcttggcgttgcccctcccgccgatgaggtccaggccgctcggcgctcgtcgccatttgcgtgcccgcctagcaggactgccaacgccatggcaccaatttgcgccgccctcgggtgcgcccccagctggcgaagcaggagccgctcggcggtcgtcaccgcacgcacgcaccagctcaccggaccgccatcgccgccttcgccgtcgttccgctcgctggtccccggagagaaattggatcaggagagagggatttgggagctagggttttgcccctctctcctggtcggcgcttcatccagcgcggggacgatcggagctgtgcattagatcggatggcttagattcgcccaacgtcgagctgccgtcgccgctgattacgctacgcccaatgggccgtggaagtgcattgagccgtcctcacatatgtgggctgcgctcagctgctcggcttgcgggccgtcgaattaacttggctcgccgaagatgggctcgttgaagtttgggccagcttgggaagatccgggccaaaagaaaatttgatcaaccaatgtggctcagatttttttaaattaaagtccgtcggataaacttctaagtaggctcgaaaaaataaatctaaaactaaatcctaaatcctatactaattcatcaaattagactcggttctacctatttgttcatatatcaaattagacttgatttttaccgatttgaggttttcaaggtgtcacactatcaaaatggtgtttttcccgttgcaacgcatgggcactattgctagcagagtataaaactaaaaatagtttgaaaataattatctataagcaacgatgacgaagaaagtttgtggagaattcgtacttttgaagcatggcaggtgttattaggttgatattacatatttatatgtttgtcaaatacaacccacaatgcataccacacacattcctgaaggttatatttctagttactatgaataaggtaatggcagaggtgactattgatataatcatgcaatcttaggtcccatagacttagaattttctttaagaactgcctttctctgtgtttctttactgagattttgcacaatgctctgaacaatacggtacggacttggttgctggtgctgatcaaatattggtcacatggtgctgtacaccgggatatgttttgctgttggtcctcttgcacggctattaacaatcctgaagaggatgatagacaaccttttttttgaaaatttcattccgaaattatggaatccatttgacaaatcaaaataatatataatcgcaacttcacaaagagataaaaaaacgcaaattacattggttactaaaaaagtactatgacttgaatgtagaagttgataacacataactagcttagagcgttagacacccagttatgttcgatcactaagctagcttatggttcaatcgtgatattgatggtggcatggctggcagtgctgccattgacgtcgtcgtcattgctgacaggggcgacgatgctggtgtccttggcgatgggggcgacggttggcagctcaaggttcttatcctgcttcttgggtgtggtccggtagtagatggcatagaggatgagttgcatgatagcaaagagcacgccaagaccattggggatggtgatgaagatgtcgaagcggatgagcgcgtataacgtccagcaaaggccgttgaggaagctcaccaccgatagcagcaacggcatgtactccacgctcttcgtcttcacaaccatgatggtgagtggtgaggagtacatgatggtgccaaagatgacgcagaggataccgacgatcaaagagcgcctctgatgggtgtgcgcgcccaaaagcacaccgaccgctaccgccgccatgaagagagcctccgtagcgagcaccactcccattttcttcttgttcttcttgtcggagaagaggaagaagatggtaaggtagacggcctctatgacgaggctaatgccgttgatggtgacgacgaggatgctgttgggatggacgatagggaggacgtagaagacccaaagcatatgcaattgagtagcgtggccaggtacgggtccgccttgaagttctgcacattcttattcttgatgatccgccagaaaatgggcaccggcgagaggaagaggccaaaggagatgacgttgccgacgatgcccaccacgttgcggatcaagtccggggacaccatctcgccggctggtggcggcggacgtcgatcgccttcctgtttgcttggtttgcgcgctgaaaatatttcaggctgaaattgctcgcctgatcgtacacgtagcggttggtgttggtttggttggtagctcgttgaagcggcgtagggctggatttatacacgtcgcgtacgtccgaggtacgctctggaatctggatagggtcggtgtcggagtcccggtgacggggaacaaaattaggaaagctcgttccgtgtcggccaccatttccgagtcggaataagttcatctgaggtcccttaacttatcaacgaattcgattttcgtccttgaaccccaaaaccagatataacgggtccctcaactatcaaaaccggtgcatataaggtccctcggcggtttagatggtggttttggctgacgtggcagctacgtggcgaatttgactcggtcacgtggtgcttacgtggcaattcgaccaaaaaataataataaaccttgtggggcccacatatcagtttcatatacaaattaataaaaatggtgggacccacgtgggccccacaagtcattctcaccctcatcttcttcctcctgacctcaccatctgcggccccgccaccgtttccaccgtcctccacgccgctcactgacctcgacggcgtcctcgctatgggtggtggcgggcgagctcccgcttctctccacctgcttccccgccgccgctgtcgaagacgacgacgccgatggcgacgggtttgaggagggcaccgggccaccgatgcggctattgggcgtcggcggcgcgggagcagggcggtggcggcgcgcagggccacagggtgcaagcggcggtggcgtcaaggagggcgtcggcggcgcgcggggccccagggcgcaagcggtagtgactagtgactggcggcggtggcgcaggagcggagcgtcgggacgcaagcggcgccgtggaggagggcgtcgtcggcgtcgggcgcccttgatctggtcggccgccagcttccggaagcgaacggtgagcacgtcgccattttctccttctcccctctccacgacttcacagggattggaaactgcttgctgcagttgctgttcgattctatttctacaattctactcacgatacaatccattatttccctcagtaaatcccgttgaaatttgaacaaaattcagtgccaaaatgttcgctcacatcacacacgctgcagcatgacaaacaaatgttcgctctacacacttacgaaccaccggatttcggcggcggctgctacggcgacggagtgcagattcatcaccctgacgaggctgctaccgtcctcgccgtacctgatgaggtggccgtacatccgcagccagtggtcggaggcctcgtcgacggtgcggtaggtccagatgtgtggtctgagccagaggcagtcgacgtgctcaccccacgtgcctcgtcttccatgctgatagtggctgcgggggggtcttcgtccggtgctccagccgcgggcgaggctgacgcagccgcagccgcagccggcacacgacgccatcgaaggtccgtgacgtgcctgtcgtcggaccggataccggcgacgccgaggccgggcaagcactcgacgaggttagcctcagctcggtcaccgttcctgcctcagtggtaacagccgaagcaggtagaggggctggagatcatcgaggtcgccactggcgagcggctgtcccgccggcttcgtgcgccgccgctccggctgccgtcgccccactccgcccgccgcccaagtccacatcgtaggaaagaagagagagaggggatagcaggaagaagagagcagtgaggatgacatgtggggcccacgtgggtccaaccttttttttttgaaactgaccatgtgggccccacaattttattatttttctagatcgaattgccacgtcagcgccacgtcagataaagaccaagtcaaaatagccacgtaagcaccacgtcatccaaaaccgccctctaaaccgccgggggaccttatctgcaccggttttaatagttgagggacccgttgtatctggttttggtgttcaaggacgaaaatcggattcgttgacaagttaagggacctcggatgaacttattccttccgagtctgagcagcgtacggcccatgggccatggccaaacggacagatcagggcccgctgggctaactatgcgtgggatggagggagttcatgtttcgctcttgttcagttgtttgtacgccatttgtttcggttgaggtccccaactacccatcggttgatctagttttattataagctgtaacggcttattagcgattaaaaaagatatgtaagtaaaatttttttgtatatatgttcttagtgatcgaaaagccaaagtagaaaaaaattatgttgaaaaagaattaaaatcaaattcaaaattaagttttaaaattcaaattttggctttggcttataagccatagggcaaacaataaggccatgtgatttaacgaaaatggtattttgcgggcgcgttgagggagaatactccccagatcgaccccagtccagccctgcacgaggccttttttttttttttggctgtcaccattcttgtaggagagaacccattctataccatcgagtttgttcgagtccaacgatttgccatcgacattatatctttctatagtataccagcgacttttatcaattgttctacgatataccattaagttgagccttctttttaaaaatacctaaaatgcccttatagacatataaggttaacaattgatttatcctattagaagtttcagaaaaatatgaaaacttttacgttgcctctataaacaacatggaaattcgtatagaagtttcaagttgttacatttctattttttataaaaaaatataacttatttgttatatgtcatataaaatactttttattgttgtttataatataaatcatatttcataaactacataaggtatttttgtggtattatctcttttataagcatattttctctcatatacgacataaaagtattttttttctaaaaattaagtatccagaaaaaacttgaaacttgtatacaaacttctatgttgtgtacataggccacagaaaaattttcatatttttgagaaacttctaatagaataaatcaattgttaattttttgtctctagggtattttgggtatttttgaaaataaggcccaaccaaatggtgtattatagaacaaggtgataaagtcgttggtatattatagaaagaaacaatgtcgatggcatatcattgaactcggtatagaatggattctctcttcttgtagtgtttattattgctattatttgaactagaaggtagcccgcgcattcgcgcaggcattattttagtttgaaaatttgtccaatgtataaattcaagttcaaattgaaagtaagatattttttcctttttctaattgagcgttcatcggcactctcttttcctaagaaatttgcagaaactttgatttctaacgaatgtattttacttgtaacattaggctagtgctttcttaagattggatgcttgggatttttggtcagtgtagtgctgaacttctaatacttataattgattgtccgactggatttagatcgatccttttgtgccttgtaagctgtatatacacggacgaacaccgtcgctagatcggacatgacggatttttttccctacaaacggatgggagtttgtgatagagatagagaattggacatattcaatttttttcgcttttttttaccgcgtcgatggaatcggattcttttttttcgcctgatttttttttttcacggacgacggaaacatttcttatttttttaatagtagagattaataaaatacttaccattggccaccaaatgtgtggcaggggagaaggaaaaaaattaatgagggcaagattgaaatgtgtaccctggaacttataaggggatctatgttatgggggaagcagatcctccaacttaactatagatgcaagtcactgacatgtggatgttattttgctatggcttatatgtcatggctcaactgcacaacagttaagttgtaggatcctttccttatttacattatagtgaggagctacgatagtaacgataaaatcagtttgtgattcaatagcatgaacattacatctaaaaagagtaaattgcattcacaatgcatcaacttggtatgttgctgcaatttggtacaggaattaaaaaatgtgtgctctagcgcaacgaggtgtgtgcaatttagtgtaggaactttataagtgagcgtataagtggaacaacttgtaatgggtgtgcgcttttgatacaacaagttaagaagtgatgcgacaacttaattattacaaacattttttaatacacgttaaattttaagtactactattttgtcaatatactgtgtgtatttttaagcatgtttataatttcgttcagacaactgaaagtgaattaaactttactatgtagaaaatattatatttcggttgagatttgagaatatgaagaaaaaaaatcaaaccagatgtgcaaataggatgtgtaacgtaattcttagagattgaattcaagattataaggtagtatctgtaggattgctatgtgatgacatattgacatcgtgaaaaaaactcaactagtattttttaaccaaaacaacgtgtacctagccaagttgttgcagcataatactaaattactaagttcttgtactataccgtatccttttactgagttgttgtatggtggttcaatttactctcagcctcatcggatggccaaatgctttagctgatcagccatttaagtaaaataagctaaccaatatgcattgaagtttggctaaattggaggtagctttggctgatcagacaaagcatttggccatccgatgaggcgctctctaaacaatactgtggtggcgtgtacagtagctctatcatctcatccgcccattctagaactaatggtataaatgcatgacaactagcaaatgcaccgcgctgttcacctctactggttccggatcccatttgcagaaatcaaaactgctcttcaaacgctcaattatggtttatgctcttgtgtgacttaagtgtacttgttaacaatatcacaaattgccgcgcaaactaaattgtcactcactatgcaaactaaaagttgtttacgttttgggctaaagcaaaaaataaatcaattcacatgccggtagcatgagaaatatggtgcgagcggaacaaatgagcatttcagaatcaggaaaaatccctgccgcggctgctagacaatatacaggacgaaatcaagctatggaagatatgtggaacaacaaatatcacgagattatctgcctagaacattttcattgttttagtagtagcttctttctctcccctctctctctctttcaccattttggtgatcttgtaaatactttttcatcccctacttaatataagaccagctttgctggcttcgttttttttaaaaaaaaagttgtttacgttttgggctattctggccttgtttttctttttttttcttcaatagaaaagacaggaactatgtccatcaattaagggtgatcaagatccacataagagccaaatgtaggccgactgggatttaagatgactgttcaggccttgttgtctccaataatttgtccccaatttgtttcgttcaatctcgcttggaaaagtttgtattaaggatattctagccgatcacgtgtaatcagctggaatatccctaatagtttgaacatgcctcaattctacacaaacctactgaattaaccatctctcttttgtaaaacttgtatacaaaactcaattatgacatgtctaatttctactcaaatctaccatcatttttttattacaacgtgccacaatatttgccaaaactctttttctggtgctaagcactactagccatgatcatcaacttcttccctactagctcgccgtcgtcgccgccttctcgacttccttgggccgccacatcgtcttctcggcgcagagcatcacctctccctgcttggacaccgtcatcctcacctcccagtgcaacgacctcaggatgctctccacctccgccgccgtgtcgcggccgtcccgcacgatcagcttcccctccggccgcaggatccggtccacctcgaccatcaccggcaacagcttgcacctgcacaaggtgatagagaagagacaccatggatggctagctcagctctgaatgggggaaatgacgaaagaatgtactccctccgttccacattataattcgctttgacttttttggccaaaaaagtcaaagcgaattataatgtggaatgtaaggagtagtatgtagtgaccttttcttgagcttggagaagagatggtcggcgtggaggaggtcgtatgatcgagggtaggtgctgaaggactcgcaccagtcgtggtacatgccaaacagccctcgctcatagatgatcggcagcgtgtccgccgagtccactggcaccacgttcatcacccacacattcatgtccttcaatgccgccgcgaacctgatcgaggaagaagatgacaatgtcattgatgcgatgcgatgcagggtgtttggatgggagtggattttaaaccgttgaggggatgtcccgttatttatcttttttcttttaaattcaatgtaaatagttgtagaacattctaaaaaatttaataatgtagagtataacaacatctatcagtacttaaaaatcaagttaaatgcaacccacaaataaaaaattcggatgtgaacagtacaatactattcatatgttaaatttagttttttaatatctcaatgtttcggctgagtttggatttaaaattttgtgaagtgatatgttgtatgagtgttattaaaattctttaagattttttttataatcgttggaatgtttttttaaacaaactcgaggcatcaaaatagtttccaatcgtgtagtggtgtcgtacccgccatacacggctcgcatgtccatgacgttcctgacgttgctccagtcgatgccgacgccggcgaggtacgagctgttgacgacgtggttccagtgctcctcgtccgccgcgaagtcgtctggcgccggcttgccgtagacgccgacctggctgtgcgacagccagtagggcgccgccgacatccgctccggccacagctccggccaccgcgcgccgcggacggacttgttggtgggcaggcggtgcatgcacgcccgcagcgtgatgttccacgcggcgttggggtcgtcgtcggcgtcgcagagcggcggctccggcttctcccggttgctgtagcagccgttgctcgtcggcttcttgaagatcaccatggccgtctcgtccacggtgtcgttcgtcttcttcaccatcttccagcacatggacttggtgagcgccgccatgtctgcgtgcggcgcagcgcggcgcggcgaggagtaagagcgaggcatatgagatgagaagaattaatgggggaggggagctcaccgtgccagatctggacgtcctccggcgtcttccggtagaccggcgtggcggaccagacgaagaggccgccggggcggaggaggcggttgacctcgaggaggagcttgccgccccagatgtgccatggcacgcggcagcgcgcgcagtggacggcgtcgtaggcgccgccggggaaggggaggcgcttggtgcccatgacggcggagatggccgggatgccgcgctccagcgcgaactgcacctgcgcctcgtgctcgtccttgggcgccagcgacatggtgagcgcgtcgcggtcgaacaggaagccgccgaagctggccacgccgcagccgacgtcgagcacgacgcggctgcgccgcccccacgccaccgccgggaccgcctcctcgatcaggtcgatgtagtgcgccgcgccgtttatgaactgcgtcccgccgccggggaacgtcaggtgctcgccggagaccttcacccagttctggtgccccttgtacgacgccagcttggtgtgcggcacgttgtggtaccagatcttgtcgcggctgtacggccacgggatcggccgccggtagccgccggggagcgggacgaggcacgtcggcgccgcggcggggcagtgtcgctcacggtgctcgtagtgcttggtcgtcttgagcttcttgatcgccgcctcgttgtccaggcacgggatgtagtcctcgccggtgctcacgttgcagagcttccacccgtgcgccaccgccaccgccgccgccgccgccgtgtcgctgccgttgctcttgttcttgtttctgtcgcgcgccttcttctcggcgctcgactccgacgcctgcgtcgggaacgagccgttctgcgccaccgccgacgccgtctcgttcagcagctcagcctggccgctcgggaggagctcctgctccgccgccggattgatcttttcggtggcggcggcggcggcggcggcgctgttcgccggcgcgtcgtcctctgttgtttgggagactgtgccattgctgctgtccacggctgcgagtgtcgtcgtcgtcgtcgtcgtcgtgttcgagtcgtcgttcatgtcgctgatagtttggttgttcgatgacgcgccggtggccgtgtcgtcgtcggtggtttgcgcctcgccgccgccgccgccgtcgtcgccattggtgggaacttgttcggagctcttctccgtgaccttgccgtcctctgccaccgtctcgacgccgtccatcttcccgttctcgtcgtcgaatgacgtctggttcttcgacggcgtgccgccgtcgccggtcgccttcgcgtcggtgggcgtatcgtcggagctcttgtcagccttagtctcggtggaagcctcatcggcgttctcgccggcgtccttggtgtccctgggctcctccgccgtgctgttctttttccccttcgtgtccgtcgacggcgcctcgtcggcatcgccgctggcttggtcgccggtgtccttgccgtcggttggcgcatcgtcggcgctctgcttgtcgggatcttctgggctcaccacctcgccgccctccgtcttgccgttctcgtcggagaatgtctggttcttcgacgtcgtcgtcgtctcgccgtcgcctaccttgtcgccggcgggcttgccggactcccccgcccccgtgcctccggtggtggtcttggcgaccgcatccgtcgccgtttgcgtgtcaacgccgccgcctttcacgccggtgtccccgacgtcgtccgtcgtcttcgccgtgtcgccggcatcttggactttcttgccaacgtcgtcggctgcctcgtccgtagttcgcggcgtgtcgccgccatcgccgccgccgccgcgacccttgacgccgtcggtgacgtcgatggacgacgcgtcgtcctccttgaccaccgccggcggcttgtcctccggcgacacggccatcgggacgtttcccgtcgacgacatcatccacgcgccgacgaggcagagcgccacgaacaggacgatggtcgccgtcgagcaggacgacggcgaagaacggcgtcctccgccgccgccgccgccgttgccatccagccgctggtaccgatcccgatcaaacaacggcatcttgtgacaggctcacagctagctcatgcagtaggcacttcacactctctgcacattcacacaggaaaggcttattagcctcttattttggagtgaacaaattatgtgtaaattgatctgggatttgaaatccaaattccacatcagtaacaatctaatcacactgatcaatatagcatattattactccagtaagaaactgtctgagtatcttatttagacagtttatttgtttatgttatgtggacagagacactgtctgaaatgttgcaaatgctaatgacaagaaacaataatggaattcctgtttacagatcagattgtttgggttattactacctacattatacaaaagaaggtgatctattagttaaacatgcgccaaaattcaacaaaattaagcacaaatgaaacgaacatcctagcataattagcaaccaagaaacagtacaacaaaacaacatcctggattgaaactgacctgatgagtgatgaattgaacacactcaaaaaaatctccaaatcaattgatcctcaaaccaatcgaacggttgcgaaagcgagatcaaatatgcaccattacttatatatgcagctagcagccacagtactagatcgatctcgagctgttgctttgcttgggagaagagaagaagaagaagaagtgaagtagagagagaaagtgaggcagatgaagagagagagaaattcaaaatgcaatctaccccgtttctatttcccaacaagaagcaaccggggcatggacgcatgcgtcgtctccttgttcctctcgttggctaatcttttattagcgcggggagtttgtgttaagggaggattacgcgggaagcgaggagaaaatggggtgacgtccacgaacaccactctctccgggtttttggcgccatcaccatgcaaaattgcaaactatgcagaaatggatcgaattaattaattagctggatcaaatcaatgggaaattaaagagaagttttcattcacgaacaagggtcgagtgcttctcaaattttggcgattgaatggggaatatttcttatatatggccacatttgaaacgcaggatataataaacacaaaaagaaattagaaaaaatgcaggaattgaaggggtgtgtttcttttatcttacaggaatgaaaaacaaatgaaaaatgaagataatcccttcaataacagaaaacaaacaaagaaaaaggtttccaaaattgttggacgtcttcttcttttttcctatgaaattggctatagaaatgcaatcctatgaaaaatttccattcccttcttacgaacatataaaaattccttagaaaactgaatcctccaaaatttgtaaagcaatcctccaattcgaagggaccttagagtaaagatatatcgttgttgagatatgaaagtaggtgtaaacataattatatttttggaacggacgaatacattgctggaaattccatggtgcaggatgaaagatgcatgtacttactggtgaagtgtagctgactctacaggagttgacgcgtcaaggggaagcttggctggctaatcctttccatgcattatataccgttttctttttcatgcttcttatacacttcgtgtgcaactaattaatagagagtaaatttcataaaactgcaactttagtgacaaaactatcagtttgctgcaacattagcgacatgtttcagtttgctgcgacaatagtgtgggaaattatcacaaaactgcaacttttacgttatatgctgctacagtactagttttgtcactaaagttatagtttttggaaatttactcattaataaatccgctggttaggagtaagcatgcaaaagttgttcttccacctgttgcaacatgctaacatatcctgtttttctttagcaagagagagcaacgactttcagcctcaaaattgcttgctcatagtcattgcatcaccaaactttaagcatctacggtttaaataaatactaaaatggaaaaataataagacaaacaaattaattatccacacgatcttgacaactatacactgaaaaagttttgaggttttagtcttcatgacgatacctccaacttcctaaggagtaaaattcgtgtgctcgtcgctagatgcaatcaacaaagattatataaagggatttcaccaaatctcaggtattattctcaactaacctcgttaagaccaccacagcaagcaaaaataagtcttggagctctactcacttattggtggaacatctggttagggaggaattggaggatttagatcagcgagcccgtcgtaaaagctgtgttatttaacccttgtaacctctcaagtctcaaaagttgtaacctcatctattctccattttccctaaaccttttgtattatctgacttttactctttctcagttatatccggcagagcacttgtcattgttggtttcagaaaaagataatgtattagaaaagggaaagcgaccaatttgattctattgcaaaaacaagcaattaaagcctagacatggagttttcatcctatggaaaaaaaatacaatagctctaccacaatatttaatccaatcctatggatgcacatggtcattataatttcaaagtctagtttaaatcatatttcatatttgtaacctaaagtaaaaattccatgcaactggactcccaaaattatttccaacagattattcagcatcgatatcaaaatcagtaatgtgagctatgactgtgtgacagaaacccacggttcatctttccaattgagcacggaatcctgactcctagcagtttgaatgattttctccaaattttggtcaaatttactgttttaattttgaattctcaaaaaccatttaataattaactcgcactccacttttatccaacatcaaaaccttcaaaagtttacaatttttgtacatttttatcgcaaacgtgaaccctgtagagtgcagacacgattctcgcgtgtttacttttctacttcttctgtcctaaaaatatatatggtactctcttcgtttttagtatacgacgccgttgactttttaagatacgttagaccattagtcttattaaaaaaatataattattatttattttattgtgacttgatttatcgttaaatgtttttttaagtatgacttaaattttttatatttgcacataaattttgaataagacgaatgttcaaatgtttatcaaaatatcaacggcgtcatatattgaaaaatgagcagtatgagatttaacatattttagtactatatagatttgaatagatctttcttcatatttatatagtatcaaatcttttattataggttgctatatattctacaacaaaagatttaatcttcccaaactcaaacaaacggaaaaaaagaagcaaaccactccccaaacggccaaaccccccccccccccccccaaacccttcctctcccctcgactccggcgccgacatggccgtcgtgcaccgcatcctccgccgcgggctctccgccgcctctcccctcccttctttccgcggcctcctcctcgtctcccctcaggtaccacctattcacgctcccctcggcgtccattacccgcgccggcgcacggtttcttgattttttttatcggtgatgtttctttcgctttccccgcgaaggagctcggcaggcgtccggcgagctcgtcgtcgtcggcggcggcggctgcgggggacgtggaggctgagctgcgcgccgcgcgggaggacgtcaggcagctgctcaagtccaacccctgccatcccatcctggtaccctgtacaaaaatttttagattatctgtctagctgtcaaattttgcatctgtaaacaagttcgttatcactgtgatatgtagtgaactagtgctaacaatatggtctatgtgattgcgtgtttagttaactggtagattatgctgttcgaaccaataattttagactttgaggggatgactgatgaggaatagctatttttttttagtattcgctatatttgcgtggttcatggttgtgcatcttcttgatcaaacatgcatatttatgacatgtctgctgagttaccattggtttcaggttcggttagggtggcatgacgctggcacttacgataagaacatcactgaatggccaaagtgtggtggtgcgaatggtagcttgagatttggagttgagttagtacatgcagctaacaaaggtagtggcgcgtctggtccattaagtatcagttggttcctgatgcatatatgatgattcttacagtagttctctgctgcaggtcttctgaaggcgttattcttggtcattcccatcaagagcaagtatgcaggtgtcacttatgcagatatatttcaacttgccagtgctacagccattgaggtccttctggcacttctaatctaatctaatgatatctatcattcaaatagttcttccttatttagtggtgatatgactgctttggctttcgcatttcaggaagccggtggccccaagatccccatgatctatggaagggctgatgttgctgatggtgaagaatgcccacctgaggggagacttcctggtcagtaacttttaggttctgtagaccaaatttgttcataaccatgatttgtcgtctataaacaaaactataatgctgtccctttagtgtcatgtcataccgatctcaagttactattgcagtgggtcatcatcttacaacttcatttcccagatgctactttcttctaattcattaaacttagaatattgatatgttctagagcattgaaatttaattgatatgcgtttcaaaacacagaaataaacttacaaatttactctatttgtcctctccttttatctcaatttacgagttacatgcaatgcaactgagatacctgattgatgtaatccttttcaagcttgtacacctctcactttaaggaaccacccatatcaaaatctttatttgtctgttgtatgtactcacaccaaagtatgttaacgtagtgtcaataatagaggacataaatataattgtaaattttttcttgctactaactcattgtaggtggcctgttatttttaaacagataatggtctgcctataataggttgttgcattcctggtaatgtttcccaggtccaacttatttagaaggtttaggcagggtaccttattcatgtatctgtggattttagtttgtgaaataccaaaattggtgtgaacagactaaaaaaaaaagaaagaaacaagttatgaaatattgctactgtgagctctataatctggtgtaatcacattttggatacgcaaatgtgcaagaaaaattactccagttacaatttaaggaaaatttaaagctgcccatgctgcgcagaataaaaatcaggcatgtgatcgtgctttgcctgtgaaactgatgaaatattgcttccctagtcttgctgcaatttcagctgtttggtttttgtaatcacatggcattgatatatttcctgctctgtcgtatactgacgatgatctaatcctctttccttttaatgttgtttctgttggtacaatgttgttccctgcattttacatttccaccctttcagctgctgacccaccttcacctgctgaacacttgcgagaagtattctacagaatgggcctgagtgacaaggtacttgcaaactggttgattcaatattccaaacaacttttctggggggtttgcattggctagtctcatctgtttcgcgatctgcaggaaattgttgcgttgtcaggagctcatacacttggtcgagctagaccagagcgtagtggatggggtaaaccagaaacaaaatacactgtatgtaacttacagcagttggtattgttctgattttaagaacaccttgtccattgatgcattttcgagtattgcatgctatttagttattactatttttagattagcacaccttcatgaagttcttctgatggtgaatttgttcttctgatggtgaatttgttatctggctaattgattatttttcttgactggcaaaggaaaatgggcctggtgctcctggagggcaatcttggacatctgagtggctcaagtttgacaacagctacttcaaggtaggatgcacaattttctatattaatactaagcattatagcagtaatagaacttatgcaagtctgcatacatattcaggaaatcaaagaacgccgagatgaggatcttctagttctccctactgatgctgtgctctttgaggactcatcattcaaggttagtgaagttgctcatcagctagtgttgtaaagaattgcaaatcaaaagtgatgctctaaatttttttctttttttgcttgcttgtcatgcctgaagatccatgctgaaaagtatgctgaggatcaggatgcatttttcgaagactatgctgaagctcatgccaaactgagcaatcttggggcaaagtttgatcctccaaaggtaaatgagattaaagacttcctcacttccattattggaatggagaaaatgtccagtcaacttgacttgcttattatcgctgaaatggcacagggtatttcacttgaatagctggcgtcagctgccgatgaactgcattttggcgagtgataaacaagataataccttgtttgttcttgctactatagagcatattctggttttactacccatccagaaatttaacttattgtaaatgtgatgctggtgctgtgtattgagctgtgttactgcttgccatcttatctattgtactatattataaagatagctcgaaaaagagcaaccaaatttgttcaggtcaacaattagatgcatcacaacctcagttagataatactaggtttttatataacgaagatagtaatgtgaattgtgagttcctacattatttctaacatacttatttagcattaagatcaaactatagttgcgagttgtgagttgtgacacccaacatgctagcacgggttccttcggtttctcatggaggaggaagatttgtattgtacgcgaaatgagaaagctcattagtatatgattaattatcttaaaaaaattaaatattaactattataaacttgaaaaaatagatttatttgttttttaaacaacttccatatatataattatttttttaaaagaaagtaacatttaaccgtttgaaaaacgtgctaataaaaacgagaaaattgaagtttgaacttaagaaaaagaagaggcctaaataactcaacctaaatactccctccttgacgccgttgacttttttaaatatgtttgaccattcgtcttattcaaaaacttctgtgaaatgtgtaaaactatatgtatacataaaaatatatttaacaataaatcaaatgacgggaaaagaattaataattacttaatttttttaaataagattaatggttaaatatttttaaaaaagtcaacggtgtcgaaaattttgggatggagggagtatgtgtcttccactcttctcccccccaatcaaacgaactagttaaagaattccaaaaaaaaaacacacacacacacacacacaaaaagagagtgaaattttgctattggtagattcctcccctgaccacggagcagcgaaccactcccaaaacgccaccaaaaccctcctctccccacctccgccgccgccgacatggccgtcgtccaccgcctcctccgccgcggcctttccgccgcctctcccctcccctctcttcaggtactagtaccacctacgacgcctccccccctccctttcgctgttcattacccgcgccggcggcggaccggttcttgatttagcgatgtccctttcttgatgatttttgttcattttctcccccgtgaaggagctcgggaggcgtccggcgagctcgtcggcggcggcggcgggggacgcggcggctgagctgcggggcgcgcgggaggacgtcaagcagctgctcaagtccacctcctgccatcccatcctggtatgctaatatatgctttgctgctttagtgttcttgtgcaaagattgcgggtttgtatggttcgaagagtataatgggattttagattgtctagctatatccatggatttcgcatctctacaaaagattgttctttgtgtgtttagttaactggtcgattatgctatttaaaacagtaacttttacttcgagaagatgcaactgctctagttcacctgtgtgcaagaagactgtaacacgttctatgcacaatattcgctagatttgtgcagttcatggttctgcatctgcttgatcgaacattgcatatttatgacttgtctgctgggttaaccttggttgcaggttcggttagggtggcatgatgctggtacttatgacaagaacattactgaatggccaaagtgtggtggtgccaatggtagcttgagattcgaaattgagttaaaacatgcggctaatgcaggtagtgcttctgttctgtcattatctattgttcgtgattcatggttatccttacaataaccctctacttcaggtcttgtgaatgctttgaagctgatccagcccatcaaagacaagcatgcaggtgtcacttatgcagatctgtttcagctcgccagtgctacagccattgaggtccttttgtcactttagtctaatgataactatgaactatcattcaaacagtatttattatttaatgctgatatgattgctttggtctgttttaaaactcaggaagccggtggccccaagatccccatgatctatggaagggttgatgttgctgcccctgaacaatgcccgccagaggggagacttcctggtcagtagcttttgggttctgtagcccaaatttgttcgttaccgtgatttatcatctggaaactaaaatataatgctgtacctttagtgtcatgtcacactgatcccaagttgctattacaattggccatcttcttgcagcttcatttcgcaaattctactttctccttattcattaaacctagaatattgataactttcagagcagaactgatatgtgttccaacactcagaaatgaagttacaaatatactctattggtcctcttgtttaatctcaatttatgggttatcatgcaattgagatacctgattgacataggaaatcgcgcatatccatctttatttgtctgcaatctatttacatcaaaatcaaattatttagatgtagtgtcaacaatagaagacattaatataaattgatagttttcttgctaacctactgtaatagtcctgttttatttcttctttaatgataaatttattttcttaaatggacaatggtctgcctataataggctattacattcgtggtaatgcctctcagattcaacttatttagaaggtttaggcgtggtatcttatccatgtatctatgggttttacttcatgaagtactaaaattgatgctaactggctaaaagcatgaaaaaacaagtttcttatgaaatattgccaccgtgagctctgtaatctggtgtaataacattttggacatgcaaatgtgtaagaaagattaccccaattgcaatataacagaaaaattgtaagctgcacatgctgtgcagaatgaaaatcagtgctatgattgcacttaacctgtgagattgataaaatatagctccccaagaattgcagcactttcagctgtttgtttttgtattcacatgacattgatatatttcctgctgtgtcttatagtgtactttgatatttgaaatctagtgctgatgatgatctaatcctctttcatatgcatgtgctttctgttgcaattttgttccctatattttacatttccaccctttcagctgctggccctccttcacctgcggaacatctacgagaagtattctatagaatgggcctgagtgacaaggtacttgcagattgcttcattcaatattccaaacaactttttctggggatttgctagttacatctgttttgtgatctgtaggaaattgttgcattgtcaggagctcatacacttggacgatctagaccagagcgcagtggatggggcaaaccagaaactaaatacactgtatgtaacttatatagttatatcagtagtaggttattgttctgattttagtaacgccttgtccatgattcattttggagtattgcatgttatttagttactacgtattttttagattagccaatgggataattaagttgtcatcactggcaatgcttattgatcttgcatatatctcttccttgtaaaagctctgtattgaagatctttatatgatttattactacttcaccgaagaaaataaagagatgcttctgcgctgttgtgttagttgaccatattatgcttcatctctaatcgcggatgacctatattagcatcaatgctacaaactttcctactacagtgcttatatgctttcaaatatgttcttgtgggtagtagacttgcagtattaactatatctagcatgcactccttcatgaagttcttgctgatgaatgttctgaatgttgaatttcttgtttggctaattgattaatttcttttgactcgcaaagaaaaacggacctggtgcacctggagggcaatcttggacatcacagtggctgaagtttgataatagctacttcaaggtaggatgcactattttctttatcaataccaaacatgatagcagttacaatttacaaaacttatgttagtctgcataaaatttaaggacatcaaagaacgccgagatgaggaccttctagttctgcctactgatgctgtgctctttgaggactcatcattcaaggttagtgaagattctcatcagctcttgttgtaaagaactgcaaatcaaaagtgacgctctaaactaaaaagttttgcttgcttgccatgcctgaagatctatgctgaaaagtacgccgcagatcaggatgcattttttgaagactatgctgaagctcatgccaaactgagcaatctcggagcaaagtttgatcctccaaaggtaagtgagattaaagactaacattactggaattaaaaaatgtgcagtcaacttgacatggttatcactgaaatgacacagggtatttcactggaataagtggcgtctgctgccgatgagctgcattttggcgaatgaacaagacgataccctgtttcttcttgctactatagagcatattatggttttattaccgatccagaaatttaatccattgatcggcaaatgtgatgttggtgttttgtattgagttgtgctctccattagaaataaaaatagcggtggccattttcgtttccaggaccaaacattttggcacattacaatacaatgttttagatgatgtctgcattgagctcttacacaggatgatcaaaatatatgacataatttattactgaatccttttgtgatatttcccaagtaggactgtacataaccagcaatctcaagtcaagttacttttcatagtttatttggatcatctgcttccagatcttcttcctttattaccagataacttggtcatcatccatataaaattacatctgccaatcctactatacatatttattttatacccacaactgcactgaaatgttctcttcatcgagaaaacatacagcatacatcttttatcatggtgaaatatacattgctgaggacataagatttcatttccctcttggaaaccccaagatagccttgatcatggctcccaggttgcccttgagcactcccctgaggatcttgagcttcgccggcgagtacggcgggtacctcgccgccgcctcgccggcgaagcggcggaccagcacggccttcttgtggctgaaggcctcgaagctgaacctgccatggtaggctcccatgccgctctccccaactcctccaaaaggtaggtactggtttgttagctgcagtggtatttttgcagacacatcagaatcagtcacacttggttagcaatgttgtttgcatcagttaacatgtaagtcatgatatgcttaaaatgcacaattaaggatcagattaatgatgattattactctctgtgttcataaataaaagtcaaaacgtaccttaaagtactctttaactcactggcttatgtttttatataataaattgatatcagtagaattgctatgaaaaatatttgcatgcagttatagttaatgatatttatgaaaatatggctaaaaaggaacgagaaattagaatcaatcatttggttagcactattgttttgcatcagttgacatgcaagtcatgaaatgactactaaatgcacaattaagggacatattagtacggattttgcgagtaaatgaaaagcttggatgcaaaattagaagccagattaatgctgattattacgtggacggctgtgtcgttgacaagcattcctcctgcagagatggctgcctcatattgttcctggagcttgctgtccttggtgaagaggtaggctgcaagtgcctttgtcatggagttgatgagagcaaagctctcatggatcttatcaacctaaggacagcagcatcatgtgagaacagagatttgtccatcatgtattaatttcccaactaatggtaacattgtcaatctacagaaactcatctgtagttgactacaaaaggtcatttattagctctaaccgttatgataggaagcaaggggccaaagatttcctccttcatgatccctgaatcaagaggaacatccatgaagattgtaggggctatctttctgaaaatgttgcaaacaaataaaattttaactgatcatccaaaccatgtattcagaagcatttgtcagagttgtaaaatttcagtcaacttacagctgatgttcatctctctgacctccgaacacgatcttatcagagacattttcatcgtccatcagcttcttcagccggttaaaatggttggaattcacaattcgcgacaagtcagatgatcgcagcgggtccctcccgtagaacttctccaaaactttctctagagcctccagctgagttcgtggcacggttgattagttaaaaccatttcaccacatattcttttaaatattcaatataaaatgagtttttttcttaccagctttggggcgaatgattttgttgttatgatgaaatcaggagaaatgcaggcctgcccattgttgcaaccccatttcccggcggctatcctcttggcagtaaccttcaaatcaaattaaagagaagattgcgacatgaacgaacagggtatcctatataattgtacactcgaactctaagtaaccttcaaatcaaattaaatattgtcatatgaacgaatagtgtgcactatatgattctacatttgaagctagcacgttaggatttctatcttatcatcttattaacacgtgtttctatatgtgctctacgtgattctacacccgaaacgatgcacgttttactctatcgtgctataggcacatgaatatgacacctatctccctctagtcataaataagtgtcattccaacatctgcgaagtcgacataaattaattttaaacatggctattgttcaaaaatatatgttttaccatatgaaaaatgaaagacaaacttgttataataaaaaccttcatactacttcctctgtcccaaaaaatcttgatgttttaaggtttgtcaacaaaatttgcttcatgttaaaatgatcaaattaccccaatttatttgattcggctgtcatttatttaagtcagcacacactcagcaggttacaaagaaaatatatgcatacaattaatcaatgtatttttttcaaaactcattggcagatgacctgaaggaatagacggcccacttatctaatcaagtttgctagtctaatgacatttttatgggataatactggaaatattgaacggcttgttttctgggacggaggaagtattacacttacgcaactaattttggatgctacagaaaagaataaagtggtcaaagttatatcttattaactttatatcttatttgtgaccgaggggagtaggtctcagtgtcccatgggggtagcaaatcctgaaacaccaaagtttatggtgcaaaatgcaaattcatagaggggaattgtgttgtgctttgcttacatggaggttgacattagagtcgacaacaaccgggcattttccgccgagctccaggaccaccggcgtcaggtgcttcgccgccgacgccatcacgatgcgtcctaccttgccattccctgcaatttcacccagtttcgtcagatttcagagccactgcaagaggagctaagcttcgatcacttctcgaactccatcaatggcgacaatgagaatcaagaactaagaacctacctgtgtagaagatcttgtcccatttctgctcgagcagggtggtggtttcggcgacgccaccctcgacgaccttgatgcagctgccgtcgacgtagcgcggcagcagctcggccagcagcgacgaggtcgccggcgccacctccgacggcttcagcaccacggcgttgccggcggcgatcgctccgatgatcgggtcgatcgacagcactgaaatggataagcaaaagtaatattagcttgatcaatgctactggcaataaaataaaatgctaactcgatctaaaccacagataacatgaggaaattaaaagaatatctatgcatgctggttccatctaggcatatagctctagttacatgattttaccctcgacgaaaaaaaacagttaaaattttggaaaaattgttcacttcaaaatattttgttgcattctatagaacagctgtaaaattaaggatagagcagtaaaaatttaagtgcacgtatctatggtttcacaggaaattaagggttggttgaactcaaatatcgtttttcatttgagaaatattctttttcttttactcagcatgatattgtaccaccactataaagggtgcagatctttttctattttcactttgcctgatcaacatgataatttctcttttagcgttgtcttaactagtgcctagtcgatttttctacacaagcttagattttaatagtacaatcgaatttgatataaagcccatggttataatcaaccaacccatatggttataatctactctcttcattccaaaatatttgacgccgttgactttttttttaaatgtttgaccgttcgtattattctaaaaatttaaataattattaattcttttcctatcatttgatttattgttaaatatacttttatgtatacatatagttttacacatttcataaaagtttttgaataagacgaacgatcaaatacgcttaaaaaaatcaacggcgtcaaacatttagggaatgagggagtatatattttaataatgcaatagatatatgttcctccaatatcatgatgttgtttatagtagaaaagcattttcgcattctattcatgttattatttttctgttgctgtattgcatagaggcatcatggaagttgcatgctgcaggtggttgagagtttgctgtcggaaccctctgcttctgtctgatacacacctcaaaactgaattctttttgagcaattaatagataggttgagacttcgcattggcatgccaacactatggtccactagtaatcaaacgattacggcaaccagctagtcagcgtctcaaaagatgcttatttaattctgaatttattgaagctcaagcagtcagacgtcgatcgataaagatggatcacaatttcagaaccacacttaaacttttgtttgcaatgtactccgtaggagggaaatcatgtgtactgggtggcaaatcaccaaccatacacatcacatcatgcaagccatatgcatgagtcaagttcttggattgagcaagcatgcaatgcaaaccactagaacgagacacatcacacatgtgtttagagacatcgagcagaaatgtatatacttccctaaaaaatgtagacatgtatgtgtactcttgaaattaatggatataaatgttgaatctaagaatttatcatgggtgggcctgatgtacttgttgcaatactcaattctacttcctccgtcccaaaaaaaaaaaaactcaacctagaagggatgtgacccctcctaagacaacgaatctggaggggtcacatcctctcctagattaagtttttttggacggagggagtaactcacaagtggattgagtgggttggagttttcaaattcagattttttttaatgaagcccaattcatggaaatgtatatgatcaatttaagcaaagagagttttggagaaatctaaggaaaaaatggatatatttttaaccagtatttttgtcatcgacagaataaccaaacaatttagaattatatcttgggagtatttttggtaaaaggaaaattagcccctggcccgtgaaagaacaaaaatggagaagatgggcattaatttcgatgaggaactgcctccaattccatactattatgtcgtcacaacttgttaatttggatggtattttggcaaaaataaattctatgacaattttaatatatgttcactgataattttattttttggaatatatacttatatttgtgagagcttgtttattatatttgcctaatgtgagctcatttgtgctcacgcgcatgctcgctctctctcttcctagtaccactgggaacttttttttttatataaaaccatgcaatgcattggcacaacatatatagttttagaaaatagtctatttggcaatagcaaccagaccgtggccataatgcgtaattaattcgttcaacgctatttaaaagttccatctcttacatgccgtaatgtgtttccagtctaggcctcccttcctgtgtggtccaactgccatatctgttctaattgtttcatattttcagaatatattactatcttttcaatatagaattaaaatcagtgtcaaatactgaaatatcaaaagattgttacaccaaacaaaatcatcatagtccactgcaaaatcaaatgatactatattattattgcgggattgtttgaaagcaaccctgaccacaaaaaatattatgcaagtatttttttaagtcaaatctagttatatatgaaaccattgtgtatggttttatcgcatatagtctcagtatttgaaaattttaaaatgctgagattttccttaaaattttaaaaatgcttgctgactattatttaaaattttaaactctagccgggtactgtgaggagggattgagcaagtgaccaacattaacgaagctctcatctcacaattaattccaatgagacatgaacgtcaatggcatgtcatgcacagggaacacggattatgtgtttccatcggaattgcgtgtttgacttctgctactcaacggaaaaacaacattctagaacaatattaatattaatatagtaattgctgcaaacaaatcgattgagttaaaaatgttcaaggcacgcagtaaattaattacttttctatgaaagaaagatcaaatcatatgtgaatgttaatttggttttggtccaacttacagaaagggtagttccaggccgagatgacgagcacgacgccgagtggctccgccgccaccctcgccgtcgacgggaacgtcataagcggagcagtgacctgaacgccatgtacacacgtgtgctaattaattactccctccgttttaaaatatttgacaccgttgactttttaagtatatgtttgaccgttcgtcttattaaaaaaattataaaatatgtaaaactatatgtgtacatgaaagtatatttaataacgaatcaaatgatataaaaagaataaataattactttatttttttaataagacgaatggtcaaacacgtactaaaaagtgaacggtgtcaaacattttgaaacggagggagcggttaattgggaagcagctaggatatagacatagggtactaatacactctaattaatgacttgttagataaggtttagataactaatgactctaattaaggtttagataactgatgaacaaaattttgtttttttaggtagaagagaggcgccatcgctacactttatagtgttatatattttgtggcaattttgatactattaagatgtctgaaggagcatcaggtgctatagtagttggctagttgccactcctctgtaatcagcctccagaaaaatatcgactgttacactaaattatgattgttttactatgcgctccttaggttcttaggctagttgaaaaaagaacctatacaatatgatctttaattaccaagtggtgaaaaaaaagagaacgaaaatggccttacgattctcgacaatgatactacgtagctgcacatatcatttcatagctaatagaggcaccttgagtgatgaatttttttttaaaaaaatgcgtgcaaaattttttaacattaaaaagaaacaagtttactcaaaacatgtaacataattttaacgcggatgtcaccatgtaagtgtggcgcaggaagaagaaaacgaccatctatttatcaaatgtctggattttatttggcaaccacttttttcaagcagactagctacacatcgaacaactctgaatgcctattttcttttcttggggtgaaataagaaatctaacttcggactttaaaaagtatactttagtgtgaattttgtcaatataaaaacagaaataatttataggagcataaaaaaaacttattttgtttttggagtaaatgatatttaggctgtgttcggatggctgtgttgcgaactaatcccttgcatgcaaaacaaaacgattaattagcgcatgattaatgaagtattaacttttttaaaaaaatagattaatatgattttttaaaagtagctatcgtatagaatttctatttttctttaaaaaacacaccatttagtaatttaggaaacgtgtgcgttaaaaacgagataggtgagttgggaagtcacgaagtcacaataaagacatagccttaatgaagtgataacagccataatatccacaccttttggggcttcatccatttcttcagattcttgagggcaaacttgcaggacgacttcaccagcgcaatctgcaaattattttatttttgtcatctatcagcagagcagacagagtggcaaactgcaacagcatatgcatatgcaattgatgttcagaatcgtcagatcaggaaattgatcagttcctttcctcagttgtacgttgtgcgctgtgagcgtttatgtaagcacagttaacatctaaatcagcatcattaatcatggtaattaaaactgctaacaagtggcaataacgacgtactaatactgatcaacggccgatatctgtagaaactggtcgactgtacgtctcaggatgtatactgtgccgctattgtcaaggctaagtacgatgaatcaaacacaaaccaatattcagctaatcaattttgtacttttcaaattatttaccaccatcacaggattacttttactctacgctttgaaaaatacattttctcaaaaaatattatgtatattgtgtgaacaacttattttaaatttcaaatgttcatttgttaaaatatttaatctataaccaatttagttcttttcaaactatttaccattacaacaggattatttaccctacgcactaaaaaaacattttcttaaaagatattctgtattgtttggacaacttattttgagtcttttatgtttatttattaaaatatttaatttatctttataataagtagacaatccgcagcaacaattcactcaagtaatctgcttcaaactaagcgagacagaaaattaaggacggaaatgtggcagcagatcagagtagttaaccaattcggtatcagtaagccagtaaccaactcgatcataacagaacagagattacttgggtggattattttatcttattttataggaagaaagaagaggaagaagggagagattggatttgcctcgtggacgtaggactcggtgtagggcttggcgaggtcggcgtggagggcgcggcacacctccggctccgccttcgccgccatccgcaggatcccgcggagctgcgccgcccgccactccgcgccccgcgtaccccccggcgggaacctcccccgcagcgccgccacctccggctccatccccacgctcctcgccgccgccatctctctctctcactctctctcgatcgcctctgatcgccggcgatggatggaaaggctttgctgctgctgctgctgctggtgatggtggcgaaggatgcggaggcgtgtggggggtatatataaacctctcccctgcacgcagggtttaccagacggtttgaacgtcaaaatgggaccccgggcgaatttgacgaaattcatgaatatcgagcgaatttgtggtgggaaaaacgatgggactttgtaggttgcgatttaaatcccggtgatttgtttcgaatcaaaatgtcagaacgaattttttttaaaacacataataaatgtggcacacacaacacacgtgtgtttacatattttgagcacatgcataaaattggaccgacatatttttgagattaaaaggcaccacggatatctcgctatcgattgatacgttgtctaccacttatataaggaataattagctgagaatattcgtgtcaagggtaaggctttaagctgggtggaccggttcaatattgtttttaaaccgaaaagttagaatatcgaatgaattttgtagaaagcgattacttgcgtcaaaatctgactagtttcttgttaaattacaaactatataataaaattttaatcaaattaaggacttttcttaaaaaaaatgccgcatggcattggatataatttttttaaggacattggatataattttgacacgctgaatatgtatacaacacaattaacattatatcaacaatagaaaagtttaaaatacatgctagcaagtcacataatattataatgtccatagtagtatcataatgtacatgatatcaaccaactaaagtaacgagctttcggtctattaaagccatttatttttcctttttccttagttgaagtgccagcatatacataaatttaacacatttaatatttttttcgtttttaatcaatattgatgtaattcactctattggttttgtgacggctgtatcttttgaggatttaggccatgttgtactgtaccgcatttttttttttgcggggagtactgtaccgcatttgtaaattactgggatggaatttccgagatttatttatttttccttggaaagaattagttgtcctggtgaattaactttcttttggataaattcacattagaacttatttgctttcaatttctgaagctcggttgtttacggtacagaggaacaacagaagtaaaggaaatttcttgactgcatttaaacatggaacccaacaaaaaaacagagaactaaatgcacatgcaaaaaataataattattggaatcgagagcgttgtggaagatttcatttagatattaaaataagacctattctttttaaaattaagcacacgagctttattgttcgttcaaaaacataatgaccactagctccaacaacaccacaaatttctatagaacacaaaaaaagtttgttatcttgatgtctcatttgacaatgttgagacggaagagccagaactaaaacttttaataaagccgactccccttacatatttaaaaccatatatctactatacaaaatatcaataaaattattccggcgtcataaatatttatgcggtgcaatttcaattggattttagtgaggttactactaatttaccgttgatctcaattttttttaactgtgttataagatatatttgcggggtgggtgagtgtggtatacttgtgggtataacaataataagaaacctatggggttagctgaccccacaagtctctagggttggctctgctaatgaaagaatgactagagacactcaatgacacccaaagcaagtactccctctgtttcaggttataagacgttttgactttggtcaaagtcaaactgctttcaatttgaccaagtttgtagaaaaaactagtaacattttcaacccaagacaaatttattatgaaaatatatttaattattgatttgatgaaactaatttagtattataaatattactatatttgtctataaacttagccaaacttgaaacagattgactttgaccaaaatcaaaaacatcttataacttgaaacaacttgaaacggagaaagtatctattgtttttctatagccctgaaagattataaccgaaacctagtgctgagaagcaaaataggacgcctcgccaagagcgtcgccgtctcccgtcctagggcagaagaggttttcatattgaagagtagagaagattttatgtaaaatatcttctcttcataagaaaatagcttaattgtttatgcttagaaaacatacgagatgaagatattgcataggtagtcgttgtagccttgtgccttctcagatacacacaacgaacggacatactcatgtgtgaaaggaaagacacattatgcattacacaaatatcaataaaattattccactgcttataaatatttagcattacgtacacatggatacactttcaatagaattttagcgaagttagagggcgttttcatcacgattcgtgataatagtgtgcgtgtagcggtatgtgtgtgactaggcacacatgatgccaaaagcaactagtagtagctaacaaaagagaagattcttggtgacattagttaggcatgactagaaaacatagaccgtgtttagatccaaagtttggtccaaactttagtccttttccatcacatcaacatatcatacacacgaaacttttcagccacatcatcttcaatttcaactaaaatctaaactttgcgctaaactaaacacaaccataggagaagaagtccacaggtcgtccccttgtgcctcatcagatacccacagaacggccgcactcaagcctgaaagggatgacgtcctttcagcctgaaagggatgacgtccagatttctcaacgatacatctcatgtccttcactccccaataaatcgcacaaaaaattatgcatctcagaaatgtttagtaggtgtccaaatttttcagtcccattggagaatattacagttacgagtacatcaaattcagacagctagctaaagagaagagaaatgcacccagaatgggaaaagatacagccaaacaaatctgtgcacaattgagacgataactatcaggcgacaatggtgtagagataattccaaaagatcattagaaggctaaatatattggttccagtgaaaagggaaaacactgtgaaacagacatatataggatctcatcaaaacaactaaccacaggatcatcttgaattaatgtgtaatacaagaacaagagtgatacatcaaacatttgtttccattgcatccaagtagtacgaaaattataaaactgcattatggctttcatttaaggtaacagggcgacagggacatggaaaattgtcgaattcattcatacgaaaggaacttctgcaccacatgattcatgtttggtctttggttcctttctttctccaggcacagaacagcaaactccagcaccagtagcacctcggagcgcacaaagttgccattcaatctaggatcaacaacaccatcgatcaatgtttggtcaccggttttaatcttctctgttactgtccacactaactgcctcaatgcagcaccttcatctgcactgccatttgctggtagctcagacattcgaagccccatgactaactccagaagcaccactccgtaactgtacacatcaaccttttcagttatgggaacaccagaaacccattccggagcgatgtaacccctagttcctcggatctttgacatgttgggatcagtctggtttctctgtagcagcttcgcgaacccgaaatcgctgattttgggctcgaaatcctggtcgagaagtatgttctcaggctttacgtcacaatggatgatccaatccatacactcatggtgaaggtaagctagccctttggccacaccaactgcaatcttgtacctatgctgccactgtaacagtcccttgctaccaaacaagaacatggccaatgaaccgttctctacatactcatagaccaacagccggtgacttccctctgaacatacacccattactctcaccagattcatatggtagatgcttccaatcacacttacctctgtctgaaactcggcctcaccttgcttcacatctttgagcttcttgatggcaactatgcgattgtcatctagaatccccttgtacacagagccatatcgcccacggccaagctcatctttgaaattcctagtagccctccgcaattctttgtaggtaaacctacggaaatgatctgttacaaccctgtagccttcctccgcagcccatatcgctgatcgtgctgagtgtgtttttgccatgaaccaccagccaaaagcaatgaagcagagctccacaagaaagaatgcagccaggaaacagtagtagtagtaccacatcatgcccgttcctttgttgctctgtgtagcgtaattgaacgtttgtgtttttgatgcattgcaaacatggcgattggcaagttcagaaacatgtgcttgtgaccgggacagaaagctctgaggaaccttgatatatgctgcaccagggtatcctgaaactgtcttgccattgaagagatcagacttcaagaagcagccattagggtacactttgtacacgaatgctacacaggagcaactcgccaaacacattgctctacaagcgtgcagggatgttgacatgacatagttcatatcaaagccccagaagtcagtctgaggaatgcgcacaaagctcattttctggccatcattgctgcaagtgaggttgaatgctggcttgcatcctctgctccaatcaccaggatcactgaccacataaccaggagggcaagagcagccaatctttggtgtgtatgcacatatcccgttccaaccacaaaggccgtgtatttcacagggttgggagaaagccatccaagaattgtaccagctcccatctgactcattcaggctgtaaagccgaagatttccatcatagtccaacgtgagtctcctcttaatctccaaaccccaatctgaggcatagaaagttgtgttatcgctcgccataaatttccccagcttatcaagaacaccactcctgctacggttgtaagagatcctatagtttgtccagctactctggtcagggttaggccagtagaggttaaagatgtctggtccatcataagcaagtgataaaacgtaccgatcatcaaaccgtaaagtgtagtaacttgttgggtgtgagggatcagttgataccagctttgcggtggctgtaacaggctgcatcgggagcagagtgttggttggatgatcaaagctttgccataggatgcttccaccttgatccttcaccacaaggttcccagagtccatgagctcggcacggacagcttctgcagagctactgatttgccagacaaccgtgccatcatagtctgtgagaaccatgcttccatccttgttcagcatgactttcgacccgctctcatgcacagggcggtcttgatttgcgctccaggcgatggtcttgtcagctgaattggtgaaccagattgacaaggtgaacacagtggatgaaaggttgtagaagccgaacgagaaggtgccatccgttgaccgcagtacattagaggcatgcttcgcggagagggaagaccctttatgcaggtaattagcatgaccagccactgcagaaataggagccagaaaggaaaagaatatgaggtttagtatcaataaagagcttggcatgatatgctttcaaagagcaagatccaaggagaaaaaatgctgctactgtatcatgcaggaggaggaaaggaatcagttgcatgtatgcatagttccatagttctgtacaattgcaattaaacaatatgaacaagcacatggcaagtgattaggtacctaattaagattaataattcaatcaactggggtaccttggaatacagtccaatatgatattccttctctcatctgttttttcatcctatgatagatgactagatgtcacccgtgatcagtttggcagtccaccaagttgaagatttcaggtcttactatatgtttgcttaaatctattatatatttataaatttaggccaagcacatgattacctcagaatgctggaaaatatatgtttttcttgattgagaatagtaataatatcattaaaaaagtgggtgccagtgataatttggtttatctaatttgacacaggttccaattaatttttccttaattcttgtttatgaattgacaattatgcaagtagtttagtatggtttattattggtgtacttttgcattcagttactctctaaaacattatataacaatctagatctgggtatatcggggtatttttaaggaagataactcacctgggacgaatgatttagatttcggcataccattttttatgattacatgtagtgcaatactacaatctcactgggaagtcatcaagtcaccccaaggtccaaggagatcatttgaagaataaccaagttttttgaacagtagaatgaaaaatcagatggccaatccaacttgaatttaatacaacataattttgcagtctccactagtttcttcaattgatagtgcaacaagtccaggaaaatgctacagaaaaaaaagtttacacttagcatgaattaagaaaaataaatgatgcatctcgattttagttattcaaacataaacccattgtaaggaaagaaaatgcacaccaaagaacactccatcatttccctgtaataggattgtgatggaattgtatatgaaaagaaaaaaaaaaactgcacacggagactaatcaccagcattacaatgggcatttgaaggtgcctgtgcagttcctgttatttctatagactactgaatgaaacatcaatttgatggaacgaaaagcatgctatctagcatcccaaagaaaatattcttcttcagacttcagagatagaactaacagcaacaaaggtattgctgatcaagaatcaggactgcaatatagctgcaacaaataaagtgcagattaatcgttatccccgacaagcatgtatataggccactcaaatccatatagcaagtatgcaagcctgaatcaggggaggcaccatgcatcctagaagataagaccgaagaccaaaaaattagacaagaaggccatggtcatgataggtggaaacacaaaataaaacaaagtcttattgactacaacagagcacacaatatcaggtagtatatgatttaggtgtgtaactaacagattattttgtatcaagttggagttaaacaacacaaacccctggcacaagactaattaagaaagaattatactcttttcaaattatttggcattactataaactgtcttctcaataatatatgatatagttcactcatcaccgtcaacaactattttttgacttcaaagatgagaagttgtaggctttccacacatgcaatgtgtcaatcatcagctaaaggaaacacgagttttctctattggtttgtgggatcatgcaagtttaggggaacatcgtccacctctaacatactttattggcgatcttttttacctttttatggtcacttgataataccataaatatcaaggcaaagacaatatcttattagttatcagacacatcatggacatagattattcaaacaaatacaatccaagaaaaaaatcaaacaatttggagaaagttgaatggaataggttattttagccacttttgagaagatataaatcatgatatcatctcttcttgctagactttacacaaccttagggattccaacttttgaccaagataggtgatggaaactactgatgggtgacaaaaactgctggtaaaacaaagaacatggcttgacatgttcattagggcatagcttaaagtctgaaaggatagacacaagatcgaaacttatggtcatcgtgagagaataactataatcatatgaccagcatgaagaataactatcatagtgaaacagcattcttgtgttgaacatttagctttatctaacttcagaaacatgccaggaaaaaaggtttcggcttcaggaattcaactggccaccagcacgacaggatgaaaagaacatgtaccactactcaaaataacagctcaaaatgtaaatttataccaggcagattgtactaagatgagaaacattgcatcagacaagtgaggctcacagtatttatttccttcgaactgaaactatgcgggcagtgtatttggaagccctgcaaaatgctgtcgtctataaaccaggtatcctccattggcaaactcaagaccctgcaggtagcaaagatgataatccggaatccgaataaaaactgaattcgaaggcattttgttcaaaaccgaagattagaaaacgaacattttctgataaaaagaggaaatcgaactctagaagaagagagacccccaatctgaagggatttcgtcagtctgctccctgctgcgaatggccattccccattccccccacaaacgcggcgccgccgtgagacggtgctggccggatggagacagcgccgcccatgcgagcaagcggcggaggacaaagatagcggcagcgcactggcgtcgtgccgggctcgcctcaactgccgacggcggcgagccggcgacggcgtgggcgcagccgcagtcgcggaggaagccgccgccttcgcctcgccggcggctcatatatgggccgatttagctacaggccttaagaaattacagcccagaaagcccaaaaacgtaagcaaatatttccgactccgagtctttgaacattttttttatttttacagaaattttgaaaaaacaaaaaagttttttaaacattttaataaaaaaatttcctgagcccgcttagccgaacggcccgaacccaagtttgactcggtttggcaccatcaattttgccattaaaaggcaagaccaaaccggaaaaaggtccaaaaaaaaaaaagtcaaagcagtcaaaccaccgcgcggagaaggagatggacgtggaccctccttctccgctgccgccgccaccgccaccgccaccgccgccgggacgccgcagcagaacaaggcggtggagcttcctcccggcgtatacttcaacccgacgcgtgaggaggccatgcaccactacctcaaccggtggatcgccggcaagacgataccggagatggaggccgggttcgtcgccggcgccgacgtctacggcgacggccccgacgcgctgcggcggcggcaccggccgggatactggtgcaactgcgtgtacaagtggttcttcctttgccaccgcaagcgccagagctcgcgcaggaccaccggcaacaagcgcgccgagcgcgtcgtcgccgccggtgggcggtggaaggtggagcaggggaagaaggtgctcggcggcggcggcggcggcggggagagggacagcttagggttctactccagtaactccacgaagaagacgtcatggattatggaggagtacacgagctccgccgctgatggcgccgccgccgcccgcggcgaggaggacagaatggagcccgtgctctgcaagatctacctctcgccgcgcgcccccgccggcgagaagcgggcgctgttcggggaggacggcgtggcggtcgggcccgacggacgcaagaggaacgcccgggtgacggttctggcgacactgttcgacgacgtcgcggcactccttggacagccggtcgccgcgccgccgctgccggcgccaggcgaacagcttggccatggccatggccatttcgatgatgtagcggctcgtttcggacaggtcgccgtggcggcgctgccggcgtcgggcgatcttggccacggcgatttcgatgacgacgccgcggccctccttggacaggtcgccatggcgccggcgccggcgccgggacatcaccaacagggttatgtcgtcgcggaggcgccgctgccggagtcaggttatcttggccattatcaccacgacggccatctcgcgcaggcggcggcggcgccggagcaagatcattatcttggctatcacagtcacgacgcgcatgtcgtggacgcggaggcgacgccggagcaaggctatcatgacgacgcgcatgtcgcggtggcgccggcgccggagcaaggcgatcttggccatgaccaggggcatctcgcggcggcgctgacgccggaggaatgtggcgagatagttggcgcatacgaatttcacccggaaatggtgcagatgctgtccattggcttcgccgcgcccgacgaacagttgttgccgcagctgctagaccccaccggcggcggctacgacatggctagctccgccatcgccgccgttggcgacgtgaacgcatatgccgccgcggcgcccacgccgcgaattagacccaacgcggcggaggcaatggcggcgacggcgacggcagagacaatgccaccaccgctggacgccgtggcggccgagctatccgcgccgccgcgtggcttaccgccggagctcgctttcagtgccttgccgtcggtgcagcaggagccatcctgtgacgacggcgacaacttcggcgagctcgtggcggaggcgatgccgccgttgatcggggagaacgccggcgtcgatgccggcagcgacgagcctctgccggatttggccggcatcatgacggagttggattttggacatgactttttcagcaatcagcacagagaatgaaaaaaaaaagtcatttgatgttaagagatggtttacaatttgtttgtttggaaagagatttgattcttttaagttcttgcagtagtcatcgaagaactctgatccctgatttattgctaggactgatttttgttgtggtgacaggttcaatcaaacactggccttccagattatttgcattgaatccgattgtacagtgtacgctccatgagtatttttttttctacaaaaatattggcctgataagtatataattctagcattatgttatgattcatgacagcaacacatagcatttcacaagttacctagatgtgatcttgtcaaagaatagaaaaatgcatagcaactcctgaaaagaacaccgaacatatcagggaatagaacattgtaacatgtacaggcactgctttgttttctttccctatgatactgataataaacatgttcagattactcaatgacactaaggaatcagctaacaaatcatatacatagcatattagactacataatgtatagtcccagccaataacagattgtggaactaattatattcagtcttacaagtatacaggaagaactttgtgccaaccaagagtgggactgggactgggactgtttcataggaacatcataattttatttcatatgaacatgatgatgtttacaggtaactagattttctcttttctaaagaatacattcacctaataataccgtgtagagcctccctttgatgttcatccttctgacggttggtccttctatcatcctaatggccttttcccttgtcgctcattttgtaattgaactgtaacagactgcggactgctcattctgataaccaatgatgttggggaactgaggccaacaataaccgtcctcaaatccatgaatggtattgtcactgtttgaataaacagagagtaattatgggtatatatgttcaggtgtgtgaaatgatcacagaagggaagatccaaacttggggattctatcacagggtgcacggatccatccaatctgccctctctcattgtcatatatcaccatctgatcttgcattgtgatgtctgcgataggagagaagaagattaacaccaaggcattagaaatatgtgagaagatgaactagggagtttcgttgcttgtttatgtctcaacttcctacctccgacaatgttcagatccttgaggccaacctctgatccattgaggatgccaaggcatgcattcccatatttctagcataaacataagaaaatgttagcaaccagtaatgcataattaattactagtaatatgcggagttctagaatgtttacagtgacaataaggtagttttcaggagggatctccatgagagctttcttgccattagaaaagctcaataccactgttctgaactccttttttacatcaagaacagatttgaatggtttcttccccttccagcatagaggcaaagagtggtcaggtacctctttcaggttcttgcttaaatcacccttaatctgcaaggcacaaatcacataagccccaatgtttatttatcaatcctgtgatgtcagaatgggaaatgtttaaaacttactgcatcaacaagtgcttgatatggctgtgcagaaaagtaagtgaatgaactgccgctgtcaaagactacttccattggcctcacacctagtggccggccaccaaagtaaaggtttgccgagccaggtgaatagtaattcctaaaaatagaagttcagatcatttgaaactaggaaatacaggtcatgtcattttattcttaagatgggtcatgtccatgcctagtttgaagacccatcaacaatatgggtatacaataacaaaaacaacaaacatgttaaccaagattcgctacacattccatacagagcaaaatgcagtgtataaaattatccgtgatttccaagaaaaaagaaaaaaaggtaaatccataaatgaccatgttcactacgctgctctcaattaatcttgggagtcatttgacactagtaacgatcgaccactcaatttcaacatcatattcgaacatgatactagtcatctgcatttacttaagcattgttgcaaacaagcactgagcacccaacccatgtttgtcagaccaaaatgaagtccaaggataatagggctcaccgggatgtgctacgagccataggagcccacgttgcacgcgagtaaggcacaatgtcatcaccaaagaagaggaaccctccacctcttgtactgaggcagtggccaaccacgttcttagtgatcccatgctgcttgagctgtgaaagcaggctgacagagccactcccaagcccaaggacaccatcagtagctgacacctcagtgctgctcccaacctgctgatcatacccacacctgcacacacaaaaaggcctccatcaagaaccacatcaagtggccaattcttatcgtcttccaatgttatatctaaccagttacaagtagcatacccaaatgcaagaccgggacggacgattgaggagtttgcaagtcggagtgcgaagctgtcagtgacaagcacaccaagtgatgatccctggtcagcatacttaatctcatagtcacactgctgctttggtgaatcacatttgtgcctcccggtcagaccaccgtgcagagcggcgcacatctgatccacacatggaaccagcttgttctttgttggtcggtacagcgggtgcggaacctgtaccaaaccatcaccatgcaagacaacattgaacataataaaagatcttgagccaaaagagcaatcaaagaatgcattctaatgaggattacaatgagctagagtgaaatatagcaattgacataatccatgggagaccaaaaatggattcaacaatcaacaccacatttagaaatggagaactgaataagagatgcccataaataggcttcaagcccaactgaacccaacaatgatgtaagcaacaaaaagggacattttacagcatcagcatgcaaaatcatcatcccaatttataaaaaccatctctatttctttttgaaaggtcaacctcatcatcctaactactactagcacaagccaggaaaggagattttctcccctgaaaaaactactactgagacaaatcttggattacacaaacaaaaagagacacaaagacatcaccaaatatggacattgcaggttggaggaggtggatcccaagaagagaagaatgctactaccttggagcagctgacgcagggggcgtcgcactgcagccaggtgaggtcgctgccggtgtcgacgtccaagaagtagggcctcggcgggttgccgatgctcatcggcacatagtacaatctgcgcaacaacaagaacaaaaaagaaaaattcagattaggactttgattcatcgatgcctccaaggggcgcacacagaaatccatccccaaataagaccaaaatttgcagtcagttgattagttcttggcgccggaggagaggaatggatcagagcggggccgaatggatcaaggagaggatgggatggaagcgagccatacccgtgggggtacacgtcgccgtagagcgggaacacggcggaggactcctccgccccggccgtcaccgacagcccgcccctcgccggcctgtccgcgctcgccgccgccgccagcaccaccaccaccagcagggcaaagccggcagggcgggcccacccggccgccatgggaggaggaggaggaggaggaggggagagctaagctctgcttctgcccccttctccttgtctgcttcttccccttctcttctctgaatatatatatatttttttggttcagatttcttcagaagatgatgatgaaaaaaaaaggagaggatttttttttcgatggatggtgatggtgatggtgagatgagaggagaggatgtgtgcaaaatggtgggttttatagtggaagtatggaatgtattgcaatggaaggttctttgttgggtgcagcagcaaggaacaacaatgggggtttcagagcctctttgttcttttcagaattgagaacttgagatgaccttttctcctaggtaacctctgagatggatgcaaggtcaggtggtgtggtggtggtggttatatgcctttttgttgatgctgtggagaaaggtattttgcatgtggtttgatcatctttacatcattagtgaaaaaggctaaaagtgtactttagttctaagatgcatttggttttgacacgtgtgtttgaaaatgttagctagtaattaagttatatcttataattttaaaagctcattcttcgattaaaatgttggttcgattagaatggtggaatagttaacatcctatctcaggaagtgaaatgatggtgggtgattcaattttgagattttctatattttgtcattgacaatgcaacggcggaaacacggggcacggcgagaggtcaggtcccctccaacatttttttacatggaatcattcaattaattagataattaagctaagtaatactaatacgtattaggactgcgtttagttccatccaaaatttgaattttggttgaaattggagatgatgtgactgaaaagttgtgtgtacgataggttgatgtgatggaattgtgcaaactttggatccaaagtttggatctaaacacacccgttccttccaagactcttggaacccttctatatctaaatcttagctccgtcattagacaaacgatcgattttaggaaccattgcgaacgtgatttcttctaaatgccttcacacatgcattttctttccatttttttgtgtcttccttgttacgttgcaaaatgtctatcttaccctaaaaagtatacgctaggctagggagtgcttagggcaagttttataatagatgtggtggtcacttttaattttatccacatcatccatccaaaaaattaaaactaacttatataaatacattacatttaatacactagtcccaatacacttgccaccaatcaacccctcttattttctcttgtttcttaaaatttgtgtggaggttgtctcttgtatatatgaggtgtgactcctctctctcttctcttctcttctccacatcgtcatttcgcccttagtatattctaaggagtgtcttttccgagcattcactagagaacagttggcaaaatactaatcacgatggtaaaaagaaagaaaaatgcatatgctatagcatttaatataactcatgtttgatggtaattcgaagtatcgaccgctttttaatcgctagatgtaggcaatattcttataagattgttcaatatattactacgggggattatctactttattataataataaaacaaatattttagaaaataaatttaaaaatagcttaaaacaagtgatgtataaaaaaagtttatttgggaaaatatttttcaaagcatagagcaaataatatgttttaacaatccggtaaataatctgaaaagaacaaagtctagtatctctttcgattttcatagatggcacttgcaggttttcgtggactaaaaaacaatgtgtattgaggaattgctatgattcaacttaataaaactacaaaaatgaagaaaaatcattttggtagtaggacgaagtacatattaagatgattaggcgatgtacttaatttgcttgagtaaaaatgatatacgatttaccaacaagactaaaacctgatttggatgatttatcactgagcgataaaatgatcaatatttgcgccctttgccgctcatgcagggaactaacaaaaaattgtagcactacgtgacggttgcttgtcacttttcacgagtactactagtgatttctatcaacgtgacaggttacaggtagacgtgttgtttgcttcgttccttgttcttgtcacactggtacagacagaactctcaattggctatattaaattgctggttgagtcaatatgcaagtctcccctaataaagttaagccccaaaagaatgtggattgataatgaaattaaattagaaccagcaagtaattacgagcaaaaccactccaaattccaaaaacgtgtagcatctcttgaaagtgggaaggcagatggggactgaaagttatatctgtgttcccttcttaaaaaaaatcccttctaaaaaaaagttatatctgtgtttcaagctgacttctataagtaggagtagttctttttttaatcaagtagtgattttataattaagagtcatttaacctgcaatctatataataattgggtatagcttctttaaagcaaataccagaatgaattctagttttttttaaaaaagatgagaactgaaataattttgataacacttccaacaattttgtgcaaatgttaaagacacaataatttgtaacgtagaatctattttacgaatttcataggaagtgtaactttttttatccctgtaagatttcttacatgacacatttaaattctgaagaaaacaaaacagaaataagtgtacaaatgataccttctggcgtagttttactaaagcagcaaaagaattgcagtatcctggccacaaagaaggtgtaaactgcaagttggagtattttaagagatgaaacctacaccgcagtgcaattatactattcattctcattccttactttaggcatgcacaagcactagaataataataacaacacaagaacaaattaatgtgggttgtattttggtgtaaggaagcatataagtgcagctttattcctagcctttgccctccatcagttgtgattctagcctttgccattagcatcaagtacattagatgtataaaacaacagggaaaagcatttctttgtttctttactttggagccagtgcagcctgctgattcatattcctgttgtgcagggcgaacaagttctgaaatttttccttttccgaaacacaatacagataggtgacctataaacacagcttacccttatgagtactgaaattatcatcctactcttcacaatttatgatagttgcaagcgcgatatttgcactctataaattcctcaaaaaatatttgtaagaatttgtaaaatttgctcctctggttctaaagttgttgtcatcgtctttttcagaaatttttttttgtcaaatttcaagacatgatacttgccctacaagtgcctcaaaaataattgtaagagtttataaaatttgctctaacaaaattgaaggaaacaatcctcttttgcccccaaaccctagctggggatgaaagatccatgctctatagttgccttgtaaggggaaaattgaagatatatggtcctaagagtgcggagattgttttggtaattaatgacaacccattgttgcaactaactattttcatgagttggtgagattaggttgagttccggcgtcaagttgaaaaattgaagctaaaagatagacactataatttgatgatgagcaagtgaatacattgacgatatggggtatgaagtggctatctatggaaagatggtgaagggcaagcaaggctcagttacgatacctggccaggctaagatcaatcgagagcacgatacctcgaaacctgataaagacggagatgagaatccatttttatgtctatcagactatcacttaattaaaaggtataaattgtggttcacttacaatttatgaattaatccataacacctccgtgggttgcagagaaatttgagattataccatagtcaaagatgggttctctcaaatgcaaatctctcagattcgccagaattatattctcaaacatggtggtgctccatgttaaaatgtctttcatcctcttttgtttgtgaccagacgaaattgcccttgggtttttccttccactcacagtcaccctcgccgtgtccggggagctcggagctattctaagcccaagctcttcctctcctctatgccagaagctcgaaactttctctttgtcaccgctcctagcccaagcttgtcctcctcgtgccacaggctgagctcaagcccttcctcactactgagcttcgagctcaacctcttcctccactttatgccggagtcttgtctttatttcccttgactagaaaaaatacccgtgcattgtaacgggtgaaggctattttaattgtactattgttagatatatttgtttttgtctaagaagtatatgggatttttgttttgagatgatatccaattgaaacccttgtattttcaaaaacgaacgaatttaaaaaccaacttaaatacagatgacataccaaaactatcggtatttttgttttgagatgatatccaattgaaacccttgtattttcaaaagcgaacgaatttaaaaaccaacttaaatacggatgacgtaccaaaactatcggtagaaacttcttcaatttttattaacatatgtaaatactccgtagagagtcccgcctctcccaagccgagcccacttacatctcccgcctctcctaggccgggcccacttacatctggcagcttttatagaccgccctcacataccaacacaagccttttttgcacactttgttctcactcatgtgcacccgggaagaagaatttccctgtcggtcacccatcccaaattactccaagcgagatcggcttccggaaaagaagttgcaacttgttggtacgagtattctattaatcctattaaaccctgggctgggatgtcacatcctcacccccttaagacaccgacatcctcgtaggtcaaccccaagccaggaacgtcccctcttggccacgtctgtatgtcgggatgtcacaaacatcatctaaggttttgtaaaaaatgaactttctctcatcctattgaaacgagattggtggcataacatatattttcaccagctacccgtttcagtgccttagatccatttaccacaaccttgtgcatcgaatgtgattgagaagagaagaaaaggcaagaaagttgaggaacacagaaaacatggtcacagatggccaagcaaggtcacggtgtaggacagagggacccttatttgatgatgtcacactaaactatagcctcagagagagggtaagagagaattgcgatgggagggaacgggtggaccagaaaggcaaggatgatatctcgagttttgttcggtgacattggcaggtaattgtcatcataatcttagaaatatgatgatgcacgtccaatgaaagacaacatatacccctaaaatgttgaattgaggcagcggcagagccacctcctggactccgccgatggtgttttcactatactttctttggctatacatgcgaaaaattgtcgatagctaggaaacacctggctctggcactgaattgaggcgacggatgaatcaaaatgtgaatggacaaaaaagtatcgtgctgcatgtgtaatatatagtttgggcataaaaaatcatgatgtttgctcatattgctagttattgcatcacccacgtcatcttgatcacataaatcacttaagcctaaatagccaaacgaaattatatgttgaaacgtgagttcatggtgttagtagcacgtactccctaaaaaaacccacttctgggtttgaatctggacatacacaactcagaagtggtttttttttattaggggagtataaattagtaacgctaattgagtctccagtatctaacatgtttttagaaaaaaaaaacagtatggagaaatatataacctcttatatctttcagatttacttttggctccccactttatcatcatcatcgtggttaaagctcgcgagcttcctcaaggtcattgtcagacgctctaccgggctccacctctgtgcccagccatctatcgtttgccgtggcttgtgacgacgacctgagtactaataatggttgctgcatctccttggtttatttcgtgctactcatcaccggcgccgaaatattattactacgagaaaattgcatcgccagtacatgaacttgttgggtgggtgtaatccagtacacgaacttgtaaaatgctctttttagtgcatgaacttgtctggtgcatgcagaagagtgtgaaaaggacacttcatgactaaacttattaatttaggggctaattaggatactatgtaaatatatactccctccgtattttaatgtatggcaccattgactttttaacaaacgtttgacctttcgtcttattcaaaaaatttatgtaattatcatttattttattgtgacttgatttatcatcaaatgttctttaagcatgacataagtatttttgtatttgcataaaaaatttgaataagacgaatgtcaaatgttggttaaaaagtcaacggcgtcatacattaaaatacggagggagtatataagaagattgctattagatatacacctcttcaataaaaaaatagaatgggatgtggtgatagtagaaaaagataaagaaaaaactgagcaatgatataagtgtaaaaaatatatgaaattcatcatttccatgatcaaggataaactagagatcaaatttataaatattgcatgtcttatgcacacttattttgaacctcgtaaaattaacattgtcaagttattttgaacctcgttcgcacgaacaagacaagtttgtgtactacagatatgtaggtgtgaattgatattaaaaaggaaaaagtccgaactcaacaaccagacatctttcaccttcaactattaataccggacgaactacccccgactcaacccagagaagttttgatcctaagtgacagtccagtcaataattcttcttttttaaattgacgggccccacctgtcagtcttatcctctccatctccttccccttacctctttatctctctccccaatcctctcactcttctccctcccctcacctccatttctctccatcaccaagccgccgcacggagggggagccgaggatggcggcagtgggcatcgatgggcaaggacagcggagggggagctgaggacggcggtggcgggcggggatgggggtggcagctcaaagcggcagtggcgggtggggacagcgactggggcgggtggtgacggcgacgccaactcggagcagcagagggggaactgaggaccgctgcggcggacggggacggtggaagcagctcgaagcaacggtggcgggcggggacgagggaggcagctcggagcagcggtgatgggtggggacagcagctgcagctcggagtggcggagggggacccgagacggtggcagcggtgggcaaggatagcagagggggagctgacgacgatggagtggctcggcggggatggcggagggggagccgaggacggtggaaggggacatgccgacagtggaaggggacatgccgacgtcgacgctcgattctctccctctcaacgccccctcctctctcttctccctccctgcgaggggcaggtcttcttgcgcaagtccggggatggccgctgctcacccttttctcacgcaagtccccacccgccactgcctccgccacgaggacacatgcagccgccggcgcgcggctcggcctcagcctccaccgacgctcgtagccgccagcgcgtggggctcctcctcggctggcgcgtgacgcgcacgagagagggggtgagaggggagagagagagaggagagagatctgataggtgggcccatcatgtttttaataaaagaattgatgattggactgccacgtaggaccgaaaccgcttgtaaagctgctcaggagggggggtcatccggtagtgatagttgagggtgaaagatgttcggttttcgggtttgagggcgtaattggtgctgacctattagttcagaggtgtaattcagacttttccctattaaaaacatataagcagatagagagagagagcgctctagatcgacaccgatacatcatcggacaaggagttgattcctgatcggtttgctcttttgttatttttccttgagtcgctgacggagatgggtctgtcttcctacccatcacgtgcagatatggatacgattcatgcaaaactagaaaggaggcaaaattaataaaacaaaagaaaaagaaaagggaccataggtggggataatactctctatccagcgcccgatgaagaaaaaaaatcagacatcgtcttaccatgtcatagcacttttgcactcttccttatgtgcatgttagaagtctgcatgttgcatgcatatgtattatgagtttcctccatctagtaaccttcaaaatgagtttcctcttaacttatttatcttatcaacgatctgattgcaccattatatttgttataattaaatctttacaataagatgtcacatgattatattctaatgaaaaatatatatgtttcagctagtgaaactcgatgtttcacatgtgtggtgagaatgtttttacctataattttactatgttccacatttttaagtttttgtgttgaaatggattatttttagtgtttcaataaccattttatgatagctcatttgaaaatgttgcatatagtgttattggatgtttcggtaagtattctgagatgtttgaataggtactactcaatgtttcatatttaagatgttttaataagtattttatgatgttttgctagtgtatttgtaaatattgcacatagtgttgtttagatgtttcaacagtcaaaactcaatgttccatatataatataaaaatgtttaagttacgaatgtagtcatatatttattttttatcaaattataatcatataagatctcgttgtaaagatttaattgcaataaatataaaggtgtaatcggatcctaaaacggatatgtaatttatgagataaaatggtttaaaatttattaattaatattgcatgcatacacgtcagaagaaaaggtggatcatctcccgtatgcatggatggaggagcacccgatttgtactcgtgtcccgtagatggtcgatttggtttggtagagaagaaccagatcgcatcatatatggaataataaaatctaatccatgttcgaccatgtattagtcttacagtgtgacttggggcggagctagaacaaaatgaagggggttccactcgcttgctttactcttgtttgaattaaatttagcttgatacgggtgtctaagtttaaactgacagagtatatatatggtgaaaataaataaattatagctaaatttttttgaaccgggttcctaggcaccccctagctagacatagctctgccccctgagtgtgacatgtgtggaagctatatgattgaagggcatctcgtgcgtgcgcatgtatgcatcttaacatgtagtacaacattagtctacttttttatctttaatgatttatacattttaaactgtgtattatttttaagatccgttttaaccattagactccactcaaaatatataataaaatgagcacaatatgaagtattttaaatatataaaaataatttatttatattgtagaagtaaccaagttctataatagaattagtaactttttatagcattataagtaattctatggatgtgttcaaagaaggtcttcatgggtaaactgtagattcataagtaaataaatgatttactatatatatatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttaagtgattttgtgcatttgaaaccatggtgcccgggcaccatggtgccccatatatatatgtgtgtgtgtgtgtgttagtattgtttttcagaaaaaaataatttaatttatataagaagcaactcttagaaaacaaaagtaactattcatgatattaaaagtaaccatatgactgtaggaaagtaattaaaaacataaaagtaacacttcatgctatttcaaagtaatcactatattattttaaagaaactttgcattatattggaagtaactgttaaggaaatagaagtaatttcatagtatgagaatatgctaaaggaaaataactaacattttcacggtgttacaagctgccagagggaagtaactctgagaaaaatagaaataactcttcacattatttgaaagaaccacactggtagaagaaaataacacttcacggcattagaagtaactatactacaagagataagttctttgtagtattagaagtaactatactatgacaggatgctatatgcaagggatggtgtttggttggttggctggaccttgggttggaaatttttaaagactgactcttgtgcctggtcatgatgttatagatgttttatggtggattttttttctcttaaatcattgtactaaagaatttatatgaaactgacacaactttgaaggcgtgtggcaaacacataattattaacacatttgcacaacataagtgtggacaacgactagactaatcagtcactaaattgtactcatcattggttataccacatcgaataaacactataggaaaaagaccaatagatcaacatcaagcatcagctgtatcatcagcaaactataaaaagccatacggcatggtgtccacttccaccttaacaagtacttagccaacactattacatagccatttcactgcaaatatcaagcatcaacagcaatagagatctaatcggtacttcagtacagaaggccatatggcatggtgtccacttccaccttaatcagtacttagcaaatgctaacacatagcatggtgtcccagtaccacccctccaatacaattttaaaatagttagatgcaatcgggatgatgctcatgtaggaacttcgtaacccaacgagcacgacacgcctcattcttctgaatgtatatgaggcttataaacttgttagcagccagatgagttagaacaagatccaattggtcctcattaaaactgggaagatccatcactgcattgtagagttcagggtgcaccttagtatgggttgtagagcgtatggcagcagccacctcatgcatatagcaccagtcatgttagtcaggaaagccccttcttcttcagtcacaacaggggttcgctttctcttcccagatgaggttgagccaccagcaatgtcattcacagtaggaataaagttaccactaacaggcccagcagcactagcccctgcaacactttcacatccagcaccaaccccattcccaccctccatatccccatccataacacccaagccaccgtcagccatgtcagcaggaccaccaagggcctcattagagcccattgcaaatcttcctgtggcttgggttccaccaaagataatagccatcggtgtgtagttctctagaggcacattcaagaactcaacatctttagatttgtcctacatgatcagatttattatagttagagtgtgaactgaaattttttacagctaatggttggaagtacagctaatgatgatttattacaattagagtgtgaactcaaatcacatacctttgtatggcccatatagtgttcatcttctaggacaatcatgttgttctgatcatcccataaagccccacttagatctttcagcctaccgatacgaacccacattgaacgccatttgcgaagatggttgtatacttgggttccactggtgtcaagcccatagtggtcagtcaaattcttagcaagcccatagttcaagtgcacttccttgaaacccttgtcagtcttaacaccttgcgctatgagctcgaccatctttcttagcataaaggtagatatgtgggatgtccagcgcaaggctcctcttgcaccttgtccagcaaccttgtcattttcacatgtggaagtaaataaacaaaacaattgaatgataagttgtcagccaccttgtcttaacatatacaaattcatgcattagtagaaaaggtcataaatacaaataaatgccctataagctaccagccacaatatcttactccctccatacacaaaagttacacctatttcacatttgagtttttccaaataagttgttcctatttgtagtccttatgtatttaagacttaaatgaagagataaattaaatgttttattagaacccaatgagtcatctaaatactcattggctgcatgcttgcattcactccttgattttgtaacatccaaggtgatttaatttctccttgatcttggtgtcaaaagtaatatgtgtaacttttgtggatggagggagtataataaaaagttcaagcaaaagtaggaaatgtcactaatacaaataataataaactaaccacaatatctcataataagaagttcaagcataggtagaaaatgtcattaatacaaataataatcaaccagccacactatcttagcatgaaaagttcatgcataagtaggaaagaccattaatacaaataataaccagacacaacataattagttcatagatagtaatgtgatacatatcatgctacaaatcagaccctagatgaccctctagttgcccacgtatccccagccaagtcatccctaatttgtaccattcccctattgtcttgatctaattcatcgagctcttcttcctcatcatcacttgggttccaatcttcttcaaatggcacaaattcatcattgccataatgaagtatccaattatgaagaatgcagcatgcaagaaccaacttaacttgggtcttgtatggatgaaaaggtttgttatatagacaatcttgaaacagtttttgaaggaaccaagctcgactgtgactctaagagaggagtgtcttaaattaaacaactctctttggtcacgaggatactggcttccctcatactctctcaagtggtatcgacacccacggtatggtgggaggaaccctggtctagcaacataactagcatcaacgaggtagaattttcctaacagatgataaacatgggttcagtcattaccacaggacaagaaatcccaaatgatctaaattattgacactctatcacctgcggggacactacggccatcatccctctccaaggcatctgcaagtatgagggcatcatgtgcagacccttcccagccagcaagtacatatgtaaatttaagatcaaagtcaaccgcagccatcacattctgtattgtaacaccctttctacccctaaatgctgctgacatagcagatggaactcgagcaagcacatgggttccatctattgcaccattacaatcctaattgacatgaaaaatgttaggatatgttgtgggggaaaaaaggtcatttgtggataatatttgttttaccttaaaatatgggttgaatcttctgttgcctagaatttttcgaggtatatcagttgaaggtggtttgatcaactcatttctcagttcaccaacaacatacaagacctctctgaagtacctactgattgtcttagttgaccttctaaaaacgggttgtaaagccctaaatctaacattgtggcctacaactagaaggaacatggcaacatgttcctccactgagctgtgaatagagtcctgtagtagctctctttggcacaacaagtgacatagccgaaaaaatggtgcccttctcattctaagctgatttacacaatttgtatcatttgtatcatagatgaaacgcaggttggtttgtctaattaagtccctttccatcaatggtccataagaaatcctacgggtgcgttgtctagccctcctcacaatgaaactcatgtaggcacacattgtagcaactaaaccagcagctttagcctttaggatttgacgtacacagcgtatgtcttccatctatgcaaataacaaatttataatgcattatacattgtcagaacatggaatgcaaaaaagcacaaccatataccatacatccaaccacaagaggcaatagatcctacccatactgagacctacatacttgaaaaagaactagatctagcaaaataatcacataataatatactaaataaacatgatgcaaaaacatgcacaggagaccaactgcccaactaaaataacatcatcaatactagatctatacaattgatgaagcataagcaaagggagcacccacgacggtgcacaggagcctcaaaccctagcttcttctcctggggagtgaaatgaggaggggatacagccgtgcggggaggtaaccctcgcccttttgcatgtgcggctgcaacgaggggtctcgtgggtgcagttgcgctgcaccggatcagcctggatgcacagcgatgctcccccctcgtgtttctgctcagccttgcccagagggcgattttacatccgcccagcttggctcgcggaccggtccagccaaccaaacaagttagattttgctggcctgatgcgatgcaggtgcggtgcacccatccatacacgccctaagagtaaggaatgagtgcatggtgtagacacattcttttttgttgcatgtgtttactatttttagaaaggaagggagtcaccaattaagactaacgggagcacaagcttggcttagtcacttccatatggaattatgtctctcatactccgtacatgtagtgtatcttattgtaaaatgcatcatttaatatttagtagcattcaagctctacgcatgtagaaatttatggatatgtttcagtatagatcaacaaatttacctgttaagattcatatcacatattagacaaaaatatgtacaagttccctacacaagccaatatacacatcaaattaacattggaaaaataattgttatggaactcatctgtccaaaattttcaacatgtgccccgtgtctttaaactctaacatcatcaaccacaaaaaatcaagaaaaaaaatcaaatgatatactatcaccacaattgatgttagatatttaagatggagtatcaaggagataggttgacaacaaagcggatggagaagctcctaaaaacacactcacattaattttacatttaaaattaaagcaaagtaactaatttaacaaataaaaatgaaaaaactatttagttcgcatacatatattagaataggtcaatgccggttgaaatgacaagcttctccaaaaaaaaacatcactacacctagatatatcccactaaacaccaccacaccacgatatatcccactaaaacatcgtggtagtcgtagtctaacataataaaaacatatagagcatatctcagcaaaacaatgattgaaagaactttcgctacagtgattaaatacgttgtcttgactaaccaatttcctcgggcaaaatgtgacaaactatagccaagcagacccataaaagaaaggacgctaacaatgtatgaaagaatatagtactcctacttagagttctttttatagtatgtcaatattattattcataaacttttatcctgccttctaccaattactatccataaacttttcttacaatttgatcaatgtcaataaaatatatatgctaaaacaatgagcatttgttaattgaacgaaaatttcgtaaggtttcatactgtttgaatacttttgatgtttcatcatttactggataataaatctatcttgtccatattcactcaataataagtatttattattgcggcactgacatcttgttatcagttgcatcacatatccagcagctacctaaaacttcttttcagaatagcattgactcaattaaattcacaacttttaaatttgcacttcaaaaattatactaatcttaaaataaggtgtcagggttatggataccacatacctcggcagggcccaccacataccatgtcctatacaggagcaaccttcggatataggaggagttccggataaggaaagacaaccagagttctacatggaaacgacaaggactactcggattgtatccatattggtttctctagttctacttggacaaggggacacctatgggtataaatacaaggccccctagaaggagaggggatacggacaacacacccaacacaatcgacatagaagctacaacatagaagcctacatacgccaagacacgccgccggatatcaacttcagggataagcacggctagtaccctacggtgtctccggatactgtcaggagagacgaaagcactatctctgatctcgtcgggcatggattcgaggtggaaggctaccatgttgtcgactacgagtcagatcgtccgaccgccatgccgacaacagttagataggctatcccaaacattgtactggtgtgattatcatgaataagagcaataccggcttcggccaataggatgtaggattattacctgacaattcaggggcccgaacctgtataaaaatccctgtctccgtctcttttacctcagtctcgcgtatatcctagcaccaacgatccccatactgtccaaataccgtagtcgtgacatcaaacgtcgacataaggcataccaaaactaaccaaatatatatgagaattataattgaatagagagtgaattgaaacttaaataataaattacaataaaatggtaattaatattatgataaagtattcaaaattggtataagctttcaaaattgctaattactattacaagcagacagcatttaaatccaatagtgtaataatgactaaaaataaattcggtaactcaattgactataaaagcatgaacaagaaaaaaatagtgaacttatttatatctattaaaaaaatgtttgtgcatataattgtttctaagtttagagcttcgcaacaattaaaacccattaaagataaaaattgattatctaaccattttcacaaaataacatgctatgatgtaagtcactaagaaaactagcttaggttgtatagacatgtcttttatatacctagtcacttcttcaaatttcaccaataaagttattctgttatatgacaaattatatcaaattgtttacatttcaatagtggccagatattagaccttctgtctctttttcttcaactaactatctacattctaataaatattgtatttactaacataataaacatatgttatattttcatattttatcaattataacgaaatttatatataagaaataagggtaattagcttacaaaccagataactttttcttttacttttagctttttctagagcataattgaattatattagcaaaaaaaaatattgtttaaatagcttttaatgtttgatcattcactgaaaaataaagttatatttttcatgtattaaataagaaagctgaccaatacatggttaacagttattatataatagtcaaaacagaacttttaatcccacaaattaattgtctttagaatactaatgacttatattcacaaattcaattttgtctttagaatagtaatgacttagattcacaaattcaattatttttacttcatatgtatgtaggtttccagcctcactactttaaaagcgcatccccttcaccttttgaaaaaaatgtgtaattcccttaaaaaccttaaaaaaacaaaaggaaattcgaccgcacttccttctcaaagttatttccttctcttagaaaactatcgctacaaaaacccttctaactaaatataaaaaagctcaaaaatcattaaaaaaactatatagaaataagtcatatttgtatctctagacccattgttatgcatgggcatgtagctagtaaatagcgaaagccacaactcacttcgataatatatatagtgcactatgacaattggatttataacaagcgtcgatctttaatttatctataaattatatatttttatatgactatatatatcgttgagtattattaatatttacaacattttggattatatttagaaataaatatctttccagttcttaaaaaataagttaagtaacttgtataaataaaagatcattaccaaatataattattattattatttactcatgtaaaaacatagataatttatattgcggagcttcacacatgagctattaaggtggaagtaatagttttggctctagcaatatttattagtgaaaataaagaggacaagaaatcaacaagaagatggaacaatcgaacaatagaacaatattgggttaaagttttagttccacaccgcattatggcgaagaacaaattcaataatattaaaatattattgattaatgggagtatatatcgtaccatggttgtggacaactttccccctcatgtgtgtggctagtgactaaccttcctttttcttaccttctcgaagtcctcttgatatgtttagctaagaaatgtttgttttgaaagaaataaaaaatgatttgacgattattttttatggttgttcacttactacctatatatactatggtgcggcatttttgagaaaaaagtcaaatcttgtactaggtagggagtgaggggaagctccggaaggagtgccccaaatatcagagttttctccaagaagttccggaggagtgtcgagtttgtcgacatttttccactggagttccgaagaagcaccgaagttgtcggccttattctcttgcttgtacctcggcagatgcttcttttaataatgtaagtattcaagatctctttgtggtatttaatttatttgcttgagtgagatatattctcatcgttgcgggtttgtcacttagttgaattattaagtgcttcaatactatgattttggataaagaagaaagctcttgcacgaggctagagtaataatcaataacttacgtgtggtgtctaggttagcgggtaccttcgtttgttgtgtactccacagaaaggcggcaggtggtgatagccatttatgtcctttgtatccctccacattcaggtacatcataaagccataggtcgaactcagcttggcagaccagggaaaagctaatgtccgaagcaatcgataggttttacctttaactcaagtctaaattaactcataggaatcttctttagtcttaacccaccattagttattgtccttggatagaattttgttcttagaatactctaaagtgaagtgccacggtgatatccatgcgcttaagaatttatctatgcgcttacgaatttatctatgactgtatcaaataccaacagtctcaaggaattagagaatgttgaaagcaaaaactatgcgttcatcgaaaacaaagaagactattgttgcaagaaccattgattcaacacttcggccggggaagggaaccttcctttttcttaccttctcttgaagtcctcttgatatgtttagctaagaaatgtttgttttgaaagaaataaaaaatgatttgactaaattattttttatggtttttcacttaagtatctatatctactatggtgcgacatttttgagaaaaaaaagtcaaatcttatactataagcccaacggacgggagtttgtttccttttttttattttttttgacagatgttacggaccgtttttttttcccgcacgcatagaatcggatctttttgtcgccctttccttttattttaacggactgactaatcggatcttttcttttcacggacgcatctcatctttttattttaacggacggactaatcggatcttttttttcatggacactgatgactgttttttttaccgcatcgtatataatcagattcaattttttcgccctttattttatttttacggacgacgaaagcacctctaactttttaagtagtagtagagatagagatgtgttttaatttttgaagcaatagttggctatattattaaacttcctctggagaagaaatgtggcaccacttgcctctccaacctgtgcacccccatcggcaagaaccaagctgattcacaaatcaaatcaacccatgcaaatcaatttaagttaatttggtattctgtgtttgacgaaaacaaaacaatgaacacacagaaaatagggaaaccttgtattttattaatcatgattcattaacatgaatgtttacaaaaacatgagggctcccgcaggagttagccttttgccttcgcgaggaatgcttaatagaaaactaccgattaattacatccaaaggatgagcctatggaacacctccgattaagctgcgctttgtgatcgtcgtcttcaaatttatttgctcgccgaagattgaggttggtgcagatttaacggtgaatatagtgaatgtagaatggatggctttgtttcgccaaaacccagtcacagtacactactgtcacgtcggtgtgtggagggaatctggtggagcgggtgacctttgcctcgtcagcgcccactcatgtatcttggctttcatcaaacatggattttatggttgcttttgcctcgttagtgtccagcaacggcgtatccggtttccatccattttagacgtgttaatataataatgacctggccttgtcagcactcggccatggtttcgtcaagcctcgtcggtcatacacaatgaaacaaatgaatggctgtagccttgttagcttaagccaatacgtcgcccaacctcgtcggtctcggacgcaacgcctccgtagttggcgtatgcatgagtcaagaacagctcctgtgcatatgcatgggggcaaaatatattttaattatgaaaacaacgcctagacagtccgatcaccaatgggggctggacatatctagtaccattgttattggtatcatagtaaccgatagacgatccgatctccaatgaagaccaggcgtctagttttaatcatagaaaatatcaaatggcactcagatgatccaatcgccaatgagggccggaccagcctaataccattgattatataaatgcagtttgatcatagccgtgtttcggctctcatcaatctgactttaatcattgagatagattaagaccatccatctggtagaatttggagagagaaggaattactcccgtacatgacatgcacgaggcatgcacgaggcaaatatgtaactcttccagaatgaatatgaactcactttatgttattcagagcgcgctcctcttttccaaattttctcttcttttcatacaatattacagtttgtagaggccctgtacataagaacacagaacaccgtacaaactaaagagcatgtacctaaaacaaattatcaataaaatgaagggcttttgtgcaaaaatacgagggccaacgcagacacacgagaagccgcgaaatccacccgccctccagcgcacgctgacgtgtcgcgacccggcaagggccacaccagggcaaaacaccgtgggcgctacattctcgggcaggtttgaagactttagatatgtataaatcatggttggtccgatgccaataagactcaaactcatcccaagtatatacaaataaatatctacatccaatatttgatattttgataatttagacggcccaacccccagaaggattaggttcacctcatatttgtttgcagcccatattaatcgcttgacaaagatgacgtgtgcgtgtgtatgtgccactagggatacttatatctatggctaagttcacaatacatccacaacatattcgtctgtgcttcactttattgttttaccgtccgggctgcaaaactgcacaatgctacggtgtatatttgctccctctaggagataatgacgggctatgcatatatctgcacagcactacggcgttgttgtgttatataggataaacagcttgacggagaacaagatcagcttgttgtttaggactcaccgatagagatgccatcagcgcctgctgctacaggtacagatcgcccatctgcgggatacgcatcatctaattatgcattatcttcattttttatctctttcgatctcacttcgtctctctctctatgtaaatactcctatgtgggtacatgtgtatgcgtcgctagggcatattgctgcctaggtgcgcagcgcttacgccttgtgtgctcctctcgcgatcatgccggtttatataggcagagcgacagcaacggcgcggcctcatcctcgcgagttttcagcgtcgtcgacgtgttgtagataatgttagaaaacctatgggcttgggcctatgaaggcctagcccatatacactgacccacaccaaaaccttccatatatggaggaatgctatataaggaggagagggatgctcatattgtacacctgtactcgaggatgatagaatgatgaatgagaagagagtctcacccttacatctcgtgtctccatttttgtagaattacgggaccctcttggactatttcgtgtagcaggagggttgcgtaatacgttaccagcacgacgttctaccggagaccgaggaagagaagggtaagaactcacagatccgttttgcatctagctgattcaatcgcgaaaacgaatccctctccccgttctcgttccgtttttgtcgttcccgatgaaatccaccacagccgacttggagtcgccggtgtatgccgattggtgaaaatcacggtagacagacacggagttggcgtgccgcgacacggcatggcggcgaacccgcgccacggccgcgaacacgcgccccgcgctggcatgcacccggtgccacggccgcgcctgtacgacgcaacgtgcgacgaggccatgcactggccacgtgctgcacactagcatcgtgcccgacggcaagcccacgccggccgccatgatagcaacagcaaaacggagaggacaaagaaaagaagcagacccaagaacgaagaaaaagaaaagaaaacgaaagggcgccgatgaagacgtcgggtcgtcggctgcacaccctcgccgccgcacggccgcgcaggccgcgccaccacacgtccgcaccaccgttggctgccgcacggccggcgccgtccgtgccacgccgccatccgcaccatgcgggcctccgcaagggtcgcaccgccgctgccgaccgcacggcagcgctccgccgacccggccataccccgtcacacgggagtgccgccgccgcgccgctcgtccgccttgcagaagcgccgccgcgccgctcgaccaccgcgccgcctggcttccggcaccgccccggaatcccaccgtgccgtacatggcatgtgcggggtcaacgggagaagaagataaggaaagagaaggggaaaagaaaggaaagaaaaagaaaaaagggaaaggatcctgtgattttgcaaaaatacccttgttgtttttggaaattaagtgcatgttcctctgcattggaatctttgcactttaaaccctgaattttccaaaaacacacaaataaccctctgcatttgggatatttatttgaatggcattcggaatttgcaaatatcaccaaaatcatattctcgcataaaagagccacgggacattgaatttcgaccccaactttgcatttcaggtacctttttgctgatgtttgtgattatgaaatttaattatcgcatttacgattattgattatttgtgatgcttttattacttttaattaatatcgttgcgataaaatgtatagaattcatagtatatactggaattatttgtgggaattttgtgtaccattatattgcaacacttgtgcattttaccagcatttaatttgcgcatatttttgagtaacgaaagatgactggcatcgcaaattagaaattcgctaaatctagaatatttctgacatatttattcaatgtcgaaattacgatagagcaagaagctctacggtaccattaatccaattgcgctatgtgcactgactcgatgagtttgatctagcatctcaatctctcgctagttccttcaagctactctcatgaatgagtacgaatgagcgcgttagaagattatggaccctatctcttgtagagcaagtactatgagcaagagttggtatttttcgactataatctgctgagtcaatgacccagagagtacggtaacacggtgcaccgaatttgcactaaatactgcagaaactcttgatgttctacccgaacacgacgaaagtcgcacgcaaacatcactagtgtacatacaaagaagtatgcctaactagtcgataatagaatcgtgtaacgttcaggatagtgttcactagaagagcattatcttccaaaaaaccaactagcacagttgataatgaattcaacatgagcagctagcctggtgcacttacctcaacggaagaagaggaaaagggggagtagaacacaggtcaaggtgaacaatctagaactatgaacatgaaaaaagaggacaatcctaatagcacactcatcatgaattgagggggagaactcctagcctatttgcatggccatggacgtagaatctcctatgctagattggatcggtcctaaaatttatgtcagaatgccatagctgttgagcaagaagctcactatgaagttaattgaatctgatgtaccagaatactttgttgaatcaatatactccgtcatcaattgttgcaattcttgaatagagcattgcatcaaagaaatggttcttgcccaagtagagcacacattttccctgcaataaagaattatttccagtataaaatagcatatttaaagcatttactattttgttgctcttttctagcacatagttataatgctttgaattttgtgtagcacccaaacataagagaaaaggaatgaattgtggtccgcataaccacaaataacattttaagagaaagaggtatttccagacccatagaactggaaacattatgactgttgctagcaacaacaactgaatttgtcggcctagaatgcgccacaatcatattacctatggaacaattgtgcactttatagaagcatctattgtccgtcaatcccgttgaactctctaaaaagtgtgatgatttgggctacacccttttagcaatgaattttcagccattttcggtcttagaattataagaataaaaattacaactcgtatgatcatagcacatatatgcataattttcctaaatcatgaagatttgtgtgccagtatgcaccgacaggatattaatgcataaaccgcatatagttctagcatctctgaactagattgcgaagaataatgtggttcccatttggtactgtatggatatatgcgcttccgaagcagcaaacatcatgttcctcttagacaccgtgtctttgccaaaactgatccagcaagatcacatgaactccaatagaactcactaaatcatcttcagaagtccgcgaggacaatgccagcattgcatttgatgattggtaaattgacagcacgaagtaccaaatattcgcataagcggactaagtataaactatgaattgcaatatttgctatatcattgttgtaatacacgtggtagaaaaggacatgtagtcctgaaagcagcggactctgaaagaaaattcagaccatcggcataaacatccatcctgcaactagtgctattgcatctgtttggtttatgtgcatatcccactatcataatgcgttgcaaaaggctctctccgaaggttggaaaccttttacggagatagttatgaagcctaaattccttgacaaataagaattatttccagtcatttaggggggagagaatgaacccctagataggaaatgtcaggaaatatgatagtagaaagggactaatgcatgttacaccacactagtgaatgcagcttgcataaagaattgaaactgccaaatcactttgtaaatacttttgtgatttcgaagagtttgactaagttgcatgaatgaaatgcaccggagaagggtgataccgaagaaagtaaaggtacccctcgtcttgtctagaggcctcgaacaaaaagaattggacaagaaacttcggctcctcatgcccctaaagtaaccggagacgtctggtgaaaacagggcaagagggactatcatactcaaagtcacgaaaaataccccaccgaatagaaggggagccagttgagatctggcaagtggtacggaacctcagaacaggcgtatcgcaccttcccatcaaggaagaaaactagctgttggagtgtacactaacgctggtacatgcccacatcaaaaggtattaagcaagaaaaagaagaagaagcatatgaaaaatgcatctcctcgtatatccatggatactcgcataaagtctcatacaaccagtagaaattggcagtgagacctatcattgaatggaattaatgaactagaagttgaaatgaagaactcaacctgaatgattgataagcattgaagatagagtcaatgaatgcatttcaggagtttggatcttacacttgcataatagtacatgaagaagtactaggtcccgaaccaacataaaagaatagaataaccagaaaagaactgaagaaaacaaactcgttcgttttgaatttgagtttgatttgaaatatttggccgaatccaaatcatgcttacgcttgcagctaaaggcatgcgacagatggaagtctagtacatcagtccaactgcacttaggaatgttcatggtgcatagctttggaatagtctatatcgccaaaatgggacggaattcctaaacacgagtgtcatagcagcacatgaatacttggctaaatgaactaaaccaaactaagcatcgttgaactgttcagagcctcggcatggttttgagagatggttacccgcgagagcaatcgcgatttgaaaactatctcaacccccaccatttatgaaattaaagcagcatatgtcgcacatatgcaaatgagttatgtgagaagcaaactcactaagcatatgaacccccaagctcctctatgtacattgcatagaagcaacgaactaagtcatgtggaagtattgcagattcatccactaactcattacttacatcttcccttgaataggtgtgcccgagaaatcggaataatgaaacttagataaatgcaaaattcagggggagaatttcgctaactcatttcagaatcttgatatagaaaatcaagtacccaaaatcaatctagaaagattgaaagaagaattgggtgaattgtactctttttcccttggataagttttcccagcagtttcttatcaaggtttttaatgaggcaatccgtgcgacattgcatgcgtatgctatgtactctttctccaaatttttcccactgggtttttgtggagttttgatgaggcatagacatcacgcggtgagtgcccaagggggagtgttaggaaacctatgggcttgggcccatgaaggcccagcccatatacactaattgggcccacactgaaaccttccatatatggaggaaggctatataaggaggagaggggtgctcatattgtacacttgtacttgaggatgatagaatgatgaatgagaagagagtctcacccctacatctcgtgtctccacttttgtagaattacgggacccttttggactacgtcgtgtagcaggagggttgcgtaatagataatcaatcaaccgtctgctgtaaataaggaaattaagagcatcaccaagagatacccaatactactcccaatcctagaattttggagttttacacaaaaaaaggaatccaacagacttccaatcagcatcctaaaaaattagaaatcccaactccataattctcgttctccagttatagggaagacccctgactcccaatccgccagtcacaggcaactcccgcgcacggctgaaatgtcccacagccgtcgcgagctcgttcgctgcagccttagtttgcgccgtcgtcggctcacgaactcatccgttgccacctcccgagctcatacggtggcccatcgcaagctcatgcaccaccggcccatcgcaagctcttccgtcgtccgctcgattcacatcactgacagtctatcgtgaattcgattctctcatcgtcggtccgccatcgaactgatctgcgccactggattcgtgccgccgtcgaattgattcgcgccgtctcagtccatcgcgagcacatccgggcggccctcgattcgcgctgccgccggacatggcgagctcgtctgcgcgtgtccctcgattcttgccgccgtgtcaaactgattcgcgccatctcggcccctcgcgagcacgtttgggcggccctcgattcacgccacagccggccatggcgagctcgtccgcgtccagtccttaattcgcaccgctgctgaactgcttcgtgccgccgtaggccgtcgcgagctcgtcccctcctccccggcgaagccgattcatgccgtccggatcatcataagcgagtcctcggacgtgtgcttgatgcccacgggagagacaggaattgagcaggagagagaaggggtagagggactgatttatgggtcctacctatcaggtaattatatagaagggaggagatcatgtggtcccactttttatgggagtaactgtatatttatggcgtcatatttttcaaaaaaaatagtcggtatgtatttactttgtaagttcctaaattagatatgtaagtttagtgtatttataatgtaagtttcaaaaattgcatatgtaagtttcaaaattacatagtaattacatatgtaagtggagtataaatttaaattttacattggaaaagttataaaacaaaagcatatgcagcacttactttacaggagatgatcaggaggaaatcgaacggtccgaacaggcacagccaaagacatgtagtctcgtacgagcaatcggacggacgttaaagccgactgagatcagcccaaaaagatgtcgacatcttttaagcaagtctccgctttttattaaggaagtcatgtttacataatctgttagaggagagtatattttacaagctcaaatcatgattagaaatctctaaaacatcatctagagaatgggtttattggatatctcttggtgatgctcaacaaagcgcctgcatgcagaagcaatcacgagattaaatagctagctaatgacggtgggccccataaatatatcatatgtgtttgtttgccaatttatctcctcggcacagataagaaccatgcacaagcttagagataatcctgagattagaataatcaatgacagtgggccacatgtcatatgtgcttgcttgaatcgccatgtcacagataattaattaatgaccaaacaatcaaactactagtaacgtaccgtttgtgaaggtagataattctttgttgagcagcacatatttcctctattatgtatcacatttgatttccatttgaaccaatggttttttatgcttaaaatgtacaacaaaacgagtccaaatttgaatatattcagacatcgtatgatatttgaattttctggtcccacacatcatatagatgttcgtcaaatatattttgtaaataacggctgcaaatatcattagcatgtaaaattaatgccaaatgatttattatttttttctatgaattttggttaaaaaattcatcaaacattctgctcaactagtatggcacattataagagttgtttggttggaggtacaaacctgacttcctgggcaccatttgcattttgtcgaggaatttgttgggtaccagtgcagcagtctactcgctccgtcccagaaaaagccaaccagtattagatatgatgtttcctagtccaataaatctggacagactaggttgacttttttaggacggagggagtctgtcagaagtcatgcgcgaaaactgtcacgccccgaactagtcccgaccggaactagcccgtgacgctccaaattaacctgttaatcgataccagtcccaggaaacagtgctggtatcacagggagacagagtatcacagcaacaaaggtctctttattatagagtagaagtacagtcatgttgggctgcggacagatcccgagctcacaactgcattacaaaaggaaagcggaagctaggacttggaccaatcatcacaggcgcgacttgggaactaggccgaaaccctaaaactcatcgtagccgacttgctcctggaagaacacctcgtcagcaggatccacttcatcttcttcagcaactgggggggggaaattatttataaagagcaagggtgagtacgggagtactcagcaagccaggggaaataagtgtttaatgcaggcttcaaggaaaggctgttgttttcataattgattttgtttgaactcttttctaaaaagtctaagtgagtgcttctcaaacgacacggatgagacagtgcgtctcgtccggtcggagtatgtgtaatgcatcaatctttagaattgaaacaagattggcacccggccaacagcttttcaaacggccacccgggccaacaacttttcaaacggccacccgggcctagctgatcccgtcagctgctgatttttcaaacatcgaatccccttttcacaacagcaatttcacaagcagtagtcaaacaaaactacgctaggaatcacctcacatccgcccatgactgtgggcacggctgttcgaacagtttgttaacctctgcagagggggtacactttacccacacgacattactaacccggatcacccagcccgtggggatcagccacgtcgggagacctccaagctttcatgacaaggcattttgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacctatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattatcaatggaaggatcaaatgtaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgcgatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggttgggaagatattgaatttctaagatttattggatttttggtctaaaggaaaaaggatttatttaaatccttttttttgaaaagaaaaagaaaagatgggagggagggaatatagacttttctcgggtggctagggtgcggcccaagagatttggggcggctcggccgagctcaacggaccggccggcccaagacaagcgcgcgcgcgcgggagggggagccggtggaccgggctcaccacgcgtggtcccgggtgggacccgcttgtcagcggctcggctcaccgtgcggagggagtatgcggcgtacgcgcgcgggcggggctgggacgcggtgcacgcgcgcggttcgcggaggaacggatgcggcgggcccacgcgcagcctcacggctcaccgcggaccacacgcacggggagaaacggagggcgcagctggccgggtcggcttatccggtcgcggccgaggtggcgccgacgtggcgcctacgtggcagccacgcgggccggcgggaggttaggccccttttgttccgccgccaactcttttggagtcgtggcgaggtagtgcgtgcgtgtgttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttaccttgctccttgccctcctaagtgcttgtctgactcttacctcgccctcttctgggagtttagatggctagccgcccccgccgtgcagcccgtgcaccagcccgctttggttttgaagatggtagagttgagccagaagaaaatcatgagtcggctaatgagcagtcacaccacagcaaccgttcgcaccgtactgtttcccgcaacgcagaggttgggcaaccccgccgcagcaaccgctcgcatcgcacagtttcccatgatgcagagatgggacagtctcaccgctctcaccgcactgccagtcacaattctggagaagaacgcctcccttccccacctcatgtggaaaacaacatgcaacacataatggcagttcggaaacaaatcttgcaaggactaaccacagccatagccagttttcagcataatgcgcatggaaatggccaccctcacgtgggcaacaatagatccaagctgacagattttctgaggtcatgtccgccagagttctctcagaccgtcgagcccgtcgaggctgacgattggttgaaagatgttgatagaaaactcaactttgtgcagtgtactcctgttgagaagacactctacgcctctcaccagctaagaggacctgctgcagattggtgggagaattactgcaatgcacaccctgaacccactaacattgcttgggatgagtttgctacggctttccgtgcagctcatgtgcctgaaagcactattgacatgaagaaagaagaattcaacagacttaagcaaggcaacagcagtgtcaatgagtacctaagtcagttcaacaagttagctcggtacgcccctgaagaagtggacacagataagaagaagatcaggaaattcttgaaagggatcgcagttggaatgagactccagttgcttgctcatgatttccccacttttcaacatatgatcaacaaggcacttctacttgaggatgccagaaaagaggctaccgaagaatacaagaaacgcaagtctaaccatcagggaaattcttcccgaggcgcacctcgccctcgctacggtcaacccatgcaatatcaccagtcggtaactcaggctaaccaccagccaggctacgcccctcgtcctcagatgaaccgtccggcacctcagccacagcagcgtgcccctagtggcaatactgcgccaaacagtgttacctctttcaagtcaccacagggaccgtcagcagttcagtgtttccggtgcaacaggatgggacactatgccagacagtgtcctcggaatcctaccaacaccaactcagggcatgctaatggcagcactgccagaactcctgctccagcggcagctcagtctcttcctagctctcaggcaagtggacaaggttctcgtgcgtccaaccactttggtcgaggacgtgtgaatcacattcaagctgaaaccgctcaggatgctccagacgttgtgatgggtatgttctctgtcaactccgtacccgcaatagttctgtttgattcaggagcttctcattctttcatatcgcaagcttttgtgaaaagaaatggttggaaaacccaaaatttgcgtgtaccgatgatagtacattcccctggaaggaatataagggcaactcaaatatgcccggaagttaaccttagaattgaggaagttgacttcctagccaaaccgatagtcctagactcgcaaagcttggacatcattctagggatggattggttggctaagcacaaaggacagatagattgtgccgaaaagtccatcaccttgcaaggacctggaggaaagcaagtccgctttacccctaacacccctaccgcaagtcggtctatcctaacttgtttacaagtcacctccttggagtcggtgcccatagtctgtgaatatcccgacgtatttccggaagaattaacaagaatgccaccagaccgagagatcgagttcgccatagaactggcaccaggcacagctccaattgcaaaaagaccctaccgaatggcagctaatgagttagcagaagttaaaagacaaatcgaagaactggaaagtaaaggttatgtgcgacctagctcatccccttggggagccccagtgcttctggttaagaaaaaggatggctctgagagaatggtaatcgactatagagccctaaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccgctttctcaacgcgttatggtctatatgagttcacagttatgtccttcggactcaccaatgctccagcattcttcatgaacttaatgaacaaaatctttatggaatgtctggaccagtttgtcgtggtattcatcgatgacatcctgatatactctaagaacgaggaagaacatgctgaacacctgaggttgataatggaaaagctcagggaccatcaactattcgcaaaattctcaaaatgcgaattctggttagaccgagtagcatttcttggacacgtgatctcccccaacggtgtcgaagtagatcccagcaaggttgaagctgtacttgcttggaacccgcccaagaatgtgtcagagattcgcagtttccttggcttagctggatattatcgaagattcattgaaggattctctaagctagccagacctatgaccgagctgttaaagaaggaaaagaaattccaatggtctgtagcctgtgaagacagctttcaagaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagctcaggcctcatgaagttaattatcccacccatgatctcgagttggcagccgtggttcatgctcttaagatctggaggcattatttaatcgggaacagatgtgaagtatacaccgatcacaaaagtcttaagtatatcttcactcagaccgagttaaatatgagacagagaagatggttggaactaatcaaggattacgatcttggaatccactatcatcctggtaaagccaacgtggtcgctgatgcgctaagtcgcaaggcctattgcaatgtagctcaaatacggcctgaccaagatcacctgtgcagagaattggagaagttaagactgaccgtggtacagtcaggtgtccctgccagcttgacagtacaacctaccctagagtcgcaaatccgggaggctcagaaagacgacgaagggataaaagaattaataaaaagaatacaggagaagaaagacacaaatttctccatagacgatcaaggcacagtttggtgcggaccacgcatctgtgtaccggccaagaaggagttaagagatctcatcttaaaggaagctcatgagtccgcctactccattcacccaggaagtacgaagatgtaccaagatatcaaggcatacttctggtgggctagaatgaagcgagacgtcgcagaatacgtagccctgtgtgacatttgccaaagagtcaaggcggaacatcagaggccagctggtctgctgcaacccctaccgattcccgagtggaaatgggaagagatcggaatggatttcatcaccggtttgccaagaacccccagcgggtacgactccatctgggtaatcgtggaccgactcacgaagtcagctcatttcgtgccagtgaaaaccacctatgatggaaagaaactagcagaactctacatgactcatgtcgtatgtagatttggctgtcccaagaaaatagtgtcggaccgaggcactcagttcacctcaaggttctggaagtagttgcatgaagccctcggaacttatctgaattttagtacagcctaccatccgcagaccgatggtcagaccgaaagggtaaaccaaatcctagaagacatgctacgtgcgtgtgccttggatttcgaaggcacttgggatcgttgtttgccgtatgctgagttctcatacaacaacagttatcaggccagcattcagatgtcgccgaatgaggcaatgttcggaagaaagtgccgcacccccttgtgctgggatgaggtgggcgaagccctggtattcggtcctgacatactcaagtcagcagaagaacaagttaagctgatccgagaacgtttaaagacagcgcagaaccgtcagaaaaattacgctgacaatcggagacgtgaccttgagttcgaaaagggagatcatgtgtacctgcgagtatcacccctccgtggtatgagaaggtttgggatgtccggcaagttagcaccccgctacatcggcccctacctcataaccgccagacgtggcgaagtggcttatcagcttgagctacctgaaggtctcgcagacgtgcacaacgtgttccacgtatcccagttaaagaaatgtcttcgagttccagaagagcaagttcccctgggtaatatcgagctggaaaagaatctgacctacaaggaaagaccgatcaaggttcttgaagaggcagaacgtcagactcgaaggaagaccatcaagttctacaaagtccaatggagcaatcattccgaagacgaggcaacctgggagcgagaagatcttctccgcgccgagttcccggacctactcccttaggtgctgaatctcggggtcgagattcttgttaggggggttggtctgtagcgcccgttccgtcgtggcgcctagcgggaaaattatctcttaaaaaccctaattgcgaaatttgtttctttgcttgttgtctagtgtccgtgccatctcaagatctcaatccgcaatcgatcgtcgagatcaattccgaatccaattccttccaaatcgaatccctccgcaaaagtctagtttgcctccctcgggttcgatgggccgaattccgctcggcccatctcttccccggccccccctctctctctcccgggcgccccctctctctctctctatctctctctctctctcgctccctccccccccccggcgcgttccccccccctcgctgctcgcgcgtgcgagagccgcgccgagcgcctctctttccgctcccctccgctccgcccgcgcaccgcgcgcgcgtgcgcgggagtcgcctgcaccgagcgccccctcctctcgcgcgagctccccgctcgcaaagccggccccgcgcgccgttgctcgcgcgcgcgccgcgtggtttcccgcccaagccgcgtcgtctgcgccgtccgcgtcgcccggtcccgctgcccagccgcgccgcccgttgcttcccgcgcgcgcgtgccgagtggccgaccgcctggtcgccgccgccgtcaccctctgccgcgccagcccgcgcctgtcgcccgtgtcgtcgcgccgctccaaaccatcccaccgtcatcgccgtcgtcatcccccggcccccgccactccgcgcgcaagccgccaagaggcggaggccgagctctcccttccctctgccgcgtcgccccgctccctcctccttttcccgattcggcaaaggggcaagcccctttctctccctccttttcccctttccttcctttttcccctctcgccggcgtcacctcctgtcgccgctttggacgctagccggagcgccagctcgccggcttgaccgctcaatgtcggtttccctcgcccaaaccgacaataccgcccatttaagcccaagccctccccctccaaactctctcattttcgcctccgcgccattgccgccctctgtttcaccgtcgccgatcgtcgttgcgcgtgtcggaggagccggcacgagcaaggacgcggaagaggactccggccgcgccctcttcttcctcttccccggcccgaggccggagagattactcccgcgccgtcggcctctcgtcacatcgcctcgtcccgcacggtagtgtctccctccgttcttcctcctcgctccatctcctccccttagatttcggtagtagctcgggtagcctccccgtagttagctggcgccgccccgaccgttgccatcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcggcccctcgtggcctcatcgccgtttccctcttccctcgccgccggttgccgccgccgcaatccgccgccgtcgagcaacctccggcgaatccgagccgttggctcgtctcccctcgtcctgtgcagccacccggtgtgctcgttttcgccggtatcgccgtggctcgctccgccgctcgccgctgtcgcccgccgtccattcgcggccgggtcgtcgtctacctcccgccggcccgcgtggctgccacgtaggcgccacgtcggcgccacctcggccgcgaccggataagccgacccggccagccgcgccctccgtttctccccgtgcgtgtggtccgcggtgagccgtgaggctgcgcgtgggcccgccgcatccgttcctccgcgaaccgcgcgcgtgcaccgcgtcccagccccgcccgcgcgcgtacgccgcatactccctccgcacggtgagccgagccgctgacaagcgggtcccacccgggaccacgcgtggtgagcccggtccaccggctccccctcccgcgcgcgcgcgcttgggccgtcttgggccggccggtccgttgagctcggccgagccg

SEQ ID NO: 23286 - DNA, 12125 bp, Oryza sativa
ggtttcggcctagttcccaagtcgcgcctgtgatgattggttcaagtcctggcttccgctttccttttgtaatgcagttgtgagctcgggatctgtccgcagcccaacatgactgtacttctactctataataaagagacctctgttgctgtgatactctgtctccctgtaataccagcactgtttcctaggactggtatcgattaacaggttaatttggagcgtcacgggctagttccggtcgggactagttcggggcgtgacaaaaaccttggccatgggtggagcaactcccaccggaagagccctgcggaggtggagcacggggacgccatcgcctccatcagggttccgcctcccgcgtcggcgttggcagcggcggcgtcggtggcgtggagtgcgtcgtaggctgtgttcgggacacaaaaaacaaagcacgctattatagggagattaattaagtattagccttaaaaaacttaaaaaatggattaatatttttttaaataactttcatatagaaaacttttgtaaaaaatacactatttaacagtttaaaaagcgtgcgcgcggaaaacgaggaaagtaagttgggaaagggagaaaagaacacagccgtagtcgttatcatcgttagcctccgccgcgggctgcttcgacgatggagaggggttgcacttccgtcgtgccatggctagagcgaggcgcgcttggatttggggcaacctgagcccgaaaatcctaatgggcgatcattcggcccgcgcgatcagcccttttctcacgtgatttccttttttagcatcccattacttgtctactttagtaaatttatgcacctaaagtttgtacatctcaagtttacacatctaaagtttatacacccaaagtttataagtcaaaagtttatatacccgattcaaatttaaatttaaattcaaatatcttatatatatatatatagtattttctataaataaagtttatacgtacccaaagtttatatacccgattcaaatttgaatttaaattcaaatattttttatatatagtatttctatatataaagtttacacgtgcaaagttttatttatacgtacccaaagtttatatacccgattcaaatttgaatttaaattcaaatattttttatatatagtatttctatatataaagtttacacgtgcaaagttttatttatacgtacccaaagtttatatacccgattcaaatttgaatttaaattcaaatattttttatatatagtatttctatatataaagtttatacgtgcgaagtttacggtacaaattctatacataagtatataatctatgcactaaaaacagtagtagattttttttctgtatttttttaaaaaatttctaacttgttttttttatttttaaaaatttatgacgtaggaagaaaaaaaagaagggaagaggaagaggagaggagaaccccgacgagcgacacccgctcattagcgatgcccgccggagccagtagtagcgttgagtcgttgtcgcgagatggattccaacttgggcctgtaggcctagagagggaatagaagagagaacgggccggcaggctcggcccaaaatagcgccggagtccgtaaatacgaacagcccagcccaccgccgcatcctcgcaaccactgtctcgctctccgccgccatcgccgccgccgccttcctttccgccgccgccgttggtactcgcgcttgccgcccgtcgagctcccctcaccgataaaggctcaccgaaggtttcgtcgtcgaccccgggaggtaagcgtcgatcccgccccctggccgttcttagggtttttcctagggtttggttccggttctccccagtctcaggcaggagatttcggtttcgcgccatccatcggagtcgcgttgcgaagcggaaagctttgcggcgaatcacgtagagcgagggaccttgacccgccacttgcacattcatgtgcgtgaagaacacgattttatgcggaagatttctgcaagccacacataagtgactgtggatctagatacgggctcccccactcctttggaaggtgtgatgatttgtgggtgttctggtagtgtgaatttgttgctctgtgaaggatttacagattgctgtttaaaatgtctgtattctgatttctgaaacttatggcaagtttagcagctcctgtatatgccgattgaaatacaagtagaattatgcacactgtagtttagttagttcaaatgtcatgggtggagatagtgtgttttctgttttacctgctgcaattggtattaaggccgtaggtgaccttgcttttgcagtttcaaatatgtctggccgaggactgatgaagcaggacttaagcaagcttgacgtgacgaagctccaccctttatcacctgaagttatctcacgccaggcgacgatcaatatcggtattgatgcaacccttttagcaatgcttactgttatatggttaagtattacagaacttatcgctgcattttttattttgtgtgttttcttatgtacaaactacatatcatgattcatgattctgaaagaatgcttaggttgccccttcataagcatttggccgtgttaactagtatcatgaaatgacctacatggttgttcttttatacaaccttacatttccagtactttttgcagagtagtttgcttcctaggttattacagttcatcagtaccataactcctccacagtggagtttcatttgcatgctattggtagtttgctcatgtagatgtaactttcctttcttctgtttgtacttgtggacttgttcagtacaatacttactttttttgtccagatactgtgcatgggagggagcattctgatttttttaaaagaaaaaaaaaagataacaactaatggagatgtttgtctctggtttttttgttgtataactagggacattgtaatgttatattatttgcatatctgatttgtgaacttcctgcagcggcatgacattctttttcattctgtaaaatttcaggtaccatagggcatgtggcccatggaaagtccactgttgtgaaggctatatctggagttcaggtattattaatgtattttattatcatgcttctttccgagtgatgaatctgaactctgcgtatacctgacaactatgtatcacatttattggtaacctgtgagttttccatatattctaccacatgatgcttagatgtgtgcctttttgtacatgcttgaataaattgcagagaactttaaaatgtattgataaaattacaccatagggtgtagaattgagaagagttgtatctggaaatccatatgataaagtagtatagaggagaatatgccccatcataatgtcattctgtatattgtagttcatgactagttgcttcacatattccatatgtagtggtgtacagttcatgaacatctttcatatttagtatttatgttcttcacatgtaattcatatatttatatttgtatagttgtcctgatgtcttccttgtgatttgtagaccgttcgcttcaagaatgagctggagcgtaacatcactataaagcttggctatgctaatgcgaaaatctacaaatgtgaagacgagaaatgtccacgaccaatgtgctacaagtatgcaaacaaaccactagacaacatgatctttttagtgtttccattgaatatctgatagaaattgtcagtagagactcaaatgattgattctccaagaaaataacttaataaaattagttgccattcacctcttaggattattgctttggtgtgaagctcttatacaatatgtgtgctcttgttcactctttgttgactttagtttcctattacataaagggcttatggaagcggaaaagaagatagccctcactgtgatgtgcctgggtttgaaaacactaggatgaagctactgagacatgtttcttttgttgattgtccggtatgatgaaatccctttccctgtcaaatatgaatcctctcttgagacacggcctgatcagtctacctgaatgtttaatgatattgctttatgcaattcattgctttgcagtagcatgtatatttggttttaaacatttcggtctgtcaattgtgatcatggggttgtagttgcatctgtttttagatgcaaatattgtttccactaataggtgcatgacaatatactggaggactgaaggatatagataaaagaaattgtaaaatgctatcatttcaacttcttttatgggccactaagactaggtattggtttacatttgttgaagcctgagaaattacctatttcctcttaacagggacacgatattctcatggctacgatgcttaatggagctgctatcatggatggagcattgcttctgatagcagcaaatgaaagttgcccacaaccccagacatctgagcaccttgctgcagttgaaatcatgcgtctccagcatatcatcattcttcagaacaagattgatcttatccaggaaggtgcggcgatgaatcagcatgaagcaatccagaaattcatccaggtcactgttgcccatcatttcttatctagtagattatctcatctgtctttttgtttatggagatttttttttctctgcagggcaccattgctgaaggtgctccagtggtgccaatatctgctcaactgaagtacaacattgatgtgatctgtgaatacattgtgaagaaaatccccattcctgaaaggaacttcacttcccctccaaacatgattgttattcgctcctttgatgtcaacaagcctggttcagaggttgatgaaattaggggtggtgtagctggtggcagcattctcagagtatgtgttctctcctgtaacataattaaatattttaatcagtagttttttatgttaagtatgagctgaatggtaatgcttcgttccagggagttttgagggttaaccagaacattgaagttcgcccgggaattgtaatgaaggatgagagcggcaacatcaaatgcaccccaatctattcgaggatcgtttcactctatgctgaacagaatgaactccaatttgctgtgccaggaggtcttattggtgttggaacaaccatggatccaactttgacacgtgccgatagactggttgggcaggttctgggtgaagttggatcccttcctgatgtctatgtggagcttgaggtttgccataactcatttgtttcttcagggttttagtgaacgaatgtcattacttacatctgaacctttcacacagatcaacttcttccttcttcggaggctattaggtgtgaggacaaaaggcacagagaaggctgggaaggtctccaagctcaccaagggtgaaatcctcatgcttaacatcggatctatgtcgactggtgctcgcgtggttgctgtcaagaacgatctcgccaagcttcagctcactgcccctgtctgcacaagcaaaggtgagaaggttgccctcagccgccgtgtcgagaagcattggcgcctcatcggatggggccagatccaggctggcacgacgctcgaagttccaccatgcccgctctgaattgtgtttctccaggcagaaatcctaatctttgagagaagatagaagagatgtggaagggcagagagctcctaggcactatttttgtgaggtggatgagaaaacatgaatttgatttggaagccatgtcattgcgtgctatcgaattcagctatgctacaaaagttttgcttacatctgcattctgaattatggagaatcgttttttcaccatgttataatgaatttgaagtggggagaaacctactaattgatcagaattgcattattgcatttctcactgaatccaatcagtgatgtattattgcattgaacatgttgcaagaaaggaacatatcgctctggattttctttttctatcttctcctcccttaaaccagttgtgacttgcgacgcaaagaatctccatacgaacatgactatttactagcatatcatcaaaagtttcaaaatataaaccacagtaaccagctaaagaatacacaagaatgtaacctttgcacaggtatcttctacagtagcagtcaggagaaacagttgttcgattcaggatgagcccccatttctatacgcaaccttacttaggctaggcactggaatatcaaaagctatcaaacaattgagatttttgaggcagttgaaaaactaacatctaaattctaaaatacccccactctacctgtgattgtgcaattgaattacaatggttaactatcacacgaatcagagctacaaatcaagaaactaggatgtctggaaatctctctactcagcctatactctaaaattgctcccagaaggcggtctcaaccttgattcgatggaccgggcatgtcagggttgtcgaacatgacattgggcgctgccgaggttgagggagcgttcatcgctgacagaggcaaccgacccccgaaagagagcatctgcagctgccgctgctgctgttgctgcagctgctgctgctgctgttgcatctgctgctgttgctgctgcaagaaggcctgtcgctgctgttgctgctgtagttgcatctgctgctgttgctgctgcagctgcatctgctgctgttgctgctgtttttgttgctgttgctgcatctgctgctgcaagaaagccatctgtgggtgcacctgcatgttattggagtagaaagctggagtgccggcctggggcatcgatcccggtattcctggcggtcgaatgttcgcttgactcaatggatttgaggccatagtgttgcctctgggtgaagctaaccgaagccctgacatcatccggatgcgctgagcttgcagcccctgcctcatcctctcggactgctcactgtccctcaaaaggtaggtctcgatgtctgcaaattgcttcaacttcaactccagcctcttcaactgcaaatgagtattacaaaaataacagcaaagagtccaaatgaaaatgatgaaagccacatcaaatatcagccagtatggcataatcaagtgaaaatgacatattggacagtcattaacccccacatcacatgcataaatttcatatcagatttaggaaccaactcctggaggacaactgatgtcaattaccaggtggttggttaacactaaaacaggctactaggctagttaaggttccaaagataaatcaacattcaaccccgctggatcctcctggttttaactaaaagccagttttaaccctgggtaattaagtttctgaaaacttattaaaattattgtcacaggaggatctgttttatccacactccaaattagctagaatcatcaaaacttgtaaaaaaaatctctcccactgggtaaagccaatacttgccgaatgggcgttgatgctactcagtgactatcttttatgctcagaagtcacaacctcttttgtttctcaatgcttggtcagtttgttgacatgtcactgtagattgtgaactatcatcgtccaatcacaaactgaccgttgtgatccatgtttttatcaaattagcataatattgtttctgcactatagctaattccattcagaatcagatttcaaggcttcttcaagtccaaaaagaaatgagcaaggactgataacgcttcatctatacttcctccttttcatattataagactttctagcattgcccacattcatatatatgttaatgaaactagacatatatgtgtgcctagattcatcaacatctatatgaatgtgagtaatgctagaaagtcttataacctgaaacggaagtactctatactactataaatgttggtagtggtagtggtagtggtagtggtagtggtagtggtagtggtagtgaatctaccaccacaacaccctatcactgacgtgtcggaccctcaatgtcggtgaaaattttgtgctccctagttcaaatcctttgattccgtggcaacacacgggcaaatcagctagtttaatacaaataaaaacaatgccacaaaagaatatgaagctaactagattgtcattaccattagaacaaattgcagaatgtgaacttctgtattccaacaaacctgatgatttatgatggtagcacttaatctctgaatttcacgctcctcctgatccgcaaaaagtttacacttagttgctgctgccgacaagccacatcttgcagcatgtctaacattttctgaagagacagccaatgaggaatctgtattaaaataaaactgcatgttagagtaacatcttgaaaagaaagactgaaggatgcggaattactaattttaggaataaggtagtcaccacagttcggtcgagcagcatggcccataacatcattgccaattgaactgatccttaattgatgaacattattgtgttaagagaaatccagcaaggtgagataaagtgaaaagtaagtgtaaagacccgaagtagaacaatttacactccagttatagaactggtataacatgtcggagctaagagttcattaatctcatccctaaacctcccttacacagcataggtggctcacctggagtcacctccagtcaaaacaattaatgcttcacttgcacaggatgccgcaactcttggtcctaatgaagaggccaaaaatgcaatctgcaaatcatctctgaacagtaaggccagagacataatagagatctacaataaactgacaagatctggggagaatgatccagtatgtgggagattactatcatagttttctacctatctactaagttccacctagatattatgtttccatgtcttgtcccatgccgcaagctatcatgttagttctaaatgatggtctgcacgagatattaaataataaaatgcccatggctttgcaactaaagctgtggtttgcctatacaataaatcccagctgtcttacatcaggtgttttttaatttgagaattcggtcaatggcaagaaactatgtatatcactaaaagtgggctgtataaaagcagtgaagatgactgatattgcaatggagcataatggtttcagcacccaaatttgaattgagcagtgcaatgacataataaacaacatagtctgcagtcactcaccagtgacatgacaggattagcagtgttaatgaaaggaaggtctccagcttcgccgctttgaggcaagcttcctaaggcaaacaattgtggcaatttaaaaacggagccagaagcattttgcatcaaccaaaactgatatccaacacaaaaaaatgttaagtttttcagtaaagaaacaatgaataaacctgaagtactgccattggaatttgaatgcaaaaaaccattgttttgtactttcgatgaaaaggatgcttctggtactttaatattctctaacaatccatcttctactggaagacgaagaaaatggtgaagacattgtattttcgactttgttccaacatgctccgcaacagcattccagttttctttgtatttgtctatgccctccaataacagaaatgtttcctgatcagtccagctgtccccatcattgtccagtccatctttcttcccatccactctctgaaaatctaagcttgagtgcccagtaacaaatcttgcatcgtggaagcaatccgagcaaagagcaatgtctgcctgcttagtcagttaaaaggaaagcctgaaacacctttacaagcttctttcagaaagaaagggatttctcaagagaaagcagaataaaattactaaatacgcaagagatatagatatccatgaagatgcacatgattcaagaaggcactttgtgcaagagggtcaacaggggtggcaactaggaccagcctaactagagaattctaagcaattatcaggcatattacaaaagaagataggcaatactacctccattattattttactttacaatttggacatcgacacaatatccaatgcacatgtctcatcattaacttttcttaactttagatttataaaaattattagaaataactatatgaaagtgtttttcaggacaaatctgttaatacaattcacatataaaatcctaatatcttattaatgatacacgatatcgaggtttgattacacacattctagaacgtcatctatttgagaacagaggtagtagaacactaaaatagcagaacaagagccctgaagacaggttagcctaatgcaccatcctaatacctaatcactgcagttatctagcgcctatcggtgacttttagaacactgcatatgcacatcaatatcttaaatggatctgctacaaaaatgcagtttcgcacactagacaatacaccatccattttacaatagttgtccagtgcacatacatagaagatacaaaactccttattagttcaattggactctgattgttcttaagatcaaattactccatctaatggtgtcaaatataatctaattccaccaaatattattactggcttgtgtattcaacatttgaagaatgataaatatctaattggcagtcagaattatacacacctccttttgtgactcgtagtgcaagctaggcaaaggttgtgcgcagaaactacaaaagctctcagacaatctctccaacaatgtcttctcatcaaaaccagcatcaccattttccatccctggagaagatgaaagtgatgccccagaagcaatatcctctgcccggacactgcattttggtcgatcaaacaaaattaaaccatcaattgatttcaatggagcagacatgagatgcagctcccctgttggctcctctctgattagtgttgctgccatcctcaagccccgttgaacagacccagccgcaaggtaattaataatcccccaagcgtccaaaaacctaacaattctactcaggtcatacaattcaggcgtgcttgtgacaagcccttggcactcagaaaatgcaagcctcctcgcaggacgctccagatacgttgtaattaccctattcctcaacataatgtatttctctggcgtgtgccccggggacttccctgagaagaactgcggcagcacttgcctctccaacctgtgcaccgtcattggcaagaaccaatctacgatttccaaatcaacccataccacacagcttaagtcaatttagtgttcagctcaactagtatggcacatttcaggagctcttcgattcaaggaaacaaacctgaatgcttgggtaccatgagcaatttgccatcgaactgcttggccacgccgcggcactccatgagtagaggaggggtgcagacgtaggaggacggcttgtcggggtcgttggacaaggacgggtggtcagggagcacggacgagagcacctggagctgcccgtgagagatgttctcgagcgcggggacggccgcgccgccgccgccagcaccagcaccagccgcggcggcggcgcgctccgccgccatgacggcgagcacggaggggtggagccggttgaccacgcggcggaacgcgggcgggaaggcggagacgcgctcgatcgccgtggggtgcacctcggcctcgcggaggtccaccacggggtcgtcatcgcccccgcctagggttccgcctcccccgttgacggccgcggtgcccgcgtggagcgccgcgtcgtcgtcgtcgttgtcgtcgttcgccgccgcagccaccgcggagtcggagtcgtcggagtggtcggccgcggaggtgttcgcgttgcgcttccgcttccgccacttggcccgagcatctacaggggaggtagggttttggccgccagcgtcagcgcgggaggaggtccccgcgagggggaagtgcgaggcgaggagggggggcacgtacctgcggaggaggtggccttgcgaggaggcatcgtcgccggcgccggtggcggaggaggcggcgacggcgacggcggcggcggtgggggagcttggagtgttgccggcgagggaggcacgtgcgaagcgagtgaggaagggcgttgacaccgcggttcgaatttcttcccactttttcggcttttgctatccaatcaaatcattcaagcttgagtattctatagtgtc

SEQ ID NO: 23287 - DNA, 16102 bp, Oryza sativa
  unsure (1)..(16102): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgccgattatacaggaaacataccaatttgttcccgcagctcctgaaacttgattcgagaaagcggcttcgtcaggatatctgcaagttgcccttctgtgccgatgtaactcggtgtgatttccccattctccacggcttcacgaatgaaatgaaattttgtttgaatgtgcttacttcgatcgtgaaaaatagggttcttcatcagggccagagcggattggttgtccaccctgagatcgacgacttcagttgctgcattcctgaggtcaccgaggagccgggcaagccaaatgccctggcatgcagctgttgcagctgcaatatactcagattcacaggaggagagtgctacaactctctgtttttgagactggcagctaacaggatttttgccgagaaagaaaattactcctgtggtgctcttgcgagtgtcaatgtctccaaccatatcactgtcactgtaaccctgcagtcctccttcaccttccttcacatagcggcacccaagatgaatggtaccagcaacataccttatgatgcgcttcactgccgccaagtgttcgtccgtgggtttctccatgaaacgactgacataaccaaccgaatatgcaaggtctggtcgggtgttcaccagatagcgcaagcttcccactagacttctgtattctgtcgcatcaactagcgatcctgcactttccttgctcagctttagacgtggttccatcggtgttgcacaggggttgcagccggtgagcccagccttctccacaatacgcgacgcatacgctgcttgctttaaagtgatgattccagcttcttgatgtacctcgatcccaagataaaaactcaaaggaccaagatcactcatcttaaattcagccttcatctgctctttgaatcccttgatcatgccactgtcacccccgacaattaccagatcatccacatacacaccgacgagcagtcgcccactgccatcgccgcgcgcgtacagcccatgctccaacgggctctgcttgaagccaagtttctttagtgtgcagtctagcttggtgttccaagctctgggtgcttggcgaagaccatacagcgccttatcaagcctgtaaaccttgttctcctgtccatcgatctcaaaccccggtggctgaacaacatacacctcctcaatcagttccccattgaggaacgctaatttaacgtccatatgatgcaccatccaaccttcctgcgcagcgagagcgagcaacaaacgaacagaatcaagacgagcaacaggagcgaatacctcatcaaagtcaattccagccctctgcacgtagccctttgccaccaatctcgccttgtgtttgacgacgacgccctgagcatctttcttcagtttatacacccatttcagcccaattggccgatgtcccgaaggcagatcgacgagcctccaggtcttgttctcctctatcgaagagatttcatcgagcattgcccgacgccaatcctcgtcgcgttcagcttgagcgaacgttgccggttcttctccgctcaccatcatcagctcttcctggacctcacgattagcgagacctggcagcatggccggccccagcacattgtccatcgtgcggaaacggagtggtgcgtcatcgtggtctgcatcaagattagcagctgctccagttggtggcgacacaaattcaaccgccggcgcatcgccatgcaccgaaggtgttcggccggctgtcggtgagtctgatggcgttcgcggcgatgatgaagatcgagcaggcggctccccagcatcttggcgtgttcctgacagcgagccaggatggtacaccgtggtgtactcaacgatgaagtcggtgtcgagatcagcggccgcctcagcatcccagtcccactaggccgcttcgtcgaagacgatgtcacgggagatgtgaacacgccgagtagccggatcataggcgcgatacgccttggaccccggctcgtagccgacaaagatcattggacgactcctgtcatccagtttcttcaggttcggggtggtcgtcttcacgtgtgccacacacccaaacgtgcgcagatggtgcacggccggcggaacgccattccacagcgcgtacggggtcttgccgccgatacccttggacgacgacctgttgagcagatacacggcggtatttatcgcctctccccaaaacatacctggcagccccttcgccttgagcatactccgcgccgtgcccaccacggattggtttcgccgctcgacaacgccgttctgttgcggagagtagggcgccatgagctcgcgccgcattcccagctcggcgcagtactcggcgaactgtgtagacgtgaattctcccccgcgatccgtccgcaacgcgcggagcttgcgtccactcttcctttctgccgccgcctgaatacgcttgatggcagccggcgccgcatctttggtggagaggagggcgacccacatgtaccggctgtagtcgtcgacgagtagaaggaaatagcggttgccactgggtgtcgccggcgtgatcggtccacagagatctccatgtagcagcgccagcggctcgtcagaccggcaaagtgcctgccgcgggaacggcgacctccggtgtttcccggcgagacaggcctcacagacctgatcaacctgcgacaaacatggtagaccacgtaccagctcctccttgcccatcttgcagagcgccctgaagtttatgtgcccgaggcgagcatgccagcgccacgcgtcttcgtcggcgtgtgccgccaaacagacagggcgcgccaggttgatgtcaagcatgtacagtcgccctggggtgcgagggatccgggcaagcagacgccgctgctcatcccagacccgcatgatgccatcctccgccagcactttgaagccggtctcatccaattgcccaatgctgataatattggcagcaagacggggaagataataggtgttcgacagagtgcggtgctcaccattcttgcaggcaaagagaattgtgccccgtcctgcgatccggaccacggatccatcgccgagtcgcacgttcccggtgatgttcgtgtcgaggtcggcgaacgccatcctgctgcccgtcatatggtttgacgcgccggaatccataatccagcgcccgggatcatggtcagccgcgtcgtcgagcgctgcaaatactttcatctccacgagttccaccacggcttggtggggcggtgtgggcgtgtcgccctccggcgccgccgcgtcgaccgtgtcaacgcggccgccggtgagcaacatcaaggtgtgctcttcttcatcctcctgggcgacgtgagcctgttcttcgcgcttggacttgctcctgcagtccttcgcccagtgcccaagtttgccgcaatttcggcatttgtctcccttgcgcgccgaaccagagttcgtgctctcggggctcgcagtcccgccgccaccagtgcgccctctcccgccacggcgcttgccgcggccgccagagccgcccgagtcaccccgctttgcctcttgatccttcttcttctgacgttcagcccactcctcctcagttaggtacagcttcccaccggcggtgtgcgacgaggattgcccagaatcctcagcggctttcagtctgccagtaacttcctccatggacagagtagagatatcgagaagagtttcaatagacaagatgagttgattgaacctgggacgagctacccgaaggtacttttcgacgactttatcagcaggttcaggatcaccgagggttgcaagctggttgacgatggttgtgagccgtagagcgaaatcttccacggtctcgtcaccgcggaacgcaagcgattcatactcagcgcgcactttctgtgcactcgccttgcgaatccggtcgttgccgactcgcattgtcttgatgcattcccaggcttcccgggccgacgctttggtcgccagggtgccaatcatctccggcggcacggcactgcagatagcgtcaagagccatccggtcctcatgcagagggacgtccacgccgtcgggcttgatcgccgcccacaggcagcgagcctgcagcttgatcttcatcagtagcgcccagtcgttgtagttggtcttggtcagcagcgggtagttcaccgagccgcctccttctttcaccacgcggtggatcaccagcccgcggtcacccccgccgctgcccgtggcgcggccgccggagtcatgaggagtgcgcacgatcggtgacgacgagcgacgacgcggcatgaagacgccttccaatgcgcggtcacgagtccacttcctaaaccgtgctctgataccaattgttaggaatttccccagcgatcgctagcaggaaaccagacgaacacaacgcacgcgtactgtggctaaacctgcaaattcgcagaacagaggaaacagagcaaattttgtgcagcgctttactcagctgcttttctgtttacttccatatataaaggaacgaatacaacggaaacaactaaccaccaagaccacttctcacgccatgctctagctgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaaacggaaacatgcagataactaatcaactaactaaccgtggcacacaagattactgctaacactcgccggcatccgcgcgtggggaggagctcgccggcgtccgcgcgcgggagaggagctcgcctgccttccgcgctccggggaggagctcgccggcgtccacgcgcgggtgtggagctagcctgccgtccgcgcgccgggggagaagctcgccggcgtccacgcgcgggggtagagcttgccggccggccgtgcgcctggggaggaactcgacggccgtccgtgtgccggggaggagctcgccggcgtccgcgcatgggggtggagctcaccggccgtccgcctgccgggggaagtgctagccgtgctttggctttaaccacgcggtcgtcgtggccacgggagctagccgtgctcgatcgatgcatatgcatgctgagcatgcttgcatatgctttcactgttcccgatatggttttagataagctaagtagctcgtcggccgtccacgcgccgccgccttcttcctcctccctcccctgactgcggcttcggggaggagctcgtgcttcgtgcttccgccggccatcgtcacctctcccttcgtgcttcgtgtttcggccggctgatggaatgtaagagagacaaaaatgagagagagagggggagaggtgaggatgaaatgtgggccccatgtcggtgggttccactatttttttttgtgtgtgaatgatatgttggtcccacaattttttttactctaatgccacgtaagcgacacgttgaggacacgcaggacgaagactgggtcaacaccgccacgtggacgttatgtcagcctaaaccgcttccaaaaccacccagggatatagtttgcaacagtcttttaatagttggaggagtcgatatacccggttttgtggttggaggtcatgaatcatactcaggtcacagttgagggagtcaaagtatactttttccgagcaatctcgataggatttgccaaaaactaatgggctaccattcatagcgctgggccgaattccgagcccatgggaaagacgcgaaggatatggggtacgtatcaggtgtccctctgttgggcgctgtagcaattagtgcgaaaaaaatgtacccaggtcctgatgaccgtacagaatacaagaagcgctacatccacctgggaagctacacatatccgagcgtccgcgaatatatttctcggtttcttcggctttcttccccaagtccggctcgagtttcatctctcgacctcgccgtgctcgtgctgttgtgcagcggtgcaggtgctctcttccacttcctccctccctcccttcctccctccatggctccatctccactggcgtttccgccgcaactaaccaaccccttcgatccgattgcaggcgttcgatcggtgacgagacgatcggagacgcgccgatgccgccggtgcctgtggagcacgaggtgggcgcgagggtagagtgcccggaccctgattcaaaatgtatatgtccttctcttcgatctctctcgtttggctatttcttggctgctcgtggttgtgtatgcgcgcgtgccttctgctttcccccctgtttgcatttggtatacatgttcgattcaaagagagagagagaagctcaacctgaaatttttttttttcagatggagtaaacatggtgagagaccggcttaaagacagaactgatattctgttcaaagtaaggatattggtttgattgattgcactagtttgatttaccacccggccgtatactcatttttttggttttgttttgaagctgaatagtgtggtctggatttcacccagtagcacgtcacttcatgagcttttaggtatgaagatatctatacttgtttttaacttcttttttcgaggggactactttatttttttaacttcatgatccattatatatgacgcactaacattatttttcaaaaaaaattggaggaggagttgcgtccgatttcacagatggacatgccagcaggtgtgttccgcttcctttgttgtatttagaatatgtggcccattataaaatttgctcttttttccccatgaatgtgtatccataattgctgattgatgtatttagaatatgtgttttatagtttttctggcaggttacaaaagacagagttggctcacaccatatgtgtaacgtcacaggttagtttcccaaaccacagctttctattggaacgcgtgaggatatatttcttattttacctaatgaactacagcttcctaccggaacgcatgaggctacaggcaaaattgcctacattgacacagagggcacgttgtatcttttgaaatgctgagttatacgtctcgctgtttcattttgtgaattcatttgcatccctattcttctaaaactgtttccttaatagagtttccagtgaccctgaaaaattagtcaaaattgctgagcgattgggtgttgaagccactcctgttatccaaaatgtagtatattccctccattctttttattcttacattccatttctggactaatgcacgaacatatttctgcctcttacattctttatccatttcttaagacggtatatgcgagtgcatacacctatgaagacatggaggccttgttgtctgatcttcaatccaagatggaaaaggaaccatttaagatgctggtacgcatgggttcacaaagtaaatctatattgataagttacacatctcatttaggggaatattaggtgaaaaccatcaaataagtgtaaacccatgaaaattaaatctagaggttttctaaaatcatgaaaaaaaatatcctagagataggtataggcatgaagtaaattaccaccaaatctcaagtcaaaactcaaattcattttgttcctaccaaatgaagtttgagttttgacttgaaattttctggtaatgtatttgatgactagacctatctttaggattttttgtcatgaatttagaaaagttataggtccggttttcacatgttttgacttatataaatatatatctgatggcctccactggatattttctccctcatttattctcatgtggtattttgttcttacatatagataatcaattcggtgacaacattgttcaatacagaactctgtaatggctgtgcgtttgatggatgtcaggtattctagcaattaaattcttttctggtagctgtatgttagttggaaattaccattttatctgcatgcttaaagtcatggctatgtaattgcagataaagacactagagatgatgtattgcctaaggatgatagccaataaatttcatataggggtgtatgtcacgaaccatggtgagattttacattttgtgtgttccagttaaaggaaaatgctttattcagagtaaggaattggaaactgtgacttatgagcctattgattgctaatccagaggaaatgggtttgactgatgctaagattaagaggtcactcaagcaggggctatacttcaaggaagtaaaagatctccgtaaggtaagaaagttgtatttaaactactgtttctcgtaagatttagtgttttctgatgaccaaatggcaatctagtaaactaattgttcttttgtgcctctaatttattttgctcttattttgtagctgaataatgctgttcaggtcactacaggaaacagttcccttggtgacatgcatcaaggtggtgatatgcatgaaggtaacacacttaattacccctcagttctgttctaagcaccagtgccatttggaattataacttattccctccatactccatttggagttatgtctataacagaaagatacaatggatgcacaaaaactgtatgcggacgaaaacatgaaactgtatgcgccaacagccaaaggctcctggtttgttcctgacttcctgtacatcagtatagtttcagatacaacccaattcacataattacagttttaacgagcatgcagctgaaagtactgtgttatgaaatggttttcaactaaaaaggttttttttgtgaaactacttttgaaagagtaattctttcatagattttgcattataactgtagttttgtgaaattactcaaagtttaagtttaataccatggattttgcatgacatcttcttacagatgtatttttgggtctgcaggattttagaaccaaaatcagagtttcttatccaaattcctggttttatcttgatgcaagtccagatgataaaatcaaacagttatcacagatgatcgagaagcgaatttcactatctcgggaaagtttttatctgacttatttgggccgtaagcttgaacccgaaagtactcttcgagaacttgggcttgtagtttcactgataacatttgagttgcacgtacgactacgtggaggttgtccagacaaggggtgtgtaacttctttctctcagtattacctttttgtttggaacaactctagtttatcctcttagttattcttatttttgaggactaacctttttttcgcaattgttctaatctttttgtcatgtaacaagcaatattgttattaacctctaatgtgtgacttattaacattttatagaaatcaatcactgcgggaatttattgcaagcaacagcgtgtgttggattacaatgtctcatgggaagaatctatactctaacagacttgtaagagaagtgcttgtaagatatccggggcaaaaaggaatgcgacaggtggttaagttagttatgcaacctttagccatccgtatatgtaatgggattgcatcacgtacacaaggcacatgatgcggataagagttggaacggatcaatttctttagaaacatttaggatggttgatggttgtatggaagtttcacaacatgctgtcaaagatttagatgaaactagcgtctgtgaggactataagaaaatttcaaaactgttcctggatatgttggagctcaacaagggacatcctttatacctcagtcatttatgcagtaagatgaagaatgctaatgttacttcagcaaagagcaatacttttcaattgttcttaagagttcatccatcattgatgacatattcaacacgttcctccttattgtgggagatgaaacgtgaaatcgatggattattacctcccaatgcaaaaaatattcagtctgccattgatcaaattttgatgaatagagattggacactacttgctaaacaggaagctgctttctcacctacctataacagaagttacaagaagtcgtcaagtgaatgcttcaagttcattcgaaattggttaactcatgggatagagaacttcaatgtgagtttcttttctcatttaattatcatcatctgttattcttccatgtagttatgtttattctcacttttttttattttcttttatagacctcagatccaagaaggtttacaactgaagatatggactatctattggagatagtcttcaaagattttctagctgatattgtctggacgttgctacaaaacaacattgggaatttaaacagatggtgcttacctggtccttataatttttgtgaaactgtgtataaactagaatatctaattctatttccatttcaggtttgcagatgtacaagaaaataactctttctaggttgatttgtggacagaacaactaacctgtgtacatgtaagttatcgttcatcaacaatcttttttttccatgtgcacgaaataaaagatgttcctaagaaaacaatatgttctataacatatttgtagtgacactatttttgatctttgcttacaagtgttcctcctgcaacagtgaaaacctctcactcccgcgaagtggcctcagaagtggaccaatcaaaagatgattgcatgacattgttggaacagggtgaagaaagctgctgaagaaacttgaaggacatttgcttcgcctttctgtagctcttaagtctgcttccttgctgtgttttgtttctggagatagtcgtaggtctgtcttttgatgattgcctgttcgagatgagggtggtatcttttggtgatgcgacgatctgatactgtaagctggagtcccaagacagaataccattttttgtaaaccctggttcatgctttctgacaaagctgcacgaaacatttttatcactcaactttcatattgtttcatcttggcaaatggaccacaagagaagtatatttgttgtaagcatagaaaaatggaagaagaggtagatcatttcttcatctccataggatgaatgcttgaatggccataatgaattggactcatgctcgatgttgtgagttgtgacatgctcatctgcggatgccataggtcaacttggcaggatgttttatatgccaaacttgaattcagactcaggtctcatttttgcatttgaattatctatgtggtaggagcagtatagacggggagaaccatactttgaatgcccgttgcggatttgagacaaatggctctcgcgtcgccctcccccaagggcggctcgggaggcgatgacccggccaccccctctcccccatcttcctcctccgcctcgccgccgcctgagcggccacaaggacggcggcggcggggctcctcgcttctcgtttcctgggcggccaggggagccccctatgcggtggcggcggcggcggcagtgaccaccaaatccgcaccgctccggctaggggaaccccctgggcggcggcggcggtgaccgccaagtccgcgccgctccggctggatctagcggctggcggcggggacggggacggcgacggtggcggggatggcgacagcagcggtaggggcgagggctggcacggccggcggctggcggaggggatggcgacggtggcgaggatggtgatggcagcagggatggcgacggcgaggcggatccggcgcacggaggaggatctggccccctagtggctagatcggacgaggatgaggcctgctgtggcgacgacggcgcggaggtcacggcggcggtggcgcggtggccgtggcggcggtggcacgatgcttgcggtgacggcggcgcggagcccgtggcgacgggagcagatggccggcggtgccagtgggtggttggttggccggcgacagcagcggctgaaggcggcggtgactggcgtggggaccgcggcgcgaggaggcgtggaggcgcggcatggccagaggctgcgtaggccgacgaggcgctggcagcggggcggcggggttggccgtggcacgaggcttggccagtagcggcaatggtggtgccatttgtggtgtggtcggcggaggcagtggtcggcgcacggtggtggcaggcataggctggccggtgggaggggcgtcggtgcagtgttgctcacgcgccggcggaggttagatggcagtggagcatcggtgcgtcatcggggataagctggcggtggatggcgggtgaaaacccagcccggctttggccgggccggcaatgatggcgctctggcatctcaccccctctagtggggttgccgggtgaaagctcagttaaggttcttgtgacttgacggacgacggcggcgatgccttcgtcgtttctctccctagagatgtcgtcatggcagcacccttgccaaagccacccaaataactattgcgagctcactttagagtctcttcctctcgtatcgacgtcctagtttatacaagctggccgtgtcggggggctaggggggagagcggttccatcttctctctcaccctgaatcccttatatgtggatagagcgggttttgtgtcaggtgtaagggttgggttttgggcgttccctgttgtagttcctttgttgacatagcggtggtcggtcacgcttagcgacggccggtccggtgctagcctcctcttgggtttgtgtttggcgctgtcggtgtgtgggtgatggtatacttttttttcctggttacggccttccagggttgtaatcttgtaatttttttctgctctatcagtatgaacttcgcactgtcattcaaaaaattttttggttgaatcatatatgattttgtaatttggaggaaaggaatagaacaatcttctaagattaatgcatctgatatggcgcacgtgggacgtcctcacggaaacgtttttgcagtttaaacacaaaacctaagaaggaagacactgcattgagatagagaaaatatcttcaacacactttctaaacaaatagtatgatcgattttgagaagaggaaaaaaagaaggaattagagttctagacaaatataatctattatgagaaatgagagaaaatagaaaaggaattagagaagaatgtcttcaacacactttctaaacaaacatgatcgattgtgagaagtaagaggaagtgaaaaaggaattagagttctaaacatattagaaaatataaattgcgccataaacgaagatagacattatcgtttctatggttgcatcctagtgacataaatgaagataggaattgcgttagacattgttcatatgtcctaaggatgccagattaaagtaatctagtaatggccttgtacttttgtacatatctaaatttttctccaaaaactcactatatatctcaattttcctcttcaaatgtcctctctttggcccagcgaaaatgtcctctctttgggcttatcagccacctcctaagtaaaaaaagaaaagaaaacaaagtgtaaacagacagttctttttcattggcttttaaagccatataaaccactcttgcaccaataggtcaaagctagattttagtatcttttttcccattgtgtggactgaagttaggatttcaccctgggacatgtgtcttaaagccaactgcttaaaaacagtaaaagtaaaatatataataaccttactagaagggcctaaacttctatgaagacaatcgaaatagaaagcacaaacaacaaatcttggaatgctccatccaataatacagttcaaactgtggcagcaaaggcatatctaaaaatctcacagcaccaaagcccacatgatcatcttgatagtggacagtcaggaaacatgaaattggattcgatgtcttcagtcctatttactgccacacttgctgtcatcctaacctgaagttcagagtgcagacttcaataaagcatcagacagtgcatcactttttcccccaacatgaagttcatagtgtagactataaataatttatgggtaaaatttttatatgtgttcttagcgatttaaaagccaatgcttgaaaaaaaaatcgatgatacaaacatcaaaatcaggttttaaaattcaaatgttcatagccgcttatatgttgcaggacagaagatgggatccagtgtttcattttcccctctacatgtaaccaagtacttataataaattacttctaactgtaactctaaatttttctctaaatgattgtaaattccaaattcaactaatatgtaaacaaagtgcttcaaatattgagaaggatgttctataacttgtccaggcgaaccattagtgttgagtgttgaccgtgtatcagaatatccccatctaagcaaaagcaatagccaataagacgggacaaggtactaaggcaacaatcttcaaatgaactattctccgtaatcttgagctatgacaacccacatgtagatttcaggatagcaattgtaattctaaaagcgagccttctagcaggctaagaatttacttgacaaccattgattaaaaacttggaagaatagaagcagtgttttgctataactttctgtgaggctcaccgaagaaaaggtttacatgttcttccaaatttagaatttaacaggttatgattaagctgtcaaccagtttgatttacaagccggactaaagctagcaccaaaatttcaatgcaggtgctgtcttaccaaaagaggatgcttaaaatgactttgatcgattaacacttgcatggtcgtttatggacttgttctagaatgtggcacagctgttttcatgactaacttatgttcccatagttgagttcctgaaatccaggggtatggaagacctattgtcatgacggaattgttgagagcgacaatgggataggatatcactagcagtgaccaaattggattggaagtaagttgggagagtgctgaatgcgcttggttgagtggccagagccctaaattatgtaactagacgacccaacctcacaggttgagccagatggtataccaagtacgtgattagatcgaagcatagatcaaagccatacaagagtcataggaccaagaccaacgacatgcacaacaatatgcaaaaaaataatgagtgataatacattgaaatcattcattacctgactgtaattactttgagagctcactagagatgtaatatgggttgaacaacagccccttgtattcataccccttctcaccgtttggatagttcttgcacgacacaactgacttggccctcatgtcaactgtgatcatccagacctgctcatggtatataggttggcgcagcacaaagtgcacaatgtgtgggtctagtaagctcaccacaggatactctggtacccactgatgcaaaccgtatttcttgaaggatgctgacccccacaggccgttgacatcgagcacatcatccaacttccataccatctgtggcatttgcagtgtccacgccctgataacgatggcagagggccgggagcggcacttgtcaacatctacgaacttgatcttcccatcagagacaccgactgtcctgaaggacgcagttggtccacaattgtcagtcttaacatggaacaagagttgaatttcgctctcaagaaaagggaacttgatcaaatggagcttgggcagagattccaagacatcacagaagataaggccaatgttgtagctagcccaatagaccttgccgccgtgggagaaggcgatttggctgctccacttgcttatcagtccagaatgccccccataatctgagtcaaaaggaggcagagctagcttcttgacaacccagctgtgctgatgctg

SEQ ID NO: 23288 - DNA, 2439 bp, Oryza sativa
gtgcccgtcaccggctcgcgaatgatgagctgcgtatcgaatatggctccggccatcttcttcttcttcttctcctcctccggcgccgctgcagcatcagcactcgtatcgtcgacagggacggatccaacttgggacatggggcttttgggtgaacaaacaaactgttactggatgataccccgcgcgttgctgcggaaacttttagaactaccgtaagaataatagtttgtatgcaagtagaaatatttcaaagttaagtagcatttctgtgtaaatccattttttattgaacatgcaaaccggttttttaatgacatttttggtacgtgatgtcttacatgttagtttcgaaaagtagaggcatgacaatgatgataacagaacatgtttgacaaaataacaaataacttggaacaatcaaaggatgttattatatcaaatcatatgtggtctttagctcgaggaggatgggttgaccggtaaaatttggttcgaagatgaattagtattagtattaaacaattggatttgcttgcatggtaatgtagttaattagacattggttttgtgaagaagaattaccctttttgtgagccaggtcattcggcactgctgactggaggactatgctttatgaaatggttcataacatattgcaattagtattttagttaaattttgttattctgggggatgttcaacgtagtacatactcttccttctgacttttgaggatggggttaatcaaagttctttgttactgaaaagggaaagaagtacagtaagggagggtttgagcggatatttgtttgtcacaaaatattaaaatgatgagaaatggtatacgcagtatatacatggtgttataaaatacagtatactttctagtttcctcagtggaatcttcactaaaatcgatgcttttctttgtagttcagctgctgtaaatatattttaggattatattcatgtatttgattaagcatggaagtgaaatatctttcaccttttttcagttgatatgttaccagctgtaccgtctttggatgttcctgttttgtcaacagttgcgctgaaattgatttgacattagcagatagtatgtagtcttagatggagatatgaatagaaaatatgagagaacaacaaacctgagatagtatgtagtcttagatggagatatgaatagaaaatatgagagaccaacaaacctgaggatacttgtacatgtcataggcggtgaaagatggagtagaactttgttcttggaaggttttggattagtttgttagttagattgaaaaatatttaagtgatataaaatagtagtccagtatgtactaacctcttcatttgtcagcataggggttgacatagtgctctcaattgggaaactcttcttaagcacataactgataacaaacttagaagatgaatcaatattcattcctctattaaaacaaaccaacaacgatgctgcaggggcctcccctctagtcgttcaagtaaaaacaaaagaccaatgaattaaagatgactacaactccctcctttgatttttgcagtactcatctttgttgaaatccatattgtcctgagtactactttttgagcatggtccctgcaaaagtgtaggattattgatcaatttagaaggctgtaaagatgtgatatttgacttcatataaaactaattttctttgttttgatactgatcaaaggagcaaaaaagtcattcttgctaaggccttgtttgaatagcccgagattgaggaccatctaaacatggtgtaagagagagatccaaaaaaacttatttttttactttcttagaatagttatttgatataattataagtaagagtggcatgaggctcatgataatcatacctcaaataaattgttgcagtaatgaaatagttgtacagattgccataaccaattcagtgtagctaaatatatagaatggaatcgttgcagtaaagaaatagttctccaaattcccattaatggaatggagagcaatataacccatgcccaatcctcaaccgattaaaatagctatagcttcctttatttgctgataaaatttgatcacaggtagaacaatttcttctcactcacaatttttttatagaagctataaaagtgattttcctgtagataaaataaaagcaaatatagatcagcaagaggaacatggagcgctgatttccctatagataaaaatagaagcaaatgtagatcagcaagaggaacaggagttctcatatatacctagtgtagaattaggagcaacaaaccatgacgcataggattggagttacgtagcaacagaataaccatgcacgtcatttttttgggtgaactctgctagcctcacattttatctgaccttcaggagagccgcaggcttgcagccacgacgaatagacc

SEQ ID NO: 23289 - DNA, 512 bp, Oryza sativa
ccaccacattctgcggattgtaggtggtgtacatggacttcatttcctcacccttgaggaaatagaaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtg

SEQ ID NO: 23290 - DNA, 1108 bp, Oryza sativa
aaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggagtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaacac

SEQ ID NO: 23291 - DNA, 3284 bp, Oryza sativa
ctccaatgtccatatagtctgaatcagctgcaaccaatcccaaatccaagaaatctacgaatgccagttaaatccccagcttcgccgtggactgagaagaataaacaaattaaagtgtacaatgaacttaactataatgaaggtggatgagaaggtcagaactgcacatcccactactatgtagcagtgcatcctcatgcataaaaacatatattgatgaacaaagtctaaatgctaaaagtctaaacacaacacatgaaacaccaaaccgtataatcaaatgtgcttaatagaacggcataaatataattcaatagattgacattatacgtaaccaatgtcataagggaccaacgagaagctaaaattggaacatgtcatcttttgtaaataaaataacaaaacagctaacatcttcatgtaaaatctatgttcttataacatagatacaaaggcatgaattatgcatggccgtctgttatctacatggatatagtaagctagttctatataacgctcaggcaagacaaaaacacatcctgggttcgtgcatgtggattatatttatataaattagcacctaagttgttcttgtgaacaaaacctgtataaacctaaaattagtaaaaaaaggaactggaagaaaacgaaagatcttcccatggaactgataaaacacggtgaagacataaaagcagaggtaaacctatagctcatgcggggcagaaggaaaacaaacaagtgaacaattcataactctctttttttattctaaagcagcacattagcaaacacatatgtatagtggaacatatatttgaactgaggctattgcatcctgaaagctcagcagctgaaaaaaaaaaagaaagcatgcacaaagtgtagggcaggcgcaaagagaaccaaaaacaacaggaaatgtaattttcatgcacaacattcaggataattctggtcgtaatgcaactcaattccaaaatcgcatgtatctgatcatataaaccacactcttatgataaaaaggctttctggacatcagaatatcaatagatataaaaacatgtaatcaaatgtgcaaccatttagcagcaacttttaataataacatgcacagtttttcatggaaagcagcatgaaactcaaatttcaccttcctattaatgaacattaataggcaacaattttccccagatctcaacattcttccacagcattagtcatgtataaaattaacgataatctgtatgttttttcatcgacttaaatttatgaccattatcataggataaaacaaaacactaagttttaagaaccaatcttagcatggccgggtctatcatcatgtctcttacaataagtggcaagaagagtagcgcattaccttgttagttttctctgatgaacaagtacggcaccatcacactggagacaataggaagctcatttattcgtttgcctcaaattgatccagtagaaaatacgataagaagcatcattttacaaacttaatcataaccagaataacaataccaaagtaatatttgtgatacacataatccccaaggcccaactacaaacttttaggtagagcaatatacaaacgcaatatcaaaatctatatcacatcacatacagtttccaaccagccagaaatgaggaccagaatacataacgaaaaggtaacgccaaaatcataactgaaaaggtgacataataaacatggtttgctcatcttagataagcatcaaacacaaagactatgaggaaccacaccaaacagtttttttttaaccatggcctcaacatgtatccagttaaatagattgaccgaccataaagttaatcagaccatctaaatataattataatcctggcctatgcgactgatctaggtaggtccactcacccatccgctaatacgttttttccttccatcttttgctgccaccaaccatagagtgctgtggtatacacgctagctgtttggaacgaagcctgttgcaatcaaaccgagaaatacctttttagtctttaaaaaccagataaaccataaattaccctatcccaaacatcgccacataaccattaaaaaatgaatataaaaatgatacaacgcactaaacaaaaccttgaaccctgccatcctccaacaatagaaaagcacaggaaaaaaacgaacaaccattcaccgatagaaaccgagctggacagaaaacgcaattgactcttcccatatcacccaaccataaaatctagccagcttacattatgctattaatcatattatttttgcacttccagaaagagcactgcagtaacagatttctgactaaggcatcaattaatagagacctgaaattataacttcactctgctgcaacaattaaagcgcaagctaagatgttctcccatacaaacggaagcaaataatagggcaaggtactctcttgactgaacctaccaaaaacaaatattcaatgtcagcaaagtgaagtagctttattttattttggaggcaaaaccaacacctgtagtcattctgttttacctatctataatttttaaaccaccttgagcagcctcaatcgatacgcacatttcttgcaggtgatcttccatgtcttctgtcagtttgtcatagagctttggcccatgttcgtgaagtgccagattataagcagtcctgccagaatataaggacaatattatgttctggtacataagaaggatattggttccaaacaagtaaaaatactatactgtgccatgaaaggctagtaggtcagacatgataccatggaaagacctaataatactaacgaaagtatttccagaacgaaagaaaaaaataattcaaatatcacaataacacatcacttaagggcaagcaaacagggcagttggcctttgcttctctcttaaaattctatttattgcactttttaagagtaaggggcatagcgactacagagttccattgaacaagttgtatgacagaagcactatctacagactacacgaatagtaaaagcccatgcttgtgattgtagaaatagagtttttatgtaagaaaaataacaattttccaccgaaaaaaacaacgatgtaaagaagaaagactttcataagtattttgaggcattgttcagctaatcttgtttcaaggggataaggacctgtttttttatgtgcaaacaaatgcataacatagaccacgctgcacgcaaactctcaagtgataaaaattgatccgagatgaatttccctagatgtaataggcg

SEQ ID NO: 23292 - DNA, 12354 bp, Oryza sativa
gtcggcacccatactcccccatcatctccccctcaggttacaggaaccgaagccccgtggcactctccgctgtgtcaggccagcgccgctccaaccccgcccacaacggacgccgcacccgcccccaccggcaccgacatccaagacgtcgtcgtcgccgccgccaccacctccacccttattctcctctctactcaacgtcgccggtcccatcaacgctcaccgggctgcaacgacaggaacgacgatggtggtggtgttgccgtggctgagcacagaagaaaggaggaatgaggcgtcgtcatggttggcgggtcctcacgacgagcagaaggacagagggcactgatctggggcgagctcgagagcctggtgacatacggttctcctcttctcgctgctgccaccgccttcattgatgccggctccgtcaccaacgtcgtatcttcgatggcagcggcaacggaggacggagcagcggccgtcggcgatggcggcgaaggacccagcaggggcgctcggcgatggcaacggcagcggaggacgggtgctgcggcggcggcgctcgacagcgccagagcgaggtggaggcgaaaatggcgatgctcggcgacggcggaggaggagacgctgcccagcgcatggacggcggtcagatccgcgtccccgacaacatggagtccggatccggacgccggcggccggaggaggcgcctcgcagcggcggcgctcggcgacggtggggaccgaggcggagatggctgctcgcctcgccgacggcgacggcgctcggagacgccgacgcgacggccacggaggtggacgcggccgcggcggcggaggcagaggcggcggcgcgaggggaacgcggagacggaggcggcgacggcggcgggagagcgggagggagagggcgagcgagagacgagagggagaagggggcggcggcggatagggttttgggagttagagcatctccaacagtctctctgaattggcctctccaaatagccatatagccaactctccatgtaatttagccagtcaaactagatgggacggacccacgtgtcagcctctactcctcttccccccccccccctctccccttctttcttcttatccttcagatccaaagctaaagctagctagctagctacccagctcacgcgaatggcctcctacgacggcggcggcgacggcgggcggtctggcgggggcgggagcggcgacctggcgtcgagcgccaagctggtggcggaggcggcaagtcggtgttccaggaccgcgtcgcgtcgcgacctggagaaggtcgacaaggcttgcatcgcgggtggcgcctcccggcgagaggcggcgcaaagcagtggcgcggaggagcggcaccggtggaggggcgacgcggaggagcggcgccggggaagaggcagcgaggaggagcagcgccggtggaggggcggcgcggaggagcggcgccggcgaggggcggcgcggagcggtggcgcggaggagcagcaccggtggaggggcgacgcggaggagcggcgccggcgaagaggcggcgaggaggggcggcgcgaaggagcggagccggcggaggggcgacgatgatgtcgacacttggcgacgggatgacgacgccgccgggatgctgctgcgcgccttagagtgtgcggagagagagagggggaagcacgcgtgggtcccacggatggcaagctggttttgactggccaaatttggctaggcagggagccggtttggccagctgatagcttggccatccaaatagcaagtctgttggagtctgtctaattttgaaccaaacttgctaaatttttgctcggagagtgagatagcaagactgctggagatgcttttacgtagtgtgggcgtttttttgcgaaaaagcccctattcttttcactttttacattcatgtccacgatttttcctatacaaacactgtttgtgaggggcctatacgtaattaaagaaaaccggagggctttttttcaaaaacacacccgagcactatagcaaaatccgacgtggcgtcgctcctcgcacgccccttctgcgcggcataattgttgcttggaagggattggattcatgctaattgttgtattccttcaaccatgcatcaatgcttgattcagtggcaaggcgacaagattgaaatcgtgccagctgacaggtcagtcaatgttgccagtgccgatttagctctttgggagatggatggtcttgattatttatctggaatagtttgagatggagattttctaaaagtgtccgattctgatatatagccaattgaagatagagaacccaagctattattttgagggcgtcttggagggttcagatgtctacaacaaggacacaatagatgatctcaatgacaagcaaggacagggttttacgtcggccgatgatttggaagaaattgatataggtctaggtgatcgaccaaggccgacatttattagtaagaatttatctgcagaatttagaaccaagttgatagagctgttgaaagaattcagatattgcttcgcttaggagtattatgagatgcctggactcagccgatcgattgttgaacatcggctacctatcaaaccaggggttaggccacaccagcaacctccgaggagatgtaaagccgatatgcttgaacctgtcaagactgaaattaaacgattatatgatgctggttttatttgttcttgccgatatgctgagtgggtttctagtatagttcctattatcaagaagaacggcaaggtcagggtgtgcattgatttccgaaacttaaataaagctaccccgaaagacgaatacctaatgccggtagccgatcagctggttgatgctgcctcggggcataaaattttgagttttatggatggtaatgcaggatacaatcaaatctttatggccgaagaagatatccataagacagcttttaggtgtcctggtgcaatcggcttgttcgagtgggttgtaatgactttcggtttaaagagtgctagagctacatatcaaagagccatgaattacatctatcattagggatgatggcaatgggtcgggtcgggcgcgggtagagtaaaaccatgcccgacccgatacccgacattgcctgcccaaaccctacccactagagttagcgggcaaaactctgtacccatacccatgcccggcaggcgccggtacccaatggatctcacatgaataataacttgaaagatatgtaatttaacaaagagaaataaaatcaataatttaccaaattattggttatcaataataatttgaattacatcacaacttaaaccttggaaattcagcttctgtcacagatggccgattgacaactttcaagaccatcaggtttaaccaggtctgcagcaaccaccatggtctacctactccaactaccgatccgacagctatcttggccgatgcattgttcaacatttggtataaatagtcgaggaggattttgcccaaaggaaattgtttctttgattctagggcttcggctataaattgccagttggttgtaggaccacaactggatccacagaagaggaacttttctaaccacattagcaagaaagctacatgctctcgaggagtgacaggccctttacccatgtatgcagctacatagccagaccagccacctatgcttttggttctaaaatcaaattgattcttggtattcatgctcatagggttggccgatgaggttacatctagtccagtgatcatggtgatgtcaatcagagtaggagtcatcggccctcggttgaacagaaaggcattgatggtattggaccagaaataagtggcagcggccatcagaggttcatccttagctgaattggctatggtaagggcaagtgcttggccaatcccgatttcatcccagtgaactttcttactagccgatacacgcttgtaccatgtggtccaactcctctcaggggtggttttctcgagagatggccaagacttaaaagttttcttccagtgacctaggttagggttggctaatctaaaggggattctgttgctttcgccgatgatgaaatcagtggggtcaaggttgccgattggaccaagaaagtaatggttttcatgcgacaggctgggaatcgcaactagattggagaggtgctgcaaatccaaaagaatcgagaagaagaaaacaagatgaggaaaggggaaatcgatttcatgcgaggaaaagggatctagccgatgagaccttacctcagcgtactcggctgatggcgcggtagacgggctggcggaggacgacatcaacgcaggcggaggtccggtcggagatggaatcgctttggaatcgctttttgcgtcggtggagtcgccgcaaagagagggcaaagtttgtttcagcggcgaaaatagaagaggacggtgtgagatttctcgagggtgacgattagtatttaaagcacgggagtaatggtcggaaaatagcgaagtgcgaaacttgctcggagtcgatatacggcaaatctgaaacattaccaaatattccggacttggggggcatgtgttaacaaccaaatttggcaacatcggcatcggaaaggaagattagatcgaagtggaatcagagataaggattatcgcgagaacagagtaagaatcggctggagtcctgatcggctacgattggatcggctgaattcgagtcagacttttggtttggtgatacagccgattccgacaatacgacttggtgtacgacatcgggttgagttgatatgcttcaagatgatggccacgcgtggatagagtcctgggaaggcaattgtatctattaattatgatattttatgtaatttccttagatatatgtttgggcaaaagtctgccgttaagacttatggtatcttagagtttgttagagataagagtcgtgtccgatatggacatagtttgtaattttcgagtataaataggccccgaaccacatgtaatcaaagaacacacacgttcaatacaatctcggcgcatcgccacccttttgctttagttttatttcgacgagttcttactttcgggttgagctgcatcggtttcgatcctcaacaagaggtaaaacttgttatgacggcttgcgttctcgggattagtgcttccatctttatgatactctaatcttgtctatgtaattcgtcaagttatcatatatcttacataatctctggcattatcgctatttaacctattatcggctaacatctgtcggtagagggcagttatagttaaacatcgatgttgacttagattatataggatatctaccactctatgaaacttccagcggcttgattgtctagatattgttctttttttcatacttaatgcggcatcagttgagtttgatctattaagtcgtgcttagaatatcaatctctagcctgccttctggttgccaattagaatagtatcggggtttcagccgatcttacctgatttaactatattcaccctatatgcttcattgatatgttaaatctgccctttatattaagatcttgttgcatttaagtatattaggcctttgtttgatatattctacttgctttaacatcttagtatagagcggtatcggagtattagccgatacatgctagatctatctgattggctatgctatgaacatatatagtcctattattaatatatatttcgatctaagtgatttatactgtctcggcatggcgaccgatctatcccaatcacttgatttaaatatatatcgatatgaggagtatatatcgttaatatctacagctgatcgagtagatttagttctttcttatttatttatgactgtcgatcgatatatatatatatgacatcggctcaaagataaatgatatgtcatcggtacttagccgatcggctatcgtttataggtttaaccgcggtttccttgtcgttatttcttgttgattgcaggatcaaatcaactggcacgctagcatacccgaaggcgagttttggacctgcactggagttaagcagatctcccaggcctcgtgttttccgtcaacactttggaatactctcgggtgaaatactacaatggtatatccgtgcgcttgcggatgaaatctgtaaccatagtataccataagtatttcggcgccattgcaaggaattcatatttctagtaatgacgttaagaaataccaacatatacgtgtgcggcaaatgaggtaaaagatttaagccgctaagcttaattgaagacatggcttctattatggctagaaagtgcaataatgtcacgcccagaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaatcagcatttagcaaaacatttaggagaagtaaaacagtggagtaattaatcagaaattttaatcaacattgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccataagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgcttcgcaatgaatcatgttatacaaaaggtaaagccgttgcctacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataataatgagtcataagttatcccaatagtgtgctaatgtttctaagcatggctaagcaatcatacctaatatctagctgaaccaatatataaagcttaactagtcaaattataataacccaagatatcaaagaataaagtaatcaatgcaaattggccataacaaaggaatagattcacaccacccaatgacattcgaaaataaatacacggttgaaataaatagagaatttaaatataggatcaacatgctcaaaggattgtgtttaggatctgtgtgacttgccttgcaataatcggtcttcaattaatcctcttgaatacttccggcgcactggcgaaccttcgcaacgacggaaacgacaagctaacacgcaaaacgaagaaaaagactaataaaaaccaaataaacaatacatataaagtaaacaaacatgtagatcataattttagatgaattatgagacttgaacggcctcattctgacttcatatgaatttattatgaattttacaagattaaatctaattaaagcccatttaaaaagaattaaataaatttaattctatttatggataattttattatgtagatctttattttacacaacttttgcaacttgaaccacattaaactgagttacaaagaattagttatgaattttcaaagattaaatcggattaaagcacttatatagattttaattgaattatgacgcaataatgaattatttttgaaaaggaaaagaggattattgcgtcagcgggctcgagttcacggtggaccgggtgcacagcagcggttcacgggaacggacggccgagatcgatcctatccaaaacgaacggccgagatcaaccgatccacgaccgggccacggcggacggtcccgatgacgtcagcggtgacgtcaccaccggcgacggctcgggcggcgcatgctcgccggcgaacgacggtgcgaggacgcgaacggagggcaccaaaacgatgcgggcgacgaggcgaactcaccggtgaccaaaacggcggcggaagagcaacggacggcgccggcgatgaggaagaagcggcggcggtcttcgggtcaacggtgacggcggtgctccggcggtcttcggcggcggcgaagcggtggacggggatggcgacgcaacggcgaccacgacggtgacctccccgagcgacggcgacgactggagcgacggcggcgcacggctggagcggcggcgacaacggcggcgcgaggtctcacggcgctaggacgctacaggcgacgagaggcgaaggcgagggtggcggcgggtagaggagagctcgggggtccttttataggggcaaggaggcggcggcgaaggcccacggcaaccggcggcgagaaggaaaggttagggttcgagagagagaaacgaatccgattcgacctcgaatccacgagtttccaaaccgaattaggcgatgattccaaaagagaaaaggaagaggagatcgagaagattatttcccctctaaagatttcaccggatcgagaaaggatcgaccggattggaaagcggcggcggcgaagcggctcggctagggtttcgagcggcggccggcgcgaggagaacgacgaccccgacaagtgggtcccgcctgtcagcggctgagagagaggagggaggggcgcggcggactgggtcgacttgggccggggaggagagagaaagagagaggtttttgggccgactttcggcccaaagccaaaagagacttttaaaaacctttttcaatttaaattattcatgaaatgcaattccatttattaaaaatactttcttggctcaaataaatcccagaaaaatctaggaactatagaatcaagagaagtatttaatgaaattttatctggccccattttatattggaatttattaattaaaattagatcttctcttttaggcttttaagatcatttctaataattcttttaaacaacaatttataatttaaggatttttaaacaagaaaagctcttaacaattataattagatcattattgatcaaataattactgaactgttctttgtatcatttagaaattgagctctgaaaaatccgagaaaatttcagagagtgtaattaaccatggagaatttaataaaaattaaatccatccatgctttaaatttaggaaattttatttcccacatttaacttcacttgtaaattaaagaacatttaatataaattctaataataatttattaaataatttataaatcctgaaaaaatcaggatgtgacaaataagaaactatatttttcaaatccatcatctaaaaaaagcaagtgatcaacgcatacaacgaacgacagccattttatttaaaatttttaaacgcatgcatccatggcaagataacctcatcactctctggtcataaggaaggaatgagtctccgctctagcaaccgaagatgatataaatgcctatatttagtctcattggtggtccatgaagctctctcggccccatatatatatagctcttgtactatcacgtacgtagtatataacatgagcattagggtaaggaaagtcatcttagctccacaccaattctgctcagcataaacggtgctaatggcccaaaacaagaccatttcggtggctctgctcctttccacccttgtggtggtggttgcggcagtagcagccaccggaccgccggatttattacaaggttggtgcgccgatgcgtgtagagaggagcaacaaaaagaccccatctacaacaagcattgcccagacttctgcgtcatctcgaccaagcagatttttagggcctataagggagccacggatccccccgtggaaagattcaacgccttgtgcgatgagggttgtagtaaggaatttaaggaggatcctgccatcagcaagaagtgtgtagacacctgcatcgtcatgtctaaggaagccaaggaatactttgcgaaaggtggcactattggtgctcccgcgggtgcatgatcgcgtagcagctgcacatctgatccttcttccatgatcgagtgacaatccccataaatggttctcacctggggaccgtccttgtatcacatttgtcctgttgttcccttttcatcttcggttgcttcattatttggtgtttataactctatgtggttgatgtgatatgttgttcttaccaatgttaccagaaacaattgttatctttatttgattaaatatatccggctgtgctttggcttttaccactcattaatctatgattccgtatccaagtaagtagagtgcgtgtaatgttaacatatagatgtagttattgcctccgcccacacgcatccgacgcacgtcgtgtgatcatgcgccagcggaaaacgcaaccaccacggcaccatgatacacatacatctatttctattcctaccgctccgagagagacaaagagaatacgtgcggccacgctgagcgattgcaaatgagtctatttctccaatcccaaggcatgttgcttctgaattgctgcaaccagtagcctcaatgacgatattatacatgtttttctagcgtgcgacatatgtttcaataacttccttgacatgttgcacgagtgtgttgtttcgatcaaatcctagtaatgttgtttcacgaacataatatcgatgtttcaggtttgaaaaatatagtttccaagtgcaagattgaaacaatgcttttcttcctcaaagaataacaccatactaagtcaattcaacacaaatgtttcaccacaacaattttttaccttttgatagtgggcccaacgaaaataatgtatcatgttttaacaaattaagctaaacttttttgtgtcgcaagtatattccgatttttcgcataggcgtgttttataacttaatatatcattgtcgtgcgatgacgagttaggccatgagattttttttttgggatttaaaattatttagttaatcatttctataacttaaattaatgtgcaaatcatttctaggttgctgtcgacctggtggcctagcccaactgcgagactaagtttatgacaaggtttgtagagcttgtaaaaggacacatatgtgttgacagtccttaaatcttaatatctaaccgtcaatacctgcatataataaaattaaatatggtatccaacttagtggtaggtattattactaatcattttcactagtatttgtgaaatatgtgtatgcaggtattttgagaagaaaacacatccgtcaagcgacaaactgcacccccgcgctttcaggacacatttacacgaattggaggtcccataagtcaattaaacaactccaaatgggcccaagtatcatgccaatgggccgagggcctcaaaaatagtgtccatgacgaaaaaagggccgaacggagccgtcccgggttcggtcgaacctccagttcggacgaaccgttttgctggccgttgatcgtcaaattttgcatggacggccctgatcacatcctaatggcggttccagggtagtttggtcatttcgcataggctgtaaccgtcatacctgcctataaaaggaggagctcactctcatttccaacacacaactttgagctgaattacaagaggctctattgtatcttttgtacattagaataaggtagagagtgaggggaagctctggaggagtgcccggaagtttggcgctcatccgactttgtcggtgacatgggaccgggagtatcatgacttagagacttgaggcagacacgatcacccacgtggcctaaccccctcgggggggggggggtcgggcccgagggtgatacggccgcccttctctttgtctccccgaggggtcggaccgctcccgtctcgggcctaaaggccaaggcgccctgaccccttgagggttttg

SEQ ID NO: 23293 - DNA, 14997 bp, Oryza sativa
taggtgagcatagcggggctcacctaaccacatttattgcggtttggacgagcgcgtcacgccgcatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggagattttgggggagaaaacgatcccagaacgatcgggggctggctcgcactttgtagcttcttcatacacagatccaccaaaacacaggagtagggtattacgcttctcagcggcccgaacctgtatacatcgcccgtgtcttgtgtgtttccactctcgcgaactttccacagaccaggagcttagaatctcacccagggcccccggccgaaccagcaaaggggggcctgcgcggtctcccggtgaggagccccacgctccatcaaacttctacctcgacgagtgtagcttcgtaggaggaatccgggttcggagaacttcttctataaagtaagcatttgttttcctttcttatgttatttaattaattttgtctgagtaagatatattttcatctttgcgggttcattgtttagtattcatactaagtgctctagtactaggactctggataaagaagaaagttcccgcgcaagtattagagtagtaattaataacttagacgtggtgtctaggttagagattacctttgtttgttgtgtatcccatggatttgtcagaggtaggcggcaggtggtgacagccctgaatcccgtcctagtaatcctccacgttcggataaatcatagagctatagtcggaaccacgctggcagaccagcaagggtcggtgcccgaagcaacagatagaaaattacctttgcttagcttagataactaaaacacatagaaagtcctctctagcctgcctagcctacctatagttgttgttcttggattgtcttagccttaggtagattacacacgttccctgagttcgatatccttttaggatcacccgaaggtgaagtgctacagtgctattctgtgcgcttgcagatttatctgtggacgtaagaaataccaacaagcatttctggcgccgttgccggggaacggttgctaatttatccgagtctaggtcatcctcgtatccttatttttatttcttcttcttttattcctttgacatgaaagatttcaaatcttgacttgaaagttttcaaattttgggttgaaatttttcaattctgggttgaaagttttaaatctgagttgaaagtttttcagatttgagatgaaaagttgaaagttttcaaagtttgacttaaaaaaaaataaatttcgagttgaaagtactcaaatatgggttgaaagttttcaaattttaatttcacatatagatctctttttaatctgttagttaaaaaaatctttgaaaaaaagacaaatctacgaatcttacactaatcggattagttacgcgtcttcaaaaaaaaacccgaaaagaaaaaaaaagaaaccgcgcaaaaaaaaaagacctaaccgctctacgtcgcgcacgaattagttttctctaatttactgtagcgtgtaattaactctaatcacagtaattaacgctaatcaccatgattagtgtgataggagcgggctgcaacctaacatgtgagagtgcgcggagttactgtaacggcgtgtatgcgtgaattagcagtccccaaccttcggtgtactttttccaaaaagaaaaaccctacaaattgggcccgcttagtttcacattaggcctactggccatgaagggatcgccgcggcttacctgcggcccatttaagttggcccagaacgttgatgcggactccatgaggcccatacaatgggccgaaaagtatgtgctggataggaaagtttatggggcctcctccacgacggtccttttcgttgggccagaactatattgggacctcagggcggcccatatatattggggcagaatgtgattgcgggctccttgagacccatttatgtatctctctcgaagccctagaccaccacgcctcctgctcgcatccttccttaacaactccgcatgataaagaagctaagcatggtgattggtggatgtggtagagtcggatgtgagtcatatgattcagtcgtattaataacaggatactttatttatagaaggagagaaacaaaacgttcacctcaaagaggcaccagagcaaattgcaaacaggtgatggctgatctgatgcgtttgatggcaacgggatcagatcactgtagatggatccaaaaaccaatcatttctctttgtggatgtcagattcactagcatcaacttttgccctaatttcctccctccttttgactttaactgtctccttaatttgtcggagacgtttggttctcagctggatgagagtgaaattgatcaaattacatttgttttctgcacttctgctagctactactagcctttactacgaagctacagagaaactaaaacgtgtgtgtctatatgaacctatgttacctggatactgtcacaatcacaccaaatctctcacacaaatgccaccgatatattgcaatccactgaagaatacaagtgtttagggatacaaattgaggagaaagagaggtatagtctaggaagagtgtaacatcctgaaaattcccaacaataaaaatcactaaaaatttcgaactttttaaaacttttgcgtcatgctggttgttatgatcgctattgcttgccaaaccgtaaatgatcacaaagaaagtaaagaaaagagctgcattcaagcaatagatataatttacgagagtatattatttatgtttagccctacaaatatttatgcacaagatagtaaaataaaataaaagttatcattaatctattttatcaaatattaaaatatttgaataatgtaggtgggtgcgataatataaatgcacatgaaatgatgaccatttaattagaaggaactctatctataaaatagttttacttgcaataattaattcgatattatataatttgtattgaatcacaaatattaaattatagaaatccatgttgtggtaaaaccaatttaaaaagataaaccaatatgcatcaaaataaataaataccgaaatccccaaatatgggaaattataaaaatctaggataaatattggacaatattaaactttgggaaaattcacatttgaacacataatatggtcactcaaatgcttaggagtaaatacaaatttattttgcaatttttctcaatttataattcaaccaaaagccctaaaagtaggaaaataggaaaaggtagaaaaatatataataaaaataaaatgtgggcaatattaagtgtgaatacaaatttacatttgaataactcagattttgtgtgaaatacgttgtgacaaaataggtggcaatagtccattctctaaattggaaaacatctaataaaatccaaagaaatcggctagtactgttcataggcctctaggtgttcgatgttgtcccctaactaccccctctctagccagcaccctagcctgctgctgccttgcgccccgcgccaccgcgcgccgtctagtcgccatcgccatcgccctgccgcgccgttcgccgtcgccatcgccctgcgcgcgccgctgccacgcctcctcgcgtcctatcccgccgcgcaccgtcgccgtcgccgcaccgtctccaacccgtcgcgtcgcccgtcgccgccgcgtcgccgtcccatcgccgcgcgccgccgcgtcgccgtcccatcgccgcgcgccgccgcccgtcccgtcgccgcgcgcgtgtcgccatcaccgcctgccaccgcacgccgagccccgcgccgccccgagccccgcaccgccacccgtcgcatcgccgctccgagccctgtgcgctgccgtcgcgtcgccattaagctgccgccccttcccctctccttctcccccctcttccctataaaaaccttccccccttctccaccccaccccattccctcctcctctccctcttccccttctccacgcaccatcgtcgtcgtgccgccgcgccgccgccgcaccgtgccgcgactgcgccgccgtcgccgtcgtcgccgccaccgccgccgccggtgagccgtcttccctccccccccccctcacctcgcgcccaccgccgtcaccgcccgggagagcaagagccgagagagagaggtagaaagaagccgggagggaggagagaaaaggaaaggaaaagagagaagagagaaaaagagaaaaagaaaagaaaaagaaaggaaggaaaaagaaaaagaaagtgaggaaaagaaaagggaaataaataggaattaggaggagatttaggatatttaaaatatttggaattaattataggattaactaaagtgtagtatttgcaaaatgatactataatcatagattattatagattattcttggtaatttccataagaaatcaattcgcggtagtaatttaaatgtaattaataactaaacaattagatgaattcttatagactattatagattatttttgggtaatctctataagtaatcgattcacggtagaaattcggatttaatcactaggaatttcagacgtatattacatttaatcgtttagtcatagactaaattaaatcgtataatattataagataattttagggttccatccaatatttagatcgcgatagaaatttctagcctattatatggatataatgctcgggtagattaaattaaaaacttatgataacaaaatatttatacccgcaaaatagtttaggatatatagatcgaaattgggtttgaccctaagtcaaccgggaccggttccacatgtcaaccacagtgggttttggataatgtttccgattaaaaataaatcatttatgaacagtgcattttcacaatattctcggattaattcgaaattgaatctttaaactagcataactcgctcattttaactccgatttgagtgaaactcgaacctaaattcatctaaattcataagctttccaatggtatataatttactattaaataaaatatatttataattattaaataattaatatcatatgattaggttatggtcaacttaaaaatatgctaataaatagaattagtattgtacagtagagtagatgtaataacatttgtctctaacatgtcttgccactgtaacaaccacacaaactaattttaagtgatgtctcaaatgaatggatgtataggaaaatactactacttatttaatattcgacggccatataattaaacctatggcttataggttatttaaatcaagtgtagccttgtgattatgtaactaaaatataaacacacatagatgaatctttaacctgtttaggagaataataacagagctagatgtggaggaatcactaagtaaattaatcgatgcaataccatatagaatagcatatatatgcctaaattgattaccacttattagaaacccaatagaaccagtgcttaaacttgtcgcatcacatatacaatatcactcatagaaactagctaatgtataattaaactataatatattcaggaatcacttggagcattgagtaatacactttctaaataagctcatgtacagtaggcgaccaaaaccttatacgttgttgcacacatatattgtatatcccattatagttatacaattaatttatctttttcatatattaaactggggagtatataacaaacatgaatagtagataaatagtagttataaatcttgacctcatataattataattatagttcaactgtaaattaggattattcattgtaaaattatgtgatgggataatctgtaatcataatatgattaacctaaacaactctaacatacaaagcatggataattattaaccttttataatttattgtgacaagtaaaatatgttcataattaaagtaaagcctccatcaattaaataataatacaaatgattcgttatttgattgatcctaaatccatctaacaacagaacctctggtatgtaaccgtgctatttagatagatgcatatatagccataatccttccatagccatttgatagactaaaccaccgattagccaaatatatatgtataccataaatgctatgttggttaactcctaaatagaccacgatgacaatagaaagattaagaaactttagcccttagcatgattggaatccattagcaaacacgaatagtacattttgttgtgcatatttgattgttgttgaatattggtttttctcgcgtattatagaccttgtgtatcggttagtcgtgaggcaacgtttgcaacttccaggaggtgaaggttgatcaagaattatatcaagaataaggactattctgagcaggcaagtcatatctttcattatgggtctcataattatcattttctggtctaggctcaaccggaggatcattatggagggcataatcaatatccaacagggctagagtaatttccagcttctccttccatgaagcataattacttccattaagttgttcaatattgcccattattccggcaatttgtgaatattgatcaaatccctgaatattgcccattatcagcagctaaataagtaccttcttttattgatcaaatccaaaacggctttggccagagaagcaaatgaacaataaaattttgtgaataagtatttattaatcagctttggccagaataataaatacaaaccacactttatcaatttgtttaaaactccttttattaattcaatcaaaacagctttggccagatttgaattgaattaataaaattttgtgatcaaataaaagtcaatcagctttggccagaatgacaattatttgtcacacttaattataatatttatttgtagcggaaataaactcataatgcataaaacaataataactttaagtaataaatataatgtaactatcataaaataaataaatgaaagataattttatcacataacaaagtcacttattattcttattatcattaattaaaacataataaaatatctttaatgtttaaacacaatgatcataatcataattctttaaaaggaaaaaattaattgtaatattatcttagcccaatctttaattaggcccattaccatgcagcccgttactatgcagccacacaaaattgaactgggccactttctcgagccaggccgcactcggcctggcccgtcattgccgcgccgccttccgcctgggctccaggcccatcaacctgggcctgggccggcgtttgccgcctcccgcacggcctcgtcagcccgcgtcgggagcgagccgatccgagccgtccatctcatcggacggccgggatcgctcccgcgcgggacaaaaccggcgcgcggccgccccccgcgaaaaccctagccccattctctcctcccctctttctctcacgcccgcggcgacggtgagcgagacgacggcgaagcggcgcacgacggggtggagatggcgccgccgagccttgctcgccggggctgcgtgccgccatagctggcgcgcatccccgtcgagcgttgctcgacggtgccctaagcacccgccggtcgctcgcgcgaggaagatccgcggcggcgacggcgagacgaggcggcgacggctacctcagcgaagcggcgtcagcgagacgagcacgcaaagaggaggagccgggccagcacggcgggtcgcgaggccgctcggggaccaagtcctcgggcgcgcgctcgcctcttattgcgtcggtggcgacacggaggtcgccgccggccaccatgcccttaggtaagcccgccgcgctccttttccccatgattttagggttagggttccatgatttggggaatttttggggtcttacttcagctagggtttcggttcttagggatttgtctgagatttgcatgaaattttccttccccttcttctaatttcttcaagccgaaaccctagaaggcctaattccatttcttatgctttgggattgcatgattttggctcaattcaactttaacagagggatttgggcatgaaaacgaagaacaacttgaacataaacacttattgagttccaatttgaggccaaacctggctctgataccattgttggattgttttggatcggtttggcacaaagtggaactacaaattgaaatgggattgagtcataccttgatctccagaggttcccattctctgtctttgttcttctctctttctctcttgtttggaagcacagagagagatgtgtttcggttcttccccgtgttctcagtgggttttgcttgatcgggtagcaatcgaatcttagggtttgcacttaagtatcgatttctatttatagccactgcacacagggggaaccgacactaggatatggcggttatcccccgatcagggatgttcatgagagatcgatcactgtagcgatcgccctaaacaaaatatctctttgccgactttaggtttagccgcaagatcatattttgcgttcacactgacacatattacatgatgggattcagttgcaggagcaggagctgaaggttcttctttgaatttaatcttctgctccatttccatccgatgttctgctcctttcacagctcacagactctattctgctatcctatccgttgattttggaacggaagcttaattagctttctgttacacgaacttgcatacttcttttatgcggttgtgattaaattctgagcagaagattttcttccattatctttcaataggcagaatatgtacttctgttagcttgcaataggcagaatatgtactgctattaaaaactgggtatagagaaaaattaggtggttgttctgccaacaattttttaacggcgatgatgttctgccaatttctttagctgacgttctgccagttttttaaattgaccagctaacatatattttctgccggccagaagcagtagattttcttgttgagatgcaatttttttttcctgggatttctttcaattgatgttctgctattttattttgaggtatattacaaattttctgatcatttcactactggctacatgttctccttggacacatgttcgcaaccattactgctgcgccgaggtctttcgctgcttctgaaattcatgttgtaagctgcacgaatatcatgaagtgaacaccaagcgcatctatctattcctaggatttctcatgggaagaggatgacatccatccaaatgaatgtcatatttctggagagagtgattcatctctttactccgggcagcagtatccatgcaatgcacaaaatcattcctgaccaaagaacgcaccaaatagtcagaaccaaacaaacaaacaaacaagagaaaaattttcaacagaacataaacaaaaaataatctccgatatgtaccaatctgcgggcaggtttctgctgcatgacaccattagctgaagtggttccgacttctgcctccgccggattgtgctgcttgctagaactcacaggcgacgatgcgcgtacggctaccaccgtcttctgccgctcgacatcacgcgttgacgtcttctggcaccgcagaaggcgacggaacagaactcgccgacgatgttttgccctttccaccggagggtttctgctccatcaaatatctgcagaaatgatctgcttgctcacaactccaaaggatgcttctgctcactcctcttctaccctacatcaccgtaaacttatatggagtctccgtagcaacctccacacaaactactctcctggtcgcacggccttgcatgcgtgcggatcaacaagccatgcatgcacaacattcaaatgcctcagcatgcagaacatatagcgcagtgatccaatttttcaagaaaagtggatttgtggatattttctctccaaccgttagtgggttgagacccgaaaccttcatgtgaggtggggacaggtacacacacacatatatatatagtaaatttgtttggtgctccatggtgcccgggcaccattgttgaaattgagtatatacccaattcaaatgagtatgaaactttttcaattacctaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatacatatatatacatatatatatacatatatatatatatatacatatatatacatatatatatacatatatatacatatatatatacatatatatacatatatacatatatatatacatatatatacatatatatatatataggacgactcttttgtactcccaggtgtatgtactccctcttcttagtggatatccattagttgataataaataattaaattaaatgggaaaataaattaccgttcacttttgtatttttcgaattctggatgcatgcagttaggccggtacatacggacatacgttaggttcaaattttgatatagttgaggtagcgggcaagtatatacttgtttttcctcgtgtactgtttaaaaagtagtatatgtcactgatgagattcataaattaacagtgtcgtcactgagtatatactgagaattcagaatgaactgtatcagcactttttcaccgtcaaaaaattaagcaatgcgtagcagtatatatactagtttacgtagtagtagttgccgtatatactggagtaccttttaaatagttgtagcagtacatatatacaactttgtttggaggtagtacagtatatgtatactattttttatgtaggaatgcatactttttattatttagtatcagtatataaccttctttactttaacgttagtatactgatctattgaaatgagtatgtactgctcttttctaagtatccagtactcgatcggttaattaggtgtacgtactgtttttatcatgtatccagtatatactaactcagtcggttaagaagtatgtactgtcttttttagtttccagtatatactaaatcaatcggttaatgagaaatatgttgtgtcttttttagtttccagtatatactaaatcaatcggttaatgagaagtatgtactgtcttttttagttaatgagtatgtactgttttttaaaagtatccagcatatactgaaatcctcattgaagcagtatatactattttttaatggcacctagtatgcagtattgtagtacatcgatcgtcgatagaaggtatgtatggatgcacctttttattagattattagcaaaataattaatgaagtacataatacttcaccgagtggtacttattaaataattaagaaaatagtatttatatcacttggtttcaccgaatggtttatataatgagccataaaatgaagtatactagatgaaattgatagtatacatattcccccgcaaaaaaaaagatagtatatatattcaaaacaaaagcagtatgttatgatactacttttatcattgatggaaaaaggagtatagttgtttgaaaaaaggaggaggaaaaagtagtatctatcccagaaaatagtgcatcgtcgacttcatcgccatcagcatggcgtggcaccgatagcagctggcaccgtcgcctggaaacgaccaagggacgaagcacgctgactagtgcaacggattggctactcggctgcgcttggatgaagaaacgccgcgatcatctctgctttgatctgatacgtgggtggatctgttagcacgccgccatgccgtgccgtcgccaatcgatttaaaaaacggccgcagcagccgagggagcgcgagtgatctgtaagcaatagaaatagattaatggaagaactaaacagaagcttcgatctccatgcataaacaagaagcaaagaacaggaaacggaaggacatggcagaatagaatgttacggtgctcatcttcctggcttgatgagttcgattactccgttgcacgcccggcggaaggcaccactatcgcggcgcgcggacggcgtcggtacaccgaggcacagcctagagtcagagcagtgcagccgtccggcgagggtgactagcgatcgacgggatgaaagagacaccgcgccgactggcagctgggaacgcggtagatcgaactaccgccgccgacgaacttgctttttattaatgaaacagatcagtattgttgtgccttccgattaggccgggataattcagaattaatagaatttcttttcaaaaagaaaaggatcaaacgggtttgatacaaacacccggtaggagggtgggatcgattgatcggtgctttccttcgatggacggtggatcaaagcgggagtacatacacctgggtgtacagaatcattttcatatatatatatatatatatatatatatatatatatatatacactagcaaaagtgaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgctgaaatatttggtatttttaagtaggtatgtgtataattaaataaatttacaagtaaagcaagtgtgagaaataaaatgacatggttaaatttaattttttttaattctccatgattagttacgctctttgaaattatatttgaatttttcagagcttaattgttaattttattaatacaaacgtcatttaacaattatttacttggaaaaagaaagaaaatacttccttttaggtttgcttcgaaataaatacattcaataacttataattgtaatgcttctgaaaaaatgagcactaaaaatgaacttattctctttttttgggcctgagggacctaaaatagacttatttccggcccttgccggtcggtccacggccttttgtgcacgcgcaagtgcacttcccctccccaggccacaacctgggcttgggccagaaaagtggcctcactctcgatccctcttgggctgatttcggcctggacgacaccgatcgtccgatctttagggttttgatcggacggccgagcgtcgatatcggggaaacaaaacccctccttctcctcagccgccgaaaccctagcccatttccctccctcccatctcacatcgccgccctcccctccgcgcccccgagcggcggcgacggcgcccctcttcccgcgagcggcggcagcggcgccctcccccacaaccaacggcgcggcgccctctccccgaacaacggcggcgtggaggcggctgcggcccggcgggagcgggaggggcggcgggccggacctcccctccgccagatctggcggcatggaatcggctgtggtccggcgagtccatcagagctgacggcgtcgtctaaatctctctctctatgtgcatggtggggaggtacggcagtggtggtggtgctggacgtcatggaacgccggtcgggcctcgcctccgccagatccggcggtgtggaggcagctgcagcccggcgggggtggaggggcggcgggccggacctcgcctccgccagattcggcggcatggaggcggctgcggtccgacgggggcgggagaggtggcggcgtcgtctctttctctctctctctgtgaatggtgtcggttctcctggtgatgctaaccgaataggacttggtataacagatgggagtttgtttcctatttttgtggaatcggacatattcttttttttccccgatttttcttttaccgcgttgatgaatcggattcgttccggttttttttcacccggtttttttgacggacgatggaagcacctcttattttttaagtagtagtagatatgacactcatatggggcaccatggtgcccgggcaccatggtttcaaatgcacaaaatcactcaaatttttcaaaattttcaaattgtgagtatatacctagttataagaattcgattcatacctatacctatcaacaaaacaactcaaatttaactttatttcacaatccatgattacatacctaaataattatatgtatgattgctatattcctagaatcaaaatctaacgaaaacaagttgaaattcagttcaaacttgctttcaactagttagtaaagtagttaatattaatacctaaagaattgaaaaagtttcatactcatttgaattgggtatatactcgatttcaccaatggtgcccgggcaccatggagcaccaaacaactttaatatatatatat

SEQ ID NO: 23294 - DNA, 1629 bp, Oryza sativa
atattagttacatatcaatgtagttatcaagaaggaaagtacgatctttgtcataaagcatgtatgcatatgcatgtactccaagacagcaagcacatagtaaattttgtaagagaaagaacataggagtatattatatatttaacatttgttagattttgattctaggtatatagcatccatacatataattatttaggtatgtaatcatgtatcgtgcctagagttaaatttgagttgttttgttgataggtataggtatgaatcgaattattataactaggtatatactcacaattttgtttggtgctccatggtgcccgggcaccattgttgaaattgagtataagttactaccgggagtagctactctctccctatccaccctcaattcacatgcggtgcaacgggtgaaggttattttaatcttattatttttatacggtttagttaaggtgaaattcactgtgtgaattcgcttggatatatatatttctagaaaatcatgtgctgcaattaggagtccaatcatctcaatttagcatgcgagtttttataaaaagatatcttgtacgaatcctttcgtattttcgaaagcgaacgaatttaaaacacgactcaaatacatatctgtattttcaaaatcaaacgaacttaaaaactgactcatacacagatgacgtaccaaagtactggaaaaacattggagatggattctaatcacccaagtggacatccacccgtttattgcatgtcaactaaatagttatgaaaaaatttcaaaaaaaattgacaaggtagatcaatatgtaatatattactccacaaacatgcatatgtaaattcaacttgtacaagttgtaacaaaaataacaaatctaactgcaaatataggtatactaatttgagttttatttgttatttttgttacaacttgtagaagatgaattttaacatgcatgtttgtggagtgatatattatatattgatctatcttgataatttttttataactatttagatgatatgcattaaatgggtggacatccactcgagtgattaaaagagttttcccaaaaacatttttaatttttataatagtaaaaataaagatatatagatatacgtgttatgtatgtatgtacatacatatacatatccccatatccatattttctgaaaagtgttgtatccttgtatcaacgtatcgcgtatctgtaaccctgtatctgggtaacatagagatgaactgcctgttgtgctgccttgtgctacttgcgatccacctacattcgacagcgatcgatcggagaatgaaacgaagctgcagttcaggttccgcacgcaaattcagttgatctgttcttctgcagctcatcctgaattttactgcatcttgtgttcttcccttatttctttcactcgaggagctggtgatgtaaatcttttcaagcagcatcaggctttgctttacttcgattacgagagactgtacaaaatggtaattttctaccaccattttctatctgtgttaatgcaatctagcttctcatctctttatgtctgaatgtacatgtacacacgcccactttttctgtgtgttccctaattggttctattttggggcct

SEQ ID NO: 23295 - DNA, 38992 bp, Oryza sativa
cccccccccccccccccctcttttcccctcactagctgtctttattcagtaatcaggaatccccatcaatccagtaatcatcctgaatcatccattatgttaagcacgcatggaaattcagttgaaataagaaataatgttcttgtggttgaaaaattcagtgtatgatgggtcttacattcttgctcgtgctgaagaacagggcatctggtttgatatttgaccatgtgattttcgacataaaaaggtgagatttgaccgtcctaaatggtgacccaataaaagtatatgcgtttgatttgactgcctctggtcttctcctcctagtggcatgttggacctgttacaagtctatcgttttggtcatggttgcatcattagtttattttgttttatatggcatgcttatatattcaattagttcaaatcagaaatttcttctcataagttctcatttgtcacggacctttatttagcccttctttcttaagggtacacgtaaagcgtactcagaggaaagacagttcaccaagaagagtttcagttctaaaagcatacggtttatattctaaagtgaaataagaatatttccttttgcattattgtgccatcaacaaaacgacagcttcataaatcatgatgtatgtatctttgatataggggtaagtaaagtgttagcgtgagaaaaaaaaagggtatgttaccgaatcctatgtttttcttttcttgggggtagttatgttcttaggtaatctttatcaataggaaaaaagttcagatatctgctaaatagtacagaaacagttattagaccatcttaactaacatgaaattgatttttgagacaaccatcacatgcccctgatgacatggcaatctagtttcattgaatctaggagaatgtcgctatgaatggtagaacaatcaatcttcataaatctactcttctgtttcaaaatataaaaactagtatcgaattagtcgcatcttaatcaacgaatctggacaagggtatgtcccgttatactaggatatgtccaatccgatcataaattactatatattttagaatggagggattatcatacataagtactaaaacacatgtaaaaacggaaaaaagaaaaagaaaagcatccccatgaaaaaataaaaatgtttttgtgctgccactgaaagttacagtccacacaagactgaaattgcacttcactgggtgcaacacaaaatgtgcaccagaatatttaggaccaaaacgaagctatccattttggattaggtccaaaaacaaaaaacaaaaagattatattttcctctctctctctctctctctatccatcatctcctcctctgctttttagttttctctcccattttggcttcgccccacccactgcctctctccccactgtgctcgcatcgcaggaagaacccgaccggcgacgcctcctccacggcgaaatccccatagttttctccacgaatcgatccaattcgcggcctttcccttccccctggggccaattcgcgtggaaattcgggaaaaaaaaggcgggatttttctgcctttttctttacccccctttccctttttgactctccgcacggttcttctttttattggtgtcactgattgtgtttctcgtggaaaaggcgcggttttaggggtcgtctcgatcgcggatttggctccggaggcgtcgatttgatcctagcaaggtgcggtttttttttttttgttttgtgctatatatgaggtgaattcgtttccctgcttcttacggcgttttaattaatttgatgatcagattgaggaatgatggattcgtgaattttgatcgagttgcttgtttggacgatccgttatgattaagcaaatcctgggccggcttcccaagaaggagaagccgggcaagtccggggagaaggatttggccggagtcggctcgtcgctgcctgatgcaagaaccaccacggatttgaccatgtctagtaggatcgccaatcctaacaattatacagccgcggtcacaaatcccggccagaattacaccgtcaagaacgcccatcatgggggtgctggtgtcagcaatggtttcttggcgccgcccgtgtttgaggcgcttccgagcttacgggatgcgccggcgccagagaagcccagcttgtttctccggaaggtggtcatgtgctatgtggttttcgacttcacggacccgaccaaggatgtcaaggagaaggagatcaagaggcaaacattgctggagctcgtggattatgtcacctcagctacggggaaattcccggagcccgctgtgcaggaggtcatcaaaatggtgtccaccaacttgttcagggtaccgaaccccgcgccaagagagaacaagccgcttgagtcatttgatatggaggaggaagaacctgtcatggacccggcttggccgcacttgcagattgtgtatgaactattcttaaggtttgtccagtctcctgagaccgatgctaagctggccaagagatacgtcgatcatggtttcattatcaagctgcttgatctctttgactcggaggatcctagggaaagggagtatttgaagacaatacttcataggatatatgggaagttcatggtgcaccgtccattcattaggaaggcgattaataatatcttctacaggttcatatttgagacagaaaagcataacgggattgctgagctattagagattttggggagtataatcaatggttttgctttgccactcaaggaagagcacaaattgtttcttgtgcgagcattgattccactccacaaaccaaaatgtgttagcatgtatcatcaacaactgtcatattgtgttactcagtttgttgagaaggactgcaagcttgcggatactgttataaggggtttacttaaatactggcccatcacgaatagtgctaaggaggtgatgtttttgggcgagttagaagaggttttggaagccactcagccagcagaatttcagagatgtatggtgtcacttttctgtcagatcgcccgctgtctgaatagttctcactttcaggtaaaaatgaattttactgaatggcagttaaaccataagcatgtaatattgtttttgctagttgttgtatgcttgtgcattcagttcttgtcaatgttgatatggaaataggcatttatcattttaaaactatttattagattatctatcagatggaataccaatattacagatagcatggccatttcagcgatccacattccacggttgatttctttccaacagccaatacatgtatttcagcacacaagtcgtaccaattatggttattctttatagagttgggctgttgattattaccatgtttgctatatgatagccagatagcctgttggcacaattttggaccaatacaagatagggctgttaaatgcccaaagtatttactatatgaatcctgggctcctcactaaagtacataccaatttgtgaatccatactaaaattctatcacattacccttccatgtaactgtagctgacaatttttatcctttgaattgctgttttgcactaacacatggatctcatattaaatgatcatttacaatgtatacttcaagaaacgtgtccatgcatgcttctgtgttatgtttatgcagtttcttttgtctgctgataataccatcctttttttggatttatggtatgctgttcactttcttctgagaagtggagatgtatatcctaaagttaggatgtaccaccggttgagacggttggttttcacaaacaaaatcggtggaggctgagatgattaggtctagggagagatcatttttcttgccataatgttgccaaaaaaactgaaaccaaatttaaatttttatgtgaaaaagagatgaagctggcatcgacaggactcgaaccacagaacttaccctgtatagtagtaagagctaccgctaggcttgtttgtatatacaatttaaattaaaaaaaattcccctggtatgcaattgtttcggacccatccaagatgacaagatattggtgaaatttcactgagatcctgatccatggatgtgtgatattatatgtattttactagttggcgtttgagaatgaccatcagctacttgatcatttgcttgatgatcaaattgtgttgtgtttaagtttttgtgataaacgaaacttaagctttttaattttctagtgaccccatgctacctgtttgtcatagaaggtaatggcgtattgattcttattttttcttgttttgcaggtggcagagcgagctctgtttctgtggaacaacgaccatattgaggtcttgatcaagcagaacagcaaggtgatactgcccataatccttcctgcaatagaacgaaatacaaaagaacactggaaccaggcagttcaaagcttgagtcttaatgttcgcaagatattcatggatcatgaccctgtactgtttgaggagtgcctcaagaagtttgaggaagatgaagcaaaagaaaccgcgttgagatcaaaacgtgaggccacatggaagcgcctagaagagattgcctcgtcaaaaactatcagcagtgagccagcagttcctccagaggctacagttcattagcagcgctcctcagcgttgcttgctgaatgctgacgtcgtatgagcagctcgtttgccagatctagttagatcactgatgtgaatgctcatggattcctgcatgcctcatgttacttgctcctgaacattttcgcaggctgacttgtatatacaaggtagatgatggacttcgaatcttcaacagggctcagagctgtgtctgttccgagatcgtagcacctgttcttcgccgtgggacaaaggaaaggaggcagattatgtccttgcttttctgagatgtatgtgctagcctgctaggggtcaaggtgcagactggagctcagtgccctgatgttgaggacggttagcagcacatgagagagtagcaagtaggaacagagtttgcttgttgatcatggttttgcagaaatacaatgtttttatgtatgaataacttcgagtcttatcatgataatatgtaccccgggtgtacatgtgtttgctttttctagatgtatacagaaatttgtaacgaggaatgcttcctgcttgcatcaatcgatgcagagttgctgactggtggtcaatttggaattattgcatttttgtctgccttgtttaggggttgtttggttggtggctaaacttgccacaccacactttgattgatttagttcgtgcttcaggcacaaaacacccagttttttttactggttctttttcactgattggttcagtatatgtgtttgcttcagaggatgtatgaaaaaaaaattaaatgagcaatgctcctgtgcagtgagcaattgtcttgaatcgatgagtatgatctcagtttttaatggaaaagaaaaggtttttatctgcaattttcatggaattaagctgcaaaaaaaactaaattagcaaatggcaacggcagtctgcaggtctcaacagaaagaaacctgtgtttcagcaaaatgtgacatttgtgtgtggcagatgatcaagaatcggaggaaaacgactatttcttttaaaatggaaagagtagaaatgttgaatgcacctgcagactgctgataatttatctgaatgcggagtattgaattgattccactctaattctaacccggcattgtactagttgccaactagcttcaagatttaactaattaatttaagaagctcgacagaaaattctgtaagtatctgtgatggtgtaaccctcagaacacatttcatattgcatctgggaaaggtgaagatgatatactggaggaaaccaaatcttttgcaatagcaggatctgaagctcaagatttggtcccatccagctctcacattcagcttccaaggttgttcgttcagctcactaattgcaccattattcactgtctgacaactgaacatgagatattggaggaaaccaaatcttgcgttaatctgcaagtctgcagtaagatttggtcccatccaaacctcaaattcaactgccaaagattatggtttgtgatgcctagctaagctaccactccacacatttacagtcactgcagataaggcgccgaagataagatgttggaggaaactgaactcctgaaactgttactaacaaagtgacaaagaaagagttcagtttcctgcaactcttaccttcagtgcaaaaacatatgctatcagctgcagtatttcatcctcatggggctgacattttataggccagttcaaaatgaacttctgaagtttctgctctatctactcgtccaatgttctctagcatgagttgtgcatgttcagaaagaaaggctcttaaagtaattccaatttctaacaaactctgaccagaccagaaaaacactgtggtatgcatttgcatttgaccacttgtgcttgtcacaaatcattttttttttatttgaaagggacctacaaatcagaagtttaatgagtcatgaatagggtatactgcattttgactcacatgtcttacgttgctacttgctagtatttgattctctattaaaacaagtagtaagtaccttttattgttctgaactgtttttcatctactcagaaatagtcggtactgtaaagtatgacatctcatcagaaattcggaacatcagagcaacagctagcatgaccagcactgaatactggggaaaggaaagggcttctgaaatctgaatccacatctcaattccaggttcccttcaccacatcgataaccaatagaataagaagaaacgaaaattttgatgtaatactcctcgttttttaatatagaatgccattgaatttctgacaaacattttaccattcatcatattaaaaaaattcaaacatatttttatataagtcgtgcttaaacaacctttaataataaatcaagccagagcaaaataaataataattacatatttttttgagtaatacgaatggtcaaaaataactaaaacataactacaagagttaatggcatcatatattaaaaaaaaggaagtggtagatgacagaaatcaaatttattcaggaggatcagcttgatgtgactgacactgtagctttgtctccctactgatctgacatctgaccacgcatggtgcggaggccggaggcaacttgactattaagaaaatagatgcacaatgaagacacaaattttaagtggaaaacccttgtgggaaaaaatcacggatatcgaccggcaataatcactattgaggagttgattacaaacgtagggagataataatgggaacgtcaccccttcccctacagtttacaagagtatatatataggagagacacctaataggaaaagatatggagtcctattagaaaactaatccgaatatattgtaagcctaaaattaattcggatcacatatttaacatcgacctcgtggctctgccgctctggcggaccctcctagccttgccggtgaggcggcgcgcgtgcattccatcttccacgtcgccggcgacctcaatcgaccattccagctaactctcctgcagccaaggttcgtgcatcccttcctttagttccatttattttcttcacgcgaagagagcctgaggcatccttggagattgactgtgtatagtccacgactccacggtgagattgctgaaagtctgaaactgtaaatagaaaaagcaccatgctttatctctgattagcttcagaaaatttggaaaagagttatgcttgtatgcggtgagaaattgtctcaaattgatggctgcgagctagtctttaactaaaagaaggaagttttatgtgcatctttcatggagctaagctaccaaaaattagagttaagcaaatggcaactgctgtatgctgctgcctgcacatttcagcaaaatgtgatacttgtgtgggcagatgatcaagaattagcatatgctacttgttcagtggaaaaggagtattttttttcgagaatacgctaggagcgtatctttgtattaagaggaataaaagttatttacatagaaatacaagattgaagagtatgaaaggtttttttttaaaaaaaaaaactggtatgaaatgtaattgcttctactgctaatttatctgtttagcaacttgattactgcagaatgctcagcattggaaataacaggacagccatatttccctacactgcatctgttccactctaattccaatcccactctgtacccatttctaaacagaaaatgctataaacaaaacacattttatgttgcatctggccatcttggacaattgaaggtgagatactggaggaaaccaaatcttgtgccatggcaagatctgaagctcaggatttggccccatccaactctcacattcagcttccaaggttgttccacccataagttaaagctcactaattgcaccactattcactgtctgacaactgaacatgagatattggaggaaaccaaatcttgtcttgctctgcaagtctgcagtaagatttggtcccatccaaacctcaaattcagctgccaaagattatggttgtgatacctaaccaagctaccactccacatatttatagtcactacaaagattaaggcgccgaagataagatgttggagaaaactgagctcctgaaactgtcactgacaagaaagagttcagtttcctacaactcttaccttcagagctaaaaccatatgctgtctgttgcaatgtttcagccttatggagctgccattttatagaccatttcaatctgaagttcttcctctactccatgcaatgttctctagcatgagctgtgcatgttcagaaaaagaagtgcagaaagtggttccactttctaacaaactctgaccagaccagaaacataccatggtatgcatttgcatttgatatacttctgcttcctataaatcacacttttaatggttcatgaataaggtatgctgcatttcgacttctcacatgtcctaagctgctagtatctgcatctatattaaaaccagtaggttcttccttgagatttcaatgccatttaattaatacggacaccaacacactgacaaacacctagtactggcatagcatcagattatccggatctgtaaaatttatatgcttcttcagagttcagattagctgagaagtagtagattactaagtcggtaagtcccacaccccatgtgtgttgtaagagtacaaaaggtaaactagttgcaggagcaacagtacagttaataaagtattaccaggacaattgccttttttttattaaccttttggcaagggctccacattggaattctgcagggttttgaggcatcatcactcatacaaagataatacaatacaatgcaagttgtaattacttaatacttacccttaaccaacctccaacaagggttaatgcagggtttaatgtgaggaccctttaaaggaccacatttgactttgctttgaggtaagggttcttttaactttggatttcttgatcaaccctaaggacaaatattactgcaaaccatcaagttaactactctgtcaagtgtgaaatacagtagtatggtaaaatttgtgctgaaagttggttacataagctactgttagatgatccatgacaaccctgaaacctatatcccagcttcaactaaggtgactgcaattactgggtataattgcaccgttgatcactgaggaattgcaacaagtcaattttcattccatcgatatgcaaaatatttgtctaagaggatattttccaagacaaagaaaagctattttgagatatggtaagtataattcttccaagtgattcagattcaacgaagttcacagcccactatttccttttgacttctaaagacaaaagtgaacagggtatcacatgctaatatggatgtgccaaaacattttgtccaagtagggccttgatggtcctaacctaagcaaacattttggtgaccaccaacttcaacgcgtggaagatttcatcgttcaaacgctattagccaaccaaatatttgattgattatcgtttttccttttaagaaaaaagacaatgaaaatgataggtaaagttgatgcaataagaaagtaaaataatttccagaaaaaaaaatcatcaccagtaatttatgatctatctatgtccaagtttgtaggattagtgatgtgtttaaaatatttaaacaagtaatataacacaaaggctttgaaaccctccttttccagtgaaacaatgtgtattcatttcccattgttctcctcattagtcattaatctgtcattttctatgaaaagaaaagaaagaaagatggaaatggaaagaacacctgttacttaagagaaataccccctacattattccctaaataaaattccctaatcttcaataggcagaattggataccttgccccatgtgcaccccaataattgctgttccaagccccaaaaaaaaacactttccaccaacatcccacctcaccccaaccaactgacgcaacggccccacctccctgtccccacatgtcattgtcacacacacgcgcgccccattggacatagcctagtactaccttcgtcctaaattaatggtcgctttgactttttttatgtaatgtttgaccactcatcttattagaaaaaataatgcaaatataaaaaattataagtcacgtttaaagtacttttgataataaagcaagtcacaaataaaataagtaataattctattttttaataagatacaaacagaaactcagagcgacaagtctcactgacaggttgtccccgtgggacccacctgtcattggcacccaccgcgccgcgtggagcgcctgccatttgggtcaccgacatgtggggacaggtgtggaccggcgtgcgcgcgggtataaacggcaaccaccgccgcttcggattcggagcctccgcctcctcgccatttacggcagcaaccgcggcggagagagacgaccgaggagagagagagagagagagagagagagagggagagctccagtggtcgccgccggcgaggaggagcagtgaatggtgcggcgcgtggggttagccggcgctcgtggatcgatctgagcgagaggggagctgctggagacagtggtgcgtgcgtccgcggcatggcgttggcggcgaaggagaggaagctgagtaggcttgggagtaagggcagtggcggaggagggggaggtgggagtttcggggcgagggggcagcgggcgccggcggggacgcagcggcggctgttcgcggcgttcttcgcgttcctcttcgccggcgcggtgctcttcggcgccgcgcacgtcattggaggtgagactcgtttttccccctcgcctccgccttggtcgcttctggggacggcggcggagttggttggctgccgccgtggcgtgggggggagttgaattggatcttggttgggtttaggtaggccagtggaatcatgctcccatgacaatcttgtggttggaggcgcggtttggatcgattcaattggactcacgcgaatgatttgagggaaagtttcttttgcatttttgtttatttagatttgtttctggtatgcgtttagtgtttgctgttggggagtggtgaagaaaaagttctctctttcttgtggggttgcaaatcgcgtggcagatctgaggggtctcactgttccaacaaaatttgtagtgtttttttttctcattccattcttgcgtggttcgcgatttccggaatgttacgctggcttgcgagtttactaaattgcaactagtgttgctgctactgccgtttgactgaattgatactgtgaattctgggaatagaaaaggcttatcttggtcacatgaagaacgtttctgttgatgcaatctgaattcacccatgccgaatccgtttggctctttaatttatggacggaatgtgctgtgctaactaatcccatgttcgtgttgtccccctgatgcagcatccttccggcccgtgctcaagaccgcgtggccgtcggccaccctgaacgccgtgtcgtcggagcgcggcgcgcagcaagccggcatggtcagcgtcgacgccgtgttgccttctgttcatatccagcacgcggttgccttgccggaccatgttctcctgatgctcagagatggctcattgctgccggcttcggggcaatttgagtgcctgtactcccctgtcaactcgtcgcagctgcgtcgccagcccttgtccgtcgctaccttgccggatggacccagcctcgtccattgtcccgccggaccatccagggtcgctgtgtccctctcactggcgcagtcggttccggtggcgccgttgcaatgggatcggctggtgtacactgcacttattgacagcaaggacaactccaccgttgtgtttgcaaaggggatgaacctccgtccgggtcgtctaggtgtgccatcacggtacgagtgtgtctttggccgagacttttcgaagccaaagcttgttgtcacctccccagtggtttctgctgctcaggagatattccggtgtgtgacaccagttcgcattcgccggtacctccggatgactaccggtggcaaaaacagcgtaaacaatgatgacaagcctatgttggtctccatcaggactaagggccggggaagctctacactcccctcaatcgcgcaaccggagccgcttcctcggtacaacaagcattggagacgaaaggcacactcaatgtgtgtctgcaccatgcttcgcaaccaagcacggttcctgcgggaatggatcatctatcactcacgtattggtgtgcagcggtggttcatctatgacaacaacagcgacgatggcattgaggaggtcctcaacaccatggattcatccaggtacaatgtgacacgctatttatggccatggatgaaatctcaggaggctggatttgcacattgtgcactcagggctcgagagagctgtgagtgggtggggttcattgacatagatgagttcctgcacttccctggcaaccaaacactacaagatgtcctccgaaattactctgtcaagccacggatcggtgagctcaggactgcatgccatagttttggtccatcaggccggactaagatcccaaagaaaggtgttacaacaggctacacctgccggctggctgcacctgagcgccataagtcaattgtcaggccagacgcattgaacccatccctcatcaatgtggtgcaccacttccatctgaaggaagggatgaaatatgtgaacattggtcagggtatgatgctgatcaaccactacaaataccaagtctgggaggtgttcaaggataagttctccggacgtgtcgcgacatatgttgctgattggcaggacgaggagaatgttggatcaagggacagggctcctgggcttgggaccaaaccggttgaaccagaggattggccgagacgtttctgtgaagtatatgataacggtttgaaagattttgttcagaaagttttcacagacccacacactggaaatcttccatggtagattggtaaacactgtatttggtcttgcacagcacggcaccacaatacatgacatggagacacagacagggaaagaagaaccaaaaagaaattagatagaagagcgatttgctctttggtatattttttgaattttaaggtcttttgatcttttcttagttcattagaatcatcattttttgttacatatctaagaaggaaatgattcttttgtagataaagataggtagcacaattcattgtaagtttggttggggggagacaatcaatacaatcaatttcttgatttcatttttttttctcaagttgctatatttggctttattttctgttaccatatggataacacaaaactgaaatcacagtgcctgttcagttgttcacctatctgacaatgcaaacaaaatcgttgtgaagaaggctacaaccgagttcagtaaccacgagctggttaactggccgtttgtgatgcagacaaggatggtacaccttcctttgatgtggtcctggaagcatatttggcttttccagggaaaaatcatacccgggtaatctatgctgcctgctttcttttgatttttttactttatatttacatcatgactactttatctctagcatctttatatgtagtagctttgggaatgtattcttcttatgtcatacaggctattttcactaaagctggtggaaacgtatctgaagagactgcatcaacatccaggtcactctctcaaccatctttcattactgaactttcatggttaggttaacttaatctggcacatacaagcactcactggataaatcctaggtctctttccctctttaacttattgtactcccttcttgttaattatctaaagttccttgacaggatgtccttgtcttcctcgaaggtcccagatctttattttactagtatccataaatttatcaggataggcttgcacatagtttagtcagagcaaatgaagcaaacagacatggcctttttaatttcctatcctctaacccacaaattaatgttagttttgctgtactaatcaagaaaaaaagctatggacaacaatacttaaagctggcaagtgtggattggtttggtgccttctggtgatgttgctatctgaagataactcatagtagaactgagaaagactgaaagaataaagtacacacatttggccagtgatttggcagtttggtaccccatcagtataaatgtataatagtataatagtaatagtataatgcccatatgtatactatcatgacaatgaatgtatggagacatgtgagctgctatgataatgctgttgctaagtcggaccttgaaatcttcatgcagtggacaacagtgcctgaatttctggcaggtaataagctggcacacctttgcttgtctctctggcatgcagagcaaaatcctccactttgcaccctgaattggttggctcatttcattccagtgtgtagtagctctggaaattctgttgcattgtgcctcactgcatattggatgatgatggggcttcagatttagatgcagggcagctggatccataccgcgtactgtactattgtacaggcccgttcctgtacaattggttcttgtctccctgaaaaatttgatccattaggttaccgtctatgcaatgcaagttcttggcaaatgcattgatcatctaaaagtttctcgtttatcagctggcgctatgattttataattttttatgctatatcaatataaaaggtcgtactatcttgttcggatcatttaaaaaaattgtcagctgtctgaaaacgttgactggaaatggttgggcaatcaaaggatacaacggcttcttatttatattatatatattgagtttcttcagctgctgtcggttatgaactcaacatccaaggccaactgatcaagaacgtcatgggtcgcactcatgcaaggggcacatttaaatcgttccaccattctgcaggcaccttcctaggattacctaatgatctggtaatcttaatctcgcagtaattctgaagaaacagtaaacatatccattctcactgacctgataaaagaatcctttctttcttaccaacagagaatcacagaacaaaagcaacaaacaaaaaaaaaagatgatgagaattgacatcaaaaaaggaaggaaaaaaaagagagaggaagaagaaatacaggtagagtggtgggtccacagttaggcattcggatgcagcgttgctgacattaattccagaagcaatctgagctttctgttgatgtgctggagcattcgagctttctgcaagtaaactattgagcaactgtatatttgccagctcaacccaaaaagacaacgaaaaaagaacaggagaaataacaagaataatcgaagtcccaatcatttgcctaataatgccggaatatgcgtggcaatatggtatgcatatggggataggccacgagacttcctgttcgttctcctttcctcttctttatcgttttctccatgtcgttctgtccatcacaagcgtgcacttcacaattagtacaacaagatgatgatcaaatctcaattatttgcagtacttgtccacacaatttcgcaatgtagacttttcgagccccaaatcctaccaactttggggtcactgaatttggcccattagctatgtgttataatccaagaaaataataagagctgtacttcatgtaatagtataaaccaacatcacttcactgcaatttgtaagtcaccagcagcactagcaggatcagaagttaagcagagaaaaaggcaaaggcacatgaagcaaattggcaattaacacacaacagaggaatcggttcagactaggtattttgccacataacaactataccttacacctagaaatgcaagttcactaaatattggtcacagatcaactagggttgtgttgggtaagttcactctactgctgaagaagaaagaggaactgaagttgaagaatcgaaatccttcgtcagacagaaaacatcagtgccatttttaagttcatctgtaagaagcgagctccaaaagaacatcaatgtcatttatcggttcatctgtaagaagggagctctcctccaggaagctcccaattgtcatgcttatcatcctccatgatcccctcctttggttcctgctcgtcaccaaatgggtacggacccttgaaatgcctgcagtagaaatgataggaccaattatagaaaaggcatgtgacattgtgacaaacaaaatgaactcaagaggaaagtacaaagcataatcatggatgactcctcatgctacacattctaaatgtcaaaagtatgctactgtaatgtacaatcgatggtcaatttgtcagctcctagttatctctacatgggaatacacgtttgccatgatgaattcatggctgagaattggatcaatatgtccaaggctaggatagaagcaatgcgatcatcgcataaaaagaaactactggtggatatcctaacaaaaacacaggaccatctttcttgctaagaaaaggggatcatctcataagctcaattgctttcattcaggactgaaatgctaatgacaatgaatttgcaagatggtcgtacagtccaatgaccacattcagaggagcatgacaatcagtagcatcagagtgctgaaatgctaataatattcacatatgctcgatgtattatagcaatataagacaaaaattcaccgctaaagaggcagcattgcattcttgtaacaagtgaaatcagtcactgaaatatcaaatgggcctaaaatggagctcaaacaggctatgattaattgattatagttttccgatgcaggtgcccaatattagaacagatcaaggagatttcatgacgctggcagaaatcgcacgattaattagggcctaaaatagtgagcacatgaaatgaatcaccaacattcaacaacagtagaaggcagcagctaatctgcagccgacgaaatggggagagaaaataataggatcaactttgatcgggcgtaaggcgggatcacggaagcaatcgaccgatggaacgacgagggcctcacctccggcgaaacctccgggcggcggagcgggccttgcgcttgcgcttgtcccgggcgtcctcgtgcctccgccgccacctgatctcctccatgactcccgcacgggccacctcccgcctgaaccgctgaagcagctcctccccgtccacctcctcgtcgcccgcgttcaccttcgcgttgtggtacttggggttggccgacggcggggcgggggccggggcggaggaggccgagaggagggaggtcgtgggaggcgatcgccgcgggaaggagacgaaggtggccctggtgttcgcccagaggagactaggtgtaggcggtgagatgatccccgcggtggcggctgcggcggcggcggcgcacatggtggtggtcgccggcgacggggacgcagaggttggtgggctttttgggtttgagcctttcaggtggagatggagaggccgtggataatagggatttggactggaagttacgttgcttgatgggccttataaattgggcctaaataaaacatgggtctatttgtgcagcgcgtttcaatttgggaaaaagtacatcgaaggtctctcaacttatcatcgagttacaaaatcgtccttaatcgcaaaactagatacaacgcatcctccaacttacagaaccagtgtaaactcagcgtagacctacgcgggtcccacatgtcagcctcttttttccctcccctctccacctttcttcctctctcctctctcatcccctctcttctgtgtatctaccagaacccgctcgcgtgccgcccaaggaggtggtggctggcggcgtcagcgccgtcaaggagtacatggccaggcagtggcgcgacgcccgcgccgaggaggcgcgccggggcagcgtcgtcgccaagagccccaaggtgtcgatgcctaagaggtggcttgtgcgcagcatgtcattgatgggtagatgggtgtccgacgtcatgaggtacaacaccgggtaggcggcgagagaggagctgtgcgcgagcctctgccggtgaaggagcggcacgcaagtggtgggggagtagctgcgcgcgggggtgggtcgcacttcttctgcccatggcgaggggatagcgtggagagccgccgcccatggcaaggacgccatcaaggtcgaagggcggcgcaaagatggaggagacgcggaagagcaagatgtggcgcgcgtcctcctccttctcctcgaacccgtcgccatcatcgtcgttgtccaccactgccccgctccgcgccgccagcttcgcgtgccaccgccttgcaggcctatctactccgcccaccaccgcctcgctccacgtcgtcggcttcgagcgctgccgctctgcccaccgtcgcccctcttcacctacctggtccgcccaccgtcggcttcgcgcgccgtcgtcccactccgcttggctgctccgctcaccgctactccgctccgccctacctgccgtcaccccattccacctgccttccccagcccaccaccgcctcgccggcttcgtgcgccactgctacgcctcgccgtcgccccactccgcccgccgccgccgccccgctccatcccgccggctttgtgacgcggatagatacagagaagaggggaggagagcgaagaggagcgaggaagaaacatggagaggggagggaaagaagaggctgacgtgtggggtcacgtgggtaccatgctgagctgccacattaggcaaaaccagagtcaaaaccgccaagggacttagtttgtcctggtttcgtaagttgggttatccgctgtatttggttttgcggttcaagaacgattttgtaacttgatgacaagttgagagatcttcggtgtacgttttcctttaactttgttgctttactcttgcagaaccttttcttttattttctttttttccttttttgaaagaaagaacactatacagcctgtttaaatttgctgaagacgcttttgtttcgttgatgctaacttttgtggatttcacgccggaattgtaaaaagaagactactggtagcaaatactccctccgtttgatattataagttgtttggattttttttctagtcaaacttcaatagattcgactaaatttatagaaaaatttagcaatttctacaacactaaatttcattaaatgtaatattaaatatattttataatatgtttggacgaaaagtatttatgtattttttctataaaattatagagtttgacaagaaaaaaaaatccaaacaacttataatatataacatataacggaggtaatagaagtgatggagcaaaacatatgaagagactttcgggaaggtataatgctgcagtctgcttgaagatctggattgagctccaagcaaatagcaatcccctcttttatccttcgcaaaaggaaaaaaaataacctcctccttttctcttttcgagaatacacacgaggaccactaaagtatggatcgatcgatcacaaaaatttaaggagggggaaagccctgaaacaaacactcgagtaagaaaatgctgaatatgtagtgcatgttggggaaactgttcggatggtgtcccttatttatttaaaaaatcatcgaaatagttatcaaaaatattaaaaaaataacagcattcatatgttgaagtttaggccgggaattgttaaagaagactactatcaaagaggggcacggtgatggctacaagatgaagctaaggtagaacaaaacatatggaaagacttttagggaaggaattaatgctggataaagatccggaattgtgctcgaagcaattaacaatcacttctttttcaagaaaaacacatgaggaccactataatacgatacgggtcgatgacaaattgaggctggtaaataacccccattttaaatggaggtttaccgagacgccagtagtacggtctgagaaaataagctatttatattatagacaggtgggagaacaaaatttccgaagatttcaggaattgtcatacttttttttgcacggaattatttgaaattttagcaaattttattttgactaaatttgaataaactttgaccaaattcaaaaaagttggaaaaaaaccgaaaacttttggctgagatatttgcttgcctagggccggggagaggggggtggggggttattttcgaaacaaaattgtaatcaccgtgaagaaaccatttgccaaaatgcattgttgtgataggcctccctccagaactgtgcagcccagctcaaccgacgagcgagccaacttacacataccaatccacttttcgttctcgcttcgtataaaagggttaacccggaagtaatatggttgaagggaagatgccttataaattggttccactcgtgctaaacttgcaaggtgatgctaaacatgcgcacacagctctcatgggctatacatgcctcatcctaattgtgccaggatgtcacaatttttcaggcctggctaatgggcgatcgatcgcttatccccatccacccctatacactcctctcccccttcctcctccccttctcttccttctacaccgtaaatttaaaaaaaaaaaaacagagttgggaaaatttatgtacaaacatactatatatatatatatatatataatatttgaattcaaattcaaatttgaatcgagtatataaacttttgacttataaaatttgggtctataaaatttaggtgtataaactttagatgtatagaaatactatatatataaaatatttgaattcaaattcaaatttgaatcggatatataagcttttgatttataaactttgggtctctaaactttagatatgtaaacttgaggtgtacaaactttaggtgcataaatttactaaaatagaaaagtaatacatgcggtatcaaaaaagcaaaccaggtggaggaaatctgatcgcccctgacgatcgatcgccaggtagcaatctcgcaatttttcatagacagttctttaagaccaccatcgactatatatatatatatatatatatatatatatatttgtcctagtactcaagcaaatgagaccacacatctgtacatttccgagttgggggcaatggtcagtatatatatgggcgtgtgcagcgagtgaatcaattagccaaacaaattaaaacctagccattcccttgcaacaatcctgcatcgcgcgcgcatttacgtgtattggcgccaccatgaacattactaggagttatattaataacaagcatggtggtccgcgcatattgcacggctagcatcattatattttctctcatataatagcatatatgttttctcattatattattcaaatatattaaaatgacaacataattttaaattttgcactaactttataaaactactaatgtgtaatattcatattatattttatatatgtgctagttattaattatttttaatatcaaattttagttattcgtaaattatatatattcctatctggactctagactcgtcttttaatatttatttttttaattccgaattttctgtaaattgtagttctatatagactctatgctcttcttccaatattatttatttttatttctgaatttttattatttctaattgtatttctatgtggactttaaactcatctttcaatattctttaattttttaatttcgaatttcagttacttctaaattgtattcctatatggactatatactctacttctaatattccttatttttaattacgaatttcagttatttcctaattgtatttctatatggactctagtctcctcttctaatattctttattttttaattccgaatttcaattatttctaaattgtatttctatatgtactctagtctcctattctaatattccttattttttaattccgaatttcagctatttctaaattgtatttgtatatggactctgctttttatttttctccgattaatatgagaatttctaggccatgagagcggccgtgaaggctctattttctattcctttaataataactagcatagtggccctcgcagattgcgcggctagcatcattatattttctctcatgtaatagcatatatgttttctcattatattattcaaatatattaaaatgacaacataattttaaattttgcaataactttacaaaactactaatgtgtaatattcatattatattttatatacatgttagttattaattatttttaatatcaaattttagttatttgtaaattatatatattcctatatggactttagactcgtcttttaaaaaaatttaattccgatttttttgtaaattgtatttctatatagactttatgctcttcttccaatattatttatttttatttctgaatttttatattatatttatatatgtgttagttattaattatttttaatatcaaattttagttatttgtaaattatatatattcctatatggactctagccttgtcttttaatatttcatatttttaactccgaattttctgtaaattgtatttctatatagaatctatgctcttcttccaatattatttatttttatttctgaatttttattatttctaattgtatttctatgtggactctaaactcatctttcaatattctttaatttttaatttcgaatttcagttacttctaaattgtattcctatatttgtattcctatattgaccttaaactcttcttcccatgtttttcttaatttcaaattttagttatttgtaaattgtacttttatacggactctaaattctacttttaattttattatgtttattccaaattttagttagttttaaattcctatatggactctatacactacttctaatattccttattttttaattccgaatttctatttttttttcttaattgtatttctatatggactctatactctacttctaatattccttatttttaattccaaatttatattatttcctaattgtatttctatatagactctatactctatttctaatatttcttatttttaattccgaatttcagttatttcctaactatatttttatatggactctgttttttctttttctccgattaatgtgagaatttctaggccataagagcgaacatgcaggcttctttttctattcctttaattaataatataatagatataatagatagatagatcccacggtagaggggacaataataccgcctatccaagagagggtgacatttgagaggcttgaggctgatttctgcaagaatgagagaaagatccataggtttccacaaggcctaagaagatggatcgggggtgaaggcgaccgctacatcgtcccaaccttcgttgccctgggtccgtaccaccatggcgagcctcacctgcaaaagacggaggagctgaagtacgcaacggcacactacttgtgcatgaagtggggccgctcggttgaggaagtctacggcaaggtcctcgccgtcgccggcgaggcccacggctgctacgacaacgacgacgacgccgtcgctcagttcagcgacgacgagttcgcggagatgatgttcctggatggctgcttccttctgaagtatatggtcctcgataatgattgttctctgttggaaaaccggatggttttgtcgacggggccatgcatccagagagacattgtgctgttggagaaccagattccatggctagtgctggatgccctcatgagtatcatcagtcctatagatgtacacatgtttcttacagccgtgatatctgatccgatctatgttgccagagagcgtcgtcttcttattactgacagagatgttatcgtgaagagctccgtcccgcatttgctaggcctcgccagatcacacctaatcgatggcatgccaactgatcatctagagcttgggtttagtgacgatgacgacgacgaccacgacacaagactgtccattagcgcagctgaccccaagcaggaacgcatggttcgatcgccgacatgaacctcagcagcagaaaagtgctccccctcttcggtgagctttccctgacgcccttgttcctaaatgattccatcgcttgctggctggtcaacatggtggcgctcgaggcttgttgcagtaaggagtatcctcgcgatggcttcgtcgtcagctcctacctctcgctcctggcgatgctgatggacaaggaagaggacgtgcacgagctgcgagccaggcacatcgtcgacagcttttttagtgatcaggaaatgctcgccttcttcaagggcctcgcaaggcacctccgcctcggctcccgctacttcgcggcgatacaaaagatagaagcctacaagcacgataaaagggtgttcatcgccgtgcacaagttcttctaccacaatctcaagatcatcgtcaggctcatctggagtttttttaccgtccagcagagggcctcggtaccaactcgtgaccgttcagtatgtgtaatccgacggtccaaaacaataggtacatggtggtaccaccactccgtccgtgaggtaccgagcatccaaagcgccctgaaagggtacaatggtcttatcgcgtcaaaaagcttcggcttttcctcttccttcccccagcgccgtcacacctcactcgaagcgccgccgccgacggcgagcacacgtctccgacctccaacctaccccctgcgacggaaggagctttacctgcaggctgtcgatgaaatcctcgccgaccactgccttccctgcaggtgctccgcgccatctccaccgggccaagttcctctttcccagcgtggttgcgtcgtcccgaagtctctcttcctctggccagagggtggtgccactcgtttggagacttaggtgggagggccttggcttctttgccccggacagcgatgacctcggccacgacgagtaacgagcatatggctggagatgcagtcctgcaacggcacatccccttcttcaccggcgacaggaaaaccctcggcgactgctcatgtccatgggttcaccagcaacagttccaagtccaacgttgtcactgtcctcaagatcggaggtcattaaactacttgcaatgtgtttctattgtacatatccataatttgagcctttgataaaacaacaaattccctttcaacaatattcgttcagataaataaattggctttgtaattaggtcacttcattacgggatggtctattggctacaagctagggttaggcttgcagattatgcgttcgaaaccccaaccattatttcctcaatggagaactggtggctgccttttgaagattttggttatatttcatcgctatcttgaacatgaggcagaactggaggcagcgccaggtagatgaactcttgggcttttgcggtaggtggtggcggcggtttctacgcttggcgccggtggcggcggggatgggggcggcggcggcgacggtcagagtttcaaagactgcgacgctgctgacgcatgaggagttggcgagtgaggggggctaggagatagcagcgtcggcgcgtgagggcgagtaaatcgccgctccgttgtttccaatcatgcccatggtaattgaacggctagatttcatttggtacctgaaggtaccagtacctggagataccatatgctggaccgtaacaaacatcatatatctgattgttaattgaggaatttaacaatccttaaaaaagtaccttgaggtaccaaaattttacactaaaatttttagtaccttgatgtacttagtacctagaggtactaaattttactaattttagtaccttgatgtacttagtacctagaggtactaaattttacactagaaaatatagtacctctagacatcttctcaatgatggtaaaattgcccattttttagctccttcatctcaattccaccaccaacttgtactgtgaacttcattgtttgaatttggcgaattagattcctaacaacttgtatcattacatgttcttgtgacaccagatttggaacactacttctagctaatgtactctctaatataatcaaaagcaaattgattggcaaatgtacttctatatttagccacatgcatcatctaccaacctattctatatttgttggttgagatgggatctttcatctccttaaacttcattgtttcaccaccaattgctcgcatgttttgagttgagtataggctgtagcaggaatacatagcatgacagcaaatccacaaatggaagaactctcagctactcctagcagcgattaggtccaaccactggaaactgccgagcagccaacggcgatggccacggccgctgcagaagccgtagcgattccggtcgaagaggagctgaaaagagcagccgaaaagatggagaataacttctccaagatcaaaaccaagatccacaggtacccttcaatttttcgaagcttaattagcacagatgaccgctacttcgtcccaagagctgtagccatcggtccttaccaccatggcgcaccccacctcaaggaggcagaggaggtcaagcgtgcggccgcctactacttctgcggggagtcaggccactcggttgaggaggtctaccagagaatcctcttggttgtagccgaagcccgaagctgctatgtggatgatgacacggtggcaagcataggcgaaggtgactttgcggctattatgttccatgatggttgcttctttctccagtatatcatttgctcaactgacgacattgctccatcattagaaagttggttcaactccaacgatgctagcatggagagggacatctttctgctagagaaccagctcccatgggtggtgctggatgccctcatgacctttaggtctgttcccgtgggagagttcatctctcaagaaagcaccagttttgatgcctacacagatttagaaaagtgatcattcgtcttggatgaaagctacacaccatcacatctccttggcttccttcggtactaccaatcagggctgagcatgcctaatggaagcatggccctcgaaccccctgaaggaattacttcaatatcacagactagcagcgccatcgagcttgcagaaatgggcatcaacctggtagccaacaagaaaacatggtttaatgacatgagcatcagcaaaggtgccttgttcggcaagctcttcatggcacctctcgtcatggacgaccaaaatgcatgctggctcatcaatatgatggcactcgagattttctcggcctctactggcatggcctctactggcatggatggtgaagacactgtctgctcttacgtatccctcctcgcgatgctgatgagccgggaggaagacgtgcacgagctgcgagtgaagcgtatcctacatggtgatttcagcaaccagcacacactcgtattcttcaagaaccttgtcgatctaattcccattccttttcagcactgctatttattggacaatcttgaagcatacaggcgtaagaggtggatatggatccctatacacaagttcatctacaacaacttgaagaccatcgtcacggtgttctccataatcggcgttctcgtcggcatcttcaaaacactcatgtctatcaagcaacaccagcagtagtgataaacatcccaagagtagcagatcagagcttgctagctgtacgttgcaacaattatttcttgctagctgtacgttgcaacaattatttctatctatatgaatttgtcctttttttttttgaggaaaaacctcagaagaggacaggaagagcctgctttcatttaagaagaagagacttggcccaatttttgagggaaaccgggcacagaaacctcacataagcacggtttgaaggggaaagccgggcaaaacccacacggagaacaaaaaaaaaagaacttgcgacggcacaactagaggataaaacataggccatcgttgccaagctcccaagagcagctccgacttcctatgaacagaccacagacaagcgtagggcagggtcttcaagacgaagcctccaaggaggaagatagcgtcgaaacgcaaacaacgtccgtccgaaaatcggagcaaggttttcacccgaagaaatgagtagagcacagaaacgatgccttcaagaaggaaaacggcgcccacaggcgtcgccatcattggctctagcccaagatcgagcaggacattcgccccggctcgctctccctgccaaatacgacaaccctggctaccacagcgctaccatagaaagcaggggagggttatcgttgccgagcttatcaccgacaagcagctccgatttcccccaacacacctacccaaagacactaggaagccaactgcatagtaaccccaacgaaactaccaaaaggaaggagcaagggggttatcgttgaccagcttgccacacccggccaagcatgcagctccgactccaccccaaacaccatcaacaggttgcgtcgcagaggtctcatgcaccaactccaccgaaccaggcacctcaccgacgcaagaaaaacaaagcgctggtagtgttgaggctctcgaactccaagcaaatctaccaaccaaagctagctccccgcccctcgccatggaactccccacgaccggaatctgaaagcagaacggtcaacaggaggggaggagctctaggaaacgggaggagccctagataaacttggaggtacacttgttggtgatcaagccaccgacaacactgttgttcaccgtgtcctgcagctttccaaacgaacgaaccacgtcagcaaccaaccgaccaacccaacgacgacctctccaagtggcaataccaccggccataaccatcaccactaaaaccccgccggccaacagcttctccagccacctcaatagccaactccacctcgatagcaccttcgccagccatcgccttgctcgcctccactggccacctgcacctcaattcgccgcccaaatacctttgctggccacaaccacctccgctggctaccgtcttactcgccgaccgcctccgccggcctcctgcgcctccaactcccttctcccacaccgaatccaagaaggagatggccagagtggccacccctcaccctccagtcttcttcctcgcgccgctgccgcttctcaccttcacctcgccgcgtgattgtggggatcttcaaggcaatcctctctctcaagcgcccctagctagggcaccctagccagctaaccgaacaacatgccatggccacatcaaccaccgtatatgtatgcttattgttttatttaatttgttctattatttgtctgtctgtttactttgatccagtatatatatcttcgaatgatgagttgtttgatttccaataaggtcaccatgaccactcactgtgcgcaagcacgctagatgcaccagcaccttaatgttgctgatttcacgtacgtgagctcttaatccatataaaatgttgtcgattgtcccagtgcatgcatgtgtgtggtgtgtggagaccgaagagaaaacacacaaccgaataaattggctatgattatcatcaggatttttttatggcaaaccaaaagtatatagtttacaccctccattgcacattgatccaagggctagtgttactcttttatatactcccctctgttctttttctagatgacgtaatacgtcatatagaggtagtatacctcaattgttgcactaaaattgattttcacacgggactaagtttacaccgtccgactgcacttttttagcgctaaaaaaaattcacagctgacgccgctcctcaaccagcgacagcttcccatcggccctgatcgatccctccaatcagattcaatccacaaaaaatcaaatgttcccaaatccacaactttacatcattcacaatttttcattgaatcaatccatcaccagcataactaatgtacaatcgatgatgaatatggcagctccttatctcgacatggtaatgaacgtggccatgatgaattcatggtgctcagaataggatcaatgtattgaaagctaggacagaagcaatgcaatcatcaaaaagaaaagaactactagtggtattggaacaaaaacataagagctcatctctcttgataagaaaagaggattatctcataatttcaatttgcttccaatcagaactaaaatgctaatgacaatgaatttacaagatgaccagtacagtccaatgaccacattcagaagaacatggcagtcagtaccatcagagagctgaaatgctaatgatattcacataagcccaatgtattatagcgatctaatgtgagataaaaattcgccgctgaagaggcagtattggtacgaagctttcatgtaataagtgaattggtcgctgaaatatcaaagcggcctaaaatggagcacaaacaacgtatgcttgtagtttttccgatgcagcatgcccaatattagaacagatcgaaggtggcttcacgaagctgacggaaattgcatgattaattagcacctaaaacggtaagcaaatgaaatggatcaccaagatagtagaaggctgcagattaacgaaagggggaagagcaaaaggaaaaggaaggatcatctttgatcggcacaatctaggcaggatcatggaagcaatcgaccgatggatcgacgagggcctcacctccggcgaaacctccggccggcggagcgggccttgcgcttgcgcttgtcccgggcgtcctcgtgcctccgccgccacctgatctcctccatgacgccggcgcgcgccacctcccgcctgaacctctgcaacagctcctccccgtccacctcctcgtcgccctcgtccaccttcgcgttgtggtacttggggttggccgacggcggggcgggggccagggcggacgaggccgagaggagggaggtcgtgggaggcgatcgccgcgggaaggagacgaaggtggccctggtgttcgcgcggaggagacgaggtgtaggcggcgagatgatccccgcggtggcggctgcggcggcggcgtgcatggtggtggtcgccggcgacggggacgcagaggttggtgggctttttgggtttaaggctctccttcagctgttgatggaggggcagcgaggccatggatcttccaaattgctaattagcgcgtccgtgctgtcaactttactcgcgcgtgtttctggccatgctcgcacgcggcccacttacccccatcgcttcgttctcttttctttttttttttcgttttttttctagcgagcgcgcacatgcggctgtttctttttttttccggaaaatctttctttttttctccacacccgtaattttttttgctatattttataaattagctgggtggcccgcgcaattgcgcggctagcgtccaaacaaaatcatataattttcagtatgattttacttaaaatttattaaatagctatcttgttgtctcaagactttgaaagaacaaaccttatcatctctgtatttctaattaaatagtttttaaaagtcatactggttactaccacttactttttcatatccttctttatttgcttgctcgatctaccactattagtcattctccttggtatcttcaaaaattggatcttatagtttttacagtttattatctcgttgggtttcgtttttataatttctagaagtctcgtcaaacgctgccattatactcctctatggaccgtccactgttttttctctttattgttattgggattttaaaaatcgaacacaattattgttcgggttcattttttactttctaaaagtcctgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgctaacttctgacggccgccacgacttcatgcgaactccgatttgggcgtgcaagtacttcatggaaagcttatcaagtctactttcgaatggatccagctacatgtccatatctgttctggagcggccgcaattatcattttactcccgactattttctgtccatggtgctgcgtcacctcttttggcccaatgggctgtgtatccatgttgggcccattaggggcgcgtcctagggttggagcacgaccctatggtcgttcttcccctctttttatacctctagtcgccgctaagaacaggcgggttttgatgatagaggtagcttcttgctaccggctcgcagcgcgcgtgttggctaaaccgcccgtctgcctgtaatcggaaccccaccatattgtgtttgatagtgaaactttcatctttatctagcaatttcagtgcttgtcctacttgttcttgcttgttcttcgattgcttgcaggacgagtgccctcgtggccgggttgacgcgcaccacaagttcgtggcgaccattggagacagtgtatcggttgctaaggcgcagcgtctttggacagttgtagtcgggccgtgaacgtcgacttcatctaatcgagttatcccttacctctcatcgaaagatcgggccacaaaccctagcgggtttgcatcaggtggtatcagagcgtggttcatcggtgagagaatttacccttcccttcgtcattaattttttttcctatagtccagaaaagaccaacaaaaaaaaatagtagattagtttttccgtgatcctatagaccattgtgcctttttactagtactgcttagttaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccactgtcgcagtcacccaccaaatcactttctatttgtgtttgatctgttgccgatagcttttgtgagttgccttgtatcctgccgccactagaaaggaaatagaaccctgattcgagtgaccttccttaaaacagtcatatctttttcatacggactcgaaattaggcttataatatatccacggacatctacaaaaaaagttacatccgggttcagcaaatttaaaatcgccaaattcctcttgcaaaattctgtttttgtggcgagaagcttcgggacctattcgcatagaactttgaaaaaattctacaagcttcatactttgtccgtttgagataagattttctgtggttggttctagtgtgctcctagttgtgaaaaaaatatcaaaaaaataataaaaaaaataaaaaaaaagttgtgcctctctcctcagcactagagagagcaagcaaaaaaaaaaaagaggatccagcgagcacaccacaccattccccctttgtcaccaccttccaccaccggttcttgttttcgttgctgtttgggtttgtgttttgtggcgtcctttgtggttaggctcgcgtctctacttcgactagcctaggaccagcactgtacactatacccttgagcgattattcaatttgctttggctaacgtggtttctagttttctcttgagcattgctttcagcccaccaacagctccaccacaaacccgactacagcttgacaggtcttgttgctacagcaccgatacacctcgttccacggttgctaacttgtggtgttgctgtccccctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggcaggtccaaaggataaagatgaggagggtgcatctcattccccacgcaccaaaggcatcatccaatactttacaaggcaagtgaagcagcacacggaaggacttgatacagatttgtaggtgacaaatgagaagattggacaattggagtccacgcagatctccaccatcactaagcttacagggctggagacagcggtcgcccgcattgacactagccttgctgctcttgtgcggcattttgatgctctcaatgctggaggcaatggtgggggtaatgacgatgacattgacggagagtacgtcgaggataatttggaggatgaatatattgctgacactgaacaagatgatcgagatgctcgagatcgtcgacggctacacaacaatcgacgaggtatgggtggtcgccgccgacgcgaggtacgcaacaatgatgatgctttttctaaaattaaatttaagattcctccttttgatggaaaatatgatcctgatgcgtacctctcttgggagattgctgttgaccaaaaatttgcatgccatgagtttcctgagagcactagagttagagctgctacgagtgagttcaccgattttgcttcggtttggtggatagaacatggcaagaaaaatcctaataacatgccacaaacttgggatgctttgaaacgggtcatgcgggctagatttgttccttcttactatgcacgtgacttgctgaataggttgcaacaattgagacagggtgcgaaaagtgtagaggaatattatcaggagttacaaatgggcttgcttcgttgtaatttagaggaaactgaggacgctgccatggctagatttttgggtaggttaaaccgcgagatttatgacatcatagactataaagattacactaatatgacccgattgtttcatcttgcttgtaaggctgaaagggaagtgcagggacgacgtgctagtgccaaggctaatttttctgcaagtaaaacttcatcatggcagacacgcaccactcctccggccggccgtactgcttctccatcttccacacccacaactagtcgagcagcacctcctccatctagtgacaagtcagcgacaaaggctgctcagccagcaccgagtgcttcttcaatggcatccacaggccgaatgagagatgttcagtgccaccgttgcaagggctttgggcatgtgcagcgtgactgccctagcaagcgagttttggtagtcaaaaacgatggtgagtactcctctgctagtgattttgatgatgatacacttgctttgcttgcggctgaccatgcagataatgagccacctgaagagcacattggggctgcatttgcggatcactatgagagcctcattgtgcagcgtgtccttagcgcacaaatggagaaggcggagcaaaatcagcgacacacgttgttccaaacaaagtgtgtcgtcaaagagcgttgttgccgcatgatcattgatggaggtagctgcaacaacttggctagcagcgagatggtggagaagcttgcacttagcaccaaaccgcacccacatccatactacatccaatggctgaacaacagtggtaaggcgaaggtaacaaaactggtgcacataattttgcaattggaaattaccatgatgttgtcgaatgtgatgttgtgcccatgcaagcatgtaatattctgctaggtagaccatggcaatttgatagggattctatgcatcatggtaggtccaaccagtactcttttctgtaccatgataagaaaattgtgttgcatcccatgtctcctgaagatattttgcgtgatgatgttgctaaggctgccaaatccaaatgtgagagtgataaaaaagcccaatctgatggcaagaaacctgagacaatcaatttgaaacccaaatgcttacttgctactaaatctgatattaatgagttgattgcatcaccttcagttgcctatgctttggtatgcaaagatgctttgatttcacttcacgatatgcaccattctttgccccctactgttgctaacattttgcaggagtactctgatgtgtttcccaaggaagtgccaccggggctgccaccggtgcgcggcattgagcatcaaatcgacttgatcccaggtgcttccctaccgaaccgtgcgccataccgaaccaaccctgaggaaaccaaggagattcagcgtcaagttcatgagttgcttgataaagggtatgttcgcgagtctcttagtccatgtgcggttccggtaattttggtaccaaagaaagatggttcatggcgtatgtgtgttgattgtagagctattaataacattaccattcgatatcgtcatcctattcctaggttagatgatatgcttgatgaattgagtggctctattgtgttctccaaagttgatttgcgtagtggttaccaccagattcgtatgaagttgggtgatgaatggaaaacagcatttaaaacgaagtttgggttgtatgattggttagtgatgccttttggtttaattaatgcacccagcactttcatgaggttgatgaatgaggttttgcgtcctttcattggaaaatttgtggtggtctactttgatgatatcttgatttacagcaagtctatgggtgaacattttaatcatttacgtgctgtttttaatgttcttcgtgatgcacgtttatttggtaaccttgagaagtgcaccttttgcacagatcgagtttcttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgacccatgcacctctcctccaacttcccgattttaataagacttttgaacttgaatgtgatgctagtgggattggattgggtggtgttttgctacaagaaggaaaacctgttgcatattttagtgaaaagttgagtgggcctgttctgaattattctacttatgataaggaattgtatgctcttgtgcgaactttagaaacatggcagcattatttgtggcccaaggaatttgtcatacattctgatcatgagtctttgaagcatattcgtagtcaagggaagctgaaccgtagacatgctaaatgggttgaatttattgaatcttttccttatgttatcaaacacaagaaagggaaggagaacatcattgctgatgctttgtctaggagatacactttgttgacacaacttgactacaagatttttggcctggaaacaatcaaagaccaatatgcgcatgatgctgattttaatgatgtgttgctgcattgtaaggatggaagaacatggaacaaattcgtcatcaatgatgggtttgttttcagagctaacaagctatgcattccagctagctccgttcgcttgttgttgttgcaggaagcgcatggaggcggtttgatgggacattttggtgccaagaagacacatgatgacggagcgtgaggctcctcaccgggagaccgcgcaggcccccctttgccggttcggccgggggccctgggtgagattctaagctcttggtctgtggaaggttcgcgagagtggaaacacacaagacacgggcgatgtatacaggttcgggccgctgagaagcgtaataccctactcctgtgttttggtgaatctgtgtatgaagaagctacaaagagctggagaaccagagaactctaactctctccctctctggtcccgaatcccaacctctctcctgctgaatctcccatcaatcccccttctaagtgggcaaggtcctccttttataccaaggggataccacatgcaccatctctctcttttgtgtggggacttatcctcccttttctcaaacttgacttgctttctcttcataaatggacggagctatgtatggctgccgtccgaatgaccttctgatgggacggcccatacctacctccacttccgccggaagcaggcgcgacgtgggaacatggctgtctgctgacgacatgaccagtctcagaccggtcacaaatcggtcattcttgtccaccacgtgccagcttagcaatctgcatgttcgcccttcttcatacaatattttgcttgtaatggttaggatga

SEQ ID NO: 23296 - DNA, 49521 bp, Oryza sativa
  unsure (1)..(49521): unsure at all n locations
cgaacctcaataaatgcggttaggtgagccccgctgcgctcacctaacccatacacgcggcacaaaactcccaaggggtcggggcgcctcaaccctcggggccgaaacgggagcggtccgacccctcggggagactaagaggggggcggccacatcaccctcgggcccgaccctccagagggggtcaggcctcatgggtgattgctcctgcccaagcctctagtcatgatactcccggtcccatgtcaccgacagtagcccccggcgttatgctagggcgatcgccctcctcgagggaagcggtcgggcgtgacgccactccctaaggcctggtgacaggtgggaccggtctccatagttgggcagaaacccaacggtcgccaatcacgcacatcggcaatggtaactcgactgtcaataatgagcggtctcttcaagactgccacattactcgagtagcacgcgaatcgggacgagccggttcgttttgcctggagatatggtgatggcgcttcgattggcgagcgtaattaacgcgcgcacgatatgttccatctcgactgccacagccgcatatccacctcatgcgccgcaagcgggcgaatgggattagtggaagcgtgggcgcgagaaacgagggagcgatatagtgggcgcgagaagcgaggagccgggcacaacgttggcaagggtataaagactccgaggaagagatttgcttccttcctctcaccattattccccttgtcttcgccgcttgcaccctaactccttgtttcctgtgccctaccttcgccacacgcgctcgctttcaaacatctcttcctccggcgtcatggcacggggctccactctgcttgatggtagcgtgctgccgccttcccgcatcgtgagcgagaggcaggccgggctgccgcgccgcttcatgccggaatctgccaccggccgggagatagtcacgctgggtgagggacgcccggcgccatgctacccggggcggtccgtcttcttcctcccttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagtcggtgtcgccgccgtcggtggttggtggctgctacttccagccgcgggggccggtgctgaaccgctacatcccctgcgtcctccgcaagaagtgggatgactggaagagcgactggttctacaccccccttgccgacgaagcgcgcctccaacttccgagccagcccccggcgcaggcctcctactggcgggcgccggtagatctgggagatggctatgacgccgtcctcgaccgcctggcgggcctgcgatcccaggggctcacaggggccatggtgtacgacgactaccttcgtcgccggattgcgccgctccagcggcgcgcccggggcgcctgggagtacaccgggtctgaagactacatgaggacccatcagggagtcagatgggactgggctcctgaggacttcaagatagtggtccaaagggtgctgaatctcagctccgtggaggcatcccttattccccaaggagtcctccccctctgcagcgatccagaccgcgcctccatcctgaccatcatgcaggcggtcggggcgtcggaggagcgggctcctcgaggccacaatggcacgggcgggagccacaggggggaacaatctaccccaggagggggtcgtgcttctgggccccgcgacgggggcccggggagcagccgccctgccgacgcccgggggaagaggaagcaggaaggaacccctcccccatctcctccccgagggggcggggcggcgcgtgccagcagcaggcacctggagggggccacgccgacgtcgcagcccgagggggagcggaagaagaaacggctccgcaagatgggggggacagaaccatcccggggaaaccttatttcccctccaaggtggtcgtttaaccgaccccctcgcaggttcgtcccacacccatcgtggctgtattcattctctcaacgcgagtttccactcacccattttgtttgtcttctggtctttcttctgtttcagcgagatcccatcgcgttcctcccgccattccaagtccggccagtctgaggccgaggattcggcggccgcagaggcccggaggcgggaatctgaccggcgagaagccgcggatcgccttcgggaagccgaggaggccgctcgggagaccgcccgggctcgccagaccgaggaagccgctcgggaggaggccggactccaccaggccgaggcgacgacatcttccgaggcgacccgtgaaactgaccggcaagaggctgcggatcgccttcgggaaaccgaggaagctgcccaggtggccgtccaagctcgccaagctgaagaagccgctcgggaggaggccagacttcggtcggccgaggcgacgacgacttccgaggcagctcgcgacgaggccgcgggcgcatcgcttgggcccactccctcgtgcgacgctcaggaccaaccaggtccgggtgacatccccgagtccggcacgtccatcggcgggctgagccgcgcggcatcctctccaaggcggctcttccccacaccttccgttgccccactgagcgcagaaccccttctgcaggccttggccgtcgcaaacaccacggtgttggacgggttaagtgcccaggtggaggccctgaaagcagagcgggcggagctcgatgccgcatgggcgcgtgtcgaagaggggcgacgctcggtggaggccatggtggaggtgggccgcaaggcacaccgccggcacgtctcagagctcgaagcccgtcggaaggtgctaggggagatcgccaaggaggtggaggaggagcggggggctgccctcatcgccactaccgtgatgaacgaggcgcaggacaccctccgccttcaatacgggagctgggaggcggagctagggaagaagctcgacgccgcccggggggtccttgacgctgccgctgcccgagaacggcgggcgacggagaccgaggtggcatcccggcggcgcgaagaagcccttgaggcccgtgccatggcgctggaagagcgtgcctgcgtcgtggagagggaccttgcggaccgcgaggccgccgtctccatccgggaggcaacgctggcggcgcacgaggccgcctgcgccgaagaggagtccacactccgcctccgcgaggacgcgctcaccgagcgggagcgagctctcgaggaggccgaggccgcggcgcaacggctggcggacagtctgtccctccgcgaggcagcgcgggaggagtaggcgcgccgtaatctggaaggcgtccgcgccgagagggccgcactgaaccagcgggtcactgaactcgaggcgcaggcaaaggagctggacgcgagggcgcgcagcggcggggcggccgcgggcgaaagcgacttagccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagaccgcgccggccggcaggcgggcctctggggtgggcggatcgcgaagtacgccgccaaccaggggggcctcgcccagcgcctctcggagatagccgagactcttcaacggctcctcgaggagctcgagaggacgattaagtcatcctctagagacctcgcccggggggcagtggagcttgtactggcgagctaccaggccagagacccggacttctccccatgggcggcgctagacgagttccctcccggaaccgaggacgatgcgcgcgcgcaggtccgggacgccgccgaccacatcgtccacagcttcgagggttcggcccctcggctcgcgttcgccctcaactccgacgaggaggacgatgacggcggagtgggcgacagtggcgacgaggctggcaacccgggtgcatcggagtgagcccccaggcccccgccaatctctaaatagtttcttctttcttcttccgaggccttcgggcccccttcttgtatagactaatttaatctgcaatcaaataaagaggaaattttttgtgtcaattctatttgttgtgtgtatgagacgaggatggtctgtgccacagtccttttgtgtcttggcttgatcaaggactcgtgcccaggtcccagtcctcaaacggctcgggtcggggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccggcccgagcccccgagggcaggattgagcacaagcgacctatttcaagtcaagattcttcaaaaggaaataacagcacagatacaacttttaggaaattgaaaatgcttttattgaaatacagatataaaagaaataaaaatatgcatatgtggtagcccccggccaaccctgcacgcccgaggggggtgcggggttggcccgagcccgaaacctgacacccgatcccccttaggggtagaagcgacgaaggtgttcgatgttccacgggttaggcagctctgtgccgtcgcccgtggccagtcgaacggagcccagccgggggacgccgatcactcgatacggaccctcccacatcggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgcttcgctcctccaagtagtcgaggtcatctctgcgacgctgatcttgatcagcctcgcagtacatggtggcccgaggggacctcagggtgagctcggatgggagaaccgcttccgcgccgtagacgaggaagaaaggcgtttccccggttgctcggcttggtgtggttcggttcgcccagagcaccgctggcaactcctcgacccacgaatcgccgtgcttcttgaggatgttgaaggtcttggttttaaggcctctaaggatttccgcattggcgcgctccacttggccattgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaatccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgtcgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcctcgggggccggtcaggcgcgtccgtctcccctatggggtcgggtcgcgccgacggctgggcaagcctttcttcaaaggcgcccggtggggactgggctcgcgaggaagcgagccgtgagagttcgtcggcaatcgtgttatcccgtctgggcacgtgccgaagctctatcccgtcaaaatggcgctccatacgccgtacctggcgcacgtaagcgtccatctgcgggtcagagcaccggtattccttacagacctggttaacgaccagctgggagtcgcctaacaccaagaggcggcggatccccagtccagctgccaccctgagtcccgcaaggagtccctcgtactctgccatattattggtcgcccgaaagtcaaggcgtaccaggtatctgaggacgtctccgcttggcgaggtcaacgtgacccccgcaccggcgccctgaagagacagggagccgtcgaactgcattacccagtaggcggtgtgcggcggctgcgaggggcccgagctggcctcgggaatggagacgggctcgggagctggggtccactctgccacaaagtcggcgagggcctggctcttgatagcgtggcgtggttcaaagtgcaaatcgaactcagaaagttcaattgcccatttcaccacccgtcctgtaccctctcgattatgcaagatttggccgagggggtaagacgtaaccaccgtgacccgatgcgcctggaaataatggcgcagtttcctcaaggtatcgggtcttggcgtcccggagggcctcactaacaaagtagacgggccgctgcaccttccggtggggctgatcctcttcgctaggggtcgcatcccagcctctctcctgctgaatctcccatcaatcccccttctaagtgggcaaggtcctccttttataccaaggggataccacatgcaccatctctctcttttgtgtggggacttatcctcccttttctcaaacttgacttgccttctcttcataaatggacggagctttgtatggttgccgtccgaatgaccttctgatgggatggcccatacctacctccacttccgccggaagcaggcgcgacgtgggaacatggctgtctgctgacgacatgaccagtgtcagaccggtcacaaatcggtcattcttgtccaccacgtgtcagtttagcaatctgcatgttcgcccttcttcatacaatattttgcttgtaatggttaggatgaagcctggcatacatctgaccgggaccaacgtgccatctccaggagctaacacgccggcaccggctagggacgagtgcttagaggctctcatcctgacgggatggggcgaggcgtgcgtcagaccgcctgttgccacctaacccacgatctgttcggtctgtgactggtcacagaccggataaacgagcgtgctgcactgcgttacatgcggcatgacgcgctcgtccaaaccgcaataaatgcggttaggtgagccccgctgcgctcacctaacccatacacgcggcacaaaacccccaaggggtcggggcgcctcaaccctcggggccgaaacgggagcggtccgacccctcggggagactaagaggggggcggccacatcaccctcgggcccgacccccccgagggggtcaggcctcatgggtgattgctcctgcccaagcctctagtcatgatactcccggtcccatgtcaccgacacatgacatccttgctagtcatttcttttggccacagatgcgaagagatgttggcaggttcgttgctcgttgcgctacatgtcaaaaggctaagtcacgcttacatccacatggtttgtatatgcctcttcctgttcctactgttccttgggaagatatttcaatggattttgtgttaggattgcctaggaccaagagggggcgtgatagcatttttgtggttgtggatagattttctaaaatggcacatttcataccatgtcataaaactgatgatgcttctcatatcgctgatttgttctttcgagaaattgttcgcttgcatggtgtgccaaacacaattgtttctgatcgtgacacaaactttcttagccatttttggagaactttgtgggctaaattggggactaaacttttgttttctactacttgtcattcccaaactgatggacaaactgaagtggtgaatagaaccttgtctactatgcttagggctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggaattgaattttgaacctggagatttggtttggttgcatttgcgaaaagaacgatttcctgatttgagaaagtctaaattgatgcctagagctgatggaccatttaaagtgttagcaaagattaatgagaatgcatataagattgatttgcctgcagatttcagggttagtcccacatttaacgttgcagatttgaagccgtatttgggagaagaagatgagcttgagtcgaggacgactcaaatgcaagaaggggaggatgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctactttcgaatggatccagccacatgtccatatctgttctggagcgggcgcaattatcattttactcccgactattttctgtccatggtgctgcgtcacctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatttcagtgcttgtcctacttgttcttgcttgttcttcgattgcttgcaggacgagtgccctcgtggccgggttgacgcgcaccacaagttcgtggcgaccattggagacggtgtatcggttgctaaggcgcagcgtctttggatagttgtagtcgggccgtgaacgtcgacttcatctaatcgagttatcccttacctctcatcgaaagatcaggccacaaaccctagcgggtttgcatcaagtcccgccaaaccatcagcagctttgctatgtactcctttatggctcacccgctacctcccttctttatcgtcattaatattttaaaatcgaacatgattatcattgttttttttactttttagaagtttcgaacctttaaaaattggaccttgtagtttttagagtttattgtcttgttgggtttcattttttataatttttagaagtcctgtcaaacgatgccactatactcctctacggctcatccgtcgcctactctttgttgttatcgggattctaaaaatcgaacataactatcgttggaattcattttttattttctagaagtcccgccaaccgtcggcggctctacaacttactcctatacgcccgcccgctgcttttcctttttattatcattgagattttaaaaatcgaatatgattatcaatgaggtttttttttactttctagaagtcccggcaaccaccttgtccgtttgcttcatggcctgtgtgtcgtccctccttttaatcgtcattaggattatatttggtgttttattaacaatttttatatgtcgtatcaaccgccaccactctactcctttataggcctattacttaatttatctcgtcatgtgtttctttcaatagtttttatcaccaattttagttatttataaattgtattcctaactgaaatcttttttcttttctaatttcagattttttcccccaaattttaattaataccttataatgttctttaaatatttttttatttttgaatttcaaaattgtattcctatctaataatttttgatattattttattttttattctgaattttaataaatctcgtaatgggtttttatatgaattcttctttcaatattgtttatttttaattccaaattttagttaattttaaattttattcctacttgaacttttcttttttatttttgctaattttgaattttattttttattttattccgaatattaattaatctcgtattgggttcttatatggacttttctctcaatattccttatttttaattccgaattacagttatttctaaattgtattcctactttaactctcttttcaatcatcctaatttcggattttatttattatttattttgaattttaattattctactattgggttcttatatgtacttttattttcaatactgcttatatttaattcagaatttaaattaattttaaattgtatttctacttgaactcttatttccttttcttttttctaattttgattttttaattttttttatttcgaattttaattaatctcgtattggattattgtatggactctgctttcaatattccttatttttaattccgaatttcagttatttttaaattgtattcatactcgaactcctgttttttctttttataatttcgaaatttattttatttttattctgaattttaattaatcacgtattgggttcctatatgtactcctctttcaatattgcttacttttgattccgaatttcagctatttttaattgtacttctacttgcactcttcttttctttttctccgattaatgtgggaatttctagcccccacagcaaacgtggtgccttctttcatggatgttttaataatataataaattgaatctttcaccaatttcacttgagagttttgaatttgagttaatttttttttaaaatttaagttgagtgttttgaattttgagacgaaattcaaatttaaattgaatattttgaattttgagacaaaagtttacaaatttaagttaaaagttttcaaatattgacttgaatttttttagattttagttgaaaagtttcaaattttgatttgaaaactttcaaatccgaactgaaacttttcaagactgaacagaaagttttcaaatccgagttgaaagttttcaaatctgaattaaaagtttttaggtcttcacttgagaattttaaaatctgagatgaaaattttaaaaaatattgagttgaaagtttcaaatcttggcttacaagttttcaaacataagttgaaagttttaaatcctgaatttaaaagtttgttgtagttaaatttccgtaccaatcctaattttccgtgtcctaaataaaaggaagaagatgtgcgggcagttatttttctaaaaaaaaataaaagcaagaagaaaacataaaagaaaagcgagaaacgctacccgtactgctgatctcgcgcgcgagttaatctcgcctcgcgcacgccgggggtacgaggccctgtggatcttagggatttggattggaagttgtgttgcttgataggccttgtgaatcgagaaagctagataccggtatcccgttctcccaacgcccgcgacggtatcgtcctctttctcgtcccagagcactaaacgcggtgctcatgcttagctagtatcccaggccgtcgcggtggcgaggacgtcgtcagggctaatcctcaacaccttcgattcgctcgagcacgacgaactcgcggcactgcggcgaggcctcgacgtcccggtgttcgacgtcggcttgctccacaagctctcgccgatggcgccgtcatcgagcagcctgctgcgccaggaccgcggctgcctcaagtggctagactcccaggtgccggcgtccatatgttgacgcgaaaaatatacacgggccaaaataataaaaaatgatcaataattacaaagctaaataattatgattcttatgtcatatctgttttttagtttatttgaactgttattttgtttataattaaataaataattcaagatgcatattactcatatttcacttcgtaaaaatgaaaatataccatttaagcatacacacctatcctttgcaggtaaccaaatagaaaaaaaaatagagcattataaaaaaaatgacaataagtattacatcacctcaatcattgttcatcctctgtagcgcatttacagtggtacgtaacttacgtgctacatcttaattaaaagtaagaccttagaaattgtaagaaaagacatttgaccatcagttttcacttaataggtggatccattattttaaccaatagatataatattagagaaaatcttaagctgccatgtgttacgccttaaaatttagacgcaaaggatattaaaaattttgacaaaaaaaagcggatcatcgattttcacttaaatcattagaaaaaaaaggcccccccacttcgccctcccctcacatgtgcacaacacaacactacccatgtcccctcctcccctcctgtctcagcttgagttctccactctctcctttacccctcctttttatagtgagaaataatcaataatattaaaacatgcaatttttttagctgttcatctgatttctaatctaactattgctctattcataattaaatcaacaatttaaaggttcatatcctctatagttttaactggtataaaataaaatttaaaatataaaataccaatagggactaaattgaactatttggagaaaatcaaataagttcgtacctttcactaaaattagacagcccattacatgttctatttttataatattttttaaatacttacatgttaatggccttgcatctatcctataccatagtattatgagtttgtcaggctattaagccacgctatggtagcagtatagatattgttagttgaaaaattatatttattactattaaatttaatttttcaaactcatgttaactatattttcttttaaaaaagatactataggtcaaacgtattacaaggaagcgataatctacgatatgtctttgttaacttatatgtaaatatgtaacaacttgcatgaatataaaccaactaaggctatgttcgggagtgagggttgggaaccttcacttcccggcacacaaaatgaagcagcgtttagcgcgtgattaattaagttttagctatttttttaaaaaatggattaatatgattttttaaagcaactttcgtatagaaacttttgcaaaaaactcaccgtttaacagtttgaaaagcgtgcgcgtggaaaacgaggaggaggagttgggaagatgtcctaccgaacgcagcctcaaaactgtttactaacaataacaataatagtgctttaggatttgttaaaaaaagccaataaacattcaattaaacaagacaaaatattttacttttaatttacgtttaattcgttagatatgtttttttccaaacaaactaaatagatacttttgaaatatgagagatgtttatatggatcatagataattgtttgtacgaatgaattaaatattatatattttaaaagctaacaaatagtttggaaaaattatctaagcaataccgatgaagtaaaattatggagaaatagtacttatgaaacatggcaatgtcattgagttgaaattcgatctatataagtttttcgaacgcaatctaaaatacatgcccgcgcaatgcacggactatcttcctagttttttttaaagtttgataatggtggtgggctggtggcgatgttggcgagggacgatagggcgcccaaatacctgtagttgttgtagacaaacttatgaaaggcggctatcaccgggcgattccggcgccggttactcctcgatccgctccaagacgtacgaagaggtagtggctgccgaagcggaggtgatggctgatgctcttgaggaagaacagcgtctttctgcaagttgctgaaggtgctgagcaccacgcgacgcactcgcagctgctgcacatcctcctcgctgtccatcagatcatcagcatcgccagcgccgatgattatcataaactgattattaacagataaaccttcaaaaggctgagaagtctaaacttattattcaaaatcttgtcctccatcaatataaatcacttcctatccttgaaagtcaactagctgccactttgaccatcgtttcaaaaatattgtcataaacaatacatctaggacattgaatgaaatagaaattgtcaaataaaacagtgcaaagtcaaaatttcaagtattagagcaagtataatagtgagcacctgagctataagcctaatataaacttacatggagaagagaggtaattaaaaatcaacggtattggctctcatgcaagagctagtttatcgcaagctccaagacaaatatattaaatatataagtgagagatagagagaggagaagaaatttgtagccaatcttatagctaatctattgggaaactattctaatccctcgaggggatgttccctcgtttgcttaaaaactatctaagcagttatgaaaaattctagaaaaatttgacaacatttatacaacacatatatacaactccacaaaatcttaagtccaaactcaactcacacgtcgagatataaaaaagacaaattcagcgtatgaatagtagcatactgttatatctaaatttgccttttttgtttctcgatgtgtatagatcgaatttgaacttaaattttggtgaactagtaggtatcattatactttacattattatttgtttcagaatttttcacaactatttacatcgaatttgaaagaaaaaggtatacgaggacccctcgagggactagaatcctctccctaatctattatatatatgggctaatagtaggaagtgagctctactattatctttgctcttaacaaacggagggagtattaaagccaaaatactaatcaaagtagttaatataattcgactgcaggatatgttaattgttcttgtctatatatccagtactaccaattaatatctactaccaatctgggtgtagagaggctagattattattcctttatttatttttcaaaaaaaaaaactcgcctggttggcattggctagcgtcccctaagtgccttgaagatgccgacgaacacgctgacgatggacaagatgacgctgatggccttgatgtgcttgtagaggaacttgtagaccatggtccttgccggccggttccgccggtacgcctcgatctgctccaagacgacgaagtagcggctgcccaagctgagatgctggccgatgcgcttgaacaagtccagcgtctgcgtgttgctgaaggtgctgagcaccacgcgatgcccccgcagctgctgcacgtcctcctccctgtccatcagcatcgccagcgccgacaggtacgagctcaccacaaagtcgccgtagacgtacgacgccgctgctccgctgctcgtcgcctccagcgccgccatgttcaccagccagcaggcggtcacgtcgttcaggaacaccggcgacagcaggaactcgccgaagatgcgcttctccctgactagtctcatctcatcatctcatgtccgcgaaccacaccgccgtgctggccgtcaggttgacgccgatctgggccagctcgacggcgctgctggacagcaacgatgtgttggccgccacgtagttgatctctcgttcgggcatccgccatatctggctgaaccggaggagaacgaggagatgagctggccggtagctttcataactctgcccgccattgatgtctcttttaagcttcgtgatgtttccacgctggcctgtcgcccagacgacggaccaccacctgccagctttgtctccgttcttggggaagaatttgtctcccaatccggcgacgaaattgcgcacgtccacattgaggaactccatctccatgagggtgtcgagcaccagccatgggatctggttctcgagcagcatcacgtccttgaggatggtgtggtcggacgcgaccgcgctgccccggctcaagtagtgcaggaggaagcagccgtcgtgacggcgaactcgccgtcgctgaagtgcctgaccttgtcgtcgtcgtcgtagcagtcacgcgccttgcccacgacggagaggagcttgccgtagacatcttccacagaggccgcgaagaagtggttcgccgccgcgagcttggccttctccatgtcctgcaggtgaggcggctcgccgtggcggtaggggccaatggccacgacggtcggcgcgatgtaccgctcgtcggagccgccgatccctcgcaggcctcgagggaaccggtggatctttccctgcgcaatggcggcgccgtggctggctgccctccagcaaccgtgtattcttggtcatcctctctttcatatccttcaaagtggcttgtgtgcttcacctgggacgtcgatatatattgccactgcttcaccgtcagccatggcggtggctagctaactatatattgctcactaagaaatcaagtttgaggataacaaagtttcagtttccggccgggctgtcgcgcgcggcaggtatttatagggagcacgcatgcaagtgcagtgaaatgtacgtataaggtacagtcgagctgtcagtcagatacttagattaatggctcaagcatgttgctttgcctgagcttgatccacgatactactaatctttatgtaagcaagcacttcaagtcatcttctagggggtatctggttctttttaggcaccatgtgacactttttttttggcgaagcaacatgcagcattgcaaactttagttctgtagtcattcaattcgttgcttttttttttgtttggtgcatatattgtgctttaatttcaaactactgaatgcgatatctggagatcgatcaactaaggccatgtttggatcatttagtccctagattaaaaactttagtcccctattatttggatctagggactaagatagactaaaggcacgtggatcaaaggagagagaagagagaggctgccattttagggagagaaaagagagaccctataagtactttcaagagggactaatggattctagttctaatatgtacttgtattcctttttagtcatccatgtttgaattcttaaggtctaaaagggacttaaaatagagattagtcctatgaacaaatagagcctaagaaacttttgtgatgatggctaaaggctaaagctattatacgttccttcattctgtctgattttctatcacatatgccctgcacttttgcctacgcatgcctgaggtctcttacacgttacaagaagtctcatgtcaagcagagcgagaattattagtgcaggaaaacctatacggagatgaggcggagaagtgtagtattaattgatgatggcggccactactctgcagacgttgtggccggccggtgcccgtcgccagcatccttatgtgatgacgacggtggtataatggtatatagcagctagcgtacaagaagtggagggctccgacactattcccggtcgagccctcatatacgtctggggctctaattaagatgctttggcgtgcttggagctgcttaggaacaatgctacatatccctatacaggttcgagcctcctagatgataacaacactgctcctgtgcagatcaggatgccccatacatggatgtgtagatcggatgccctgtatgcgtgcacacctcgcgagattataggctaaaaataatacatatttccctccatagtaaatactaaccacttgtcatccatgaaattaagttagcaagataccaatttgatcactattaaaaattggtgtatctataaatctaaaatgatctatcatattattaaacaatcttaaaaggagacatcacatttcctgttgaggctataaataccattaattggagacagagaaaaaagttcaagcagaaatacaattttaaagtaactgaatttcagaataaaaataaggaacgtcgaaagaaaaatccatataaaacgcaatataagattaattaaaattcagaataaaaaataaaatttgaaatcctaagacaataagatgataatcaggtgtaaacaaattagataatttttgtaatggtgctagccatggtattgcgcgggccataattgtactatagttataatgcaactaatatgtttttttgcgcatgcataaaagtagtgcacatcaatatattagaagaaaagagtgtttgtttacacaacacaatcagtctgaccagcttatgccaagggaagggagaaaagacaaaacaagaaaaaaaacaaaggaaaaaaggaagagactactatgacggctaaacacaactccaatcagcgggaatggggcagagccatactaccctccaagaaaaccccaaaacaagcaacgctagctaacgaccatagatggcccttagtgaggatggactctagaaccattgagacagaaaagagagcatagagtcgaaaatcctggagttctgttccttccaaagttgccaagatactaggaggaccatggagtcgaagccggcacagagatgctcaggtaaacataccctagaagaaggccaccagtcctgaagccagctgccacgaggaggagagagggcagcccgatcagaaggcgacagcacacagagccatacctatcgagcaaacatgcagtcaaggagaatgtggttcgccaactcaaagctcctaagtgcaaaagggacaggccgagtggctatcaataccacgcttctggaggaaatcggccatctagcagtgctgctaaaatgcaaactagaggaagaacttgcatttagcaggatcattcgcgtgccagtgaagaacaacacaggcaaaagtgtgctggccatagaaaaacgcctggtatgccgaacgtgtcgagtagcgctggtcactcatccaacgccaaataagacgattcccgacacccggcgagagctgaatgtgaagcaccacatcccaaacaagaagaaactgggagatgaccaggatagtgagggcaccgcggatatcagaaacccaggaattgtttgccaagccagaagcaaccgggcacgaacctcggaggcgctgatcaggcacaacgaagaggagatctggagccaaggaggccaccgagcagacgccgatccattggtcagaccagaagagcatcgactcactatcgccctatacgaagtaggtggatgcctcgaacatgttagagacggtctgctcgactagggccttcaggacatcgcagtaaggatgtcatgagcgttgaagccaaagccaacaaacacgcagggcaaaccgtgccatcctaaggtcaggaatttccaaccctccgaaagctttgggatgacagacattcgtccaggacacctggcactactcctatgagccgagtctgaacccttccataagaaggtgcgacgcttcttgtcaatggccttaatgacctagactggaagaccgatcgtcatagacacatggactggaatagaggagagaacatactaaaccaacatagagtggccagccagagtggtgagtcgtcccttccagggtggaagacaatgggatactttgggcttgtttggttggtgccctcagctacatgcctgaagaaaagtgctgcctgaaatatccctgaaatcttgatgcgttcggcttgatcaggcaagcctaagattactctgtttggttgcaggcctgaggtcaagcgtgcctgagctcaaaacacaaccattgaatgacgtttattatgtgaacaaagcgtaaaaatataatacatattcattttacaacagtaatctctcatctatatacactagcagtccatccaattgcacgatgatcacaagtatcgcttgcatctagttgacatcgaagcttcgagcagcaacagttgaacggaggattgggcaaggggttggtgcggcatctggggtgtcggctactcggctgcgcagggcagcaggacggattagcagcgctaattatcggtggctgttgcggcctggagttcaggcgaccaaaatgggtcgcctggctcaggctaaccgcaagtcagaaggaatcaggctaggcaaggggtagttgatctcaggatagcaaccaaacaaggttcaagctagcctcaggcttgtcttcactagggcaagttcttctcagggcatcaaccaaatagcccctttatccacaagtggttgcagggccgtcttcggcaacatgcaaacgaacagcagaatgctgaggtaggtacaaggaaagtcagaaatcgcgtagggaaagcatgactgaaccaactccaagtcctcaaccgaacaacggatcagagtaatcgagcatttgacaaagttggtgcatagcctggacgctgcaccaaagacaaagaggatgccctagatgaacttaagatcctgtcgaaccggggagaggaagagaaccaaatcatccgcatagagggaggcgcgcggtgtcgcaaggcacgatcgttgagcaaaaggaacccgcctgagtcggaggttttgcggagcatcgcattgagcacatccatgactagaatgaagagtatgggaaatagaggatcttcttgccaaagacccttccggtgagggaagcgtggacccggcactccattgattagcaactaatatatactaatttgcttgtaacttaccgaaattgctaatagctcagcaggtaaggagcaccgcgtatgaaaatcgaaagtcaccccaaaaaaatgtcggatgttctttaagcaaaaccaattaaagatttattaacataaatagtagtactaaaagaatattcgtggacaatttactcaaaaacggctttgtataagtgtccaaacgattaaatcaaattatatattttttgtttgttggagaaagtaacaacgcttaactaagaaagcttaattactatagctccctgagtgctttgaagatgccaacgagcacgctggcgatggacaagatgatgctgatggcccttatgtgcttgtacaggaacttgtggacggcggacctcaccggcctgccttgcttgaacttgttgatctgttgcaagatgtagaagtagcggtggccgaagccgaggtgctggctgatccgcttgaagaagtccagcgtctgcgcgttgctcagcgtgctgtacagcacctgcttcgcccgcagctgatgcacgtcttcttccctgtccatcagcatcgccaccaccgacaggaacgagcacatcacggacgaggacgaggacgactgatccgcggtggtggcgccgccgctcgcctccagggccgccatgttcacgagccagccggcgctcacgtcgttgagaaagatcggcgacagggaaagctcgccgtagacagggccctccttgacgctcatatccccgaaccactccgccgtgcttgccgtcaggttgacgccgatctgggccagctcgacggcgctgctggacagcagcgacgagccgaccagccgtaccgagagctcttccgttggcatgcgaaatatttggctggaccggaggaggtcgaggaggttcgccggcttgtagtccttgaggaagctgcttttatgtggactgacctcgaacaatacgctgaaacaggaggttgtcaacgagacttcgtgttccttattattgcggaggaacatgtctcccacgtcggccacaaaacagcggacattttgctccacctccatctccatgggcaggaactccatgagggtgtcgagcaccagccatgggacctggttctcgagcagcatcatgtccttgaggatgctgtactccgacgacagcgcgcggccctcgaacagcggcttccttttctccatcatgaactgcaggaggaagcagccgtcgacgagcatcatggccgcgaagtcatcgtcgctgaagcacttcaacttctcgtcgtcggcgtagcagccgcgcacgtcgccgacgacggagaggagcttgccggagacatcaccggcagaggcgccgttcgcggttgcgatgaagcggttcatcgccgcgagcttgacctcctccatcttgtgcaggtgaggcttgccatggtggtaggggccaatggccacgaaggtcggcacgatgtaccgctgctcgtttgagccgccgatcccaatcaggcctcgagggaacctgtggatcttgccctgcgcaatgggggtgatgtggctgccatccagtttctgtatcttggtacttgcttgtgcttcatctgggacgccatggccgacgtcgacatgtattgccaccacttcgccggccattggggcagctaaatgttgctctcaaattattcaagattgacggtaataagctaattaatggagtagatatgtagtttcagtttctaggctgtcgcggcaggtatttatagctatcaagcatgcatggaactctctgggatcgagtgagatgtacgtataaggtacactctcgagctatctgtcagcagctgatactaagactgatggctcaagcatgttgctttgcttcagcttgatcgacaaaactaatctttttgtaaggaagcacttcaagccatcttatagctaggggggtatttggttctttcaggcacctcgcgtgtgacacttttttcgccaagcatcgcagcgggaaaccgcctccgcccctctgcacagccgtttgttctagaatcattcgttgctttgtttgtttggtggtgtatatatgctgctttaacttcacactatactgcatgcgatttctggcgatcaatcagcgaagaaacttttctgatgatggcagaagccgaaagccctcgtacgttctaaatttcattctctatgatttctggcaatgtcttcgtgcagtcgcggtgaccgtttgtgtaattgtgtacgtgtcgtggagatggacagagatccatagaaccgaaggtcaattgcattcaagtgtgcactcgcttatctcttccacatcatctgctccttacgttaacaaacaaagcaagtatggtgtagttttaaattgaaattaaggttgagaaaaaaataattataccgttactcattgaatgaggtgaaagtatggtgtagttttaaattgaaattaaggttgagaaaaaaataattataccgttactcattgaatgaggtgatagatgtgattagtacttcaaaaatatttatattatgtacaaaactagctggttggtccgcgcaattgcgcagctagcacccaaacaaaatcatatattcttttagtatgattttacttaaaatttattaaatagctatctcattgtcttaagactttgaaagaccaaaccttatcatcctcgtgtttctaattatatagtttttaaaagtcacaccagttactatcccttatgtcatctccttctttatttgcttactcgatttattactatttctattcattcttattagaaccttaaaaattggattttatagtttttagagtttattgtcacgttgggtttcgtttttataatttctagatgtcccgtcgaacattaacattatactactctacggcctgtccactgtctcttctctttattgtcattgagattttaaaaatcaaagataattatcatttgggttcatttttactttctaaaagtcccgccaaaccatcagcagctttgccattgtactcctctacggctcgctcactgcctcccttctttattctcattgagattttaaaatcgaacatgattatcattgttttttttactttttaaaagttctgaacctttaaaaattggacttgtagttttattttttataatttttagaagtcccatcaaacgatgccactatgcccctctacagcctgtctgctgcctactcttattgtcactgtgattctaaaaattgaacataactatcgttggtattcatttttttattttctagaagtcccatcaaccgtcggcgactctgcaattatactcttgtacactccgcccgctgtttctcctttttattgtcactgagattttaaaaatcgaatatgattatcaatggggtttttttttactttctagaagtcccggcaaccgccttacttgtttgctttacggcatgcctgacgtccctccttttaatcgtcattagtattctatttggttttttattaacaatttttatatatcgtatcaaccgccaccactttactcctttataggcctgttacttaattttatctcatcatgtgttttagatggtattttctttcaatagtctttatttttagcacaaattttaattatttataaattgtattcctaattgaaatcttatttttccttttcaaatttcataatttatttttaaaaaaattagttaataacgtattgtgttcttttaatgtttttattttttttattttcaatttcagttgtttcaaaattgtatttctacttgaactctcttttagtttttctaattttggatattattttattttttttcaaaattttaattaatcttgtattgggttcttatatggattcttctttcaatattgcttatttttaattccgaatttcagctaattttaaattgtattcctacttgaactcttcttttattttcttttttctaatttcggatttatttttatttttattttgagtttaattaatctcgtattgggttcttatatggactcttcttttaatatttcttatttttaatttcgaatttcagctatttttaaattgtattcctacttagactctcctttccttttctaattttggattttattttatttttatttcgaattttgattaatcttgtattgggttcttatatggaacttctttcaatattgcttatttttaattccgaatttcagctatttttaaatcgtatttctacttggactctccttttcttttttttctttttctccgattaatgtgggaatttctagccccacagcgaacgtggtgcctcctttcaaagctgttttaataatataactagctgggtggcccacgcaattgcgcggctagcaacaaaataatatttttcggtatgattttacttaaaatttattaaatatctatctcattgtcttaagactttgaaaaaccaaacattatcatccacgtatttctaattatataatttttaaaagtcacaacagctgctaccccttacttctatcatatacttctttatttgcttgctcgatgtaccactatttttattcattctctttgaaacctttaaaaattgaatcttagtttttagaggttattgtctcgctgagtttcatttttataatttctagaagtcctgtcaaaggctgccattatacttctctacggcccgtccactgtcttttctcttttattatcgttgggattttaaaaatcgaacataattatcattcaggttcattttttactttctaaaagtcccaccaaaccgttagcggctttgccattgtactcctttatggctcgcccgttgtctccattctttattgtcattgagattttaaaattgaatatgattatcattaggtttttttttactttttagaagttctggaccttaattggaccttgtagtttttagagtttattttctttttgggtttcattttttgtaacttttagaagtcccgtcaaacgatgccggtatactcctctacggcccatatgccgcccactctttattgtcattgtgattctaaaaatcgaatataactatcgttggaatttattttttttattttctagaggtcccgccaaccatcggcggcttctcctttttattattattgagattttaaaaatcaaatatgattataaatggggtttatttttttactttctagaagtcccggcaatcaccttgctcgtttgcttcacggcatgcctgttgtccctccttttaatcgtcattaagattctatttggtgttttattaacaatttttatatgtactatcaaccgctaccactctacttctttataggcttgttacttaatttatctcgtcatatgttttagatggtcttttctttcaatagtctttattttttatcaccaattttagttatttataaattgtattcctaattaaaatcttttttctttttataatttcagaatttattttttaaaaaccttttttattttaatattttaatattttttatttttgaatttcatgtgtttcaaaattgtattcctacttgaactctcttttaattttctaattttggatattattttattttttattctgaattttaattaatcttgtattgggttcttatatggactcttctctcaatattgcttatttttaattccgaattttagttaattttaaattgtattcctacttgaactcttcttttctttttgctaatttcagattttatttttatttcgaatattaattaatcttgtattgggttcttatatggactcttctctcaatattccttatttttaattccgaatttcagttattttaaattgtattcctacttgtactctccttttcttttctaatttcagattttattttatttttattctatattttgattaatctcgtattaggttcttatacggactcttctttccatattgcttttttttttaatttcgaatttcagctgtttttaaactgtatttctatttggactctccttttctttttctccgattaatgtgagaatttctagccctcacagcgaacgtggtgcctcctttcaaggctgttttaataatataatagatagatttgaattctgtgatgggcgccaacttggggctcaattaagatatgtaatgttatctcaattgggtctaaattatggcccgtcactgataggtgtcatccgtgacgggtctgagttttatgcccgtctaacatgtctgtgcggtcatatctcaatcggacgatattttggcccgtcacagatgactcattcgtgacagcccactaatttcaggcatgttagaggctgtcatagatggaatgttctttactagtgtttcaaattgctcaacaatgtgtttttttaaaaaaagtttctatgcgaaagttgcttaaaaaaacatatatatcaatatgactttatcctgccttatcctatatcatctcaatattacttgtaaaattaatcattgatagtatgtttaatgcgctgccgtaaggtgaaaaccttattactacgagcaaagatagaaattatactatatatctcatgcgagccagtcgtggagattgaatttgtatggtttaaaactctttgtatgtcaatatatatattgtatctaagtgtgaatgttgatgtggataatgtgtatgattttattaaaactatgtatgttaatgtttagtaaacgtgaatgtggttgtaaatttgtaatgtgatgatatgtatgtgtgcggataagaaatctactaatttttgtgtatgggggtgcattgttgcatagtaactgaattttcttttccaatattccaacagcgcatgcaaaaattattttcacatgtggctgccttaagaaatagcctataaaaacattcttttttgaaggaagctctagatattcggtcgtgtaaagtttttttttacgtgccgttttcttatacacctgatttttgcaggtgctcgggtagaggcaggtcaagaaatacccatctaaaagggttgtcacctgaagagatgttttctcgacggtactgtatggaacagtgaaagtaaatgacaaaatgcctaagtatgggggaaactgttttaaacactcgggtgaatgtccacccgtttcttgcatgtcatctaaatagtttatgaaaaattttcaaaaaaattgacatgcattataggttaatatgtaatatatcatctcacaaacatgcaagtttaaattcgacttctacaaattataacaaaaataacaaatttgactatgaatatacggataattggatacaagccactgcaaatatgggtgctccctccatttgatatatattataagccgttttgatttttttaaatcaaacatctttgactaaatttatagaataatttagcaatatctacgacactaaattagtctcattaaatataacattgaatatatatagttcgataatatgtttgttttgtattagaaatgctgttatatttttcaagaaaacttgtcaaacttaaaaaagtttgattagaaaaaaaagacttaaaacatgaaacggatcgatggagtatactaaacttatgtgaaagaaagagataaagaaaaatgagaagtattagctctcatgtaagagctaactatagtattaaaaaatagtggggaaatgctttttactcccggttggtaaccccctttagtcccggttcaaataaccgggaataaagatcgatctttagttccggttggtaaccccatatagtctctattttccaatcgggagtaagaatatgagactaaatatcgctatctttagtcccggttcaaataaccgggactaaagtttttttcttttttttctattttgtgtatctcacgcccattatctcaaatcattcacagcaatatagtcatcccaaatcactcacagcaacatagttcattcacaacaacacagatcgaatcacatattcaacacatatcacacaacaacaacacagatcgaatcacacattcaacacagatcgaatcattcattaaggaaaaaagaaagaaaagaaaaaatgcacgccgcagcgccggcctccaccgcctgtagtcgcaccggccacagccgggcgtggccctccacacgaggccaccgccgccgccgccgccaggccgcctccgccgccgtgcgaggccgccgcccagtcgccgccaaatcgtcccctccgcgaggccgcctgagaatggggaggagaggggaggaggagatgaggaagaggaagagatggggtgaatgaggagagaagaaggaagatgaggagatggggtggagaggaggaagagataaagggaggaggagatagaacttattaattaccatgcacctcctcctcgatctcacgcgcacgcctcgtcctctccgcccatgccgatcttttttcccggttggtgttactaaccaggactaaaaataataaaggggtctgacaccgcctatcttttttgaaccgggactgaaaataatctttaatctcggttggtaacaccaatagagactaaagatcaaaaagtagctctaaccttttgaaccaagactaaagattatctttactcccagtttttattgcaactgggactattgtggaatttggtcgactgatcaaagatagtttttccagtagtgaaacttgctccaaaatatttacattcaattcatgatgagagaaagagatagaggagaaaataaaactaatattttatttaacctattatacatgttagctttaatataaactaataatcaatagttagctactttctttgtttcatatgataagtcgtttttatttttttttctaagtaaaacttttttaagtttgacttttatagaacaatttagtaatatctacgacactaaattagtctcattaaatatatcattgaatatagttcgataatatgtttattttgtattagaaatattatatttttcaagaaaccttgtcaaacttaaaagagttttactagaaaaaaaaagtcttgcaacatgaaactgatggagtatattattaaagttgctctaacgtctctacgctaagaccaaggaaaccaaatcgactcggcgtgcacatgcacctgaactgatttaatctctcaatgaattgattggtgcacaacatttgttgttaaggtcattcccaacctaatgattaggatggtgtctatagtattaaataagctgccacctagaatgaaaaataatatggcaagtgaataaataaggaaagagaaggaaaccatgtcttgcatgagacatggtttctacacaatatccaagacatcatgtgagataagtagcatttaatttaagtatggaatagtgatgtttgcattgaaagagtagtgtctagtactagttttttgatgatgtggagtttatagaaactatgttagtgtcatggattggggatggcctaataccccctccatccaatcagcatgcacctcaacggatttaattcgtatgcatctcaagttctcaacgcatggtactccaacagactccgcatggagtagcatgcgaggcatttacttcagtttatacgctggtcaattgggaattaatatttggaatttggttaggcgctgttcaaaacagaatatatcgcgctaggggccggggagcaaattgatatgctgtcattccgagtgcattttgtgaacttcatatttagcacacttgcatatcgtatcattttaatacctacaagttctagaagaatggtaatttagaattggtttttgaactttatatttgcaacacttgcagcttagtttattcatgtgatattcaaaagcagattcatgtactattgagcaagacgatgcgttgttcaaattatgcctagaagtctgcggcgtaatatatatctaaaaccaaaggaagtatctggtgtgggagtgtctacggtactccgaactccaaagtccactacactgaacagcaaacaaatttatgaacaagcgagactatggttgtatttggagaagattagagatatggccaatttataagaatctggaaaagttaagttttccatcttatgatttctttttttttcttaatgaattggcgagccgccaatttcattgaataaaggagtaaaactgtacaggcacaaggcacaagaaagaaaaaagtacaggctcaaggtctttggcccgagattgttacaacgtactccctccggtttgagattaactgatgttttggacatcatggcaaataccaatgacagtattaattagatccatatttcctgttatacccctcattaatactccaatcagcagttacttttttctgtttgcatgcatgcatgagaggtattctggagaaatagaagggagagagtagtggagaaagctaaaacgtaaattaaactcaaacctgagggagtaacccataacatcaattaatctcaaaccggagggagtaagccagctgcgaggtgtttcactccctccaaggcccattctggcctcttccttcattttgattattataccggtcgtcgggagctctttttgctagaagaccttgcggttcctttcgttccaaatcacccaggcgactagcagcattagcgtccgtagggccttttttggtgcttcactggtgttgtagtagcctcccaccactcgaggagcgttgatgtttattgccatttgcgttggctttagtagtttgcatgtcgcccagtctgctattgccgcccaaattctcctcacgtatatacatcccaccaggaggtggtgggccgtctcttggctcctttgccaagtagttatgcattgtaggccgaagccgtcgtgtattcgccgtggctagttagtttccatgtgatcttgtcctcttcgtgttccgtcaattataggttgtggacaacaccccagacattgacgagttggctaattagctccgtcgtccaacctgagcttgtcagtaggttgaggtcaaccaaccattggtcggattgcgacgcttgttgtagacttgcgctctttttcttagtagtcgcgtagaccagcggtgttatatcctttaggcgtcgcccctggtaccaagccaatcccagaaaaccttattttggctcctctccaattgttaaggtcatcgccgctgcgaagaggaatttatcggtgtcgtcttatggtgttcctgatcccacccatgctttttctggtgacctccactcatgccagaaccatctgagatgtaatgctcttgcaaactttttcaaggtttaggatgcccagccctccagcatgtctagttgattttatatttccctcctgtcaaagcttctctgccggcccagaggaacttccttctctgcttgtcaaggatctcgacttattctttggaagctttcaggcccgtcaggaggaagtcaggttgtgatgtgaggatcgactttaccaaggtagatagtcccgccagtccattatgtttcccccgccaccctgctatgcagttcatcgatttatcataaagcggttggaggtctcttctttgtagccgcctagctgtcagaggaagtcctaggtacttcattgggaagttggttgtggtagctggcgtgccctataggacgtcatctaagtccaaattgtcacacctgatcaggactacgtgggactagcttttgcaggtttgtgcataatctagtcgattgtccaaagcggttgagcaactcagcgaacgcgcatacatcctccttgatcgtgtttatgaagaccgccgcgtcgtcagcacacatggatgtgcggaaatgcactgccctacctcacaacttgcttaagattcatgttttagtggtcttgtctagcatacactggagtggatctattgccaggatgaagaggaaagggaatagcgggtcaccatgtcgtatacccttgacatgcctgattgtttcgaatagttatagtttctccaaatatagactgttttgaggagttaaaaattctgaaaaaagaaaaactacaacagatagagactctccaaacatatctgtatgtctggcgcttggaggcaggtcactccagcaggatccacctaccagatacggctcacaagccacgtatctgtatcggatacttcatcggatacggatacgtatcagatacgctccgatacgtatccctaattaccacgatataaaataaagaaaattacttggatacttctccgatacgttccccatacttctgaactaacgaacccacgctcgcagcatagaagcgcagatccaatcctcctgcagcgccgcttgcatcgctaccaggggcacactgcacagggcctccacgggttggccaccgggttccgccgccgctcgccacctgaggagtagggcctccaccgccagccgtgcatcgcgtcgccacccctggtcccctgggcgcagggcctccgccgtcggtagtcgcggcatctccgtcaccaggcgtagcttctccgccggctaccaagcccaacgcgtacagtccatcatcaccggctatttggttctttcctcttttcctggttgttttgttatgtgtttttccttgtcatttagatccggtgaattttagaattggaatcttaaccacttatctagcactagtatgtactgctagcgcggctacagattcatcaggatcacttgtgaccaggcatgggagcatattatttacgaggggcaagctacatgatgagcttgatctcctgggatagtactattaaaagatctggtgcatgggacctgtctaggatgtagctctttcaaccacatcgctggctatgaatgcaagcagctcttgaacttctattgagttgaacttatatccggaacaagttttattctaattatctctaatgatgtcatgtaatttgtataactctatttgcaggcttatagttatttatgtgttatgtttttcctttgtattttttatttttttaaatatatatagacgtatccccgtatcggtgtttttaagaaaatgacgtgtcctcgtattcccgtatcgtgtatccgtatccccatatcagggtaacatagggatccacttcatgctcaacttcagctgcacatgttgtagtactattattatcatttgctttctaaaccttccctggtagtgtactactagtaatgtgcaaattgattgccgttaagtcattttaatgaggcgcaattgggcaaggctgatcgatcgtactagagctataggtagagctactcttttctaaacttctttaaaaaaaactctaatgttgatggtgagcaatgaatctatcaccagccatcccactgccacgtggatccataagtagtgaggtaggtgaatttcagtcctttcctcaactccaaaccaccaaacaaggaaaatttatctcaatatgagaggctataaatgatgaccaatactccttttcctttcaaaatgtaagacacaataacccttaactcaaacactaaaaaataataattattatctcctagtttagatgacagacagttataagataaatcaataacgatataacccatacattccaaaccatcctagttaaaaaaacacatgaaaataataacaaatgacctctacaagttctaagcaaaactaatgctaatctaaagcataaactaaaactaaatttcaatagtgtgcaataaaatgtgtagtccaaaagtgctactcctatcccatacaaatccatatcattaagtacctaaaagccaaattaaatataaaaatgagtaaaaatatacagcaagtacagtacagaactagtaaaacatacacaggtttagtggaataaggaaccaatatgcattataattcatgcactcaatagaattggagatcttgaaggtgaaggtgaaggatttaaaacataattatttagtggagataagatactagttaagtgcatgcatgcatacatgccttatattatgaaacatctaaaaaatagttgtgcctttatattatgaaatggatgaagtatgacctaagaatttacggtggaaaaaattttcttttaatttgtgaggctttaaaatctatggtggggttctctttttcaattcttgttatagtaaatttcacttaaccctaaatattatgatttgagttgaataaaacagcatgagttttagcatgtgacacataagtttaacaaaacacactattaatcattttaactttgatctaccatacttttgagttctacaatcacatctcaaatttatgggtattttatccatcagataaatcttacattcatgtaagtaaagtttttacaaaaattttaatataggagcatgccaaattgattattggagtggttttgtaaaactttaaaaccatagtgcacggggttatatgtcacgtaacaaaatcttatgatcttatataacttggactataataagctccacgtgagtataataaggctacaaatcacccaaaatcaccgtttcagtacaccgtgtgaagtcaaagggttccaaacttcaatcctgagctggagctatatatgtcaactaaaactcaagctatcattgatcttttctattatttttttcctttttttgggcacagaatctttcaattactttaatttatgctagaatataaagtgaattatccccttttttttcatcagcaatatatattttttttgttgttgttaccatcaactactcgtttgttttgacttttgagctgagctgccgcctgccgaaagtactatatatagaaccgagcaagaagcgtgccatgcatctaccccgtagcgaattagcaactgatcggaactctgttaagctgctagctccgggcaagttcgaccaatggctgctaagccaagcgctgccgaggtagcggtgaccgtgactccggttaccctttctgttgccgcttgctccggcaggcatgttgaatcaactgaaactgctctcggcgcagaggttcacctctgcatcaataaaatcatgattcataggtactactaccatgcaaatactattgctaatgatttcttcatgcatccaccataaatgtcgagctagctattaatgtttaattaacttttttttccctttcttgtataaacaacacacggagtacattcatgctatatgtactactagtacatttcaacattagtactagtttagtagcagtagtagtggtagtagtcaacagcatacattgcaaaaacacatgcatgctactagagagagagtgtgtgtgtgtgaccatcggttttttatacataatacatgtcctaggctgtgttcggcatacctggttcccaacatgactagagcgcacagaaaacggagcgatccattggcgcgtgattaattaagtattagctattttttaaaaaaatagattaatttgattttttaagcaactttcatatataaacttttaaaaaaaacacagtttagcagttttaaaaacgtgcgtgtagaaaacaaatgagagatgttgggaagaagggatgccgaacacaaccttagtcttcctggtttggtgtgttcactttagttcttcacaatacgaactaaagcttttaggtaacataaattacatccctagatttttttttcggggccataaacaaattactataacactacggcttaaaaattaatttaacccttgatttaacttccttgctagttctacgaccactccaaccatcgttgtacttactctataatttaagtgattgtatgttaaatatataatatactcctatgttctttctcttacaaaatttactatgtgcttgttgtcttgaggtacatgcatatgcatacatgctttatgacaaaaatagtactttccttcttgataactacattgatatataactaatatacttattactccaccaagaccaccacccacattgattttatattttaattttaaaaattcaaactttgtagatttttgataaatatatagttagtaaaattaaatttcatttaattaatgaaatttaattagggtacaaaactataccgataaattcatgttttaagtattttataaaaaatattggttttatggctgtcaagaatatatattacaagaaatcaacgctttaaagaatcttaggtactattcttttctcatgaagataaagattttacctcggtttctgttagcacgcttttcaaactacaaaacgacgcgttttgtacgaaaactttctatatgaaagttgcttcaaaatatcaaatatatccatttttcaagtttgtaataattaaaacttaattaatcacacgctaatagctttcttgttttgcgtgcccgcttttaatcttcatcttcagaagattcaaacaagacctcagatacttttaaaaattaaaatgtgcattataagaatcaacagatttatacgaaagggccatataaaagaatgtacctgttgacgagaaatccgcgctcggccgatagtaccggaactgtgttggcacggactaagtcgacgaaaacaacggcctgggagatctgcttagctcaagtgtaggtccaaaggttgatgagatacgtgcgtgccagacagtttgatcctacaactgacaagagatacaaatagcaaattaataagccgatagagtaattctaaccgatgccgataccagccgatagcgataatattttgagctatcggctatatggttgatgtagaatctgacaatcagttgatggtaatataatgaaataacaatataatccagtagaaaccaatcggctaacaatgagttgatcaaataagcactgatccaaaggttaaagcatacatcggctgaagatccgatgccatgaaattcacaagattagataaacagtaaaatctttgttgtgatcggccaatctaacttgtatgtaatccttataagccgttgcaacatccagataactcatcggctgaaaccccgataaaacctttattggcaatcaaaagcaggctagggactatggttctaagcacgacttagtagatcgaatgtattgatgcagcattaaatgtgaaaagaaacataatatctagacaatcaagctgttgactgattttcagggtggtagttgtctaaggtaatctaatctagcaagacgatttagctgatactgacagaaaccctaaaacgagagatagccgatagaactaaattaagatgctaaaattagattaacagagacttcagtgtaagcttaacaagccagctcgtgagctgctcatttagctcactagtataaaatatcatcgtatctttatatacttaattactcttgttaactactacttaattagtcttttagttatagtcaaactatatatttgtatttagtgatttctttgctaattattgtttattattacgttaatatatgataaaatggtaaatttaaaattgtacatgtaatacaaatgagatatatatatatagctcgttaattaatgagcataacgagcttaacgagcgagctgcgctagctaggattttttttagaagcacaatacaaacgcagacactcacagcttacacttagctaggattttaactcgttaaagttaacaacccgagctgaactgggttgttatccttacctatctccactgcttgacattttgtgttcttgtatgggctataggtttctaggaggacatccaattaatataggataaacaaagattaatcacaagaactatggttgatgtgcacaagccctgcatgtagaagccaaaggtgtaattcatcttccatatctgcaggtatcctgcgattcttcaaaatctaaaaatggattactaccgctacttcgtcccgagtgttgtggcaattggcccctaccaccatggtgcacgccaccttcaggaggcggagaagatcaagtggagtgccgtctgcgatttctgcaagaacacagggcactcggcagatgaagtatactggaagatcctccccatcgcaagcggtgcccgaagctgctacgagggcgatgcggtagtaggcgttcgaaaagccgagtttgcagctatgatgatacgcgatggttgtttcttgctgcaatttatggctcatatgtgcgatgtagccgttgacccattgttacaaacttggttcggctccaagcaacctagcatcttgagggacatgtttatgctggagaaccagatcccgtgggttgtgctcgaggccctgatgaccttcatgcccgtacccgtgcccgtggataacttcatctctaatgcaggggcaagtttcaatgtcaggttggatgataacattaatcctttcgacttgaatgaaattagctgcaaaccacatctccttggcctcctccgatactaccaatcaggattgagcaagcttggtgaaagcagctgggtcctcaagcgccctgaaggggtcactactgcactgcgacaatctagcagcgccatcgagcttgcagaaatcggcatcgatgttgtcgccaccgaggcgtcatggttcgcggacatgaaaataagcaaaggcctcctattcggcaagctctccatgccaccgctggtcatggacgacctcaatgcatgctggctcctcaacatggtggcgctcgagtcttacttggcatttactggtaagaatgacgtgcaaacggtcagctcgtacatatccctcctcgcgatgctaatgaaccggaaggaagaagtacacgagctgcggctgaagggtatattgcatggcaaattcagtgacaagtgcacgctcagttttctgaagaaccttgccgggctcattagcctccccccgcaacacgtatgcttgctggcacatcttgaggcctaccagcgaaaaaggtggatgtggattcccatacacaagttcctctacaacaactacaggatcatcgtcaccgtgttctccgtcatcggcgttctcgtcggcatcttcaaaacactcgtctctatcgagcaacagatgcagttatagttagcaagctagctggcttcatcgatcggtacacaccgagcttttacttgaattctgaatttctgataaatctgcgcttttataagtaccatcatgccatacttccattccattacctaattcctttttttccttttcaaggcaaaatgcaggagtttctgcctgtttcatcttaagaagaagagagaaatcattacacaagcaatccgcagtctcagaaagctccaaaaacagggagttatcccaaacagaacaatcaaaaacgctgctacagcacaggtaaaaagggggattaagtcggtttaaatccctactaaatatttaccttttgcatttatatgtacgcccaaatgctcactgctcctgatcggagcagtaggcataatccatccttgtgtacccttttatttttctaactaaattcctgcttgtaccttaattccgactttgtaatgaacactatctgaattccgtgtgtatgactttaacattatttggtcaattcaaatgccacgaatctgctggtgttgtgctgcagatgcatgggatcagtcacttgtgcctgcacacaaatggtctctttgcagctatgtatcagatcagagcatgatccatgcatgtaatcatacaaattgtatcctcctttatgttttctcatatttacatgtgagacctcaaaacaactatagctagctaaaaaaaaggaaggcactcacatgctatccccatttgctttgatattcaagagattcttttggaggccctccttgatctttttcttttctatttctaagtcaaatttgggcttggattttctcgacttgccaagagaatcctatatacattacactgtaatttttctaataaacaatgtacaagagaatcctatatatttataaagttcattcccactaagtgttgttaatgttatttctcttttctatcattaagttacatcacatttattatttttagctcttggatggttgatctacgctacaaattatctctcttttttcttattttatgaagtcatatcattttagttttgtcttcggatgattaatctatatatcttccttccttttcttctcaccttaattttgctttggaatgattaatctatgtataatttgaattataaaccacatcatcttaattgttcgaacattttttttcaatagtcggtcaaagatgaaaattatataaagtattacaaaattatattgtctagctattttacatgttatttctactatatattatcatacaaaacatgggttttatccagttaggattaaaagtaatttattatcttaaatagatagaagatataaaaagcatccttacatataggaacaaataggagagagacaatcacatagggataaaatgactgaaattaagcgaaaaatgtgacgctataattctagcaattccggcatagaaattagaaaagttgtttggtctgcatcacataaaaagcacagaaatttgggataccctgaattgcttggtttcagcaaatcaaaatatttccataaggtatttacgcaacatgtttctgaagaagaagatctcacgagggtcaactttcctgtcaggagaagagaacaagttggaacttggaagcttagaaacaagagagcctatttctttggacggagaattcaactgggagaagtcatgatcgatgagctcaaagggaggaaaaataacaaccaatcaatctagaattccacgcatattcattagtttctccttccgattagttggagaaagactaatttccaacgctaataaaatactgcaaggacaaaagcaacacagttttctccatggccccatggcgccaataattctcaagagaaaaaaacgaaaaacaatgtgcagagaaagccaaaaccatgtctgcttcctctgaccacccaacattccgacacctccagcttcagagctccgagctgtttaaataggccacaacgccacaagaattttctccatcccattcccgccatctctgcatcttcttcttcttcctcttccttctgatcacctctcctccaagaagctttcgtttctctcatctgtcaatcatgtcggcctactgcggcaagtacaagggtacagtaagcttcgtttatgattttgtgttcgctttatgtttggaaaagtttttttttaagttctctttgagttgcactcgttttgagcgatttggtgtaataattggttgtagctcgtttcagcgaaggcggagatggatttatattccattatccaaaaaaaacacttgtgcaacacatgcatttcttgattcgatgagtaagccatgcgtttctgcttcttgatcaatgatttatgggttttttttttgttttttttcagatgagttgatcaggaacgcggcgtacattgggacgccggggaagggcatcctcgccgccgacgagtcgacgggcacgatcgggaagcggctggcgagcatcggcgtggagaatgtcgaggagaaccgccgcgcgctccgggagctcctgttcacggcgcccggcgcgctggactgcctcagcggcgtcatcctgttcgaggagacgctctaccagagcacccgcgacgggacgccgttcgtcgacgtgctcgccgccgccggcgttctggccgggatcaaggtcgacaagggcaccgtcgagctcgccggcaccgaccgcgagacgacgacacaggggcacgacggcctcggcgagcgctgcaggcggtactacgccgccggcgcgcggttcgccaagtggcgcgccgtgctcagcatcggcagggcgtcgtccaggccgtcgcagctcgccgtcgacgccaacgcgcagggcctcgcgcggtacgccatcatctgccaggagaacgggctggtccccatcgtcgagccggagatcctcgtcgacggcgagcacggcatcgaggcttgcgccgaggtgacggagcgcgtcctcgccgcgtgctacaaggcgctgagcgaccaccacgtcctcctcgagggcaccctcctcaagcccaacatggtgacgccgggctccgacgccgccagggcgccgccggaggtggtcgccgagcacaccgtccgcgcgctcctccgcaccgtgccgccggcggtgccggccatcgtgttcctgtccggcgggcagagcgaggaggaggcgacgaggaacctgaacgccatgaaccaggtggcgagcaggggcaagaagccatggtcgctgaccttctccttcggccgcgcgctgcagcagagcacgctcaaggcgtgggccggcaaggcggagaacgtcggcaaggcgcaggcggcgctgctcgcccgctgcagggccaactcccaggcgacgctcggcgcgtacgccggcgacgccgccgccggcgagggcgtctccgagaacctccacgtcaaggactacaagtactgaggctttatgacgaattgatatttttgttttataatgtagtgtaacaataagctgcgattgcttctatgctctcgcaatgtcgcgtatttgattttgatttttgcttggtcttgtttagcgagtgttttgttttggttctgaattttgaaatgaattcaaagtgattttgtctgctgtttaacagtgaattaaaaagtggagtactacctgatgattccaggacaatgcgattttggttctgtcactttgatctgggttatacttgtggttaatttgattagagtatcagataacaaagattaattagaattagtacccttttttttcactgaagttgatctgatctcgtcagtttttaggtgcacagagttgcctgtacaaatttacagtgatctaagttgaacaaagttctgagctgactactgggccattaatcaggccggcctataacacggcccagatacgacaggtgagacagcccaagtatggtgtagttgattgggcttgcagttgcagaacaagaaccagtcggcatctgccctgccgccgttacctcctccattaaaagctggcgctatcaatcaaacctttgcttaactagcacttcatttgtggataagctcaagagacaccactagtagagcatactaagagcacccgcaatggtaaaataaggtgctatctataaaacatgtacatgtcagcaatagactaaattaatagtaaaccacctcaatagtatgtctacatgggtatctatagctctctaatacattgtctcgtttttctctataaactatctctaggttagtaagatagctttgctcctctcttcatttaatctcttccaagtaggaaaatatgctgacatagatctcttgtaaaaagcctatagataaccattgtgggtgtcctaatgggcaagcctacaacacctcagatagagtcaatcatcactgtaaataaaaattcccagctgaagaaacaaacaactgggaatttctctcccaataaagatgataaaatttttaggtgcacatacagttgtctgtaccttgaatagacggtaccactaatgagatcatggatcaacaatcacgtgtgtatcaggtggttgatctcatcgtcagatcaggtcaggtgcacactgaatcttgcttgactattcccgacgcgtcattctcatgaatctcatccccttatccactccacccaatcattcataaccaccgcccacagaaaaacacacacgcacccaccattaaccaccgccgcagaagatcctaatcccctttcctcccccacggccaaaaccctaactcccacggcccgatccacctcctcaaaaacacccccatcactcactgacatgtgggtccgccgtatcatgttccccacatgtcagtgaaacgtgtggtgagacacgaggtgaggctggcagtgccacgtggaaagaggatagggatgagcggccggccagccggcccaaaccaaaaaaccagcgggccgagaaaaaggataagcccacaggacacgcgcacccccatgacatgcggggcccacgagacgtgagccccacggcgtgtcgggcgcgggcgggcgacgtgtccccccgaatcccaatccgcctccgtataaaatgccaccctccctatcctttctctctcatctcactcactcgctcggagagaaaaaaaaagggaaaaaaaaggagcgtagaaaaaaaaatttaccactcgcctcgcctgcacaaatctcgcgcacgggttggcggcggcggcggctcaggctcgatccgcggccgaaaccctaggtacggcaacctccgccgcggaggcggcggcggattcgagtccccatttcggcggcggccggtgctgatgcgtggtgtaattttttgggtgcaggtggtggtggtgggattaggagttgaggtggggatggcgtcgccgaggaacgaggggttcctgacgcaggaccagcgggagaagctgcggatcgcggtgcagaacgccgagacgctgtcgctcgcctccccgcgctcgccgaccgggggctccacctccgcgctcctgcagcagtacgagcagcagcgcgccgccgccgcggcggctgcggccaggggcggcggcggcggtgggggtgggggtggggtgaggcacgtgcggcggtcgcattccgggaagaccattaaggtgaagaaaggtgaggtggctccggcttgatctatttatgctcggtttattgccttccttactgttgttgtggtggttctagagatttggcatgcttgattaggatataggatgtgaccactgctgctattgttaataattatcattgctacctgctgattattatttatccatatattgagtgttgtggcgtcttgtttaggatgattggaatgtgactttacccattaggttgatatagttgccaatgtttatttgagaaatatgtcagtgcagttgtagtgtgagttagtgtttcatggtattgggtttagttatatttagtaggtatatattgtggtatttgtctattatatatattcatatatagaattgattaaatcgattaggggaaacatgaatgtgcttgaatgtttgcttagggaatttgtggaatgtcatggtttaagtagggaagtattgcattttgagtttttggttagtaatcagatatttggtgtgttgatggttactcctgcatgcaaatatgggattccgtgtgcgtgttgattggtgtttctctcagctacctataggaggaggatttagttgggtcacgacaattatatgatttgggcatctagtaatttctgattagttggttggattagttattctgttactcgtgagattctttttgtcgctagtatgttctttccgcatcgctagtaggattggaggtgccatatcataaaggcatcgattgtacacatttgatcttgataacaactttcagtcagttcatatctctgatttgtcatgtatgtgcgacaggacgtccatctgccactatacatctcttatcacgtcaacacacttgattttcccccctcattctgcttgtatctttttgctagcttaatgcagttttaattattatggaggagtttctagtttatcaagtaatggttgcctggtgttgtttacaaaattgtgtgccattttgagctatctgtgggactctcatatcatatagggtggggattgccttctctgtctggactatgtttattaagaattattcttataatttcagttgacaattctagttgacggcatttagtccccatctatacatatgcataaactgaatcgcttagtaacatcaaatcttgtatacttctgtatattgtagtttttggcaaaaggagactgcataatgttacatgttaatttctccagtgtgatggctcaaggcaatgattataaatgagttttatgctgattaattagggaaggcatctgaactgtccattgattaggacggtcaaaggttgtcattatagtatttatgcttaactaacctaccttttgctggtgggtgttcgctgaatgcaggagtacataaaaatatttcttatgttcagttcatcccccttatcagtagtttggttttatgatttttaggacactacaatactctctagtgtccattctctgctagttctaaatttccaatgagttagtgtatttgggattctacacacaatttcaccaggaaagttattgcactctccaatattgttctcattacatctatatctctacttctgctgagccaaagattagtctctctctctctctctctctctctctctctcatatctgacttgctgagcttctatttcagatggtgctggtggcaaaggtacctggggaaaacttatagatacagacacagatgcatgccttgaccgcaatgacccaaactatgacagtgatgaggtaatatttaatggtcttgaccatgtactctagccacttgcacttttatgtatcgatgaactctagccacttgcacatttatgtaccgatgaattgtttgacacctgctattttggagaaactggtaaacatctagcttgtatccagtattgtctaaatatatgtggttagagtccagccagacgtatggacattcatgttctttttctggtaatcaggaaccatatgaactagttgaagcccctgtttcaaccccagtagaggactacaagaaatctgttgccccaattattgaggaatatttcagcactggtgatgttaaattggctgcttctgatctgaaagagttgggttatgatgatttccaccgttactttgtcaagaagcttgtttccatggcaatggataggcatgacaaggagaaagagatggcgtcagtgcttttatcatctctttatggtgatgtgatcagttctacccaaatcagactaggctttgtgatgctgctagaggctgttgatgacttggctgttgacatacttgacgcggttgatgttcttgctcttttcattgcacgagctgttgttgatgacattctgccacctgcttttctcagcagggaaaaagcgagtctctccgagtcttcaaaggggatgcaagttgtacagattgcagaaaagagctatctttcagcaccccaccatgcagagttgcttgaacggcgatggggtggttcaactcgcaccacagtagacgctgtaaagttgaggattactgatcttcttaaggaatatattaagaatggtgacacagctgaggcgtgtaggtgcatcagagaattggcagtgccattttttcaccatgaggttgtcaagcgagctctcactcttggaatggagagtccaactgcagaagctcttattgtcaagcttctgaaggaagcatctgaggaattgctgataagctctagtcagatgatgaagggattttctcgtgttgtagatagtcttgatgacctatctcttgatataccatctgcaaaatctcaattccagacattggtatcaaaagcagtttctgaaggatggctcgactcttcgtttgtacatgtaggtgccaatggggatgtccaagatgatgaacatgagaagctgaggaggtacaagaaagaggctgtttctatgattcatgagtactttctctctgatgatgtacctgagattattcgcagcctcaaagagcttggttctccagagtacaaccccgtctttattaagaagcttataacaattgctatggaccgcaaaaacagggagaaagagatggcttcaattcttctatcctcattaagcatggaattgttctcaacagaagacattgtcaagggtttcataatgcttcttgaatctgcagaagataccgcacttgatatattggatgcctcagatgagctgggactgttcctagccagagcagtgattgatgatgtgcttgcgcctctgaacttanatccgataagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23297 - DNA, 555 bp, Oryza sativa
cccagagtccgcacattctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatccgccagcatcatcttattctctatttgtattccctccatctttcagatacggatgtagccttggatgtgcccgtgcccaatgaagaggaagagcgcaacatgaaacgtaagtacaaaagtaccggaca

SEQ ID NO: 23298 - DNA, 8373 bp, Oryza sativa
gtgatggattgcacatgcatgtgtaattacaatttagagtgattactaagaatatatataatggcactatatattcactttagtgtcatacatatatatactcgtgacacactagttatatatacgacgtctcatacactaccagaaactagattacttatgacggctaaaaaccgtcaggataaaacaaatgcacgtcagaaaaattgtttgtgatgtgtcaacgtcaggaaaattccgtcaggactagcttgtcagagaaaaataaatttaggtgacggaggcgcatcaggattaattttcctgacgtgtactcacgtcagggatacttttcctgacgttgatgtgagcagtcatcgatattcatctatcgctgatggtctcccctgtcacagttttgcagtggttttttctgatggttatgacagtcaggaaaatatatttccctgacagttagacaactagccgcaaatcatcaggagaaaacctaccagaacgtaagcatgaatcaaatatacacagtacaatagcaaaagtactcattttcagtattcatcatgatcacatacacacctccagttcaagttcaatatttcgtaacttatggatcaagtgatacacatagatccctcataacagtataatgtagttccagttcaccatttgaacataacacaaaagtgtcactttgtggagtttgcatggccaagatactatgtaagaaacttagtactaattttggagtcccacattctatcgaggtttagaaccataaatacaacctatccaaaagtattagtatgacacaactccacagtcagtatatccaaaagccttagcccatcttgcatgatctgttagtgaagtgagtggtagcatcatggagaggcaatcaagatgtgctagtattacaaccaccagagttgttgttcccaccgatgttgcttccatcattggcattcaaactgctagtattattggcattgcagttgttgtcgctgatgttattgccaccattgccagaggcggtgttatatccatcgctggtgttgttcccattgtcctcaactggctgtgagactacacgggaagaacttgttccctgcagcagttcgaaatgaagtttataagaattcagtccaattaaccagtactgaaaagtgaaaacgcatgccgatgcaactagaagaaacaataagtaatacacagtggtctatcaaagttcctatgcaattcttttgtactatattgaacaaatgttggagtaactataaccttctaaaccaattttctgttttgtgcaagatgcaagtcatctcaaattaaaataatatattttgtcttaccatctcaattatttgagaatgtgactacaaggccaactgttacaacaatcaacatgagcccaatccctcactgtaagtgctgcattgtctgttctcactctgacataccaatgcaaattagtttgctatttcaatagggcaaccaaattgtactggcacaatataaatattcagctagttcatctatgagtaaccgcagcagtataggagaaaatacttaggtaaataactaaaataattgaactccgcttacctgtgcaaatggatcttcctcttctactggacagtccaattcttgtggtacttgttcacccaacttttcataaagtgcctacatttaaaaagtagccaactgggtttagaaactaaaaactaaaactgagagtaaaactgagagtaaaagtattattgtaacttcataccaataacaacttgtcagttcgttcctgttttttgcgcatgtattgattctcccggagtagttgttcattttgtcgagccatattttggaaagcaattgaattggcaggtcgaacatttgttgatttggccacagccaaaatattagccttcctaacagctccattcgctatctgtacgcgaccatgtggcaagccaccattggtgctgtacaatacattctcatctaggtctctttgttgccaatcatctggatatttagccctaagacctgttaaataatcagtctacaaaaaggttggaatttagtaccaaacaaaacattccttcaatggaaagaatagaagcagaaaccataccacatgcttttgtgctttctggcttgggattggtccaatatttccatcattatctatatttttaaagccagtcttcattgcactaaaagtgtttagtgttgtagctttctcaggtccaaattttactccctaaaacataattggtttgatgagcaataccctatgaataaaactaatgaaaaaccatgctaaaaagatatggtaccatatattgttgtgtctctgtgaatggccgggaacctcctcggttttgggcaacatcctcagaattaaggcgtgcttgttggcctctctttctttttgccttgaactcttcagtacaccaataatctgcaatgtatgaaaatccattgtctctgcaccaatcaacggggccatccttatattcatcaacttcaagttcctttgggcgtgctaatgcatcatcaatctcctccccaattttatcatggtacaccttgacagaatcgacacaaagctgatacatcatttgcctcactgatttcgctgcataattttccaaaacacggtcagcctctaccttgtccgcctcactgacacagaatgcattctgcatgtaccaagttaatatatattagatagcaatttaattgcttgtcaatgtaatttgaaggacattttaacaatgacttacccaaaattcttgcttcaccttatctgcctttgtgactcctgagtcgtcttccttttcatagtaatcaaaccatgaggttgctggacggctgctgatgattacaccattctcatccttctcttcaataatgccagggtattctcgtttaagaataattcccatatgtgtaccatatttggggtctgatttcaatagagggtatgttacgtactcaaattgcctaaagaaaacacccatgtgagaattgttccattaagaggagaaaaacatagacaacacatgtacagagcttttgtatacatacacatattagatttgaagaacttgtatgctactcaatttatcacgtcacaaacatatcggctttgaacaatataaattctacagaacagaaataaagacagcctctaatttattggagcagttaacaaagtaataagcattagtagaaaatctgtagggttctagaaatgcagatacttactcatcaccccgaggtttcagcgcgatctttcgaccccgcggaggtacttttagtgcagttcttgagcccttcttcctccctcttttatttggtggcgcactgctcatgccacttccagcaatattggtggcttgggaggcattatcagtattgctactattaccagcacaaagtctttgggaggagttagcaccggagttactactgccacctccattaatcatttccgggactctgttttttgcattagtagcactagcattgctccttgtagagatgttcctgcattgttgctgtcttgcaagccgcttccgatcaatgccgttcatttcttgcaatgttatatccatttattagttttagaagagcaccatcggtccataaaaaaagaagaataatagcatatattttcatagcatggaatcattcaaacaaataataatccatcagtgcttaatataaaacctttataaagtacaaaatgaccttaggtacttaaagcttaaaaagtcatatgaaagttggcagctgcataaataaattaacagacacaaaatacaatagatatttcaatctcaatagcttaaactaaaaatcatttggatcataagctgggggctgtggcccttcatcttcttcatcattttctttttcttcttcttcttcttcttcttcttcttcttcctcttcttcatcttcattgtcatcttcatcgtaattatcttcagcctgcatttgcttttctaggaattctaagtcttttgcattggttatctcatccaaaataggtggagtcatatttcctaagtcagccccaaggtcaataataaaagtgccttccaatccatcttcttgatagaatgatacatcttgggtttgatcatcatttgggttggaatcattatttgtgttctcagctttctggacataaccccgtggattgacatgatgtacaacccaccattatgatagatcacgtcttgtagtgcatgggtaaggcaaataatatacttgtgtaacttgactagccatcacaaatggttcaaaagttgaaagcctagacgtgtgcttaatttcaactaaacccaaattgtcagtacgtcgaacaccggtagatgttgggtcaaaccaataacagtcaaacaaaaccaattcaaggttcatgctgccttcccaactaataataccatagtactctagcacatcattgttttcgccaacacaagacacacacaccccactattggttgttgttaaccctgatttcttgctctcatacttctctgaacgaaacctatatccattgatatcataaactccataagtggaaactgtacttcaaaaaccatatgacatttgacgcaaagcattgtgtatactagatgacttcatgcactgcaaatgacagatattagtggtagttttagttgattgcacattgaaggaaagacaatgtctcaagtggttagagtcatacttcagttctgaaccaatcaaagaaattaggcccatttcataatgccacgacaagattttcatccatttaatcgcaagtctcgcaactgattgggtgttggtgaaaactcgctcttccagtgttccctatcatatttactacattaataaatttaattataattatggcataaaaatatatgaatgactcatagtagatttgaaacgtacttgaagaaatcatccatttctggtgtgtttgtcaatatgtataaggtagcagccttgtactcttctattgtgagtgcatggcagccccgtgggctaatataccggccagagtactaaaatatttctaggttggatgtactatcaaattgtgagctaccatcatcatatcgaggcatcttgtttctagcagaccgaactttaggattgaaatagagtgaaagaaaattagatgtttcctcaactaggtaggcctcaacaatggaaccctcaactcgagctttatttcgcactttctttctaagtttttggataaacctacatggcaggaccaaatgcattagggtcaataaactctacaaaaacaagttaatgttttacttcttgtcttacctctcatatggataattccaacgaaattggacaggacctccaagtcgagcttcatagggaagatgtatgatgagatgttgcattggattaaagaaaccaggtgggaatattttttccaacttgcaaataagaacagctacattctcttctaaagagcggatggtatccttgtttagttcttttgcacataactgcctataaaaaaaactgagctctgccaaacacttccaaacactctctggaataaatccacggaatgcaacaagtagcaaacgttccatgaaagcatggtagtcatgactttttaggccaaaaatttttctttgtagtaggttaaccccacgcctaatattggcagcatatccatcaggaaactttagttcttgaaaccatttgagaattgttgttttgtcatccctatcaatacaaaatgatgcctctggtttatgccattttccattaccctctgacactaattgcagtaatggacgactacaaatttcaaccaaaactttccttgccttcacattatcctttgttttatcttgtatgtcaaagcatgtgttccatatagattcagctacatttttctcattgtgcatcaaatcaatattgtgccgcagcttcagcttatcaaagtatggaagttgccaaaaacagcttatatgagtccaatggtgtgttttaccaaagttttccgtatcatccacacacgcgtacatttcttctttaatttcttctcctgtcagaatccttggtggctcatcaagcataaatgtgttctttctaaatgcatttagttgagttctgaattcatgttcgttgggtagaaagcgtctatgacaatcaaaccaacaaggctttctaccattacggagctgaaaagattgagaatcacccatacaaattggacatgccaaacgaccatgggtgctccacccagcaaacatcccataggcaggaaagtcatggattgaccatagaaatattgccttcattgtaaagttttgcttgcgtgaagcatcccaggtttctaccccctcccataacttcagaagttcatcaactaaaggttgcattagaacacttatttttttccctggatgctctggtccagggatgacaagggtaaggaatgtgtactcgggcctcatacacacaccgggagggaaatttaagggagttataaatactggccagcaatagtatggagcagcacctaaactatatggagtaaacccatcagttgctaaagcaagacgaacatttcttggatcttgtgcaaaatcttgaaagtcctcatcaaattgttgccatgcctcgccatcacatgggtgaaccatgttaccagattgtgagcgactatgggactgcaataatcttgctatctcctcatgtgcatataacctttgtaatctatctttaataggcaggtagcgcaaaactttacgtggggttttgttttggccattctcataacgagaagtaccacagaaatcacacttctctttatgctcatcttccttgtaataaagcatgcagttgttgtaacaaacatcaattttaacatatggcataccaagaccttctagcaatttttttgaacggtaaaagtccaaaaccaacttagactcaggaggtaagaattcatggattatccctaaaacatcatcataatgtgcaactgacatgttatactgtgacttcatagctagcaaacgagctacagctgagagacatgaatgtgttgtattctcatggatcaattcatcagcactagcaaccatcctatagaatgctttagcataatgtgcaggttcttcactactttctggtggctgtgcactggctaagtcaaccaacatattatccatcctatcagattcaccaaatccctcatgatctattaatgaaggcccaggatcattgtcatttatcaccgatctctcaccatgtgatgtccatattccatagttctctttatatccgtatttgcacaagtgcaactctattgtatcccttttgtgcctaaaataattccgacattgggcgcatggacacttaatagtaccatctttaacaacttcttgcatagaaaatgcacggtttaagaactgtgttgtattatcaatccattcattagtgagagctttgccacgtgtccaaccactatacatccattcacgacttgtcattctgtggttaaaaacagattcaattcttaataaattattttaacgtgcatatatgtcactcttatttatcacaccataaataacatcatctacttgattaatcacgtcacaaaggatagcacaaaaagaaattatgtacaatataatcaacatttagaatgaaaaggttcatgtgaaggttgttattgttctatcacttactgcacaaaatatattacagtgaagtaagttgaaaatcctggttacctcggatttggtattgacaatgagacgatggtaagcaataacttgtcagcacttcagatgagttcgacacaatctgtaaatattagccaacattacagttccattttgcatagtaaaggtgaaactttcaagaaaaatatgtatgtcatgcttatactaagatgcaccaggatgatggtgtatcatcctttaagagaaaatcactctttttatgaagcttaaagtttattcactgcctacaagctcaattgtgctaaaattactattctctcataggaacataaatgttgtacagtccaaacaacaacaaaattactattatcacagaataaagcattcattgacaggaggatagtgacatgcttagagtgctgaagaaattaatacttacgaatagtgagggatttattcaaactagcagccaaaatttaaagatctttaggataaattccatgctaccagtataaagcttgtaatgaaattctagagaaaaaaaaaccagcagatccatgggagtattgcctcaaatcatacgaaaatccctaagaactgcaagctttatcagagttcgttaaaaataaacaaaaaagta

SEQ ID NO: 23299 - DNA, 38021 bp, Oryza sativa
  unsure (1)..(38021): unsure at all n locations
tacccacctatctcccaccaaaacctattattttcacttactgctccattcacgtcagaaaaatcgcattattgtgacaggttgtgaatcctcgtcaagaaaattctatttttctgacgttagtacaggctcgtcaggaaaattagatttttcgcgataggagccattgtacacgtcagttaaataattggccgtcaggcctagtccggtttctggtagtgatatactttcataataggattcaagttctcatattaggtgacattaaagaatcatacatacattgtgtgttggcttggacaacacatatgtagtcacgttaaaccattaattagagtaggtacaataatatggactccgatcaatgatgatataaaaaaaaaacccacgtaggctcgaacattaatgacttgacagagtggagggatgattattttacatattgactctaaggttagttgtggatgacgtaaaaacatttagagccaacagtgaatttatctttgcatgcatgcattattgttactaccaatatataaacattaatcagtcttggagagttatatcaactattggcctgctcctaatatgacatgtcctattgacatttattattaccacaattattcacatatactaggctgcacaaccattaacatggttatatcttatatgcttttttgtttgtggtctaactcatatccctccatgtttctctatatatataactagaagtacatctaatttttgtcggccacatagagataaaaaagaatatagggaggcgcgagaagagatgcaatcttttgagtgaactactcatgggtccatatccttgttcacatccttaattagttttttcttcaaaaaaaaaaactttcctatttgagggggagggggggactatctggcttgctaatttcgtaagaaagaggcaaattaaccacaccgcttacttccaatataggaatgaggggaatctgtgaaagagcacatagagattattcgactgccaattacgagttcgacaaaagaaggtgatccaatcttgtattgactttcttgttaggcaaattttgctatacaataacgtgactttgtggttttatctctaggacacgtcaaaagtcaatcttcaggggaaatgcactctcaaaaaaatgtggttatttgctaatggacaccgcaaatattaatttccgactgaataggagagataaacagtgtgaaaggtcaaaaatacccttgaacccacttataaaattcttccccaacatctcactctcgaccctcctcgcttgatcctatgactccgccactcgtttctgttcttcagaaacaagtaaaaaagagcatttgactaattctatcatctatagtatgctttcatccatatgtacaagatatattgagcatgccgacaaattttagttcatgtgttaagagtgctctggtctaatatttgatatgcagcagtagaagttagttagggcgttaggctagagcttcaaagaattcgagcatgccaatgatggtatacggccttccttttaagagtttcgacaattaattaatactccctccatccacagaagttacttttgacaccaagaccacggagaaattaaatcaccttggatgttacaaaatcaaggaatgaatgtaagcatgcaaccaatgagtattttagatgactctttgggttctaataaaacatttaatttatctcttcatttaagtcttgaatgtacaaagactataaatatgaataacttatttgaaaaaactcgaatgtgaaataggtgcaacttttgtggatggagggagtatgtcttgtagatgatcgacctggcctgtaaatgctcagacaatattttttttaatttaaaagaaggcaaaatttgctacaggacaccaaaagattgtggcatttgctgtgagacacctgaagattgtgtatttgctcatggacactgaaaaaagtggtaattagctgctggacactcctcccattattttattatttccggtcaaaatggagagagaaactttggttaaagacaagtttgcccatgggcccacttgtcaatctctctttatctgttcttcttcctttctttgtctgttcatctctttctcattgcgccgccgccgagctccgctctggccgagccatcgtgcgtcgtcaccgtcggcagtgaactccggctctagtgtcgaccaaaccgagcatcgtgctcctgctgcaccacctcctcgccgtcgacgatgggagcagatcatcacgtgctctagcctgagaagcttcaacgagctgctcacgggagagctgaacacacggctgcaattgagccccgacgcgtccgtgctgtcgtcattgtcacttcactccccagcagcagtaatggcggcgcacccggcatcgacgtcgacgctcaactactatgcgacgttgttcgacggcctgcagcagagcacgacggcgccggcggagcgcgtgctgctcgggatggagatccgcagcgtggtggcatgcgagggggcggagcgggtggagcggcacgagtgggcgtgacagtggtcagcgcggatggaggcagccgggctggagcgggtggggctgtgctacagtggcaccatggaggcgaggaagctttgccgaccaaacattgcagacctcatccgtgctccaggatgccgccgtgcgtcattgccgtcagcggccccagcgatgcgctgccgccgccgccaccaccccgccgtggccgagccctcctggctcaggccggccgccgacgcgaggagaaatggggaaaagaaaagaagagagagaggaagaacagtacgtgtccaggggcattttggtacttacacagctctttctctctccattttgaccggaaataataaaataataggaggagtgtccaacagctaattaccacttttttacagtgtccacgagtaaatacatgattttcgggtgtctcacagcaaaggccgcaatctttcagtgtcctgtagcaaattttgtcttaaaagaatgacaggaactcaggaattaatggtcgacttatattggttgcctgaccacatatatacaccatttcgctcgctaaagataaattttctatcaattaactgccacagcccacacttcattcgatcttgcaccagcaaattgaggtgtaactaactccaaatttaagaaaggctcatatatatacatgttctagtttcccctgggtactacatttagtagatgcatgtttgctcgatacagactttttaattagtttctaaaagttttttattggtgcaaatttcgtgttacatgttcagcctgttgtaccaaattttattttatttttcaaacagaagggtggcactgggaatgagaggcagatggaaaaatgttggctgatgctgtgacatttagaggagcagcatggcagaaagagtaagtggagtgtgtcgaccaccggccttcagagcagatcagcttgcagaatttgccgcagtagcagctacacgactgcagttcctcgtgcgctctcacatcatatgatgtatcaactgtgatggatgtactttgagtgatggactctccataccacaaggtgacaactagctagctgcatgctggttcgattatgagccctagcaaactgttgatgatcacctctctaattaatctgccgcattagacaggagagaacgtccaatatgatattacatatgtcccaatataagtgcagtcgtggttttcgtgttaaacatttgaccgtttgttatgaaaaaatttaatgaaaaaataaaaaaaatcagtctcacataaagtattattcatgttttatcatgtattaataaaaaaatactaatcataaatttcaaataagataaaaggtcaaacgttggaaacgaaaacccacatctttacttatattggaacggaggcagtaagaataattgtgttgttccgcattaaatatctcaaggaataagttaacaaaattaagaagaatattagttttgttatgttggccgaccatgtttatcctgtgaaccaaagtaatttttgttagcttatttcttcagatattcaatgcggagcaacacaatcaaggactataaaattcctcaaggaatataaaattgctctataaattaagttctattgggtgagcaaagtcaattcactagctcttgaattatacactggcaaagtcagtagtccttccacaaattatatatatatatatatatatatatatatgcaatcattatttcactctaaaatattaactagaaatgattatatatccatatgggtgcaagagagaaaacagtgtaggagctgttgggggaatggctccagatttacggagctagcctccggttcagagccacccctaccctggagaagcaaccaagtcatttgagtctctcggggctgttaaacatccagaggctaatgggcttccagaggcatgatgagcctccggaggacagccagccgccgtagggtcacggagcccctccggaggccacatggtctccagggccccacggagtctctggaggccatcgatccgctggaggccaacaaggactccgaggatatcaagccattaagggccaatcgactttcggcaaacaacggaactccggaggccatcccggactccggagttggttaggatcatggatggccgggaaggccatgtgccagaagccattgtagatccttgaagtgtaatgaggagtaataaatacgcactacatatccaccaaccacctctggcgccatggcagggacgggcttgcataggccactacctgggaaacgcggctttacccgtgcggtggtcagagtttttgggggcgccgctgtaacgctccacttttcgtgagacgttaaaaactaattcggcaaaatcctaattgcgaaaatttttgttctttgtgtgcgagtctaagtcgtgccaagatctcatttcaaatcccgttgttccctctcatcgacatcaaatcctcctcctcaaaatttctcttccagttcaagtctccaaatcaaattccgaaaattcaatccctctctttgaatccttgccaaatatttgccctgactccaaaaataaccaaattcctattttgaactccttcccccaaattcaaattctctccaaatctatctccttaaaaaagtctacttgacctccctatttttggatagaccggttttcctcccctggcccatctcccctcccagcccatcatcttcccccctcgcacgtgcgttgcacgcatgcgagccgagagagagccgtcgctcgctctctctgtttctctcgctctctcgtcttcttcctctctctctctgtttctctctctctctctcggtcgatctctctctctcccatgccagcgctgccgccatcgccgatttttcccgctgccgccattcgattttcggccgtgccgctcgttcccgcgcgcgcgctcgctcgaggccagccgctcggtcgccgccgcgtcagcctgacgccgcccgtgactacgcgtcgcccagccccggctgtgcgcatgcgtccaagggagggaggcagagccctcggcctcgctccctctccctttcctttatcccgaaacaggaaggagcagagctccctttcttctccacctttttccttttgcccgaccaccatcggcgtcaccgcctgccaccaccttgaccacgccagctcgtcgtccttgcatccttgaccgcctatgtcggttccccctcccaaaccgcctcttctccatctataaagcccaggccgagcctccccatctcattctctctcggcatctctcttccaccgccgccgcgcctttgttgccaccttgcagctgtcgacctcgcctcccttcgccgtcgcgcgtgctggtgaagccggcgtgtgcgcgaggagccgaagaggactccggccacccttcttcttccccttccccagcccaaggccggagaactcgccccgcgccttcgaccgcccatcactgcccgcccggctctatagtgcctcctcccgttccccttcctcgctctccgtcgccccctctagtctgcgtgatagctcagtggcactcccgaacacgcgtagacgccgcccctagacccgccgccgcccagcatggcctcgccgccgttgccgcccgctcccggaggccgccgctcgtcgccagccctccttggtgctcttctgccccatcggacgccggaaacggactccttgaaccccggagatgcttccaccgcctctaattgaatcctcgtcgcccctccgccgtttgccccttttctcaccgccggcgagcgccgccgcgattcgtcgtcgccggtctcccttcggtgaatccgagccggtggcgcactttatctcctccgtctcattattccggtgtgctccctccctctcgaatcgtcgcgacaagctcgggtgaactcgaacgccgtccgccgtccattcgaccgcgccccctttcttcctcctctcgccggcccgcgtggccgctgcgtaggcgccacgtcggtgccaactcggctagaccgagtcaaaccggccagcctcgcttccccctacgtgcgtgcgcagaccacggtgagccatgcggctacacgtgggcccatcgcgcctcgctccacccggcgcacgcgcccaaaccgcgtccaccaaaccctatcgccgcccctcccgtgagcccttccctcagtgaacctagtcaccgacaagcgggccccacccgggaccccgcgaggtgcacccggtccaccggtcggcctccccctcccgcgcgcccctaatgggccgaccacccgcgcccgcgccggcccaatggcctgaccgcgctgcgcatgaccccttgggccgcgcctaagccgcccgagtaagtctaaatgacatccctccttccttttcttttccaaaggatttgataaatccttttcctttagacagaaaatccaaataatcttaggaaatccatatctcctcaaccgctcgtccgattgactccattcctcttccagtaattccgtaaattgagatctatttaatggcactattatttagtctaaatagggtctttttcttggtcttttgtctaggttttcgattgtttgcgtatagttgcggttaccggattttcgtcgatcgtggatttctcgaagattcgagaagctcagtgaagactttgagcaaggcaagtcaccctttgtccaattgctcctataattggaaaatcattattattttgtttgcaacttgcattattagaatcacacacttaatttgcttggcctcggtttgtgtgccaaaccgacggacctacccagtagtcgcactaattcttgtaggctgtactatcctgattccttgtcgctccacccttgtggtacttcggtatccgtgctctctgagcgcgtatacctaatatcccacatacaccgttgattatcgaaaacttgggaaatgggtttgtgaagccttcaaaatctgacatgtggtgtcggtgtgtttgaaaataaaatgaattgtgaaaactcgcgatgcgggggttgtgcctatgtggcactgtcctgtattcgcatataaggaccgattcctgtgggaaactcatcgaacataatcaaagtgcaaccacaagatggaatgggacaccctggctaagtaactagtcggttcagggaaacctcgcatgccaatagttgggaacgccggggcggggtcaggacaaaccgagttcctggtaaggcaaggacgagaagcttgctctcttaccgatcaaggtggttggagttgatttgtgaatgcctaaaatggtctatatttatctgaggatttgatccttctatgtggcatgaggtaaccctgggtcggcttgggaaaggctttgtcacgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaagagttgttgtggattgggaatcgtaaccagaattagcctatgtggcagatggatgacctgagtggtcagaaacgaatctgtgtgattcgggatgtctgcgggcatcatagactaggctgaccgagtggaagcggattgctttgctgctgggcagctggactctgggagtctgcaaaaatgaaaaaggctctggcagccgcctaatcagatgaaaaaggatctgggagccgcttaatcaagtgaaatggctctgggagccgataagtaatgatctgacccgggaggtcggtacattaccatttgagttgttgaaaagcatctcttaagtcgaatcgagacgcaagtctccttttcgacccaaacttaaaaagaaataaatcacttagtgatttcaaaaatgatttcaaacaaaggatttgcaaaacaaccttgtctctcttccaagcttgcattaaacacctaagttcccgtgacttgctgagtacgaaagtactcacccttgctctatataaatatatatagttcctccgtcctgaagctaaagatgaagtgaattgaagaatagggtttcgtcctggttcccagccgtcgcctgtagtgttgggtgttagaccgttggttccgctgttgttgctgttgctggtgtttcctcgtctgtgtcttcgtttgtattctcaggctgtcctgagctgcaacctaagttaaggtaaataagtcctctatttattttaaggatttgcaatgattcatatttgtcaccgtgggtaccagcactatgtcctgggactggtactgtgatcgcggtttcgtaggaagcggttcacgccgtttttcctacgacacgctcctgtcaggtgccgttgtacgagcacagccgtccctgtcacggaggatattactaggagcccgagggctggcccaccgggcagccaccttagattagtccaagagataggggcaaaaatataatttcctcttgtatacctagtataaatgcataacactgctcacgattaagggcagaattcgcgttgaatgcactagttggaatttgtcccaacaggagcagagaattgactagtaaacttggcaagtgagttgctaataatttcacatatatatgaactaatacttagatggctatagctaggagcaatttctaattaacaggttagtacgaagctagtaggtaagggcaaatggaaatgggaggcatctcggagaaatgaaggactatggcacggtcgatgcctcggtggcaaccaactcatagactcttgatgtgtgttgagttatcaggatgcagttgagttggggaaaatgtgcaacttatatctactccctccgtttcgaaatgtttgacaccgttaactttttagcacatgtttgaccgttcgtcttatttaaaaacttttgtgaaatatgtaaaattatatacctacataaaaatatatttaacaatgaatcaaatgataggaaaataattagtaattacttaaattttttgaataaaacgaacggtcaaacatatttaaaaaagtcaacggcgtcaaacatttcgaaatgaagggagtagtagagaacctagatccatcaaattttactcccggctaggatgggactctatctgggttggctgaagagaacaaaattagagttagtttagtcttaccaatccaacaggctgatcagcacagtgtttgcactttcgtttttgaataaaatttcacaatttcggggtcccgaaaattcaggatgttcaaaacttttttggacaaaattatttgaaaatttaacattgttataatatccaatattgaacactcaaatgtgctagagtatagtacaattaatacatattgcgttaatcaggcacaactaattaatttgcacggtatgtggcacagggtatttttttacagtgtgctgaagtaccgggtgaattgcaatacacagcatgtaaaatacaagacactcatttttgcaccagagcctctgtaattttttatttattattttttctttggttttcacactgttatactacatcttcctcgaaaaaaagtacactccatctaattgaaatctcgtggaacacgatcgaaatttatgatgtagctttcatgattcaaacctgaagaaagaaaaaggaatgttttttcacataacctattgcaacgtgcgtgatgcatgtcagagcaaaaaaagaagctgatctgcccggttagcagcgctgacatctttcaattatcagtgacaccagatacacctactgatatgcaaaagttgttattgcctctactacaccttctcctttaaatacattttatttattttcgtgcaatgttccattgcattctgagaaattaatatcagaactgtttttgtcatacatacttcctcctttccccctcgtttctcaaattgagcagtgtcatgaatcatgataggaatgggtggcatcaggaacacaacatttacaggatactcgatgtactcgatcgatgcagtccagcaacggtgcgtaaggtagcatgcgaccttgctaattccacccactgtatctctttcgtacggttgaatacactacactcattcaaaatttacaaatttgcagtttttcatgttttgatcatgaaaattaaatctagcataccatccctcgatgctcgagaagtttttgatgcaaactgttcagataaaaaatggttgcgtgggtagattgggccaatttgatccctttgtaactacatctgtacatgtacatgcatggacagaacatcactatgtgattctccttagttataaagttatcagtcccatttttccattaatttgcattaaacaagcttcaagaaaacacctgctctgattagctatagcttctttcaattatgagtgacaccagacacacctactggtattcaaaaaatgttattgcctccactagctaccttctcctttaactattttatatattttcccccaacgttccatttcattctggtcttccatatcttctatctttttaggcagtgagaaataacctcatgttcctatcttacttcaaccctttgtcacttagttcctctgatgttgatcagtgtcaggataagaatgagaggcatcagcaacacatcatttacaacatcattcacagactctgtcgacgcagtagtctagctaccaacaattcatgcactgctggggaactcatcttttagtcatgtttgtaaccccctttagtcctgggttgtaaactgggaccccgataccgggatgtctcagttgaaataaccgggactaaagattcatttttagtcccgattggtgttaccaactaggttttttctttttttttatttttatttaactgcttgcatattgatttccccaaatcaagtgctcgctacataacaaatcacagattcatagatcaaatacatcacaaattctaaaaaaaaatacatcacatatcaaatacattgcattctcaaaaaaatcatcacaattctcaaaaaataaattctctccccgcatgtngcatggncgcatcgncaccattaagctcccgttgcttcaccgcttgccgccgaccgnggncatcaacgttgctcntcccgcccgctgctgtgggagagagagatatgcgagagaggcgagaagaccagagcgagcgagagaggaatttcatttattcgacgtgtgtggagatcaatagaggacaaggacgtgggagagagatatttagtcccgaaatatatgatctttagtcccggttggtgataccaaccaggactaaagattgttggggggcttgacacgggctgacagctattgaatcgggactaacaatgatctttagtcttggttggaaacagcaaccgggattaaagattataaagtgccattgagcttttgaactggcgctatagatattcgaaccgggactaatgtgatatcccttctccagtagtgttggtattaggtattccaattttgttttgggccaaaatgattttgaggcactgaaatttctgaaatttactctttttttgcacgaaattatttgaaaatttgactatatttaaataaactttgatcaaatccacaaaaagttgggaaaaaaaaccctgaaagtttcagccagtatattttgccagaatggggcgaaattaccaaaccgaaaatgtaaaccatcctcgatcctcagtatagaatgcttacatccctgtcccacccagtctaaggcatgaactcgaatgacccttaacgcggcaccatcatcatatttcctatggcagcatgccccaacactgccaaattcatatgggaattaaactagcagggagtaggcaactcgattttttgatggcattggtacagcgcagtgccagtgttggtaactatcgcggtggatatctactacactgcgtatgtttgcaaccaccttgctgcgagtatgctaatccacggagatggctcaattggactgcggaagcgcactggagacagcatcggcgcctgccgatgaagagatagtactatatatgatacttacacacctttctcgagttcgctggttcgattaataataactacagatcaaaaatctctaggcaatgggaattaattatgtaaggaacttacaagtttgcaatggtacataccgcaatcttcttcaatgatcacaaatcttgcaaagatctaagcattgaaattccacgtacatgtgagagaggcatcaaaagtgcagctagctaggttaattattagtgaaagggtatgtagtctaatagttacagtaacttgagtagtatccaaggtgttgagttcaaatctctataggagcgaatttcagattgggttatttgaggagctaagttcccaacttaaaaatgagttcaaatctccatagaagcgactttcagattggattgtttgagaggctaagctccccaacttaaaaatgctgcatgtatccagttagatgcagagaccagattaattaggttgcctacaaactgtcaaggttaatgcttcagcttcactttgtcataatggtcattatggttttgaacatgcaaatactgccaactagtacttccacatgcaaaaatcaatgtgtgatatcactaatttaccccttgtactcccaacatttccatttgcctccagtcaaaaaaaaaaacatttccatttgcccaacatggtcctgtgtatcaatgataagcccctatatccatttggtgcaatagaagaaaatattttttttctatgtgaaatagcacgagaggcttctattacaccatattataaaaaaaaataggaacagggctagagcagaagattggctagtgaactttgccaagtgactttctaataattttgctagctatatatatgctgaagtaatgtagattgctagctaggagcatccatgtttaattatgtacgaatttctaatggacatgagaggtatataggaaaaatgaagtaattcgattggtctcttcattgcacactggaggattctggtgaaaccgatggacatgccaaggctgcagtgcttgatctcgtcgttcttgatgagattggaagttttcaccctccaagtccccacgtaggcgatggctgatgctggtcaagctggtgatctgaaggagctagaggaggctggagtggaccgtagtgtttgttccagcccactgtctttgccttggaatacgtatattttgcttctcttatatctttgggctgtgctatatatgactggaataaatctattttatcttcctccactctttgggtcggcgaccgatgggctatggcctataggggcgggggatcgatgttggcctgtggttgtgctgatcgttgggccgtgtcgtgctgggccagcacgtcgtgccgaggaagaggcccaaacacggcttaacagttaggacgggccggcacgagcctgataacagttgggccgtcctgtgcctgggccaagcaagatctccatgccgtggaccgggccatcagactacgggctttttggccaactatactcaggacaatggctcaccatctcaaagaaaaaaaaaagctcatatttgtactggcctgggtactacatatatagtagatgcttgttgcttgacacagaccttttaagttctacaggttctctattggagcaaattaggtcttacatgtccagccctttgtatatcaattttgttcagaaagggaatgacactgagaatgagaggcatctggaaaactataggttgttgccctggagatcatagcagcagcatgtcttacttagtacatgaggtgagtcgatcacagccgttgagagcagatcagtttgcagtgatgggcagtgtggcacccatgacttccattgatcgtgagctctacacatcatatggtgtaacagctgccagcagcgtctccatggacacacagccgagttgagtcatgaaatctcaatgcccggataggaggtgtcagctagcgatctggatcatgatcagccacaacatattgttgttgttgagcactaattaagctgcacaattacacaagagaggatgattggtatgcataactgtgtatactaattgttgataattagcccatgcatgcattcatatggatgcaagagagaaacaggggaggaactgagaatagggtagcgaattttgcaagtgacttgctaaaaatttgctatatcctgaagtaatagtgcttagatgactatgagcatccaggtttaagttggatttactagttaacaagctagtactacctccgtcccaaaataattgcaattctatgttgtttagcatatattaaggtttgagaagaaagactatggtgccactcattaaatggtgtttatgtgagagtgagaagacggttgagggtaaaatagggagaaatttgaatgagatatgattgatggggcaattagtactctagaattataattattttgggacgaattttaaatcctagaaatgcaattattttgggacggaggtaatagttgaaaatgagaggcctataggaaaaatgaagtgccggacaaggtaatatgtccttcaatttcaagacatcttgtaagcaaattaattgtaacaaggttagctgctacaaattaaagcttgacgagtgtacaacttgtttctaccagagcatgcatttagatccatcaaattttattcccggctaggattgtggatcaaattatgtcatcatcagacacactggaaactcaaatgaaaatacacgtgctagactgctagtgtatggtacaattaatacgtattgcagtctatctaggaacataaatatcgcacaactattgcttgctatttaatttgcacggtatatggcacgggatatttttgttgcagtgtgctgaattactgggtgaattgcatgacaggtaaaattcaagaccctcatttgtactagactgcctctgtaaattttttttttttggttttgaccctgttatatagtccttctaaagaaatacagagtataataaagctgtaccaatgctgtatttgtgttttttttacactacatataaagagcaattttatgatccttaaggaggtaccatgaaatactattttttctagagcaattctacagtccttgaggaggtaccatgaggtaagaaccgtagaattgctcacatataaaagcatcagagtagtgcgaagaggagtgctttccttccctcgttcctctctagactctagtgtcgagcagtgtcacgataagaatgagtggcatcagtaacacaacatttacaacatattcccagcagctgatgcagtctagcgacggtgatcactgtagcacgcttgcttacatgatccacccaccatctctctttcctatggctgaaccagaaccggcaactagcaggcggcacgcaggtcgcctttccaccgttgttactgaggcgctatgttaacctgcttcactgatgcaagaaacttgacaaattggcgatgatgcatattgtatttggatgtaggtgggcaaacccgctaccaccccacataaaaattcacttaaaagattttagaattattatataggtggggcaaaaaactcgctttcccgcctccacttggaacctaacactgcactcttctttagtctcgcaaatctttcaatatttaagcatgtgaattaaatccactctatcatctttcaagatatttttaaggggagctttcggtggttgtaattttcaatgatcaatgtttgatccacatgaataaattaaaagccaaaaattaaaggccggaatttcacctccgggaccatccaatcagcccatgaataagataatcgaataatacctactaacaagagatattttataattcttaaaaggcaccaagagatattaaaaacttttagtgtaaatttatgcaccttctagtgctggaggtatcgagggatgccaaattttacactataaaatatggtatgtacctgtcagtacctcctccacaactgtaaaatcactcatataacaaaccatatgtggccaaaaacaacttctcggttgatctacactagctaaattggttgcaacttgcaaaaaaagcaaatacacatgcacgagagctacctaagctagcatgctagtgaacagcccagcaatgaaattttagcttcaattatgcagttagctagctcgatcgtgagaaatagttaagtgactcaccatctcaaaatctagctctatagaaccaattttttttaaaaaaaaagagtaaagtgtacgggcactccttaaacttgtaggggtatgccatctagatccctaaactctcaaaatgcatatttaagtcctaaaatttgtcatagtgtgtcatctagatcccaaatcgccacaaccccttcaggatcctacgtggcgctgatgtgacatgccacacggacatgatgtggcatcattttgactgacaaatgtgacccatttaatatttttccttcttttttttcttctctttgttccctttcttctcttttctctgtgacccgagcagaagaaaggaaaaaaaagaagaatgagaagaaaacgaaaaagaaaaagaaaagaagaagaaaaaagaaaatgacatgtcacgtccatgtggcatgccacatcaacgccacgtaggatcctagaggggatgtgtcgatttgggatctagatggtatactttgacaagttctgtaatttggatatgcattttgagagtttatggacttaaatgacacaatactacaagtttactaaaagaaaatggtacgattggctcagctttttagtaccctgagtacaatatgtcaatatatagtagacacatgtttcagcccgtttgtttacaattttggttatacaacttcttttgaaacaaatttagttctacatattcagcccgtttgtttacattttatttgtaagaaaagaatgacagtactggggaatgagaggcatctggaagaatgcaagccgtgacattggagactagaggagcaccttggaataaagaggccgtgtagggagtcgatcgtcgccgtttaagtccaatcggcttgcggcgctgaatacagcagcagctacgtctccggttcttcctgtgatcccatgtgatgtgtcagctgcctctgacgtctcgttgcgtggatggcttcagctcaggaattttctacacatacatggtggtgaaaactaactgaatgatcagtcgtaactgagaggggagatgctgccagtggcctcttgcagatgcatctattctccaaaactgattcgatcgagcaatccatggatagctagagagaattcaatcccctttagttacagaagcacatacacatggacacaacatagcacattgagatgctttccagcaagaagggacgacggtaccaaatcaggagcgttcattggatcgaatgacagagcttggttaccatcatactttgttggttactttatataagatagatccaaaggttataactaatagttcatcgatttaaaatgcataggagtattcaaaatatgtagcttaaattatggttgtttaaatatctaacgttattgcgaagtgagcgcaactcaactggttagatttcttgtggtgaaacttgcccacatgggttcaagtcatagacttgacataggtgctcgtatttacagctaattattctttcagtggtatgtggcgtacccgtcgacaacaggacgctcacggtgacttcatcaatctcaaaatgtgccatctcaatcttttgaaggtactctaagggctagggtgtacgcgtgttgagtttctaaaaaaatatccaatattattgattgtttctattttagtttaacaactaaaaaatagcgaggggatagcaaaatatatttgaattttttcttaaaaatgtattgattagtgaataatagctagtccgtagaatatatatgatccaaagtaatatttttttaataatatagttaacttggttctttaattttaaattttgtaataaataatttaatttatcccctacttaggctacatttgatctcattggttgagcttatgtagggcacgcaaaatgatgtaggtcatcaattcaatattaattaagtattatattacaaacatgaaaatagattttttttaaaaaaatgtatagaaagtatttgcaaattgaacacgacagtttagttgttcggagaacatggtcaagataaataagggagagccaatctgataagcattttagaacacaatattaaatttattacttatgtacttatatattgattaacttcattatatatatatacatatatatatatatatatatatatatatatatatatatatatatatttatatattcaacatcgccatcaccatggttcattgaacaataattccttggtctagtactactatatagcccaagagagaacggccatctactatatagctagctcatatgagaatttgcctctcttgttgaagtagtgggtactatatagaagatgcatatgttgcttgatagatacagatggtactatgaatgagaggcatcagaaagcatacgaggtgtctttgtgtagactagaggacaaccattagagggaaatggctatggagcaagtccatgtcgcctttagacctgatcagctcagcttgccgtctccacatgatgatcccagtcaattgccactggcatcttcttaagtcgacggcatcagatcagggtttcgtcacaccctattgtgccacaacatatatatatatatgtatgttgatgagctcttgaggccacccaagtggatatgacaatcagtgaatgcatggctgtattattccagtcttccaaatagaaaatgaagaaagtaaatgccaaaatgaaaatgaatgttgtatattggagactatgcccaagtagttgtcgcaatagtgacattggagattagaggagcaccttggactaagagcacctttaccatccttgaaaagaaagaagggataaatcagggccgtccatctaattagatccaacggtggttcagactttggtaccttctagtatcgtctctccatctgcaccaggtacaaacctctaccccaatctccggcgagcccgtgccatctgtgcctcctttgcatgctcgtaacctccctttcagtgtcgaactccactgcatgccttgcccctcctccatttcccccatccgaaggcccccaaagcaacacctttatcttaatcaggacaaggcagcttaggggcgctcgacgtagaaaggatggtgcaaggaaaaaggataatgggtagggaagaacatgcgagcaaggtttacacaaattcgatgttaccaatcttaccccatgtcaatggatggcaaggtcttcctagctctattttttgcgagttccattacaattgaacgtttgcctttgcgacgctccaactatgggggtattagagatatagagttatagacatgttttgtatcttgtcctagtcggtttccctaattctctcctgattctgattcatgtagagattaggaaccgcctctatatttactcgtggtccgtaattaatcaaattatcacattgactcaattgcgctttcactttgagccagagcctttgaagagagagaccctcttacaaaccaaggatgaccgaccctaaagacaattgaagatggaagcagagatgctacaatggggaaaatttattctccccgaatgctgtagacaactggaattcagcaagaaatttacatgtttgcaatgatacacgagttcacaaaggaaaaaaaaaagaaagatctataattacagttatatagatgcaggaaataaagggtactgtttccttaattagtattttatttgcttcacaccataagaaattttggattttgaatatatccacgcatgtgcttaatgaatctaaacgagggattgagaggctaaaatatcttataatgtaaaatatagggagtacaaatattacaaatcaggatttttttttatcctcccagcctgccttcacacattattttcagcttggacttcctactgcatctatataactactagtttgcatccaacattgcattagaatcaatgctttgtctttcagacatttccttgaaacgcatatcttcattctttgcatcctgaccagttcatcgaaaattggaatgagtggcaatggaatacaacctattatacctctgctttcaacggttcttatcctgcaatacattgagttcactcgttggagggctcttgcaacttgggaggcatttgcacctgcaaagcatgattaagttttgttctgaggagtaaactctccagcaaaaattcttgaagacgggagtatgtctgtctaggaaggattcacttgaacatctgaacttcgaagcttctcaaaccaaggttcaagttcctcgtgaagagaacactatcctcttactatgtgacatcatgtctctgagcaagaatatctaattatgtaccaatcgggaattggagaaagaagtactaaataaaattttgccgtctccacggagagcagggaaaacaacaatgctttcaaaatatctttgttgggtgcaattgtgcatagcccaggtttagcatctttgttgggttctatttatttccagcataattctgaccatgggatcacatttcagcatcacaaattggtccacacaagagttggataaatactttgcaccggaacattttttctagaaaaacattatgaatttaactaaaaaaatcacagaaatcttgatcgggttggggaaattgtataaatagaacaaccctatcgtacgtggaaatagacaccacttggatgagaagttagtatagctcaattggttagactcctggtcgtggaacctgcacaccttcatttatgtcctagactttagacgggcgctcgtatttacgtttaactattcttttatggcaggcaacatatctatccacagcgaaaccacggtggtgacttcataaatctgaaaatgtgctggcccatttttcggacgtgctcataagggtgcgtgtgtatgttcctaggggtgagggtgcatgtgtatgtgtgtaaaaaaaagcacacccagttggcctgcaggatcgttaattgttctgtcgctttcacctttatatactaacatctaattttacaattttccatttaaacttccgtattttccagtatcttttttagctaaagagaaatggtcacctgttcttgtcttacaccttcccttgccccttgccaaaaaaaaacaataatcacaatgttgagaattcgagataggaatgggtgacatggggaacacaacctttactggatactgctgatgaaacatgcctttatctattcatctacaagattcctggaaacaatgccttctttgtctcaatcccctgctcctacttgagaccaagagagaactcacaaaatcggaatgagtgacgtcacgaatgccatacatagtctgcgagtaaaaacaagtcaaaattatatatgttcctaagggcctgccataccagacacagttatagttagtctacatgctgatcatcgaatgagcttttgttacaggcaccgacaattccattttctcactgaacgatgagaattgaattacaatattatgtgattattcttcctatatatagttcccacttagacacatcatcaccatcattattgctagttggtgagctttctttggtattgctctagttgttgttggtcatatgaaattcgtgcttttttttggacccgcctaattttttggatgcgctcactactacatgtggcccatgttgccgaagtgaatggggatgagtttggacagtgctacgatccaattgaaacaaagtagacaaagctaccgataaagtgtcttactgaaatagaagaaaatgataaattatgtgcacggtgtcaagtggcaaatagccatgaagctatagttcttgcgagcaatcgcattcttctagtgtccatgcgtaaattttgctgaaagtaatgatgggtgggcagcgaaattagtactatgaaattaacttcttataattgtggacgtaacttaaagcctatgatccattatatttgtggatggaggactagaacgttatctgaatactagataaatatttaagactataccaaggtttttttctacatagaaatttttttaaaaaaaaggaggacttttttagcattctttaagaaattagacagccttcaactaaaacaaaaaaaaacaaaactataaaagtgttaagaccatttaccaggcatactttcatgtcaaaataagacacaattatcgatatatatatatatatatatatatctttgtttgtatttgtggtaatgctacaatgtgtattagggtattagctgtctgtttggtcatggagatggatgaatttgaactatactttactttcttctggctaatatgtggttgtccatatttatcttttctgttttgacattcaatttgcaagaaacaagttacaaaaaaaaacacctatgccaataattagcagtacaataactgttattgcgtccccccagcttctcctctataaattttgctatccattcaattgaatccccaccttttcacatttcaattcccctatgaaatgaaaaggaaactaactcgaacctgatgtcaagcattgtggcgataagaatgagtggcttcagaaagaagatgcgtctacccaaaagaagcagacaatctgtgcacaagttccagtaggcatgtccagtacagaaggtgtttgacatcgttctgaagagttctgttcatgaacacacgaacccatcatattgcatctacgtcgttgtgatggctttctcgccacagttggcatggcgcgttgccagcatcgccaccgtgctcaacggccttcaaggtggaggcgggacagtgaccatggacaacaagagatgagagcatcgctccaagaggcattgcgcgattatgcgtatgtgcgtgctccttcgtgacagtttgctacgagaagagcgatagcaccttacagtacagtaatgtcgttgtcgtggctgtagactgatgattaacataataatcgagcagtccactatagtttacatgttagtgggagggcatgatggacaatgtttgaccgtcggatggcatttcgatgtccgagatgctggagtatgtgtccgaatatgtatttaaagttaggtgtaaattaggacttggagttataatatatgttaggatagaagtaaagttaggcttttatcataggctctcgcttaaattcctcccacatctatataactagttgcatgcaagtagaagagatgctttttcttttattcttttccttgccatgaatatcttcatgctttgcttcctgacccatgcatggaaattggaatgagtggcactaggaatataacccattataattgtgcttgcaacagttcttcttgaagtgaattgagatcacgcgctagatggctcttgcaatacaagaaacctgcaagacatgattttggttttttccatggaggaaactctcccacaacaatccctgaagactagagtacatttgtggcctggcaagatttggatgtatttctttactaaacatttactaatttgcaatctatttgagtttctgacattcaaacatagaagtctgtctgtctgtccctttatcgatcatcacatgtaacaatttaagtcaataacatttttttacccctcagctaaggctggcatgagttgtgtacacattacagcgtcgatcctcatatgtgagttgtgtattctttcatctacaaggttcctctaaattaatacctagtgccatcttcgtagtttagttcatgggaggcaacacgatcacaaattggaatgagagacatcaggaatcccacacttagcaagagctgaataattaatcagttaaccccttacgttatagttttttcagttcgcccgtactgatcatgtgcaacgaaaaaacacggatgatcatgttgttttcttaatatgacatcctgtactgataattttgtttgtttctgggaggctagtaataggagactggcgagaggattcagacattttcatcgttgctcttattcctttcagttcagtgactctagattcagaactactagattgttaatggacatagtagttgcatcatattttgcctagctcagttaacagaagatgtgctaattgatttttgttttgttttgtgaaatcacgctgtccggtctctctttctatcttgtgttgactctgttagtttgcaacttttcatagtggcacatactagcagatcatctaacccggcttaaactgtaataaaccatgctccttataatttgttactgctttctggcttgtccacaagaaaacaacatgtcatgaatccaacacgcactttggacctgattcagaggttgccatggacaggggcgggcccagtgtatattcaagggtattcagatgtatacccaagatttttggacaaaaaataggtatatatactctatatttcgtatatgtatttaaaaaattaaaaaagaaaccttaaactgctcatattggaccttatttcaccatttcttctctattgggcctaaacttcccactccccttcccctttcctctcagcccgcggtctaattgggccgttgtcaaccttgcatctcagcccatttcgacatatccccaattcccctcccatctaaccctaattcgcctccccatccatcccgacagttgcgcaggcgtgcggctggcggcgcgccgccgagcaggcggggcttgtggcgccggcccggccgcgcgactcgtgtcctcgtgctcgtggtcgtgggatgtggggcgccgcgccgggcgcagggcggtaggcggctgcgccactgagggctgccggcacctggcctggccggctgaccggctcagccgcgcagggcaggaccgcagaagcaggagcaggacagcaacagcaagccgcgcaggacaggagcagcacaacagtgacaacacagtgagtgactaaatctgtacatgcacaaaatttgaataaatgtagtgaagattttaggattgggagctgcaattcactgatttagtgagtacacaaatttgaataaatgtagtgaaaattttaggattgggagctgcaattcactgatttagtgagagtgtacttgcttgcttagtttgtagtggtctagtggacactggacggtagttcatagttcataccatattatcaaatttgtttaattttcagaactgaaacatgaagacgaagaagggccagctgttgatttaaactcttttttggagaaacaagatggggcttcattaaaaaaaattcaatttgcaagctaaggacaaggacatcatcgattattttcaaaatatcaagcgtcgaaaagttaatctctaaattgtaagatttcttcctaatttatcattttctttcatttttgtatttcatatgttattatgttggcactttgatatgtttaggcttttaggtgtatgaacaattttttttaccccttctcatttcgaatacacaagttcaaaaacctgggcccgccactgcccatggactcctacgcatactattgagcaatttggccttcaaaggaaagggtcatgctgacgaagccgatgtaaatctttgagcattgatccgttttttctcagtcttagctgcattttagttagtctagccttgcatatgtaggcaatactgaaaatagtccaggagtactagaattcagttgagcaatttccatttctttctttatgttgttgaccgatctaggagctatatcgtgggatggcgcggtttttgcgatcctgtacgctcggccattagatgcatgtaacaaactcccaggagaggagaataaaaggagaagatgaacccagaaaagctgtgcaagtttcaagcagcgcatactctatctcagctagctgctctgttttctgaatttcttcagtctactgtagcgaaacctacaaccgtcagataacacagcaccggtgagattgagagtgaaattgaatgtggtggagcatatttcctgacaggtcattgatccaaaatgtatattgcttacatctgcttgcaatccttcttcacgagcttaccatttgcttcagaggtttacatctatttatttgaagggtgagggagggtttttgcttccctccccatgtttttctcctctcttaatgaaatgtttcagcaatcctcttatgtattcaacaaaaaaaatgtttgatgtaattttacacttttatgacacgttgtgaaaatcttcaaggaaggaaatagagctagctagccatgcatgctaggataatgcactgcatcattttctaagtcaaatcaatatacttaactaacaatccaacaattttgtagggaggggtatatcctcaattcccatataagaagatgttatatgaccaattgtctcatcaaataattcttcatcctcagatatagcagaacttctgtatgatgaatggatatatccttaatacccagctgactggtttaatattatccactggatatattaatttctcacacgtgttttgaaatttattacgccaatatatggtgaagtgccaaaaggcgcaattggtcaggccacatgactgtttatgtacccatacagctgctttttgccaagctcacctaatgtgctcataatttcctccataaattatattttaggcagtaataataatgatatattgcttcttcttgatgctatccataccaagctcatcttgataatatcctaccttctttcacactatatatatagcagaacatcttgcagtagagaacttgcacacattttgctcctgcatgccttcttgctagcaagttcccattgtggccaggcttttcgccgctggcctcaatggccagggcataattcttgacgaactccgcggggttggagtctccccggtacttagagagcttaggtggtcggaagcctggtgggtacagctcctcttgtagctgccacatcagtggggactcgaggtttacggcgatggggggtcccttcggaggctagcttccctcgatccggagatactcccccaacacccgcaattttgaagcatctgacaagaccaaggaatggtactgctccataatttgcatttacaggctggtctgtactctgcacacgttattttccagcttcaacttcctactagatctatataactagttgcactgcaaagtttcattagaatcgacgatttgtctttcattcttttccttgccattcataccttcatgctttacatcctgacctgtgcatcgaaatcggaatgagtggcgctaggaatacaacgcagtataactctgcttgccactattatgaaactacagtatattgagatcactcgctggatgtctcctgcaccagggaaaaattttgcacctggaaagcatgattttgttctgttccaaggaggaaactctcccacaaggccacaacgattgccaaataatggagtgcatctgttcatgcaggattgacttggacatcagcctcaaagagtggtacatgttccctgcagtgaaccttgtcactttactatcttagaatgtcaatgtattggaacaaacatgtaactatgaatggggaattggatactaaagaaaattttgccttctctgcatagagcagagaaaaaaaaaagcaaatttccgaaaaatcaacttgctatctgcaatcatgtatagagtaagattgcatcttattgtatgccggtgttctctcataattagccattgaatcatatttcagcatcacagaatggtccaagcaaagagttcgatggatcttttgcagagaaactccgcaaatgtacagataacatttaggaattaggatccttgtgatgttgtttgagtgaatgaacagtgcaatcatctttcagtagtaatacccctccattatttatatggttcgttgaagcaaaggaaaccacctatacttgtgtaattaaagcggtgatatcttcattttttaaaaaaaaaataagcattaacatcaaacaggggcggagctagaacgaaatggaggggtgcttaatttactttattttatatagagtttaagttgatacggtgatctaaatttgtgttgagagtggtgcatacatggtgaaaacagtgagttataactacaaaattttcttaactgagttcctaggcccccccccccccataccgtcgctccatccctgacatcaaacacacctcatctacaaaagttattattacttctgctaccctcgtctttatatactaacatatctttctctttccacaatgttcgatttcaacttccacaatttctatctttgtagctaaagagaaacaacaaccacacattcctatcttacagcttccctagcttgcagtatcgagataactaggaatgagtgacatcaggaacgcaacatttaccatttcccccacgctatgtcgacgcagtctagcagcagtattcagtatggcatgtgattactccatcccatctcgtgcaaggatgcaactggccatcggctacaccatctttcttccagaaggctgcaagaacaccgacaaccagcaggcagcaggctcatctatatgctcagtattctgcttctgttaatgctttagtgtcatgccagtgtcatcgccatgggtcacagtagattccatttgaatctctgaggttgaacttgcgaagaagtaagataatggtagtgaaaagtctaaacgaatcagtgctgcatcgacagatatatggacttaataaacagtggtaaagccagaaaagagagaagtaataatgtgtgcatgctagtatgacgttctattacatcaaagtatacatgctcagctattcagagttaacattaagatgcttaattgttatcatagtgaggctagaggatttaatttggtggcctcttgaatcaattttttgttcctagtttgcaaactaaataaattttttgtgcagtaattttggcacttcaaatacttttgcagtaccttcgctgaattcatagacaagtatatgctgaattcattatatttcttggcgacgaacgccggcgacgacgcatatcttttttctttcagtattgcggcacacgcacacgtatttggaatggacacacaagaacagaagcctttcagcaacaaatgccttcttttttttctccgttattcgcactgaatcagctaattatcacaagcgcacatactgcagagcaactaatttggctttataagtctcacgccagcacgcatgattacttgacccggactctactacatgcacttctccactaatccctgcaacacatgcatgtacgtacttatccactaagtaactaactagcccactaattaaggcatgcaacatatgcacgttgtaactagctagcaacttgacccatttatgaattggccggcctcaaactgaacacatcaagtttccagccatatgcaaacacgtctaacacatgatgtgatcacagtaaacaaaactaattaaccataaaagaatgatatgcaacaagaattagtgctaacaaagtattgatttgacttagaaaatgctgcaatgcacatcatcctaacatgtctagctgcatttcttccttttaaaatcttcttgcatgatccttccctttgatggccaaatttcccaacatgtcaacctactagtcgcaaggccaaagaatgcaacaacagctagtatggacaggccaaagttcctgctgcctctcatgtcaaatgcaagcaacatcaggaagctatatagcaacaccagtataggtgaagagaacgacaggacagagagagccagctcttaatttgttgtcacattctgctatatatgtaactgcccttccaacattggagagaacaaatttgacatttacagcttccaccagcatagacttgtattatttatgatgaatctcattgcttcaggttaattaaggaaaaagtgctatattcttgatatactacgtacatatcagtgcaggccacaggtttggattcatggcacattgttttcttaaggacaagcggcaggcttttattaaactaacgcagtcaacacaaagacagatagagaaattatcgcagctaataccttgatttcacaaaatgaaaaaataaagtcgaccaccgcatatatgctgttaatgagacattgtttattttttgttgaaatgtatgaaatctggcctctacatccaaagcgaatgtacagagctaagttaattgagacaacacatatgatgcagttaatgagttatgacaagttagtttttttaatgaaaaagtactatcaggtcttgcctagaagttatatattaaaaatataatatttggagacaggagtaccagtttatccaaatattacaaatgttgtaaccaatcaaaaactgctaaactaatacactcgttcaccctacactgaactgaagtgaattgaacaagagcctacaatctctaaaatcctctggctggccatcagtgttctactatcagaagtaaatagcatgccgggccagccatttactcttggaacttaagactgggctgcagatcattcaaatggactatgattatctttgatttctattgtggatgatcaataaggaccaactaaaactatgtttgctgcagtaccaggccttcgtaaacatactgtccagtgaagtcgacaggttattggattctcaaagagtgtggcatccctgatgtcgctcattccaatttgtgaccgtgttttctctattgatttaacaagaaagaaagtattgtttcagaggaatcttgtagatgaaggatacatgcagaggagatgaaggtgtatatatataggcctttatagttgactgtctattgatttattacatgtgaatatggccatgtttagttccaaagtttttcttcaaacttccaactttttccatcacatcaaaactttcctacacacacaaacttccaatttttctgtcacaccgttccaatttcaaccaaacttccaattttggtgtgaactaaacacagccataaagcttccaaacaaccgaatttaataactgaaactcaaatagctttgtagctagctagtaaattttatacagacttctcctccggcctatctgtaccaggatgatcttcaatgtgctataatggagaatcatgatcaggagtacaacagtgccttcttggaactggaagatacgcacgaggagagatgataacctcataaaatgactagaattcccaatagcgagcgtactcgcttgttcgtcgtctccagcatgctctgaccctcccattttacttacagtgagaggataacttcatggctagggttgctgccgcgaccggtagttcggaaattcaagtggtcaccagctcgctgcaagaattacacaagtataagctggttcatttcctttaattgagaaacacaatactagaggggcctaataagcaaaatatcactctctacggctacccaaggaccaatcttgtttgtgaccattcaaagtgacctgaagtcttggagatcctgaccgttttttcgtacaaatagggggtttccatacaaaagatccatcccactcttggcatggacatatctctttgttcaccataagagctgttatttggttcatatggggcgtttccacgaaaaaaaaacgcacggaccaatctaagacacgtgcggtgatccgacaagcaaatatgagaaattttatggtccttgaaaaagtatctcaaggtacctaaattttacactaaaatttttggtaccttgagatacttggtagctgcaggtatgaaattttacactagaaaatatggtaccttccagtactttttcaagaagagcaattctacggtctttgatgagataccatgaggtatcaaaaatttagtataaattttggtacctcatagtatctaggtaccaagaggtaccaaatttacaatagaaaaagtggtacctcctcaaggattgtaaaattgctcatactggaaggaaaaagatatgcgtcgtcgccggcgttcgtcgccaagaaatataatgaattcagcatatacttgtctatgaattcagcgaaggtactgcaaaagtatttgaagtgccaaaattactgcacaaaaaatttatttagtttgcaaactaggaacaaaaaatttgattcaagaggccaccaaattaaatcctctagcctcactgtgataacaattaagcatcttaatgttagctctgaatagctgagcatgtatactttgatgtaatagaacgtcatactagcatgcacacattattacttctctcttttctggctttaccactgttttttaagtccatatatctgtcgatgcagcactgatttgtgtagacttttcactaccattctcttaattattcgcaagttcaacctcagggattcaaatggaaatgcatggcggtatgagcatcacaatcggaatgagtggcatcagcaatataacactttacttgactcaaagaaaacgcccaacaattctacaataatatgcatcaatgttggctcttggatatggcagaactgcatcaagccatcagcgtgttaccaatatccaatcgctcttaacaagaactgtgcacgctaattatgttcatgtaaggcgtgagtgcctaggaaacctcagtgtgatccctcagcctcaccctcacatgactgacatagcgtgaaaataggagttggattaatacaacttagtgcttctcattcctcaagtatcaataaaattgttgtaaacaaactctctaaaaacaatttacaccaacgatataataagcagttgtcatctggcaaaatttagtccaaatttaaactacacaaggagaaaagaaataaccaaattcagtaatgaatattacttgcgtgcatttttttttgtgagactagtgccgtgcttgtgtgttgcaatgggattggaagaaatatggacgaatggttttatggggttcacttttttctggtcggtcaatttcctgaccagttagatccaacaatcggaaacgatttggtaccgtggggtactggtacctcgagatactttttattggaccagagcaaatctcttttctagctgcttttcctctcttctacatatttgtcaataagatagcagttcatcttgattatttcagcctctcttctccattcctaacaatttttcgattatgctgatattgcctaacctgatgctagtggggatgagtggcactaggaattgtgatatgtcgtttctgatgtgtgtaggttgtctctgacggcctgctactgaagtcctcatagctacttgaaccttagttctctagcagagcttggttgtactgtatgattgtgtcgtgtgtccctcatgtgcttaggagcaatgtctatagatcaagaacaataagtgatttaggctgaggagaattaagtgtaattatgtcttccttaaaatatggagaaagagaagtagctaggtactggcctgtttacttacaaagaatatggaacattggcatgcatatatgagcatgcacaacaccatttttattactcaaagatgatgacaacaatttgatgcggtatatctgttgcatttcatgctaatagagaactaagaacatatatttcaattagtagtacatcatgatactttccaacaacggtaaaaaaaatagctgtttagaattattgaaaataggtaatgtctgcagattgtagtctgagaggtgctaaaaattattacctctcttttctttctggcttcttttgctcctctcccctagtctatatagttatcaacaagattgtttatctaggctattgcagctagctaagtagcctctcgttttctccattcctcacaatttcattccgattatagactgatattggttaatctgatgttattattgaggatgagcggcatgaggaattgtgatatgtcctttggtctaagtcctgctggtgcatatgtactctcaagtcgccacgatttcacagtgtaattgttcgatccacacgtagaacatgtttatgatggcaattaactagagtattgcacatgtttatgatgtcctattaacatgacattttaggtgttccaggtatcgaattgctgctcataattaactaggacatcgttttagtattttctaccattgtcctcacatgtccatatattcttcctagatggtaattctctacttcccatttaccgtgcttctttatttcccttctcatttcctagtctaccataaagcaatcagtatcacatgaatgtaagccatccacaatagaattgagcggcaccaggaatacaatgctccaactcaactgatctgaatgtccttcactttcatcccctcagttgtttggctgaataaaacattaaaggcttgttctaactcccaagcccagtgtaaccaggcgagattatttgatctattgcataacaacggctatctatgcagcttctcaaaacagatggaagcttgtgttcctgatgatagtgcattggcatgttcttactggccagaatggaacatggcctgcaagtgagtagtgactatagttcagaaaagtaactcgacttctctgtttgggaatgtcttttccaatatttattacatcgaaaagaattacaatttcctcacaaaaaagaaagtacaattagaactacatcttgagaatttccaatgaattaaaatataactctttagaattattggagattaaagtctgatgcattttacaacagtgtagagaacactatgcctattgtcctgttgacaattattagttcttttttctggcttcttttcctcctctctccaagtttatatatttgtcgacaagagacagacatgatctaagaaaagtgcttaccaactaatgaggcacattgcattgtagcttacacaagccatttgagttgtaatttttttccccttattactttcaacaagaccgtcctagtaacttgttgccatgatcaatggagaagaatgttaatgtgtgcatatatatattattagtctagtccctgttgagattgaacaccattgaaactcttgaggctaaaaaaaaaacaggaaatcatttcaaatgctgaaggctggtaggcgatatccctttgtctaggctccaccaatgaaacattgttaatgtgtgaccatgaaaacatctcaggctaccagtagccttaacatgttctatatatttcttcctacattgttttagggaaatatttcttcctacatatggttctatgttttccttcatctcccagtttaccataaaacaagtaggccatatgtttcagtaggattgcatggcatcaggaatacagtgcttcaacataactgatccaaatgtccttcttatcatcaacgatccctctactgtttagcctaagttaaaaatcaaaggtttgctgctaagtgccatctggctcctgagcccactgtaacctggaacctcatgaacgcttcaccagagcagaagggacagatcagaggagatggttcatctgttttccgggcaacactagcagctctgtcgtgtcaatgagtcaatgactgaaatcttttccattattaatttggtacctccaaaagagaagaatgtattatctcctcatagaaaatgtcttttacaatattgggtaactctcttcatgacaaaaaacttaaaaagaaagaaagtagtacatctttctaagagatgtaaaacagcaactcaatagaattattgaaatgtactcagggtttttattacaggtgacaaaaaagaatatgagagtagtggtaatcgggatttatcagaattatatcgccatagacaaaataagcaaaatttgaaaaaaaaaattggacaaaattatgtattacacctacccctgttgcatttctcactagtagaattaaaacactacacctacctcctgattgctggctcttttctctaacttctctcctagcaccaatacaacacaccgcgcatctaccatccttcttacttgctctaccaagtctatattttgatgacaagaaagttcatctagatttctttgtaatatcttgtcttctcgatccattgttcataatttccccgattctacgattatattgatgtttgccaatgttagtgggcatgaggggcacaaaggaaatatgatctgctatatgctaagcctctcaaaaggcctgctactcatgtctcaccatgatatgatgatggatcaagtgttgtcatcagactcgcagcggaatccaaggttatcgtagcgagttgcatggctgtgtgagtgtgtctgactcgatggcaaattcagaaattttctaccagaaataacatgtttggacaatttgctggaacaatttcttttcgagtcaaatcaaaagcataaggacacatatgagtatccgacacatagttctgcatcaatctctggcctactaaagaaagctccaactaacatggaaaactcgatgtaaactgcaaacttgtaggaaatagaattagcattgcaactttcatgtttatccgtcatattgctcttcagcaaatgcgttcggttgtgttttgtgactacttgttgagcatatgaaaactaatggtcaacaactggacggctgcaacaaagggaagaagctactaagtctaggatcttagctttcaaatacatagaaatggagagatagcagtgaacttgatcgtccttcaattcataatgtgcaggttgaaccaaatcaattttgtgcaatatgaccgaaagatgtgttgtaccaaaagtagaacgcacgatcaatcaacttattggctcctatgattacttacacatcatatctgcaatgtcaatgttttcccttcctttccatggagtagcaaagtatatagattattgtcaatttgtcatgcatgatcatttgaggaacatcgatgtgtgttcatataatcattggagatgattttttttttggaattgctaaacttctgtcagcagaaaatacaacctcaaatcttgtaaatttcggatcattggatgtgcttcacgattcgttctcttcttcttcaactccggcgaccacctcttcttctctggcattggcgaacccaaactccggcagagggccaacgaattagggtcccagggtggggtgggggtaggagggg

SEQ ID NO: 23300 - DNA, 28305 bp, Oryza sativa
aagagaacatcacacagctactagactgtaccaattattactcttctctggactatatataatacatttgttaacatggtggttcttgtatacacagttgtgtatttatctatctttctttgcaagttcaacctcaaagcatgaacatcgcaataggaatgtgtggcatgaggaatagaacacttcactggaggtaaagcaaatgctcattaatcctgggagcatctgattcctggttctcatatagtcagatgatccggtgaaattgcaccaggccatcaatatgtgtccgtggtgtcctacaagcaagcatttaagtgttcctagtatcgaattgctcttagttaaccaggattgtcaatgctatttctgtgtccatatttttcttcctactagcccgcttgcatattttccttctcatctcctagtttaccataaaactatcagcatatcgcaagaattgtaagccatgtcacagtaggattgagcggcattaggaatacatcgttattgagcagcattagaaatgtgcttcaatatttagcctaagaacaaattaaaggtatgttgctaagtatctgttggttttaatgtaccgattataaccatgaaccctggagccacatgcgggcagggtttcccaaaccgccggggccggggttaccacgccccggcggtaagcacggttaccgcgcggttaccgcggtaaccgtgaaaaactgcgagaaactgtgcaaaatttatcaaaaatttaaattattttttaaatttatttgaatttaaggaggttaccgcggtatttatattaccgtacccccgcggtaagcccggtaaccgcggttaccgccggtaagggaaaccctgcatgcgggacatagcttggcttgagctccacacgtggaaaaagaaaacacaatggaaaatattaaattttagcaagaatttcaatagaaatttcaatgtatctaaaattaagttttatacataaagtttctatgtacaaactttttatgtatgtaaatattttttgttgggttcgggtaaggctttgtttgttcggcccaaagcctgagaaaagaaaacagacaaagcccgcatggaagccctgggctaatatgtcataaatgttctccaatttggattttttttttttgtcttttcacgttggcaaggcgcccgggtcgcgaccgaatgaattagacacggctgacaacacgcacgatcgaatgttgccatggcctgcttcatgaccagaaatacagaacgtaggcacaaccagccactattgcttttcaagtcagaaccataagaacatacccaaagtacacatgattctgcaccaatctctggactactaataaaatttcaactaacacagaaaaaaaaaactagatgtaaaaattgcaaaactaaggtaaacgtaaatagattccgccttataggcgttagaaacaataagagggcgacttcgatgttcaaccgtcgtattgcccttcagcgaacttgtcctcagggtagaagacagccaccacctggttgttggcaaacttcctcccgtgcatcccattcttcgccttggtcgagctctctacatctgcaaattccaaaaacacctgcaatgcactctcatgcttcagaacagtttcaaaattcataacccatgatgttattatttgtattaaattggcaaaagagcaagaggagcactcaccctcccaactccagcaacaggagcaccgctgggatcaggtcgcgggatcacaactttcaccaggttacctgaacaagcgtcagtgagaacatagacaaatagaaaaaagcatggcatcatattatatcataatcataaagctgataaagcaaagtaaaattggaattgtgtgtcttctgtaggctatgcccgactgccaatattgcataaggtcggactataaaagactctgcaatggcactatgtgggactacaaaaaagacacacaaaaagacaaacacacaaaaggaaactagttcagtaactgagcaaaggcaaaaatcaattatgaaactgaatcagagtgattggtgcacaggaagcgagaatgtgcgagttcattgttgcttaccgtatctgcacccttcttccctcatgtcttgcacgatgtcctcatactcctcatcatccctcagttcatctggtgaaaccacttgggtcaggcataccacctttgtaggcagtgctccccctccaacttggaacatgagtttctgtccaagaaacaacagtcagaaattggaaggctagtgtttaaactgatttgtgctccgtaaaataatgtgtttaagaacacagcacatacctgcatttgcgcctgttgttgtacatgcaggagcatgctttcttgctctggcctaggttgagaagctccttggttagctcgcctaacagtgagggtcttgtctcccatcttgataccattaagagcagcacaggcaatgtccgtgacattaagatcctggtatacacagaaagcatagcccttcgagtttccagtttctctgtccttcacaagatcaaaaccacgcagaggtccaaaggattcgagcaactccctgacttgagcttctgtgaagtaatagggcagcccacccacaaaaatgcggtcaggaccttctaaacctccagctgagccaggtgttaagccaacagcagcaagattgaggttggggtttggctggcttggacccaatgcagctgctagggaaggattatagtctgttggccttctaaccttcacaggtgctccctcaaacattataccatccaaggccattgcattgcttgcttcctccacagacctcatctccacaaatgcaaatttcttatcatggtttatgtagacattaagaacagcatcacctggaccagctgtatttccaccaacagcagccataacttgattgaagtatacagcaacagtctgtaaaagaagaccagacatcagtataaaacacacaaaagtacaagccacagaaagtgagaaatgtggagaaaagaggatgatttcttacatgctcattagcagttggaggaagtccaccaacataaacacgcctagcatgtcgagtagcctgttgtgtcatagcttgtggctgaataacaagcggagtgaactgatacaaaaacaagagaaaattaggactgtgtctttataacaaataactgaagtatcatagctcacagggggttcattcctaaagttcaaaacaacataatactcaccggggtttgagtcaaattgaacatgttcggaagcatcccagaaatagcaggggccacaacaggtacctgacctgcaaataccagcaaagaattcatcagaaaaataatcaatgtttttacttgtgatctatcattaacaaaaccatttagaacaacccaactactactgataatctaatataggtcctgtttttcaaaattcaacatagatgaatggatggcatctgcctgcccagtgaggactgaagttaacaattattaaactaacataatgtaatactagctgctattggaagacgaacaggatatcaaaccagattgtttcctcctcgtacaattaagctacagtgtctcccattgcagcagttggacaaagtggcccaagattgctttcctaccgatatgcacacaaaacaaacaaacaccaacaaaaaaagagaaaatcacttagttccaaaccagttatgataaaataaaattaattttctacatgaaatatcaactatataagtacaaaataatgattaccatgccttcaaggcatccagtggtaagacagcagtgtcagaaagagaccagtaaatagtcttttctcgaccctcaggcaaaacaaatatagaaattttgaatatgtacttcattgggaactagagatgttcgtaatttataagtgctagcattgctgaaaataaaaaaaggaccaaaggagttacaaggtcaactagttgaaaaaacttggttgtcactccctccatcccaaaatattggagcaactaattttttttccgaggcttcataattcagggcacgtatgcatgcaattaactagcacctctccctaccctaaaaccatttttttaaaatcatccatcttcaagatctctcatctcattgggtgcatgtattgtatttattggggcgatccaaacaaggaggtgctaataactctttcttggtctttgcattaatgttacttgagccttatgttttgtgatgtagacaagttaatgataaagctacagcaatttgtggtagtttcaagtataaatagataaattcagcagagcaaaataaactctcaaattatattgggtgctaacatacctggggctgctccagcagcaagcgcaggaatggctgcttgtggtccctggtcaaatccactcacgcgcttgctgttttaacaaaagccaaattaataactagaccaaaagaattacataagcaaatagaattaaagccacctaagaaggtacatgacaaagaacaaaatcaagcgcataaatggattacattaagtaaactagtaaagacatatgaatgtaccattgaaaaaaaattgaaaagaaacacagttcactgcatgttttaagagtgtcaatcttttgaagataagaagaaatactaagttactaacattctgaaaattgcatcactgttaagacttaagaggtatcaaaagaacatgtgacttttgtaagctaataagaacaggcaaacttggcccatcatcaacatcaggaaccaatgcatataataagcatacaagggcattcaatcacatacctagatcgagagcgtgagcgagatctagatctgcgatcacgaccctttgaaggggagcgggagcgagatcgatgcctgcggtgaccatctctgtcacggtctcttctcctgcattaataaagtgtaaatcagattcccacaataaaacgtggcatgaagcaaacaaatggcagaggaatcatagcatatccattaacatacggaaaaataacctgtacctttcagaatcatggccccggcgtcgatcacggtcatcagaacgttcacgatcgtggtgttcccttctttcgcttctatcgcggtgctccctgtggcgatcacggtccctgtccttgtcaccacggtcgcggtcccttcggtctctatcacggtctctgtcgcgttccttgtccttgtcccgttctctttccctctctctagactttgaggacctgccatcatgtggctgtgtctcgtgctgaataaaagaacaagagttatcagtcagtcctcttatcttcaaaagagaagattcaattattgtttagccccaataagctgtcaacgaccagaaactactctctaagagtccaaggtgatacaatcagcataaggtgaatgttgaaatttgcacaacaattaaattcaaacagatctaatccgaaaatcgcctaaaaatttcctagttctatgttttatttgaatcgtggtctccagaggaaattaaaacagcacaaagcaattacaatcaacctaacaacctaatagttccatcgatttggagagcataacattgcaagcaaagtaaaccacctaaatccctaaatctcaggcaaccagatgaaatccccttgcacccaacccatgaaacaatcccaaaaccaaaccgccccccatcccaaaacatgggccaaattccccccctacagatccgcgacgcgcgcacctgagaacggccgccgtcggtggcgccatcggagaagccggtgggcttggcggcggcggcgggcggggacccctcgggcgcagggtactcagcgtacgcggaggcgggggccgggtcgccgccgttcccgttgccctcgtagggctgctcctcgtgctccgccatcggcgcgacggagtgggcgggcggcggcggcgggatttctagggttcggtggctcgagcggtggaggcggcgggcgcgaggtgggagagcacgcgaggggaacgggtcggtttatatagagaaaggacactgacgtgtggggcccgggactcgggtgagagccacgtcggtttttggaggcggtggcggtggcggcgtctgcaaccgtcgcgaagtcgtgttttgagtttaagtcggttgaattcgtgctttgttcaagagaaaaaaaaaacatcgggtttcgttttgatttttgcgtttccgcatcagagtatccaatagaagtccagaattcgatgcgtatttgggttcgaatcccacacaaggccacaatttaggccactcggctgcaacgcggcccggtaaaggcctgactcatacggcccatatacataacaatattcacgattatgttcaaatcggtcatgcgagtgttgttgtttccaaacgaattgatgttaaatattcgaacgagatttcaaaccgagatcaaatggtgttcacaacgagtcgtccgacacgatcacttgtggaacagcgcgtccatgtcctccaagcttcgccctcgcgtctccggcagccgcgcgtgcacgaacacgcacgccgccgccgccacgccggcgtagaggaagaagaacccgaccatggtgatcccgccggcgaccgagatgaacgtcatgctcatcacgccgcacgtcagccggttcacgacgatgccgaggctcgcgccctgcgcgcgcagccgcagcggcaacacctccgcggtgtacgccgccgtcatcggcccgagccccgccgagaacgccgcgacgaacgccaccactgacgccacgcacgccgcggcgctcgccgcggacggcggcgcgacgcggagcgtgagggcgagcgaggtcagggtgacggccatgccgcccgtgctggccagcaggagcgggcggcagccgaggcggtcggagaagagcgtggcgacgaggatggagcacgtcttggcgaccccgacggcgacggtggcgcccaggacggaggtgttcgacgccatgccggccttcttgaacaccaccgggctgtagagcacgaccacgttgacgcccgacgcttgctggaagaactgtaggccgaccacgcacgtgaggatccggcggaccatcgccgtcggccgcaagagcagctcccgccacacgccgccgccatccgcctgcggtggcgcctcggcggcgtgcttgatctcctcgaggcggagctcggcctcctcgacggagtcggaggtgcgcacgagcaccgcgcgcgcgtcggcgtggcgaccgcgcatggcgagccagcgcggcgactccggcatggcgagcacgcccgcggcgaggagcactggagggaccgcgccgacgccgaacatgacgcgccagccgaggtgcacgcgggcaggccggacagggcgtagttcgacacgtagccgagcaggatcccaacgttgacgaacatctcgaacagcgtggacacgacgccgcgggcggacgccggcgaaatctcggcgttgtaaacgggcgcgacgacgagggagaacccgacgccgacgctggtgacgaagcgcgccgccatgagtgcggcgtaggtggcgccgagcgacatggcgagtgcgccggccatgaggaacgcgttcgccagcacgagcgtgccgcggcggccgagaacatcagccgcccagccggcggcgaggatagacacgagcatgaacacgttcatcgaacccgtcagcacctcgatctcggcgtctctcagcgccatgtcctcccggacgaacagctgcccgccgctcatcagcgcgagatctgcaagcacacaacacgaactacctccatggatgtgttgccaagaagctctaaccattgccaagaacatcgatgagtgcacgtactgtagcccatgaggatggtggtcatggaggcgagggtggcgcagccgaaggcgtacatgttgcggcggcgtcggggcttgtcgtcgttgtcgccggacgatgcgaggagcgtagcggcggcggcggcgccgtcgtgcgccatggcttgcttaaggtttcatactggagcctagctagcatggggtttaagtcttggactaaccactcagagcaagttgtaggtgtgtcggattaaattgatttcacatttacttcccataggtcatgttgcaactgtgtcgaatgcaggtgatatatgatttttttttattttttagactttttatttttaattttattaatagaccattctaaaaagtatttacagatgtaaacctggccaaataactctgtcacgccacgcgcagttagcgtggtagcgttatttggccacgccagcctcttgcgtggccaaaagatttagatttcgaaaatactttttgaatgatctattaataaaaataaaaaagactaaaaaaaattcgtgatatatactccctccgtccctaaaaaaacaaaactaagaccagatacgatatattttactacaacgaatatcgataaattctttatccagatttatagtattaaagtatgtttcacatcctattctagatttattttttataagatggagcaagtacaaaggtgcatatgtaacatgacatgtgcaaaggtgcatctaaccgtacataaataatcatgtcatataaaatcatatgtgtggtttaatttagcaaattttgccccttatctaacatgtagtggtaaaatagaagtgtcatgcatatccacagtcaagggttagaattcgccacattgcataagaagaggtcacctcaatgctacccgtgatcataaacatagatacccttagttttacaggctttaaaatggggatcctatgactgaagatggtctagtataacctcaaaattagatagtgtattaattaggcgcatcgacatgggcggaccatttttagaaacaataataagatgtgtatcttactactacatctttggtaccacattaaatttgagaatgtttattgtgtgtgttgtttttgcacacataaactccggtggacacacgaataaaaaagaagaagaaaaactacagacatagataattaatagtactccctccgtcctaaaaaaaaaggcaaaccctagatttacgtgtccaactttgtctgtccgtcttatatgaaatttttttataattcgtatttttattgtggttagatgataaaacatgattaatactttgtgcgtgacttgtcttttttttttcttaattttttcaaataagacggacggtcaaaaattgggtacggaaaccgtttgtcctttttttgggacggagggagtattgtttagtaacagtggctgtactaactgtgtcatacgtacatgtctatatatgagtcagagaattaatcatgtctccaaagttgcctacaacagcaaacaacaataaatattaaatatagtagtagatgaacagagatgcatacatatgctgcaacagatcgtccacattgtatttggctattcgcatattgcaagcatgtaaaatagcagaatataaaacagctgtaaacatatatcgagaagataaaagactagatatatgaacagtgggctacagatttatagtcagctgcagctagcacgaactacaagatacaatgtgcgtatgatatgtggaaccaagtatcaataatgcagtatatatttttaggtaactattgtatctatgtggaaccaagacgatgagcatgattgatgagccgtcagactcttgtatctccgatccctgaggttgaggcgtataagagttaataagggcatgttagttggtgaaatgaaaatttttgggtgtcacatcggacgtttgaccagatgtcggaaggggttttcggacacgaatgaaaaaactaatttcataactcgcctggaaaccgcgagacgaatcttttgagcctaattaagccgtcattaacacatgtaggttactgtagcacttatggctaatcatgaactaattaggctcaaaagatttgtctcgcgatttacatgcaaactgtgcaattagtttatctttttatctatatttaatgctccatacatgtgtgaaagattagatgtgatgtttttgcgaaaagtgtttggacacataagctgggtccaagcaggaacatcggtggttggttcccagcaatattagctaggagtcctgtttaaatcctaccctaaaaatttttaccttatcaaatcgaacgtttgaacacatacatgaaatattaaatataggctaaaaacaaaactaattacacagattgcgactaatttgcgagatgaatcttttaatcctaattgcttcatgatctaataatgtggtgctacaataaatatttgctaatgatggattaattaggcttaataaattcatctcgcagtttacatgcggattctgtaatttgttttgttattagactacgtttaatactttaaatgcgtgtccgtatatccgatgtgacacgccaaaactttacacccgtggatctaaacaccccctaacttttgttttcgtttccaaagatttggtgtatttgatgagtgactaggctttgtttgttcgttcatcagctcatgatcacaattaatcattttccattcttccatatctcaaaaaataataagaaaatcagatcatcacaagttattagtatcacctaacacgagttacacgagtcataaaaggacgttctcccacactctggacgaagcctcatttaaccaccgtgctccatgtcaaacctcaaactttacccatctcagtaaaatggttagcccaattattatatacagcagtagatccagaaattttttatagcctagaacacacacacgctagctaataaaatcgtggaggttgcgatagctaaggaaacacgggtttatctagtttagtgtcaaaatcaatcttatcaaaaatttgtcacattttagcgttacaaatatctatagcatgcggtttgtttagtttgtagtcttacccaaatttggtattttttataagagggaattgtcagaaatgacaatttttatagggtgtcaatgagaggagaaatgtttagtttattatcttactaaaactttataatgtaaaatttaataaagtcaaaagtggtgacaaactgaacaaccaaaagtgtgaatattggactatggtggcttgaagaacatcaaatggctggctagggtactctggccctgcaccagccaacgctcttagatgattttagtggtatgctaaaaatgtgaacttgattttggttaattatttccaaatgtgattgctacttctcttttatatggcataattgattttttacatatgtttgacaaaaaaattacgcaaatatgaaaaatatacttaaagtattttttaatgatagaacaaattacaacaaagtaaatggtaattatataattttttaataagataaaacgtcaaacaagtcaacaacattatatattaaaagaggaagagagtaaataggtttattaatatctcatttttcaataactgcgtactagaaaaaatacaacgtaagtaatggatgtaagtaatggatattgttgtggaagtttcagaaattataatgtaatgtaattaaagtgtaactgaatctaatatattatgagaaaacaattgactgtttttcgtggaaaatatgccatagatacagctagtcccataggaagtagctatataatattcgatataatattcgatagtttttaggtgaaaaataaatgtaacagtataattacattacaactactactatataacttgtattctatagtcaaaactactctgttttttggttggctagcaacgtaatctccatacaagtggtttggagcttgactcctacttgcacatggtcgatttgattttttttttcgcttcttgcatgaatctcgaggccattcttgcttggataacaaggcaatggccacatatctaaaagtttggggggcaaaaaaatattttggttcctaaatgttactccctcaagttagttttaaataaggttgaggacaaccatatatagatttatctttaaagcactataataaaaaatatttatttattaattatatattataataaaaaacatagtcaaagatatattttgaaaactgtgtcactgtctagaacgtaaagaattatggaaccggagggagtagaacagtatgggcaaactcttttaatccctcgagaggacatcctctcgttctttacatgtaatccaaataattatgaaaaaaattcaaaaaaatgacaatatagattagtatgtgataccactccataaacatacaagtttaaatttaacttctataagttaaaaaaaaacaaatatgactgtgagagtcattcttcagagtcttctgctacctaaaagcaaagctaatttttttttagataataaaagcaaagctaatacatcattcttcagagtcttctgctacctggatttttcttttatttgctgaaataatgtttgcttcatatgagacctcaaatcatttggagacaaattgagttttgtctaaaaaaattttggtgcaaaaagcaagagctcaatcacttggagaagaccatgtccatgttctccaagcttctccccctcgtctccggcagccacacgtagacgaacacgcacgccgccgccgccacgccggcgtagaggaagaagcacccggccatggtgatcccgtcggcgagcgatatgaacgtcatggtcaccgcgccgcatgccagccggttcaccgccacgccgagccccgtgccctgcgcgcgcagccgcagcggcatcacctccgccgtgtacgtcgccgtcgtcggcccgagcccgacggagaacgccgccacgaacgccaccacggacgccacgcacgccgcggagctcgccgtggacggcggcgacgcgacgcggagcgtgagggcgagcgaggtcagggtgacggccatgccgcccgtgctggcgagcaggagcgggcggcggccgaggcggtcggagaggagcgtggcgacgaggatgaagcacgtcttgacgacgccgatggcgatggtggcgcccaggacggaggtgttcgacgccatgcctgccttcttgaacaccagcgggctgtacagcacgatggcgtcgatgccggacgcttgctggaagaactgtaacccgatgacggtggcgaggatgcgccggaccatggccgacggccggaagagcagctcccgccacacgccgccgcccgcatcgtgcggctccgcgacggcgtgcttgatctcctcgaggcggaggtcggcctcctcggcggagtcggaggtgcgtgcgagcacgacgcgcgcgtcggcgtggcgaccgcgcatggcgagccagcgcggcgactccggcatggcgagcacggccgcggcgaggaacacgggcgggaccgctccgatggcgaacatgacgcgccagccgaggtgcaccggcaggccggcgaaggcgtagttcgacacgtagctgagcaggatgccgacgttgatgaacatctgcacgaggcgagagcgagatcgatcaatggaggcctaacaaggtgttcgacactggaaggacgacgacagattctacatggccagatcgacggacgcatatatacgtacgtcaagcaacgaggtcaagacgccgcgagtcgacgccggcgagatctcggcgttgtacacgggcgcgacgacgcgggcgaacccgacgccgacgctggtcacgaaccgcgccgccatgagcgcggcgtaggtggcgccgagcgacatggcgagcgcgccggccatgaggaacgcgttcgccagcacgatcgtgccgcggcggcccagcgtgtccgccgcccagccggcggcgaggatggacgccagcatgaacacgttcatggacccggcgagcacctcgatctcggcgtcgctcagccccatgtcctcccggacgaacagctgcgcgccgctcatcagcgcgagatctgcaagcacacacaacacgatcgaactacctccatggatgtgttgccaagaactcgatgagtgcacgtactgtagcccatgaggatggtggtcatggaggcgagcgtggcgcagccgaaggcgaacatgttgcggcggcgccggggctcgtcgtcgttgtcgccggacggcgtgaggagcggcgcggcggcgtcgccgtcgctcgccatggcgaggtttggtttgggcgagagctaagctgtgtgtgtggtgtgaagcgaatgggattaaaagcagggcgacatactgacaacagtgacctacatcatcatggtgggcaacctccgattattggaaagtaatttccattcacttttactgccgtagactggaaggcagagatatgaatcacattatgatatgatgcagaagtatatctctactattataaaagttgaagatatttttactggtattttggtacgttatccgtgtataagttggtttttaaattcgttcacttttagaaacacaattctgtatttgagtcagtttttaagttcgttcacttttttaaatacaaaaggagaatcgtataagaaatctcattaaaaaaactcgcattctaacttgggacgatcgaattcctaattgcagcttacgattttctaacagatatacatctaagcgaatttaacacagtaaatttcattctagctaaaccatatgacaataataagattaaaatagcattcgcctgttacagggcacggtcatttttctagtacatataaaatcaaagatttataggtcgctttgattttttaaaagtcaaacaactttaactttagttaagtttatagaaaaatataacaatattttcaacataaacaaagaaactattaaaatatatttaatattagatttaataagactaaaataatgctataaatgttgctattctataaatttaatcaaatttttaagaagtttgacttaaaaaaaataaaaaaacttactacaatataaaacggatgaaataagtgattgtttagcgtgaccatgatgaatccgtaatccaactacagtcctaacggaaacatgatttagcaagctttgctcatatttgaccaaatcaagctataactgtcgtatctcatttccagcacatcattcaataactgagacgaactgacgaagtagttgcaagagagaaatctaaggatcaacgggaggacatgatgattgacaaaaaggatatggtgataatttgcaatggaatcagagagtaaatatgaagtagcaaatataactcaattttcaattatttatcatctaatactccggacaattaatagggtgaaaatttggctggtaagttggtcaatattagtaattaattgacatgatcatctatctattgtatagtaaagtccattaaactttctacaaacactctcaaaccaccacgtatgatttctacaaacgcttctaaatcaccaaatgacgctcataagttgctcaaataaattagatgaatttccaataatactaaaatatatatctaaccattgattttacgttaaatacggcggacccactattttcaatcattggatttacatgtaagaccactgcaaaatgttgccaggttgatttataagttataatgatgaaaatatgtaatatatctactgatttgaaaccagttcataacaatgacagcgcaacttgtcaaatgaacaggtaggatgtacagaaagctaagcaaactgtgaaggaccatactcctatgatcccccaatctcactataacttatcaactgatcttttattgttacactttattgaattgtatatgttgtattgttggacaagtacaatagttagaattaggcacttctcaccaaaggcgagaaaggaccacttgctcaaaggtacacatctttccatggcacagtttctacctttgggagcaagaatgaaatcaaaatttcaactctacttaactcctattacaaatcagttgcgagattctgcaaatttagacatcagaagctacctgttacagattccaaaacccgcactcgaagtcaataagattacaaaatagagtacacatcagacacacagctatagggctccctgattccacaacaatccgtagaaggctagcagccaacacagaagaaaataaaaacaaaggggaaatcctaaattcctaatgatacatttgagttggagactgggggagcttaggtgtgaggaaggcagatcacatgctgtcagctagcaatgcggtgggaaactcttcctgttaaatggaatcaggaatttcaatccatgagaaccattagtgtgtccagcttaatggttgaccaaaaacaatcttaattaaccatcacgaagttgtgtaaaataaaatatttttactccatttaccaaattaaaagcagcaatggcggaaacatcaacgttcaatcagttcatccatctttgatggttaaatatatcttccacttgagagcaacaagttatttggttaataaaatccaaaaatgtaatctgttcgacaaaaagaaaaacgcagacatgtttatgacacttccattttccagtaatcttattttccaaggacattttctgataatcttgaaaaatctagttcctctatattttctaaaaatcaactggattcgttgtgacccctcttagattaagttttttttggacagatagtacttacattgttaagtgagtacctgtctaatcaatcatcacaggtacatgtcgctgaatcataaaataattaatcatgcctctaaagttatctacaataacaacaataatgaatatcattagggatgcatggatgctcatgctccaaatgatccacataacggatgtccaaagtgagactattagcagcctggcccatcagtgaggcatgtagagttaaaagctgttaactcagttgttgggttttcccttctatattggcgtaagtaattgtttttattttgagaattttggtgtcaactgatggcctgaatgcctgatgggtggctaacctttgtttgtctatgagctcatgacaagtgaatcttatcaccaaacagtagtactattcgtacttgtgccggcaaagattaatgttctgctaatgctgtgtcttttgttcttgtaggagtaggaatataggatccaaaagcaccgaaggcaggtcaacagtacaatcccaaatctactcaatcaatacttcaatagtgataagaccaatgaaagaattttcttaaagaaaaaatttgtgatatatatactaattaataataattcaagctagaagtacatgagtgctaaacacttatgattcttttgaaaggcatgcattaattttacatgattttcacataaacttttaatttttttaaaaagtatgacttctacatgaactggaaaattcttccgtgttcgatattagatttgcataactattcttaaataaacattttttcgattacacggcacacgcatatgcacacactcatacacacaacaccatactcatcacccgcaaatacgccccctaacacactcaaataaatatcttctcttgttacatctggttatgcaaaaaaattggccagctagccatgttcaagcaaaaggtgagcttcaactagcacagtctaaatgtcactccaaaattaggcatttgagaatacttctctccatctctatcatcaactccatgattgtcagattagcccggagttgtctttaccctaagatccaggtgcttggggcgaagatggttggagagggttaggtcaaggaagtggttttagagggaggacggaggagtaggcttgttgtggccccttggccacaaaagaggaggatgaccatgggccagcattagctcagggaaggagacaaatcgacaaactcacgacatcgaataattgttaagattttgtgaaattattacgtgaccaacaaatagatgggcattttatagtgaactacgaaggttgcccatgtatttacgcatgcatataggttggttgtgtttgagactcttatagatgcggaatgctaacctatatagttggccaaaaggcccatagctcgacggtctggcccacagcatggagatttggcccgaccaaggcacagcaaggcctgactgttgtcggtcccgtgtcggcccggcccgaccaataggttgtgcctgggcctcttcttcggtacaacgggtcagttcggccgaacaatcagagagggaaaagagactttttccaaccatatagatacgacctaaataagtaagggactcaaaatggacttatctaggaatataagacatggcccaaagaaatgagagaggcaaaatagacttatttcaaggtgagcacaatggacagcccaataagacacgggtcgtgcctgggtcgcaggtacaacctgtgagctagcccgaaacgacacgaaaagtatgttgggccatgccatgctctagttgtgcccaggccaggtcgtgtcaggcggcccatttgtccatctatacgaagtaactgataacacctccaatgcattttggttgctaaatgttacatcgtcccttcttggatggagaaaatcaaagttaagaataaataaattcttcatactcttccataaaaaatgtagtaatgaaatagtacgttgatcacttggcgaagagcacgtccatgtcctccaagctccgccccctcgtctccggcagccgcacgtacacgaacacgcacgccaccgccgccacgccggcgtagaggaagaagcacccggccatggtgatcccgccggcgagcgagatgaaagtcatgctcaccacgccgcacgtcagccggttcacggccatgccgaggctcgcgccctgcgcgcgcagccgcagcggcatgatctcggcggtgtacgtcgccgtcatcggcccgaacccgacggagaacgccgccacgaacgccatcacggacgccacgcacgccgcggcgctcgccgtggacggcgacgcgacgcggagggcgagggcgagcgaggtgagggtgacggccacgccgccggtgctggcgagcaggagcgggcggcggccgaggcggtcggagaggagcgtggcgacgaggatgaagcacgtcttgacgacgccgacggcgaccgtggcgcccaggacggaggtgttcgacgccatgcctgccttcttgaacaccagcgggctgtacagcacgatggcgtcgatgccggacgcttgctggaagaagtggaggccgacaacgcaggtgacgatccgccggaccatcgccgacggccgcaggaggagctcccgccacacgccgacgccggcggactcctgcggcgcctcgacggctcgcttgatctcctcgaggcggagctcggcctcctcgacggagtcggaggtgcgcacgagcaccgcgcgcgcgtcggcgtggcgaccgcgcatggcgagccagcgcggcgactccggcatggcgagcacgcccgcggcgaggaacaccggcgggagcacgccgatgccgtacatgacgcgccacccgacgtgcaccggcaatccggccaacgcgtagttcgacacgtagctcagcaagatcccgacgttgacgaacatctgacacacgcaagcggagcatcgatcagagcgacccaaatcaaacactactagagctatgatgcgagcgttacatcgagcagcgaggagaggacgccgcgggcggaggccggcgagatctcggcgttgtacacgggcgcgacgacgagggagaagccgacgccgacgctggtgacgaagcgcgcggccatgagcgcggcgtaggtggcgccgagcgacatggcgagcgcgccggccatgaggtacgcgttcgccagcacgagcgtgccgcggcggccgagcacgtcggccgcccagccggcggcgaggatggacacgagcatgaacacgttcatcgacccggcgagcacctcgatctgcgcgtcgctcagccccacgtcctcccggacgaacagctgcgcgccgctcatcagcgcgagatctgcaaagcacacaaaacacgatgagcttgctccattgatgcgtgcgtcgtgctcaagaacttgcacacgtactgtagcccatgaggatggtggtcatggaggcgagggtggcgcagccgaaggcgtacatgttgcggcggggctcgtcgccgggcttggccgccgaggagaggagcggcgccgtggcatcgccggcgtgcgccatggtgaccgtggcttggtttctcggcgaacacggtcgagttgtgacttgggctgtgttcggattccagcgatgggaactaatccctcccgcacggaaacggagcggtctattagcgcgtgattaattaagtattagctaatttttttttcaaaaaatggattaatttgattttttaaagcaactttcgtatataaactttttacaaaaaaacgcatcgtttagtagtttgaaaaacgtgcacacggaaaacgagggagaagtgttgggaacatggggatgcaaacacagccctatagtgtaaattgctggcttttaaaggcttccattgctgggacaaccagtgttttccatttcggtaagcaggaaaatttcggtggcaccgaaatatcgaacgattttttttgaaaatttaacacatttatattgaatttgaataaattattaccaaattcacaaatatttaaaaaaatctaaaaatttcccggggaacaaccagtttgttttgaggtgttttatggtggttaaaattattggaggtatgttgaatataaatatcacctattgattatttaaaatggaggttactcaagtatatgtttctaaggaaagtatttcaattgtatatgcttccttcggtaaaaagtaaaaccgtttttggatttttcaaagtcagattatacagttttggctgcatatagttctttggtataattttttcaaaacaataatagttacaaaagtgtaatgctatggaaactatgtttattgatgctccaagattggtggcaaacctcgcgatgtcgcctgcacaagcaagacaggaagaggtttcgactcccttgcactcatgttgcctagcacttatgaaaataaaggaacacccgcgtcttcgacaatgttctatcataggtgccaacagtatggtggagtgaattgggcaagaaggaaggcaatgggttgagaccatggccaatcctatcgggttgttattaggcacatagcttggcttagtttcacatctctcatcttccccttaggagtcacacctggtttagcaagttcttgcgtgtcatatctctcaccttcccctaagacttttgcgtgttggcgatttttctttttgccattttcatataccaaaatcctatttatgctcaaagttaactcgtgtaattgcacataatttaaaacaacttgttttttgggatataaaacaacttgttcttttggctaaagagggtattatttcattacataggcaaagcccaagcagttttcaaggtctaaaaaaaaacattagaaccttttattttctgaggccacatgtacatcaatactatctataattcttatcttccactcaaccaaaaaaaaattattccaaaattctcatgttttatgtaaagttgaaggaaatcacccatccaaacttaccggaagaaaacgtttgaaccggcgatctctacacgagcaaaaagtatctcagatcagagatgcaggtagatcgattccatgatgctaacagatccacacggacaatgtcgaggtgagatatgtctgtttgcaaggcgacgaccatgaaggccaatcacttggttgtcttgtcgatcacttgttagtgagattatcatcagatgtgtactaaaccagtggttagcttttgtttttgtcctctgctttttttctcgtgtaatgacaattggttatcacctaacacgagtgctgcagattaaagatgctacctgctgcatgttcatctgttgttcatgtaggacgatccaagcatagaagttggatggtacaagtcctggttttttaaagaccaacaatggatgtgtttagatccaaaatttggatccaaacttcagtccttttccatcacatcaacctatcatatacatacaacttttcactcacatcatcttcaatttcaaccaaaatctaaactttgaatccctatataatggcatcccataagccatcctctagttagccactgtcagattcaatagattcatttttttttacatgtctcactaacctttctcactcacacactctctctctccccctccaaaagccacaattaatcctttgttccaaatggtcatatatgaaaattttcttatataatttgaatcttacaaatttcatagtacttattaggatcgtaccgatggtcctacctaaaaaacctacaaaatggccttggcctatctggttaactaaaataaacgtgtgtgcaatcgaacaggaataaaaatcaattgaaccggtttttaattaaactggattggttggaccagcaaaaaccagttgatgggatgagctgaggcccaattcaattatggaagctgcgggctcaacaaaaatcccatggaaaagaaagtaaggtggttgatagggattcgggctttgtttgttaacatgaaagaagaggaagctgactagttgggttggacttggaagcaaacatttattttaggctccattctaatgcgcagatttggctacgttgagctgaattggtagcagtctaaataatactccctctgtcagaaaaaaccaatcctgggttgatctagacataatgtacgtccaaatttaaacctaggattgaatttttttttggaatggatggagtagatagcagcacattaacttgccactttagttggtagctgtgtgaatagtgcattggatggtaacatcatattaacccgccactttagaacggggcctaagtagtctaatattatatgagcgaaccacagaaacaaacattttgatcaaagtcaaactactataagattgattaagattataggcaaatataatataatatttataataccaaattaattttattaaatctataattaaatatatttttataatatatttgtgtctggcttgtttggctgaggcttgggccgaagcttttcagccaaacagagtgagacccgtaaggaagttggatcatcagtgaaggctaattatgtgaactctctagtggccatgcacaaaaaataaaaatcccaatactaacaaacttctaacttttccatcacatcgttccaatttcaaccaaacttctaattttagtgtgaactaaacacacaaatagaagatcccttgtatgtccagccaattaactaattaagccaatcaatgcaatggatttgcctgaattgaaaaaggcttatttggctgatcagcctaagagcacccgcaatggtaaagtaaggtgttctctataaaacatgtacatctcaacaatagactagattaatattaaaccacctcaatagtatgtctacatgggtatctatagctctctcatacattgcctcgtttttctctatagactatctctaagttagtagatagctttgctctctctcttcatttaatatattccaagtaggaaaatatgctgacatggatctcttgtagagagcttatagataactattgtgggtgccctaaggatatactagcttgctgatgaggccctattactactttttttttacaaattaaatttaaagcaatttaactttaattaaagtttaaataacttataatctgaagagtaatggaaggagggagtaaatacgcacactgtcgcgtcgcacagcatgttggttgcttgcttgctactagtagctgccgctcactttagccaatcgcactcgcgcctgaattccagcgcctcatcaatgccaccggcgtagaacgcgaggtttgcatttgcaccgagatgaaaaaaaaaaaacgatcaatctccatccccatatctctcctataaatctcgccggccgtcctcacatcagcgcaagaactgcactgtgttcttcttcaccatcagcaaaggtaatgcatggattataacactacaagtttccaacttctcatcccaatctgaccatcaaatcaaatcaaatcaatggcaaacacatacatgcatatatctaactatccatttttgttttcagccaccaacgaataacaacaatggatgtcctcctcctgccgccgttgccggcgccggagacgacggcgccggcggggagggactggtcggagctgccggcggacgtgctgtcggtggtgttcgccaaggtgggcgccgtcgaggtcctcgccggcgcgggcctcgcgtgccgctcgtggctcgacgcggcgagggtgcccgagctgtggcgagccgtgaacatgctgcgcggcgcggtccggtgcctccacctcgggcaggacagggacctgatgtgcgccatggcgaaggtcgccgtcgaccgctccggcggccggctcgaggtgttcaagggggaggattttgttagcgatgagctgctcgagtatattggagacaggtaagtattttttttaattttatagaagcctatataactatataagtacattactcacttcgtcccaaaatattacaaccttatacttgatgtgatataatgttgctatattttgggacggatggagtataatgtatcggtagcatatactgttaaaaaaaagaacactatatgctaatacataataattttacagttttaaattataaaccatttaagtgggaagataaattaatttatatcccgaatcactcgtactagccgtatataggagtaatatactagcaccgtgaagtgtttttttctttaaaaaaaaagttttggcctctgcgcgcgctagggtttgcaatttcagttgccaccgaaaatttggtggttgccggaaatttaaaattttcgtgatttttgggtttttcggattaagattatttaaaatttttaacatattttgactgaatatgaataaattttgaccaaatttacacatttgaaaaaacccgaaaatttcggggagatttgtgttagtcggtggaggccgaaatttcaaagcatgagcctgcgccaatcgatcagcttataattgaaccactcacaacaggcgagatatatatcgatgctaataaaaaaatgcttttaatccaatatacttatatagttcatccccactaagtgtagttaatgctatttatctcttctctcatgaagccacgtcaccccaattatttctagccattggatgatagatctatggttcaaattgtctctttttttcttctctcataacaccaagtaattttaatcatttttaggcctcaaaattcataagtatcaatttttttagttttaatattcatacttcatcttatttgtatatattatacaacttaatttcccgcagcggtattcatctaatttacaaacttgcaactttgcaagtacaggtcgccttctctgaaggttatttccgtttggtgctccgacgaaaccaggatgtccacggaaggattcgccgagctgacgaggaagtgccctctcctagaggagatcgtcctcagcagcggcggccatcgccgtcccccgctgccgcggctcgcgctcgcggtggcggagctgcgccacctgcggcggctcactgtccagggcatcggcgtcagcaacgacgagctcacggccatcgtcgatggctgccctcgcctggagcttctcgatgtgtgcagctgctgggatttgtgtgtcgacgacgacgcccagctgcttgccaagtgcgcgaggatcaggacgctcaagctgccgcccagtgaagaggatgattactacgattactactactattataattaaccaagtctacggccgttatgctgatcgatctgttagatgatgactatactactctgattaactatgcgtggtaactacagtcgatcaccttaatttggttgaatcatatcttatttcttctatcagtctactactagtaatgtgatgatcagttcctactactgtagtgtactgcgagtaatgtggtgatcagttaattagttgattgcggtttgaagtagcttagctattactacctccatttcaatttcaggctataagactttatagcattgtccacattcatatagatgctaatgaatctaggcacatatatgtttagattcatatatgaatatgggtaatgctagaaagtcttatgatatgaaatggaggaagtatcttttggtacatatctggttgtgtatatcgtcattgatccttgtttttatcttaagtatgatggtatcacctatatatgagaaactgaatgtatgtatttgtgaactttctggtactcctgaatgctttatgaagatggtcgattggatgaatattccattacttcctgcgtaatttctgtgtccttttgccggccggcctgtctgtttaactgatcggcaggttgcatggatggcttgacatgtaggataatatccctttaattgcaccatatgtagtgccactttgaatcaaaagatttacgtagaaatttcataggatttaaatcctataggaaattttcctatttggccctttgattcaaaggattgaagctttccaaatcctatgaaattcctatggaatggcacattgcatgtggattttggagaaaatttagtaagagctccaacctcttagaaaatttcctttgtctatctctctcatccgattcctatgtttttcctgcgctccaatcaaacgaccattcatttgtttttcctgtgttttgcaatcctatgttttacacttcaatttctgtcagaatcttgtattttttctattcctctgttcttttctaccctgcgattcaaaggggcccgtataggtagcaatgcatggaaatgatttattctcctcattcactctttcaagtttaatctgtggaccgctcctgatccccaagaaatgctacatgtagacattgtttacatattctaatattcagttaggacatgggactcttgaaccataattaaccatgtcaatacatcatcgtaacattgttaatttgtgtactcttgaattatggtaaagacaatgatcttgatattgattacggttaatttcaggtagctagctagtatctttcggtactaattagctgtaactcttgagtaaaggctgaaatgtttcgttctattattaaaaaaaaataagtatctttcggtatgtttcgttctattatctttcggtattgtcattgttcatggtgaactgagtgcacttctgagttttgagtctacattcaagaaagtacttctgagtctaccatcatggagattattacattaatatttccaagcttaacatttccattttgtccttctactgcctagaaatgatttcttcatctctttcaagttagaactgcggacaatcgtagcaacacaaccaataataccacaaataaagccatctttatttttttaatgactcacataagacagtgcgaaattctattgatagagggagaaaaaattgaaaggtcgtaactaggaaaaaaaatatatcattacccacacatcgacagcgccaacgcatagaactaggaaaaggctagcaccggaccggccgctaggccaagaaagaaacacggccgagatcgcccaaataaagccatcttcacttggtgaagagcacgtccatgtcctccaagctccggcccctcgtctccggcagccgcacgtacacgaacacccacgccgccaccgccgcgccagcgtacacgaagaagcacccggccatggtgatgccgccggcgaccgagatgaacgtcatgctcagcacgccgcacgtcacccggttcaccgccacgccgacgcccgcgccctgcgcccgcagccacagcggcatgatctcgctgccgtacgacggcgccagcggcccgagccccaccgagaacgccgccacgtacgccgccgccgacgccacgcccgccgccgcgcgcgccggggacggcgcgccggcgccgacgcagagcgtcagcgccagcgaggccagcgccacggccatccccgccgcgctccacagcagcagcgggcggcgcccgacgcggtcggagaggagcgtgacgacaaggatggagcacgtcttgacgacgcccacggcgacggtggcggccagcacggaggtgttcga

SEQ ID NO: 23301 - DNA, 15147 bp, Oryza sativa
cggcgtacaccggcgccacgacgacggcgaacccgacgccgacgctggtgacgaagcgcgccgccatgagcgccgcgtagctgccgcccagcgacatggcgagcgcgccggccatgagcagcgcgttcgccagcacgagcgtgccgcggcggccggcggcgtccgccaccgtgccggcggcgaggatggacgcgagcatgaacacgttcatcgacccggacagcacctccacctgctcgtcggcgagccccaggtcctcccggatgaacagctcggctccgctcatcagcgcgagatctacaagaaacagcaagacgacatcaacgacggcgacggcatgatcgcgtgccacgacgcgacactcgaagcagcaagctcggagacgtactgtagcccatgaggatggtggtcatggaggcgagcgtggcgcaggcgaacgcgaacgtgttccggcgaggctcgccgccgtgcttcgaggcgaggagcggcgctgccgcgtcgtcgccaccgctcgccatggcgcgtcgcccgccgccgccgatgaggacagaacgatctctgtcgtacgaaattctctacaaaataaaaatcaccaagattaacagcgtataatatgatcgaaacaactactaagaagcagatgttgttcttgttccaatcttcaggtggcagcaggtgatcagaatgaacagctctgaagatggtgacaagcatgcaaagccaagtgagatacgaagtttgcaagattagtggtgagttagtgccttagtggagttgattagtcatgagaatgacagtgattatcagtgagggtagcatgattagtagctttctttttgtcagttagctacctggtgagaatggcagtgattattaccacctaacatgagggtccttcctgacaaggactccacaagtgactttgttgcttcacttgttcatgctgatgaagtttcaacctcttgtcaaatgtttctttgttgatctgaaatatgtggagtgacaaattcacaaatcacattgtaagactagtaattctgtttacagttcttcagacattagctgaaattcagtatttcatgacagttaatacatatattatgtgaaaatctcttgaaaataagatatatctaatccatgcctgattatgtgaaataaaaagaactgcggagaagtaaaaagtgtatagtgttaaaagcaagaatactctgaagaaactgaacatgatactcacaaaggtttagagcaagtaaactgcagtgttagatctgttggttggttcttatccaaactaaataatattaaccatagcatagagttcaaggtgaaacgatcaaatcactctctttgatataatagtgcctagtgctgacggtgcttgcttatggttatcttttgtttgtctgtcaattaagctgatgagaatggcagtgaatcaacatacttctttgcatacaatttgctcgcatgaagataacaagatgaggtctgcatgtccagcaattcataattccagaccgacaaaattcacaagcacaagcagggaccttttccaacagcagatgttaactggagatgaacggtataatattatactaatccattcaacattgtaagacaggtaattctgttacattgtacttcaactcgatgcttcagaaatgtaaatgcatacaaaacactgacaacaccaaacattttagctgccgctgccacttgcattggatgcaatgtatcacaaatctcttgaatcagctctgtttttaggccatcccgccgctagttgctgtcctgattatctgaaacaaagctgcagatgcacaaaaatgtatggtgttaaaagcgcaataatagcagaagaaacatagcaaggtggcctagagaacatccgaactgtaagttccatatagataggcaagaaagttgcatggctacacaacagaagatcaaaacatgacctacttgcatgcactgaagagctagatttgttggtatagtatacaacagagataaaaataacctagaatttgagttgtaataactaattaagaattcaccaaatcactcataaaacacgcacaatagcagtcttaaatttctagtgacatagccagctctatttcattaggttatcatgaatttgtagcagagtgacactcagcattttaattcctctagtatcaattcaaaacctaagagtgctttgtcatgaagacttaaagctaatgtgatggaattcatttgtcattatcttttgaaagcaaaagaagagacaataataagctatgcatcagcgcattctaaagtaacacagcacaagtgtcagtgaaataaaatcaacagaggataaagataaggttggaaggcatacatgatccaatgaccacaaatatgaagaatccaagcacaagaggtccaactggatagtcgttccccttcttcacagtagtttcaggcactgaacccctcttggtgatattcttctggaactttgcagtcttcctgtcagcaaggcgccttgaagtagtctggtcgtgcaaaacaacccaaccattcagcatacacaaatattcatactcagttttctaactactttacatctgccaggtgtaaaataaatggcagatccatgtactaacaagttggagaccaactcatggtccatcaaagaaagagaagatcacttttttatagaatttataagtagttaatggaccttactatgccaagtcataatccagaaaagtgcaaaatctgtatcacatcatgctctaactgaaccaaatgctgctcagctaccagtttagatattactattcattactttaaacatcaaatattcactattcttcctatatccgatttatgcctaaaagttgtaaaattaaaataatggaaaccagaacattggttgcaatgcagcttagtgcaaaaaaaaaggtagacataaaagttggcaaaacttaaccttgacctacacctctcctaaaagcacaacctaaaccatgcaacggcggttcagacaccattcagaatattccacaagaagcactttcaactcccaaatagtgtataaaaacctaccatgaatcagataacaagttgcaactacaggtttttgaaacacggttcctttctagaccaagtcaactctgactcagactgactctttggattattttagttgttaaatgtaaaaaagccatattcaatgggtagatgcctccctactttcccagtgaacattgttaaaaccacaagtcaaacatggatcacccatattttgctaaagaacctatgcaatttacctcgctctacgtaagaggctaagaccaatccttgatgatactaacatgcctaaccatgctcctaatgattaccactccaaactcaagtacgaaagctattctgttatgtaacctaaaaataatttctaactggagaatcatcgatatcgacactagaatacaagaacatagaagcttataaattttaaattttaagtattaattatgtctgtcagaaacaatcagaactaactactgctctatttttcacaaaggaaggatcaattggagaatggaaagaaaatatttgctaatcactactccaatttaagactgattcacaaaaagaaaaaaaaaactgcctatctcgactacaaatctcaacaaattctgtaaccccagcaatcaaacatcaacagaatacccgaaaaaaccaccagatctggcgaaagcaacacatcaaccgcacggatccgcgaaagccagcatctctttgtaccaaaatttttcctcaactcgacgataaaggcgagaccctttcctcacccagatcccgatccgtacccgcgcccttccacccaacaggagagggagctacagtagtacgcctccaagagaagtgttgagggattcaggctcgcttaccatctccgcgggtcgcgtggcctgccgccgccggtgatctcgccggagaaagagagagagagagagagagttgaagcagcagctgttgaggcgtggtgatttgggacaagcagaggggcttttatagaaaaattcgcgcgctctctccctctctcttctcccgcgtgaaccaaccgtgggagggaggtgtggtccgagtccacgaccccgatccctgcaccgggatgatcccatccgtccaaatcccctcgagattcgtgcatacaggcctcgattcatgggcatggtgcactgacgaggtattagattgagctgtcaggttttgacttggcgtgctcttcctcctcctgtgtcttcgtttccacgatgcccccgttgacttgttcacggcgacgactttggcacgccacgccgccgaccagatccacgtcgccgcggcgcgccgggcgcgctcccggcgtcgcgatctgtcgcggtcgagcgatcgaccggccgtgcacgcgcacgccagcgcgcgcacggcgcacccgtgacagcgcccacgggcacgcacccgtgcatgcatccagctcaccttatctcgacatggataaatctctctaatacaacaattgaacaactaactaatgcaatatcagtaaaacagtaaaaaaatactaaaaaaaaacaaggttgggtgtttggctgatcgatgagctgcagtcaaggtttgaaatttcggtcaccgaaatgctcatatctcacccccaaacttttagttttttgcaaatttttgtgaatttggtcagattttattcaaatacattcaaaatcagtcaaaatttttaaaaaaatcgtacgaaaaaaatctgaaatttcggttctatcgcccacatgcagtagaaatcctaatttcgaaacttcaaaccctggctgcagtacatacaggtaaatttggtaaaacactacacagatccacttaccattttaccatggattctgaatgttttttgtgttcacggtgcagagtgcagagagattggttaccattcatgcatggatggatggatggatcgagctagcaatggatctggatcactgatcacacacatgtgaggtgacaaacatgttcgtcggatgatcatttcgtcatcgtcttcgtcatgccgatcaccatgtcatagatctccttcagcatcatcatctgccgcgggtcgtcgccgtcatttctgtctctcccgttctgcgccacgtcgtcgtcgtcgacggcggcggcggtggcgcggccggagctgcgcggcatgctcagggcctcgcgcagcagctcatgcaccttggacaccgcggcggcggactcggacgacggcggcgacggcatgccgctcagcgcgtcgagtatcttgcacagcatcgcgttctgcgtcgtcggcgccgccacgccgccgctgctgctcgccggcggtggcgggacctcctcctgctccgccgccatgggctgcagctgctgctcggcctccttggccttctccacctcgccgtcggtgatggcatcgacagagaggcgaaccttcttgttcgtcattgcagtttcttggacatattcagagagttgattgttgcaggtttcatggggatcagtgttctgctgcacctgtttttcgttttcagtgatctctggagcatcatctagctcaatctctgggaaatatggaaaatgtcagtgtgtaatagctcaaatttaatttaattccatgtcagatatcaatgacagtaagcatatgacacgttagaagataaactttctggaatttcattcaatcatgagaaatagccatcaaacatattgttgttgattccaatgccccacatatttttaatttgtaaaaaattggcttcaaaactgtagctgttctgacaagtaaaacagtatgcataaaactaaactgcagtggacaatcaatcagcttacaattgaagatatgcaattgctttcaattggaaaagttggaaatgtctcctaaaaaaaagttagaaatgaaatcaattacccatcacatcaggataattctatctgattatgtgatgatccttctataaataaagaaaaagtaaagcatagattccgtaacatagtcagtgctaagaaccaaacacaagcactgagtaaatcagcataataataagatgagaagacaaaaattagtacacataccttggagcgcctgaagcagaacttcaggacccatcgattcagcttgaacaaccttcagtctttcgatcagatcagtacatttctcgaacaatttcttccctttcgaatcctcgctaacactgaacacctcctgaacatactcgagctctcgcgccaacgcatccgtgccccagatcttggcacaatgctggaacacattcctgacccaccccagcagctcagatgtcccatggcaggccttgcagaagaacactgtcacatagtgggcaactccatcttcaaccgtaatcacagtcttgatctgctcctcacgaattgcgcagccagcgtgggtccagtgagagcagccgtcacacccaatccagcggcatgtgttgacatcgaaatcgaacccgttgcagaccacacacatgcagaggttgcagaagcctctcctgcagcagcagacatcgcagtcgcactcctcagctgggagaacactctggcaggagatgttcttgcatctctcgtaggcgaagatctccgcgagacggctccgtggcacgctgacattttcgtgcagatatgccgggatccccatcttgagggcaacaaacatctccaactgcacatggtgagccgtcagaagcgttgccgatgtcaggtcaggcctgatttcgacatgcttctgaagacgaacgagttgctctacatggctctgatcatcgatgtcctccatgagcaaccggagcgcgatcttgagttcttccagcagccgctctgtcatggatttcattttgctggcaacaatggcgacgtcgcctttgacaacatcccagacggtcaaatcttcagggatctgagaatgaaaaatgagatgcaaattagaggcgtcatcgatggtgataaactactcatcatctattttcatagcaattgctagagaagaggcaatgtctgtgatctggaactgacattctgtatggcagaattgtgtcctgaatattcagaactcagcaagggttcttggttttccaaggccgaagagcgcggtgtctgaaggcctatggagtcgaccttttgtgaaggtttcttccgacggaattttcgacgggatgagggtgccatcgaaacttaaaaccctactaaacctgcaaggaacagttaactccatgagtcatcagctgcataaaggtcatattataagaagagaaattttatagttcttaaaaaaaagtatctgagctacctaaattttaaactaaatttttttggtacctcaagatactcagtatctagagatatcgaattttacactagaatggtaaaattacccttataagaactgaatcctctaacttagctcatatgttagccacataaccaacaggttcacaatggcccacgcaagagacgtcataggaatctcatcgcaccttataagggtccgatcgcatcccaaaataaacctagatattattgaattactcgagttaaattccacatcaattattccccttcacatgcagcgcgcataaatatttttcacgttgagttaaataaatggcagaatataatttttgaaagccacaaaaaggtccagcatatatgccctgttatcacccaccaaccgttgatcagagagaaaagagagatatatgtgtccatcatgatggaatggaagcatatttattagagcggcatagaatgatagctacaacatatatatagcaaatacaaattgtattaacaggattgctacgtgtcagatgattaatatttttcgtaactcccaatcgatggcatcgttaactttttgtcgttatctatgattctatatctaaggtgtctaagatttcaatttactctctgtcaactattacgtagtccgtccctcgtatgaacctttagagacacataaaggtacgattctatttcaaatagatcaattttacagtatttaagatacttattactttgtggtatcaaatttatgaaatgcagtatctcctgggtttatttttttcaaggatagtaaaatcaccctttcaaataacctcgcacacgcgtgaaatcaaactagtttgcgcataacgcctataattcttagttcacccatatatactagcctactccatagtccgtactagttatgtatatatactacaactcatcgtaaaaatgagatcgatgcacctccatttgttgatttgttgcatcaaaaacaaaaaaaaagtaaaaaaactcatcctcaacgtatacccggcaaccaaccacagatccggcgatgctacggctatatggagctagctagggtttcgatcgtctcgatcagatcgatggcgccccggccggtgtggcaccagctggcaacgacgacgacctcaccgccggcgatcgatcgatcgactgcggcggggatcggacacagcagcaagcagccgtgacgcccgcctagcttcgctgcgacgtacggccggcggcgccgccccgcggcgtgtggcttcgacgtacgtacgcacgtcgtcgccgtgcgccggctggtggtcgatcgatcgaaagctagatcgagctagcctgcggcggcggcggcggtgacgggagggggaagagacgagcggagaggagaggagaggagaggatcacctgagagcggcggcggcggcggcggtcggagcggtcgctctcgatcgctgcgcttggggtttataaacggtcggaagcggaaggctcgggcagatgccttgatggagatgggagtggagtcagtggtggcctaggttaggtggggaggacgggttcacactacacacgtgcacgtttcggggaaacgaatgagtcggctgggcccacccgtcagtctaaatagccgcgatgctgcctactccctccgttaaaaaaaactcaattcctatatttctgtgtttaacgtttgaccatccgtcttattttaaaaaatatataaaaaaaataaacagataaatcatgcataatgcattattcatgttttatcatccaacaataataaaaatactaatcataaaaaaaaattatataagacgaacggtcaaacattggatatggaaatccaagaattaagtctttttgggacggatggagtactttcatctcccccgtcactactgcggctgcacacgctcagttgtagagtacttgctcagttattccctctcctttcccagttcatctctcttctttttatgcgcacatttttcaagctattaaatgatatattttttataaaagttttctatacaaaaattattttagaaattatattaatttatttttaaaaaatagttaatattaaattaatcatatgctaatgagctgttccattttacgtgcaccaaggattagtttccaaccgtgactgccgaacatagcctttaagtcaaacttttttaagttagtttagatttgtaaaaaaatatgctaataatttttaagtacaaaacatatatattatcaaaatatatttagtgttaaatttaatataactattttggtattgtagatgttatttttttctataaacttgatcaaacctaaagactaagaaaaaaagtcaaatgatttgtaacatgaaatagatggagtagttgcatttgcattttcacatacttaaattcattcaaaatcatgccatcacatatatgtacttaaaagttaaatcacaagagatacaactaactaggaaaatctatgtatgtactgatgttgatataccgggaaacacaaagttttggagatgcaaaagggatggtatatatgtttggtatatatgtctagtatcagcattttagggtataaatgaatgaattaattgttataaagttgaaaatagatttaaaataatattttaattaagaaattaacatataaaaagtttttctgttgtaaaaatcgtgccatttttctcttaaaaaagccgtgccatttaagagctttatggacgtgcccgttaatccatctatttctacaaaagaacagggacatccaaacaaacatatatacttcgtcctatgaaaaatagaagcacatttaattttccaaggctctaagggttgggcaatgtaatgctgatcaacttgctgagagtgttgcacttccatacatctaaccgctcatcagctctagatttattcagaatctgacccattttgattaatttgtcatcattttttttcttaacactatacatgcaagctcatcaagcaggggcactgcatgcatgttctgctcagtaatttcctaggaagttaaatttgccactgcatgcatgtctacagctagctgaagaatgaagattatcttagctaggaccacagcttcaatcaagagacacagcacagatcaccaccactcctgcatttcatatatttgctcaggacccctgcaattagggctgtgtttagttcacactaaaattggaagtttggttgaaattggaacgatgtgacggaaaagttggaagtttgtgagtgtagaaaagttttaatgtgatgaaaaagttggaagtttgaagaattattttggaactaaacacggcgtagcttgctagcagcatggcactgagatcttctgcaactgcaagctggagtagactgcatgcttcagagatgaaagcacatagctgatcaggacgtcgagtttatgcatatgactaggtacacatgtaattaatataataaccgtattttgaagggaaaataatgctgttcagctgctatatgcagatgcatgccttgcttactgatctgtttggttgagcaaatggtagtgcatctcaatcattgggggccacaaggttttattccatcaacatccaaccctctcactcattctcaatctcacacttgtgtttcagagtatatgtatggcccattgaaccctacctagctgtatcatatcaacatgttcagtgcccactactccctgccatgtgggacctctctagttgctctgctcctatcaaattaccaagtcatagcaatttgcaaccctcccctgcatgatcatatatattcatgacactctctgtcatgagctaatttatgttgcattgcataattgcatttgcacttgcagtagtagtgatctagtactcctagctgtactctgggaaaaatagcatggtcccatttgccttcccttcttttattaaggggattaattttagatttttaattcatcatctgtttgaaaactaactaattatattttcgcttatgggggtgcccaggtaccgaagaaaaggtttatttgggaccaatgctctatgttaattaatttggcgatgttgaaatgataaagtttttataataaaaaatggctaatcctatacatgttatcttaatgtctaccggttggttctatacttagtgtttgatgctatcacaggagaagcggaatactatgtacagtggtgctacactgttgaaattggtagctaagagtcttttgtaccattttggatggaatagcacctatagagcttttaattctggtaatcatctttttagaggagttgggaacttgtcccatcactcttttttttcctttcattttcaattctaaaacacattggttgtgtgcttgtaggcagaagccagatatgtaaaccattaccattattaaaaaaactaattacaaggtgataagcatatgaattgcatggacttatattgaattgctctgatccctgtcttccttatgtactgcagatcacagtttctctttctttttttttctttctcttttgaaagaaatactgcagcagggaatagtggacatatagatgaagcccatgtcgttgataagtgagcccagtaaaggcccagcataaccattccatccgtttatccatcttaattttctagagttcgatttaattaaatctgtatttcattttgtttctctggttacgtttttatggctgccaacgtttggtgatactttgctagcaaggttggttaatcagcttattagaaagcaaatgccgtaggaccacttactagcacttgttcttctcttatatataatgagcgaaatgcatatcgaaaattcagatgcgacattgtaaaaataataattatcttgcaagcacatctcatgtaattctcctgtcactattacttatatttgagaatgtacaattgtcatactactcttattctgtaggcgcgatttctttttgctgtgtcacagctatgttagtattttatatttattaattatctatatcagatgcaaatatattaaccaatttaatgaaatgttatctcactgtgtgattatgcttgaaaactgagcaaaaatgattatcaagaagtttaagttgctaaaagggtcagaataacacttcttctgctgtgttgtactatttggtgctgagccacatgaatcagtcttaactcttaagtcttcaaaagattaaaaaaaaaaaaatgagcctctcaatttgcggctggaaataagagggctagctgcctctggcatgagcacaaccaaaactaacaaactagccagagatcaaagtctaattagactcatccaaagtcaactcatgcaaacttctaactagcgataggacagctagctaagtatctgaattgatcaataatacacctagtacaagtatacatgtgggtacacttaaaaattatctaacacatacatatatttgctagacatttaatttcttccaaaaaaaatgttagacaaaaattcagaagtcaaactagcaagtaacatgtgtgagaataattcataacaaatttcaactcgatcctattctgttctaatataatataggcacatacatatatacaatcatatatccctctttgtatggggtttatggaaaaggagaaaagtaattctaaaagtttcatcatggacttgtatttttcagctcatggtcattttgcagacttagttttttttttttttggtatgcagatattgtagcatcttcttttagcaatatatgtttactccatgcttggtgctctctagatcatctgtagcaacttttctacacatcaaaagccctttatacagtgtgagcataaacttctcaaagaagctgttgaaaagcacaccccatgcagaggcatgagtgtctcctttttgcccctgttggcctccaataagaaatccatcaaggtccaaagtacaaaaaaaattaacggcttacgcttctaggcaattctcatgaagtagtggctctaattaatcaggttttatgtatacaaatctcatgtcacaatcataaagaataggtagctaattgcctagtcttagcttaggatacggatggcgtcaaataaccgagaccttaattagcatatatgtcagtgactacatcaagatagacctggaaaagggagatatatcttggaatggagaaacaccccaatatagagttaatacaaaatataatatactattcatatttgtagggagataatcttatccattcccattatataaacaagtttaaccttctagctagttgttgataattatccccaataacattacaaatcaaataccaaaaaaatacaaatttttttaagagtacataagcaaaaaaaaaaaattctactcactccttctaaaaaaatacaacaatttatagagtttaaaatttatcccaaatataacaacctagtacttataaatttgatttttaccattaaattaactttccatactacccctattatcttttatctttattatagtcctaactagtctagacctatatcttactcactctaagaagacagatatatttgcaaacaaaaataatttgagtaaaacttttatatatgtgttcttacgatctaaaagcaacggctaaaaataaactacgatgaaaaaaaaccttaaaatcaacttcaaatttaaggttgaaaatttaaattttagccgataagtataagcataagcgaaaagatgaggccatatattttgacccctctccttaattaatacctactcgaaggctaaaacttgcatatgcatgatacatatatagaaatttgcttgtacctagataaattgtaccagtaatttaaaaagtaatttacccatcattccctccaagaaaatgacgtgtgatcttaacataaacaccctactaatagctatgggagatgtatcattaacctccacatggtgatgttgtcatgccaaattgaaagtgccgaaaatgcccatgagttgtatccaacgtttcaactctatttgcacttgaacccataaagaaaacaacaagaagaaaataccaaagttgcatactattccacactgaagatctcatcagagatccacatctacccgtaaaaaaaaaaaccatatgcacatctagtatctacagcttggtcgttaggatgagatggtactgaaaatagtgaaaccccaagaagaaacggcagtacaaattaacagtacatgaatgaattacatgatgaaatgtgtgtaaaaaataatataaaacagaaagaaaaatgggctcaaaataaacatggtttttcagttgatgaaatgaagactaaaatataagacgatatagtaaattgatattttaatatgtatatctttcttttggattgttttcatcttgaatttttttctctaagggcgtggcacaattttttttgcaaaacatcaaatatgttgtaaagatataaatacatagatcttctgctagctgtatggttattcttaagaaattttagatggtccttttcatttacatgttagtcttagcgtctcatgcaacaatctagggtggaagaatggagattgacaatatgccaatccatagtccatacaaattggtggaaagctatatatatactctctctatccaaaagtgttaagcatattccatttttttagtttttctaaatgaggatggtcatatttgtaatctccatgtgctaaattaaattgttgactggaatccaaatagccatcttaataatcattagttgcatgcatgcatatatt

SEQ ID NO: 23302 - DNA, 1288 bp, Oryza sativa
atttgtcgatgagatttgatagtatatttgtaccatgaattacaagactgactttgcgtagaccggttcactttaatagcacccaaagttcaccccgttcccatttttaacacttttgtcaattctcaatcgttttccgtccgccttggtcgctattgacagccacgtacgcgatatgacgtttttacccctcacaagtacaagtagaatgcatggcaatgaaagacgaatgtatctctattatgccatctaccattctcgtgactaactttctgccactggtcctcccctatactcatggttctcgtgtatgggctgaaacacgcgtgaagatgatttgaagcgaataaatgtatgtaattgattttgcatataaaaataattgattaaaacgttaccagtgcacatcgcgtagaagccaaatatatggtgaggtggaaaaagatatgattatctctttatatggaaacaaacaaaactatgcagttactttcgcgcgaaacggacaatacaccgcgcgttacacgtcagagtacgtggagaatgtgggagtggaggagaaaagctatgagcatgaaacaataccgtgagcatcgaaggaaaacaatgtggtgagatggcatgagtaatagcgtagaaaacaagccacattacacgagaagaacatttgcagctcggaaaaagaccaaaaggaacaattgattcgatttgcagcttatttttaaataaactgcaccatgaagataggaaaaaaaatctaaattttcaatttaaaaacaatgcaaagtatttcgacatcatagttaagggctaaggtacattaaaaatataaatatgacaatcctagcgacaagtagatattaaatcaatagagatcgaatcaaaatcgcattattcacaaaatatcatcataacttaaatcataaaatacacaatataacctgataagaaagatacatgagaaataaatgtatcaacatcaacgatcacaaacgttacacgaagccaaacgccaaacagaaaaaaataaataaaggaaaataagtccaaaaaaaagaacccaacacccagctatatactataaagctctgcaggacatggaaggagaagaaaaaaaaagaaaagaaaagcagaggagagagtagcagagagaaagaaaagaaaagaaaataaataaataataaaaagcaaaggaagggaaggaaggagagagagatagaatagagagagacacacaaacacctacaacaccaacagcaccaagagaaagagagaaagaagagaagga

SEQ ID NO: 23303 - DNA, 4926 bp, Oryza sativa
atactcaagcttcttttccatgtaacgacggaatgtctcgggaaaaagttttgcatcgttaacaaagaaaacaaacgttggcggacgaatggcagcctgcaggttaagaataagcttcctttggtgcgaaaataaaaggaaagcatgaaaacatttccccaaggtgaactttacaaatctaaaagcagtacggatttcaaagggccctgataatattgcagaatgcatattactactctatcttaggacagtgagtgtatcaaatatactttgaagtgggtaaccagtggatcctttgctgactttgaaatacttctttaagggatccagtttcaatcaatcatatatcttcagatacttaaaaatgaattaaggagctgtatttgatttaaggacttcacttgacatacaaggaagtgaaaatttagttgtagtagagatcaagagaacgctagtgacctttacgacttacttgaaaggtgagaccataaacttgttggcttaagaggaataaacagaatggttcaataagaagttagaagctacctgtgttgtgtaataaacacgacctcttttaccacctcttgttcgtggtggtggtttgaatgctatagcttctctaacaacttgattaagaatagacgtaccaagtcttctagacctttccttttcaactagtgcagcagcagaaattatcctgaggaatatttgtgtataaagaataattacaatgccaatacagaaaaacatatctagtgaagttaacaatctcctacatgcaatgcaattagttggattacaagaaattgggagataacagaggaacatgaagattcagcatgaaacattagttaatgccttaatgacatcagcttaaatttcaggtctggtatgcaggaaaatagacaataacaccgacaagctacaaatagcctagcttaaaccatcaaatgctatagtagtgaagtaccaaatgcttattgcggagtaaaaaataaagttaagggattaacttgtcaacgctgctgccatgtgttgcagaacaataaacaataggagcccagtcgagtatgcgaagcttctctcttacatcttgctcataatatgttgtactctgatggttcttgtttgggattgtgtcccatttgttcacaacaattacacatgcttttccttctttctcaattctttctgctattttatagtccttggtaccacagaaattcaccatgttagaaaagattggtaagacaacatctctttgaattgtttgggggtgcacatgtgcatgtgatggggtagagatacctgctccgtaatgcaggccattgcttcaacaacaagggcaaccacatcagaccggcggattgcacgaaatgcacgttttactggaagtgtttccgttgtgctggcagcagaagcaactgctgcccttcgtcggatgccagcggtgtcaatgagtttgtacttctgcagcatattgcaatatcagcaaattagaattactttcctatgagatgtaaatttctttcttccaattcaaattgtgttttgctacaaagatgaaagatgcatgaaaagtggacatagctagggtcaataatgaaataatgatgctgttcttggtcacttaaactttcataagcattctgacaaaacctgccaatcttctgtggtgaactcggtatctatggcatcacgggttgtcccactaacagggctcacaatagttctatcttctccaactaaagcattgagaatactacttttcccgacattaggtcttccgacaatggcaatagcaggaatatagtttccatcttcttcaactccatccagttcctgtaaaacattttgtgaggtaatggacaaaatatttccatatatgaatcaaaattggaaaggagaaggctattttaaagaactactgaaaagacaaacaccacaacttatgattcaaggttctggatctagaagctcaatgggtaggctggatataacaaggtgtcaccacaccacgtgtttctagcagtattcatctaggtttgtaggactggaggaaagagagtgaaatattccactaagttagcatatccatttgtcagaagcaatacttgagttgtttccgcagccaagagtaacattttagtgttgcaacaaaaaattataataatgattccattaccaaccataaacagaaaagggtatcaagcatgcatatagacatacacaattaaacattccctggcctctgggcaaactaagcaagttcagtacctcaaaattacttagctctgaacacaccatatcaaggagctctccagttccagtgccagtaatggcagatattggcagaggagaaaatctagaaggaagcaacagaacgatgagttgagcagccaataggcattctgttcttatgaagttgagtggtgaacaataaaagaaatgaggtaatcgttaacaaattgggttgtttcagagtcagagcacaagtaaagcattgcagaatgcagattatgtatactaaaagcacatttaacttgtagcgatgctagtgaaatgagtttagagatcttgcatgtggaaccactaaaagctcagaaactagttgtccattatttatatttcgcatctaacaatgggctttagtaacgtttttacctaatatcatcaagtctgtggcctctcacatttaatcagcacaagaatatgtcagacctaatacaaactgtacgtaaaatgtaaaaaaagaaaaatcaacagaacatcatttaatatttattaattgcaaatgaactgagtgttgtgtaattacagcaaggggtcactgcgtgttgaacttaccctaatgaccaaaaatctaaagcttgcatttgccctttccgtggagactcgcacttgtttacagcaagtataatatgcttgtcagagtagttgcgacgtaaccaatcagcaatttctatatcagctgccacaaggccatcctgaaagatttttgatacccattccgttagataagacactacataacactaattcaatcaacagtaccgaaaaacaacaatagggaattacagctacaagtaatgcaaatccatgtaagaatgaacttagtcaggggcatgaagcaacaaaggcactagacaaaacaaaaatttcagcaccaggaggtttatcaaatctagcaactataaacacacattcaatctttctacgtatgagctaggttaaataagaatccatatacgtaagtctgcttccaggtagaaaataaccagaagcttaaaaagtttaatagatcagcatgcagaagttggaaaaggaatgcttcaatacccaatagaagattcagacagaaatcacacaaagagaatgagacaagaaacatgctaacaggaatatctaatatttttctctagatgcctttgtttaccacatgtacaaaaactaccatactacaagacattattggagcaattgtaaatgtggtggattttagtatgtaatcaacagtccatcacttggcaggaccaggtgctaaaattgattccttcatattacagtagaaaggcaatgatacgcaaaacttttgtgtattcctgaaaaaactattgcagtagaaagtgttgctaaaaatcagaactaccaaatataacagaagaatccagaaaatgaaatgatcaaattaaaaaaagggtaattgtctgaacctgcctgaccatccacgatgaatagtatcacagctgcttcgtcaacagcagcaactgcttgcttttcaatcattgatggcatcctagcaatagcagcttctctagaggcaagaggaatcccatccataccaacagtagttgtaatagcaagctcttccatcacacctgcttgagattttgatagagtaatcactcccccagtgtcaataaccataaactctcgatccccccagtaagatcgtccatacaaacgatctctagtcacaccaggttcatcaacaacaatagccctgttgccctgtgagacaccagaattcaatacaccatagcagcctctgcattcagctaaaaattacacacaatgctgactcttcgctcaagtaatatttgtagctgtaaatagcttaccccaacaagacgattgaataatgcagatttaccaacattgggccttccaattattgccacccttggaagaagattatccggtatctgaatcacggacccaatagtaaagaaaatagaagttgtttacatttgcactttcttaaccagcctgtcaactagggttacaatttacaagaatacgaagatataattacatgtttagatgctgatgtcttatccctgatgattcttcttttatcccgaacatcgtcatctgaagacacaacgcatttagcccatgaactaaacaaagtcaatgtaagtatgtaacaggcttctaaaggagaaaaccgaagaaatactgtacttgaaaaactttgcgacgctaggcactaacaactaaactttcaaatatagaaatacagggaactgcaattcccaaactcatacatcatgctccaaggcaaagtatcaattgatctgcatcatcatgattctcggcacaacaatcagttcatcatcaacaagcagcatatccatctgatcttatacgaacatccccgccacgaccagagtacggaactacggattgactcaaaattccacacaggattgttctactacactagattatgcactttaggctaaatgctactatctcttcacaagcactaactagtttcctactttcctggccatgtcggaggtagcgaatcgaagctgaaaccccccactcaccgatgcggagctcgcggctgagccgctcggagaggtcggcgacggcgccgagggcctcctcctccatcgcctcgacgtccatctcctc

SEQ ID NO: 23304 - DNA, 16143 bp, Oryza sativa
  unsure (1)..(16143): unsure at all n locations
ttgtgtttgattatttcgcacatgttaagataaacaaatttgtcaatgcaagtatgcagcatttcaagattgatgtgcttgaagttaggagattgnaggtgtgtttagttcacatcaaanttgaaagttgggttgaaattgaaacaatgtgatggaaaaattgaaattttgtgtgtagaaaagttttgatgtgatggaaaagatggaagttcgaagaaaacttttgcaactaaacacggccccaacatttgaactttgaacccaaaaactatgctgctatgactaggggtggacccgaacctcaaggctatttggatcgttgcataaagtatatgaccagaggctcattaggatgaatattttttctttactatgtactagggattaattcttttcagttggtttgagatttgggttaattatggatccatccacaattatgatatagtgtatggtaccatcaaatgatgattatctctgtgtcagaccttcgttctcctttcaaccctcctctcaccgcgcacaacgcatttgtacactacgctccgtgtaacataaccatcatatcgaatactttatatccttattaatcaccatttcttagcccatatggacctggcccattataatatattggtacatactgaaatagtagtaatgtaaaggtacagttatcctcctccatcatcgcacttttcaaagtaaaagaacaaccttaaaaaaaaaagaaaccatgttctagaaaaaaaagcctccaataaaaaaaagaaaataaaagccaaacctacaaaacattctttgtatttctctagtttccgttgccatcaaacatatcgtaaaagtcaaagtggtggttaaacctcagttctatgacaccatcaaatagtgattcactgattaatggaacatctttggtaggtcatgtcttggaatatgaccttggttgacacaatcagtaagctcttagttgaaccacctgatactgattgatagcaacaaacgtgcatgagagcccttttgcaaatgccacattcaaggaacatttgcacaaagaaccttgtttaattcaccttgtgtgattttaatgtgagatgccaaagtagatactcctagcagctcaatttttgggctcaccaacaaatacctacacctaatttatggagagataaaagcgacattaaattcactcacatctaaaagcaacctttttgtcctctacataggtgatgactaatagcattgttcccccttgggcattcatgtactttgacaactgtttttcttttatcttggtaaaaaaaagaatctgaaatcctctagcatgttactgatgtgagaaaatgtacttcatatgaactgttttaaccaatgatatatactattattatttttacagacgacgacgttagtttttagcatggcattagatcatttatcttatttaaacgtgtatgtataaaaaaacagtcatattgaaatttatttgatgataacataagtcataacaaaataaataatacctatatactttattttagtaaaacgaatagtcaaatgttaggataaaagttaaggcatcatatattaaataaacggagggagtatatgcatatgaatcggagaaaaagactcactgtcaacagggaacacattctagaggtgttcttcatgtgagctcaagttaatattgttttttattatgatccaagcgtatcatgtggtcttcttgtccattgtaatgccacttttatatcttactcacaactaaatgtaacatatgtataactaaaacaaaactaaagaaactttttttttgcgaggcaaaactaaaaatactgacatcatgcaaataacgtttaaaaaggtgaactagtaaagttgagaaactgcagtatatatgttgcttgtattttgctttctgttagtgtcgttttcacatcgtagatcagcttacacgtaagtttgcttggaaacccaatgattagcataacacgtaacggtgtctttgattactaaggctgtgtttgaggagaaggaaatagagaagattggaaagatacgtaaaacgaggtgagccattagcgcatgattaattgagtattaactattttaaacttcaaaaatggattaatatgattttttaaagtaactttcctatagaaaatttttgcgaaaaacgcaccgtatagtagtttgaaaagcgtgcgcgcggaaaacgagggacaatccccctatctccccgaaagaacgcagcggagtgtttgaggagaaggggattgaggagattgggaagatacgtaaaacgaggtgagccattagctcatgattaattgagtattaactattttaaattttaaaaatggattaatatgattttttaaagcaactttcctatagaaattttttgcaaaaaacacaccgtttagtagtttgaaaagcgtgcgcgcgaaaaacgagagccaatctcccccatcacccctaaacgaacgatgcccgcaaatttgagagttttagacgtctcatctgagaattgtttgaccaaattgtgggaaacactaatccatttgctgctttcctttttccaaccatacaacgagtgtaacgtaacatgtttctcacacttgctaccacaaagtttctcatgttctcataccactcgcccactttttctggatagtatttaattaaataaattggtttgattcaggttcacaatttcacgagatattgctcgaaattcaggtcttgcagtgcatttcgggctattggttcaaaatttgttgattttctttcaaaatgtatcgaactatgcccaagggttactgaagaaaaatcgatgtcttgccgggtctcgaattttactggccaaacgatattgtaaacccttatttaaatatacgagatgcactctattatttacaattgcaatattttctgaatacacaagatgcacgatatgatttataaccgaagatgcacaatatacacaagatgtatgattttatttactggtgcatatttccccatccgtttctgattaagatataaattcatatataaattatacctcggttccgttagcatattttttaattgctaaatggtgtatttcgtgcaaaatctttttatatagaagttaatttaaaatactccctccgttttaggttataagacattttgattttggttaaagtcaaactgttttaagtttgataagtttgtagaaaaaagtaataacattttcaacccaagacaaatttgttatgaaaatatattctattattaatttgatgaaactaatttagtagtataaatattaaagtgaatttcacaaaacccaggtttgaggtgctcgtaacacaaaaccccaagttctactatttgtttcaagaaaccccatgttttggagcaaaatatttcaagagaccccatatttactcaaatactcataatttaaatattatatatgattatttagtatatgttaacattagtaggtttcaaaaacacatcccatcctatgtaatttatctttttctcactcttgagttgacaaatgataaaaacgcaacataacttcattaataataacacattaacctattatttacaggtataacaaaacatactaccaatgacctatattcattaaaatgaggctaacatttatatatactcaaaaatatctcgtattattatttttgtaattattatgcataaatatattagccaaaaacgatgatataagcttaaacatgtggtttcttgaaacattttgacccaaaacttagggttctttaaaacaaatcgtaatacctgaggttttgtgttataggtgccccaaaacccggggtttctgaaattcactctaaatattactatatttatctataaacttagtcaaacttgaaataatttaattttgaccaaacttaaaatgtcttataacctgaaatggagggaataccgtataaatctaattttaattttttttaataacgaaaacataattaattatactaatagggtttctagtttttcatacctttatttcatcatcaatcatcatattaagttaaatctatctcaaacaccattgtaagagtagcttcgaaaaaattgggaagaaaaaaagcaatcattatccgaggtgtcacaccatccatcctcttcttctcctggtgagggggaaccatgggcgcacacgcttcactgcgtctttttccatccaaccccctataaaatctccaaatccaacaccccacctcaccttttcctcctcgtctcgtctcttctcgtcgccggtggattcgccgccggctccgccgccgccgccggaggaggaggacgaggagagggcgctccctcgggggtgagcatccagccacctcggcccgttgcctcctcttcgcatctcggccccgcgagattggaagtgagggcagggcagggcggcaggggccatggcggtcccactcgtgctcgtcgtgctcccgctcggcctcctcttcctcctctccggcctcatcatcaacgccatccaggtgcgcccgaatcctcagctagattggtggcgaaatcttttcttttctgttcttcccttgtgtatctcaggcgatctgatgcggccgtggcgcgagatttggtttctttttcttttttttgtattctgtttgcgcaaatcatttcgtcgattgtttgtagcctctttcttggattactaaattattgtagctaggatttctgggttaattttgtactgttttaggcaaagatttaggattactaaattattttcactttaaaaaaaaattgtctgtcactgcgcgaaactgtaacgagaatcatcaaactttgcttcatttgatctgctaatctgcgcgcaactacgcagcaagatcagcatgcggcattacctgatctgctcgtatgctcgtgaaaaactgcaggccgtcctgtttctctcgataaggccgttctcgaagagcttgtaccggcggatcaacaggttcttggccgagctgctgtggcttcagctggtctggcttgtggattggtgggcaggagttaaggtatgttgatatggtcagtgacaaagcatctttctgatatgcacttcgtatcaagatttacctgttctgctaaaatgttaaaatacccacatttgatgtacacgcaatgttctaaagtttattttggaaccgttgtgcaatgcaaatcatccgtgtgaaatagcttccttttgtcacattaggacagtataaccgaatcggcaaccagaaccttcagatcagaaattaactgttattgcatttatgtgtatgccgtgcatgttacaatttaatagagctcattatttgagttgtgagcagtgagaaaagtttgaatgtggactctctcttttgatggttctggacgcctcatgcctggacattttttttatagggtttagctgcatatgctgtgagtctggaaaaacagccatgttaatactgccactgttgtgattgaatttggcccgtggagctaaaattgaaatccaactgcatttttctcttcattatggcagtaaaattagagtacagcataatcaatcaaattctggtggctaattaactaactgtacattatgcgaatgatccatgtgtacagcaattcagattacaatagaatttaccggcttgccacttgagcattctgcttaagattaaatgtttgatttgatgttaatgaagcaaacaattttaatttttgccatttcgcctttcccctaaaataatttcaacccatgttctgcagatacaactgcatgctgatgacgaaacttacaaggcaatgggtgaggaatcagttttatagcacagttgatagtgcttacaatgttcaccatgtcatttattttgttacaaacttatctgaagaatctttgtagggaatgagcatgcacttgtcatatcaaatcatcggagcgatatcgattggcttattgggtggattttggcacaggtctcattctctagttgttgaaacatcagttacactgcaatattttgttagaagttcagtatatacagatttgtctgtaatatataataaatcatccaaaacttttttttgtcatgtggtcagcgctcaggatgccttggaagtacacttgctgttatgaagaaatcatcgaaattccttccagtgagttagctagctcatgtacattttactggaacatttgttttgcagttcagtcccttatagactagtgccgctgacttttaagttatgtgcataaagctattattgaaaaaaaatgtaaagaaggtaataaaatattaaacttgctcttgggactaaaattatgataagataacatattgcattattatgtcatatgttccttctcatcagagctctatgattgttgatggtgaatttgtttgaagcaaatttgatataataccggtagatgatatgttacacttgagattccaccactccaaccgctaagtatattaatctaagggtggctaaaattgatatgcttgaactttgtattcagtcaagtggatgtcattcaggttgtagcaataagtagcagagtaggttggcagttaaatgttcagtacccaaaatgtctaagaactagtagtagaacatacattgtgtttctggtaacatagctatagttgttcaaactctctgttacacatgaaaatatgcgtgcaaccaacttttatggaagctgtacaatgtggaatggaatggtatgaagcaatcttgaagaaaatttgatgtccatcaactaagatcagaaaagatgtgttctgcttttgctagaaatctgatggagaagcagcctatcgggttcagttctttgtaattactggagatccataacctaatgtaatgtgcactagtatctcagtgatgcagacacacagacatgcgaagcattcagttatctatcttctgatatagtacttagcggttttgattgcatgcagacatgctcaatgttgtgattgcattttgcaggttattggctggtccatgtggtttgcagaatacctctttttggaaaggagctgggcaaaggatgaaaagacattgaaagtaacttttttacctcatctacacagtacacacataattctattgtttgttctttaacttagtggtcttgctatgcttatagtggggcctccaaaggttgaaggacttccccagaccattttggctagccctttttgttgagggcactcgctttactccagcaaagcttctagcagctcaggagtatgctgtttcacagggtttgccagcacccagaaatgtattgattccacgtacaaaggtatgttattttttctagctgaaatgatttcttgtatctggtattcctgtattcttgcatcagaattcacaaatataaatctcttctcccaagttttacccttgtaatagttctgatatgaaagaaatgaaaacatcatattatatacactagacactagtaaactacagatttcagatgggtaattctaaatgtaataatcttcacatatcgagaactgcatattctgtgctacggttaaattagagtatttctgttgcatatgttcacagtgtgtatctattaaacatacgcaacttcataggtgattaggatgcagaatctgtccttcaaacgtagataaatgttacttgtgtttgaaatctcttagaacaatacaaagaaggtcgaaacactcgaatgtaagatacatgtgtaacaacttgcctcgtgtaacaatgtgggtcctgtgctctactgccaaaatttacatgtaatgtctgttgcctgcctaatttgtacctatagttgctatccggtatgcagtgttatgtttttagattttgattgacatgaggtcaaccttttcaaactttgatagttaaaatgtagtttatagaacgagacaatgagtaatttcataatgatgaaaaccaccatagccaaaatcatgcattgaagactgagatgtcagacactactactcgtaatattgatggattatggataagagtacaaaagagaaataggggaactctgaaaattcttttgtactggctgatggtttctattccgaaataaacatgtgtacaggtgtttcaacatagtaatatgatgatgcctgcctgtttattaccttcctgaaaaagaatacctaatacgctaaatttcaagataaattcttgaacttatatgaaaaagatttttactggtcaattggacattcacaaattgttttaaagaaataaacaaaagcaactaactgaaagatataactgtaatacttccagtaaaattaaagcttaattgaagttctaaaatgacaatttgaaacagcatttttttataatatatgactgtaatactttcagtacaacagttacttctttaatctgtttatggagtggctgagtgatcagctccttacagttattaagaatacatggttatgtcatgcatttggccatgtagttatttcgtattgcagcattaaatctatttactgatacctcttgtgaaaaaaatgaaaatttccagggatttgtatcagctgtaactattatgcgggattttgttccagctatttatgatacaacagtaattattccaaaagattcacctcaaccaacaatgctgcggattttgaaagggcaatcttcagtggtatgtttgctaacttcttggatatctaatggcagaccaatcaagagagtgttgcagaactaaatattgaaatttgatgggtttcttttcactgttgaagtcttgcaaataaatatagatacatagtcataataaattgatttgatttgaaacaaatttccactccactgtttctctaggtacatgttcgcatgaaacgtcatgcaatgagtgagatgccaaagtcagaagacgatgtttcaaaatggtgcaaagacatctttgtagcaaaggtgctgagctatatatattttttatttagacatcttacagttaaaatgccaaatgcattggtcgatcaattaattctgaagtaaatgttgtatgttcctttattcttaactacaggatgcattactggataagcatttggcgacaggcacttttgatgaggagattagaccaattggccgcccagtaaaatcattgctggtaaaatctcaataccggagcattttacttaattgcataaaagatagtctctaggttagaacctagggctaatggcagtgtgcagacataccagtacggtctgagtgtgaacaggcaaataaaaacatagaaatggcccttttgaccatggttgtgatatatttgctcacaactggagatgcatagtgtgaggggcaatttggagtgagcagaagacaaatttcagtgagcatggctagctagtggcagtatttgcagctgtaccaactgtgaatatttttgggttagctcaaagtctgttggtccatgctcaacaagtcaaaataaaaaaaaacagtttaattttatagaaaacatcttttttaaaattcgaaatcaggctgtttggggtttgtctggtctgaaactgaaaacttgggtcgaagccccttcctttgtcagggccaagtcagaggatcaggggaggtgttttgctgggactaccgtaagaacacactgttggtgatagaaatgcaaaactcaagtacttgctgcaagcctgcatagaactgttccttgtttggtccaatacaattactgtagcaacttccataggacgtcttgtatgtatatgctactagtgtttggttagttactgactttctaattctgcttatgtaacaggtgactttgttttggtcatgtctccttttatatggcgccgtcaagctcttcctatggactcaactcctgtcgacatggaaaggagtcgggtttacgggccttgggctcgcactggtgacggcggtcatgcatgtcttcatcatgttctcgcagtcagagcgatcgagctcagccaaggcggctcggaaccgtgtcaagaaagattgaaagagatgaagatagagtctgcagcttatcaatgggagctaccaattaattgggtattgaattcatgtaggcaacaaaattgagggcctaatctttcctgtataatgcaccaaaagggttcttacagaactgaatgcctgaatagagagattctaggagatttggtgaactagcaactctgagctctgttgtgctgtattttcagagaatgtttttttttggcagaacaggaattgtactacttgtatttattggaacttctacatcagtctggatttgttcagaagacctttagtgatttatgtatcagtgaaacttatatcctgtctccaccatttgcatgatttctcaaaaagtcacaaccatgatcattcacggtagaaagaatgccatgatcatgtcttcctttatctgtcagagctaaacaaatttagcactttatctgtcagacctaaacagatttagttagttccctttaagtatgaaagggttaggtggttcaatttaactgaactccctttggattcataattcaattctttggttcggtcggttctataattctagatgcttcggataacgttgaggccaaacttttataactttaactataaataatttctaatttaatctaatttttaatttaaagacactagaacaacgtatatagattcgttttactaagtattataataaaatgaaaaattatttattgcatatattataatagaaaaacatagtcagatatattttggagactgtgtcaatgtctaaaacgtcacgaattatggaaccagagtagaatcataaaggcattgggatcgagacatgaaaatgattacttgcttggcccttttctaacctgaatggaaaaacagaatagaaaaaacgtagaaaagacatatgattctgtaaaaagagaatacatgaataattgtttgatcggataaggggaaaaaaagaataggatgaaagagataagcctcaaaggaagttttctaagatgttggagtttttgctaatttttcaccaaaatctagatgtgatgagccattcaataggattttataggatttggaaagctccaatcctttatatcaaaggaccaaatatattttttaataaaatttaaatcttatcaaattccttcataaattgtttgattcaaaggaccctaagtgacagtttcttcccatcataacaattacttcctttgctttaatagaagatgttattgacggttatctatacatttgattatttatcttatttaaaaatttatacaaatatgtaaaatgcaagttatggttaaagtagttttaatgataaatcaagtcacaataaaataaatgacaattacatgctgcctctgccccatgttatgttttggcacaatatgttttgagacggaggtagtaattttttttaataagatgagtggtcaaaatgtatatcgaaaaatcaatagcatcaactattaaaaatcagattgctatataatttctaaagaattgtctattaatagcagtggtccagttaggaaagcacctttgttttgcttgcatggatcgatttctacaccccaaaaaaaaaaatctaccacctaattctctacctctatgggcaaatgaattatgacgacacaattctgtcttgggtcatgtatttttgtttaaaaaaacttggggtaatcttccttttcaaatggagcaattgaatttgcaaaatgccttttcaagttggttggaattatggaaaagatgtagttctctaatgggccatgatttttttttttaaaaaaaaaggaaacttgcattggggcataacttcttttcaactgcttcactctgaatttgtaaaacttctttggcgagcacgctgtttcacatcatgcaagagctaagtgactgttttcattctgacaagctacattcagtaagcgatctatggagaattctgctgtaagaaattgttcataattttttttaactgctcatcagttgaagcaacttcattaacactagaagaattgaaagctgataccaaaccgttgattaagcatgaaaaattaggttgggctgcatatgaaaatcaataattaagagttaaaagatcaggcacctatcacatacggagtaaacaggtactccatctattccaaaatataagcatttttagcatagtgacaagtcaaacatttttaattttaactattaataacaaaattataaaaaagatcaatcatgtaaaattgattttactagatttatcattaaacaaaatatcataatatgcaactttttttatttaaaacatcttagttttatagatattgttggtcaaagtagcatctcggagaccgtgttagagtaaaaaatgcttatattttgagacgaggggagtagttcctaattctcatgacaggttgctgattttctaatctattaataacttcaactacttaatttctaatctattcacaaatcacaaactcaactgtctatgactctcctacaaaattctggagcttatcagaaggaatagtgattgacatatcaattaccgaatcccttgcatttggggtttttaaaaaaaaagctggtaatttactgtacatcacaagatgaagatattattatatgttaacatcacaatcctcaagcatggctgcagcctgcagagccatcatccatgtagcccagccatcaaaaggcacatgaagagatggtacaatagcaacattatacaaggtaaattatgcatggtagaagaaccaggcatcacccactgaccactagacagacccagaagagaagatgcaaaagcagcacaaaggcaaattgcaaagagcatcagaatgtacagatgttccagcagggtacatacaaataatatatagccttagaaagccccaaaatgaatttggatataatgtagcattattattctttgagacccagaaggggcatcccttaaaagttccactaggaaaaacacagaccagcaagatctctggtacatacacttcagtaagataaaaaccaagaaggggaaaaaaattatcatcctgataacaacagctagcacacaatttgcaaaacgctagagcagtttctactataagaacaaaaacccaaaaaggggggcctatatgggggcagcgccgccgtacaactgaacactcttcagatatatatatcccgcaatcttacttcacatctcaaccaagaaaaaacacaaggttgccaaaacctaaactcgctgtagaaatccgaaaccacaatctcaaaccttacataaaatggaaatacgtttaaatggttctctgaggatatatatctgatctcattgaccaaatccctggtggttagctctattaactaacccatttctgtaaatcatgtgaggttcaaaatttgcacctgatgcacctgtggttctctcctcaacctattttgacaaatgttgtatgtgaaaaagattcctaggcggcgacattgctgcacaggagaacataaaagttagagagtatatatagtgttgtgcaatgcatgcagaaaaacaaagagcacaaaaaataaggtttagtttcagtaatgtccttagcagtgtaatataacgaagatgaaaagcatacattcaaaataagatgagtacaagcatgttgtaataattgatctttttttttaacaaaaatcaacttgaagaatgctttgacaaaaaaattattacaccagtgcccctaagaagttcattctctaaaataaaatactcaggtcaggcttaagtttccaaaatcttattaggccatttatatttatctaagatgcaaagttgtctaccgtatgactgaagactcaagctaccaaacatccaaggactaccacaattaatatttgcattgcgtaaacaagcaaaatgttatgtcatggttagttgtggtaagagcaatgaattcagaatactgaatttctgataagaactgaaacatatcatttgcaacgaaatttcaagttattgaagcacttcagaattattctgaatctaaaatatatgtttgcaccatatttcagaagctaatcataaataagattagtttgtcgagttaatgatttccagctttgagactggaatcaatgaaaaaactagttattaaagggacacagttttcctaagtaccttataattcttagcagatactttaagtttggtgagttggtgacataacctaacaactagaaagctaagaacatccaaaaagactaaacagctagctgaacccatgaccctagtatacctaggtggtagccaaacatggaacaaatgtatacttttgaactatatattggatatatcacaggcatattaatgtctaaatataacaccgtcatgaatatgttaactagaatctccagcttgatgggacgctacacacataacacattaagcactgacaaaaagttcaataattggagaagggaataaagtttctacaccaagcaagtgttactatctattacgaaccacaggtcaaaactggacgcatagcttctgttttcacagctacaaatttaattgttgtactacttggacagcatgcctaaacgttgatgggtgaatcatccaaacaaattgatgtctagttcataaataatgcaataaccaaccaaagaatgaaatattcagagaatcatcatacgcattttaacgtaacagttgcaacattgagtaaatatctaacatactccagaagcagtaaaaaacacacacttgtttttctataaaaggccaaactgccaagtggtgttaccacgcttgaatgatcagtgtcatccagtattttcttaggacaactaacactagcattatatttgcaatggtaaaaacatttcctatataagcattgaatatgcatgggttcatctagcgatattgtttcagcagaatgaatattcaatatttaaagacactgttttcacattgctaccatcatagcggcaccacataaggtaatggttgaaacactagccagcaacaaaatggaactttagataaacagaacataagcattaagaatatatctaacctctatttgttaatgccccatgtaacctgctgagttctttgctgtaacatctaaagctgcattcccaagcccatagccaaatgggctggttccatcaagctcagaagatccggatctccaagttgtgtctccatagatggagccaccgccaccaccgccacctcctcatgatgaatctccaaagttccttccatacccattggttgattgattgaatgtattaacaacaccagatccagcattccttccataagcattggtaccgagaccaaagttggtttcactggatccataaccgaagttcccactgccatagcctgggccagcattagcaccttgtgcaggcacagaagggtttccccaattcacattgttgttcccaattccaccaaggcccccattggcagatgacatgaaggaattagagcttgcagagttggaagagtaactaagacctgaattcccccattaattacgagccagcgagttgaccctgacacagtcttgtcattgactccacaatagctacatggcctattgtatttaccagattttccattgtagtatggattaagctgccttccatactggagactgttgttgaagcttgagcttcccccaatagcagggttcatccctggatcaaaaattcataccgactccataaccaccaccaaaagaaggataactactacggccacccgatagaagcccaaaccttgcatccatcctcattccatagccaccgactgggctcggattataaccctgggtgtatccattgaggaagttattggctctgttcacggcatagttgaatccaccgacaggagaacgcatgctaggcccaggtgatagttccttaggaaccgcgcgcttgacctcaaccatcttaccgttcagttcatggaaggtcttgaacaatgccttgtccacagcatcctccgaatcgtacgtaatgaacccaaaacctctgggacgctgcgtgttgtgatcatacatcacc

SEQ ID NO: 23305 - DNA, 542 bp, Oryza sativa
atgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacaggcatttgattagtggctcttttgagtttgctaatacaacgattatcccagtagaaacaggttttattcaactt

SEQ ID NO: 23306 - DNA, 658 bp, Oryza sativa
aatctcatcccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccaccttctctccccacagggctccccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgcctggaacttgcctgtcttcctcctttgcttccttcaggtctctgctcacatgtcatgctattatcaaggacgtccctgacaccctgtatgacagcactgtcctgcagaaccatctatgatatggaaatgcgtcataacctgagctttcaataca

SEQ ID NO: 23307 - DNA, 305 bp, Oryza sativa
  unsure (1)..(305): unsure at all n locations
nnnnnnnnnnnnnnnnnnnnnnnnnnnnnnnnnnnnncaatgcataaatatgttagaataataatattccactagtattaggtctactaaccttttgcagagaatgacaataaagtgaaggaaaatcgacatcaactcagacgatagattaatcggacgatgtcgagaaccagacttgtgtatgaatgggccaagaacgcagacttgacacgatgaatcaggccaaaattcacaagtctacgaagtgaagtagcaaagggggccactagccaaaatgtgggctggttgggccggccctaggttcg

SEQ ID NO: 23308 - DNA, 19375 bp, Oryza sativa
atagggagtgaatctctatttaaggagttcactctcttcacttcaacacacacctcaagcaagagctctctcattcctctcaagtttagtttagtagtatctagttggtggaatagaattagaataggaatcaggagtccggaagtcttcggaagagttcgggtatggctctagtagcttcccattcctcttttataatcctaagttaatttcctggggagggtatttctccgtatttagccccggttggatagtcatgacgggctgtcgtaaggaactcggcagtcaggggtggcttctcgaagtaccaagagggcttcggatagaggttattagctagtatatcagttaactagaatgtatgtatactatgtatattagaagtataggaatagatttcctttctcttttctttccacctagcttagattatttattatgaggatgagtagttaaatgcttgtgtgtcactctacccttggattatcttaaccccagcttagaatatgattatggcaagtaatatataaattattagttgaggtctctctacatgatcttcccacgggataaaataaatacgatacccttggaatactctcgggtgaaatgctacaatggtatatccatgcgcttgcagatgaactctgtaaccataatataccagaagtatttctgcgccattgctgtgaattatatttccagtaatgtcgttaagaaataccaacacttgggcagggcgaagaaaggttgtcctcgttctcccatccttgcgacgaatcggcttaacgaagccatgcatcttgtcaccgctggacctccttaagccttgtgggcgacttcatgttttcgatcgccttgatcttctcaggatttgcctcgattcctcgtcctgaaaccaagaaaccaaggtgcttccctaacggtcctccgaacgtacacttgtccgggttgagcttcatttgatatgttcggaggttgtcgaatgtttccctgaggtcatcgatcaatgagtcgctcttcttgatcttaacgacgatgtcgtccacctatgcctcgacgttttgtccgagctgagtaccgagtgctccatggatcccgcgctgatatgtgttgcgtgcgcttattaatccaaaaggcatcttggtataacagaatacacctaaagacgtgataaacactgtcttctcctcaccctcttttgccatgctgatttggtggtagctggagtaagcgtcaaggaagcttaacaactcacaaccagccgttgaattcaccaactggtctattcgaggaagagggaactggtctttgaggcacgccttgttgagatcggtgaagtcgacgcacatcctccacttcccgttggctttgcgtaccattactgggtttgcgagccactctggatagaggacttctcttatgaagccagctttgagaagttttcagaagtttttggcgtgtccgaaggtgacgggtagcgtgttttttcccaacggtttagacgacgactccggggtgattcaatggaagggctgatctatgggcgtcagctcgctttgaggtattacaatcgcgtctaaggtgctggcgaagaacaggttgatcgagctcccgccgttgatgagaactcttgccacctttatgttccgaatagtggcttcaaccacgatcggatatctgccaggtgtagtcgcaattttggggtgatccgcttccgataacttgatcttgtgttgagaccacttcatcttggtagtagtcgtctgtgaggtggagcagacttcgtgttccgctttcttgtactctctctttgaggtgtatgatgtggatccaccgaagatgtgggagacatgtaggtcgtattctggaaaggcggaatcagagttgtcgccggcggcttcttttgtcgtttcgacgactcatactcgcttccctctctcgatcgctagttgtctcgtgagctcctttttgatgacataacatgccacatcctgattttcgttttaggatttataaattatttaataaattattattagaatttatattaaatgttcattaatttacaagtgaagttaaatgtgggaaataaaatttcctaaatataaagcatggatggatttattttttattaaattctccatggttaattatactctctgaaattttctcggatttttcggagctcaattcctaatacaaagagcatttcagaaattattcacatattaaattaatcattaaatggtcttcttataattttattaaatacttatagtgttcaagtattttcaggatttttcttgaaattattcgagcattgaaagtatttttaacaattcaaatatcatttcagtgattaatttaattggaaaagtaataataatcctcttcctagtcttgggccctttccagcccatctccctcttttgtgtgcacggctgtgcagcccaagtcggtccagccgagctccctcttctctttctttctttccttttttttcagccagcccaatacgaaagtctaattcgcctccctgctacagtgtcgtcttcaagcttggacagagcccgagccagccgtcctgtacctgtgctgccgccgcttcctccaccaaatccgccgcatcccgtgctccgtttgcgaaattagttgaggggaaatattcctcttatcctcctctatcttttcccccaagaatcggactttatcccgaagaaatcaacgcggaatcgagctcgattcgtgtttatctctccaactaaccctcggattttccggcttcgattcctctcggttggagtctgatctcttcaatccaagcctataaatagcatcccctagtcgttctctttcgtttgccccatctcccgagctctctcgtgccccgtagtgccgccgccgcgccacccaaaccgccgccgtcgccggccggcgaacagccgcctcgcgccgtcgttttagccgccgccgccgcctcctcacgtcgccgtcgggtgcgcgtggaagaggggaagctcggccgccccttcgccgtcgccaccggtcaccggagagccttcgccgccattcggagctcgtcgccggtcgtcgttcgtcgtcgtccgttgttgtttcttgcaccggtgagttcaccgcgtcgtgctcgtcacgttggtgccctctgttctcgccgccgtgacctagatcgccggtgaccgtgatgtcccgagcctctcgccggtgatgacgtcatcgtgatgtcataaagcccttttcccttctaaaattaaatcttaaaatcagtttaatcttgtaaaaattcataactaattcatatgaagtcggaatgaggccgttcaagtctctaaattcatctaaaatcatgatctacatgttaaaaatatccacatgtactgtttttgcttgtttttgtactgttttgttgattttgttctttcgctttagtttccgatgttccggaggagagcgttttcattgagaaaggttcagaagtgtttgcggaagatcaaggcaagtcacacagatcccaaacaaccctttgagcatgttgaacccgtttaaagctaatgttttatttcaacttatgcattattttcgaatgtcatcgggtggtgagcctttcccaattaattaatggccgaagatgactttattttcctatgggttataatttgattagctagaaccttatatattggtttggttcagctaaatgatatatatatataattgcttagccatgcttagaaacattagcatcattaatggggtgaattatactatattattacttatggttatatttaatggtagctcacgatggttaattgtgttattataattaattgataattaaaacttgattaaaggtgggttgtgagcacatggttttgaaggtcgtgctcatgacaattaaggaccggttcgcgagctactgttgtgaaacattaaccgtgccaaccacaagccagcgtgggcaacggctttaccttttgtatagcatgattcattgcggggcaccagactgagaagcggcgagaagtccatgggggtcgctggggagtccatgcctcttgttatatttatagagggggtgattatgatccaggaatggtgcactgtggtgagttatgttgtgcatggggtattgtcacagcctctattcgggtactttccagtatcgcgacgcatggtagacatgatgttgaggctgtgtcttgtgggtatagtggtacacctctggctagagtaaaactattcgaatagccgtgcccgcggttatgggcgagttgagcaatgtttttcgtgattagtctcacacctctcacaataattattgatgctataattggtaataatttgcttagctcctggtttggagatagatctgtacagccgggtatggttgttcagaatggttgggcctgagcagcatgggcgtgttgttcagtgttgattaaaattaatgattaaagtactctactattttattactcttaaatgtttgctaaatgctgcttttgtaaatgagcctatattatgccatcctttggtatccttgtgcacttgcatatttgctgtgtggcttgttgagtatgtaagacgtttggcttataccccagttgagttccctgtgggagtggagctgaagccatcgctaaaccgttattccgctgctgttgtttttcttttcttttgtaagtatgtaacgttattattatgatggatttgtatattaaattgtcagtttgtgtacctcggctgattcctggacgaggattttatgcacaaattacttcggaaattattagtgaatttccgggcgtgacataacagtcctccatggcgtgattgcttgtcttgtggattgggcaccatgccttgcgcgagtcgtcgctctgggggttggagcgcctggaaggtgccacttactccatggcaaggacctctcccgaggacttgcgcttcccactcttgcgacatctctttttgctcaactctggtgcatccctgtcggtcgacttcttcttctcatctcttgccttgctttttccctccttgcgcctcacagcatcgtctgcatgagcgcaccaatcgatgatctcgaatagcttcgagcagatgtgattcggcgcgttgccagctcctggctggtgtaccgatctcggacgcctgatttgaatgctcgtatgatagaagtatcgatgatctcggggatcgtatttctacactcgttaaagagccgaatatactcccgcaatgactcgcccgggttctgagttagagcgtgtaggtcatcttccatcgtgtggcgcttgtatgtcccttggaagtgggggacaaactgctgccataagtcttcccacgaagaaatcgggttcagcgggagatggacaaaccatgaacgagcagagcctttcaacacggctggcagataattagccagggcgttgacgtctgcactggcagcatagagaactgtggagtagacttgcagaaattcttctgggtacttccatcatatttctcaatcgatcccggtcggaacttctcgggccatcgcacattgcgaagtgtgggtgtgaatgccctacgtccgttgcctgggatagggtgtggcccgtggtcgcgacgttgtcgttgaagccgatccgaagaggacgacgaagactaggatgaggggtcgcttggggatcaggagctcggcttctcgagcgatgatcgtgtcctcgatctcgactcgggtgaggagattgggagtttcgatctcgtcggttgtcactgtccctctcctgtcttcggcgattattctcctgatctcgattgttgtcgttgtcgcgtcggtcattatggggccaacggtctcgatcttcgttgggggtattccctcggccatcatctctttctcgccgcgagggagagcgatgacggtgttgtcgatgcggagtaccgtcctcacgacgacgacggtcattctcgtttcgatccctcctattccgccggcgccggtttagatgttcacgaagatctaaaccttcacggcgcggcggtgtaggatctcgtcttcatcgaggtgaatggtcgccggaggcatgtcttccgacgaggtcttctccatctgcgtccttggtaggtcgctcttcgtccctgcgcggctctgggccacctgctgcttcagcaaatgcggcattgaggttcgtcacagtctcccgtagtcgctctgcccattggttggcgcctgggtttgctgctggatcaaaaggactctccctcaatatcgtatccaggttccgcaattcgtgagctagcgttcccgcaactgcagacgcacttgtctcagtattgtcgaccacgttcacatctctgggtgactgcgaagaggattcgtagccttccatgaggtgtaacacggatggcttgtttgtgcctgttggtatttctttacgacataactagaaatataattcccagcaatggcgttgaaatactcctggtatattatggttacaaagttcatccgcaagcgcacggatataccattgtagcatttcacccgagagtattccaagggtataatatttattttatcctgtgggaagatcatgtagagagacctcaactaataatttatatactacttgtgataatcaaattctaagaaggggttaagataatccaagggtagagtgacacacaagcgttactactcattctcataatatattatctgagctaagtggaaagaaaagagaaagaaaatctattcctatacttttaatatacatagtatacatacattctacttaactaatatactagctaataacctctatccgatgccctcctggcacttcgagaagacacccctgactgccgagttccttgcgacagcccgtcataaccatacaaccggggctaaatacggaggaataccctccccgaggaattaacttaggattatataccggcgcggaggaatacccgtactgagctgtcaccatcagcggcccacctctcatctgcaatatataaccccaaataatgatatcccgtaatctagaccacgtctaaactaccagatactactctaatatcatcgtcatgacatagagtaattgcataagcaaatattatacccgcaccaaagcatctcccagataagcttaccatatattcaatataatatgaacataatataaagtatttcaataccataaatgtatttagaacagtattctaataaaagtacaaaggttacaaaagagaagagaaaagctactagagccatacccgaacacttccgaaggcttctggactcctgatttctactctattcctattccaccagctagatattactaaactaaacttgagagaaatgagagagctattgcttgaggtgtgtgttgaagtgaagagagtgaagtccttatatagaggtggttatgacggttgtggaaggggaattgtccgaagtgccctccaaccgtcattggcatgcaatcctggacgttcacgccgaaccctgcatccaacggtgccaggatgggttcggccgaaccatgggctgggccttctcggcccatcttcggctggcggcctcctctattgcttcaatttgtacacttgtgaattttggcccaattcatcgtgtcaattctgagttcttggcccattcatacataagtctagttctcgacatcgtccgattgatttatcgtctgagttgatgtcgattctcctccactttattgtcattctctacagaaagggttagtatacctactactagtggaatattattattctaacatatttatgcattgcaagcatcactagttctcctctattttggtaatattgacggtcgaaactgatcgataacgaccgtcaacaaaaccccccaagctttaacctttgctcgtcccgagtgaaggacgaaaggaaacaaagacttgattgttgatcaggagttgctactatgctgcatatctcaaggatacaggtgcaaggtatatgtactctctctcagattaaataatctttggcacggtagcttacccttacccttgattcccacgagacactgcttctccttgccttgggcagttgaaagacagaacatcaatttagagtaccaataacccaatctttcttcaattcttattccggaagttttcaaacgattttgcaaaagaaagccaagttcctcaattgattcactcaatctctgtaagtgtatcaatatgaattcctcaccaaatattgccttttttgattcctactctaaggtttgatatgtggagctcggtagggatcaaacatggcatacttgcattcacatttattactgagtcaaaaacttcgattagagcagataactaaacatactcaagatcaagttcatgcaaaatttgtgtgtggtatctggtggaaatggtatatgaggaaaaaaaataaaagaaaaatggttctcctttgtgcttactttcttctcctaaaaatcatttttttttattgattagaagagggcatggctacaatttttttttctacatcatgcttatgcttgatggagcataactttatttttcataaccatgcctttccctcccttcttttttttttcaaaaggattttttttcttttctttttaggagaagaaagcacatgaaagcatggagaatttattttggtggtaatatggaaatggaatggaattttgtatagctcccagtgtaggagtttagcatgtgcataaatgtgggtatatgatcttgatcatagagcatgagaagtatctacagaagtcacaagagtttgacaaagttcaatggaatgacaagtaaccaaaatgtatatggtttaaccattatagcatttttttctggtaggaatttatatcaaatgaggaacttccaattttatcattttgaaaaacaaaacatctggaattcaagtgaaactagtatcaggatcatagtaactcatattactatctcatatctcgcaacaacttagacttagatcagcaagtgcagcctatttacctcaggttcccggataattgttggctacttatatttaacctttgagagagcacttaccaagaacccatatatcagagatataaaacagagcaactattcatcatttcaacaaagagaactagcttgtcttacctagcatgactcaaacctatcctatctttttggtattttctattttgcaaacttttatgttgttttttcaacttttataggattcaattggaaaacaaatatgcaattggaaagggaaatatgaaatgtgatacaagttacctcagtagggggagcgatgtctcccccccccaagcttggctttcgctcagggtccttgataaggattgaacccctgaaaacgaaagtacgcctgaaggtcatcgtgctgttgctgcatcatgttgttgatgttggtgaattgaggatcagcagattgttaccattctagcgtttgagctatgtgtttcgtgaggttgtactggatcaagggtgtccattctcctagtgatttcacccaagtcccaacgagaggaactcgagaaccattcacttggagattgaggcacaccactcgatcggggaggttgattgtccccccattggatgtcatgaggcgcatgccaccggtcctcactggcgcttgcccaagttgagagtccgatgctatggcatggagcttaggaccatccgagtgcatccccagttggtgcccatcctgcctcatacatctgtacgggtgttgaggatgatgaactttctcgttcgttccttgtcatgttgcgcgtctccctatatgttccacctgcacgagattcttctatggtttgcaggggaatggttagttcatggcagttgtacaaatgatatcccgcatttggcaacgggatttcatttgtacaaccgaggaaaaagtaaatcaaagatccatctactccatgttccataatatgcccttgcacttaataagcctcatcaatacgcggacgagcggctgagataaaagcaatttggtcgctaacgacacttagcccttttgctatccgagtaatcatagaagtacactcaacaggagcatagaactttatactttctaaccattgccttatcatacatttcacctgagcaattttgatctttctaaccatggcaaacatgataattaattcatctcccctaatgggtctcagatcacctctaggaaacaaagtcatagcaatccatttgtgcatgagcctaagtgtaggattatggatatcattcgttctaggtttcttgcaaattggagcaccagaaatgtcttcccaaaacctatttttctcgtacccaaaaattcctttctggagatcgattttacaggaatcgtgaaaaccaagaagtgtacttaaccctttccatgtgagtgtgaactccttacagaaaaagcgaaaagaaatattatcttctatttctttcaaagtgcatagaaattgcaaagtaagcaaacgagaaccaggctcatctaccacaacaaatctctgccaaccaacagctttccaaatagaacgaaattcaacatccaaacctatctttttcagcagctccagagagtattcttgagtgtgagcatattcccggtcgctcagcatgtagtaggcttgtctctcccgatcactgacaaggtcgaggtcggtgtcgttcaggagtcatcgcggagcttcggcgtcttccatcgagacatcagctaatgaatgagtgctagattcgccatgatgacttgatgaagagccaaaccccttgaacagacaagacagttgcctcctcatactgcacaatagagcaagaacggactaactcggcgggggttaggaatgacaagaatttcacccgccagttagtttcaccaaagcaacttgtatatatgcaactaaataattcaatttgagggaaactatcaaagcttgaatgaacttgagagcaaactttggagagggaatgaaaatgtgttgaaatggggtggaattccctctctcggccggctggctcttatagggtacccataacggacagaaatgacatgtgggacccactagctgttaccctgccaaaagcggctggtagcagttgcctggccggttcggccaaaccagggtgttcggccgaacccctggtgggcccaaccggccccactttcggccgttggattcaaacggtcagtgtggtcgtggcacagttaattttcgttgaaatttttttttgtttgctcttaaaaaattcatttgaagaatttcctcaaaattcaaaaatcctaaatgcaaatttgaaattcaaacatgtgatgatgcaaaaattcaaattgttgaaagcaaatatgcggatacaaaccaatttacctgttggcaaaggtcgcgtcgtttaaagtccgacgtgcaagaccgtacctccttctgatttagttcacggattttccacctgtctccggaggtgatggagcgggcctctttggcttttccttccatgcctttcttggttttggtgcggaagacggcttcttctgagtcggctgctctaacttcttggccggcatcctccaataacggttcctgggcatcgttgtttccttctccaggaaattctgcataaacttcaccaggctgtccgtcttgggtggctccacttcgaccacttaaatattctgtgggttcggcccgtactttaccctgaccatggagcattgtccatccttggttggaactcaaacttctcttccttcccgttgatgtggaaacggatactctccgttcccacgtcaatgttggctcctgtggtgctaaggaacgggcgcccaaggatgagtggcgtctccttccccgtgtccatgtttagcaccacaaaatcaaccgggatgaagaaatcccgtatcttgacaggcacatcctctgctatccctaccgggtaacggactgatgaatcagccagttgaaggcgcatcggtgttggtgccaataccgtgaagttgagtttgtcgaacacgtcttttggcatgacgctaacattggctccaaggtcgcacaaggcctagtcgaattgttgtgccccgatcgagcaggtgattccttctccgggagcttgtggagtaccacattgctacattgtttcgtcagcttgaccacctctgttgttgggagcggtctcttgttcttgagtatgtctttaagataacgggcgtatgttggcacttgcatagcgtccaacaacggcacgttgatgtggatcttctggattactttaataaaacgagcgaattgctcgtccactgatggtttcctaccccattgaggaaacggcagcaaccgtgtgtctcaatactcctgcggcatagtcttttctggcagaacctccatgtcaaccgagtcactagatggcgctccttttgatatctcattagtttctgcagggttaggatatggcggaccacgagtggacttacctccccttgtcgtgatcgccttgacattttcagtggaggcgtcgggttgccccgaaatcctcccggattcatttgcagggactaaagatgccaactaagcaaactgggttactatcatcttattaaagctcagctggttttgaaatgcggaagcaaagccatctagcttgacatttatgttctctaagatcttatcattagcagcaagctttttgcttagcacatcagtggttttagcttgcgcaaaaacaagatccttcaaggagggttggttagagaagttaccgttattattacctcctagataatatgggcgtggttggttacacccctgacctccttgtggacgatacccgttgttgttgcccatgtacatcgcctcctcacgggtttccgggcagtcgttcctagaatgacccgtgccgctgcagacttcacacgtgacgtgttagtctaaggccttgacggtgccttgtggttgtttctcgtggtcgtccaagcgtttcatgaggaggtccagcttggtagcaagtaactccgtctcctcgacggtgtgcatgcctcgctaacgggtctggagtcgttcctcactccaacccacattggagaccatcttccctatgagttcaacggctccttgaaccgttttagagaagaaggctcctccaacaaacgcgtccaggtgatcgcgggacattggggtgagcccattgtaaaagttctgcaggatcagccagtcgtccatcccatgatgaggacaggcggccacgtactcctgcagtcgttcccatgcttctggaatggactcgtcccttgtctgttggaaactggaaattcgtccacgaagggcattcgttttgcccatcgggaagaattttgagaggaatgccgtagagcacttgtccctggtgttaacggcagcacggttggcataaaaccactgcttcgctctcccaagaagggagaacggaaacagtcacaacctgacggcgttgggactgacgcccttgatggtgtatgtgctacagatcttcaggaactgttgcagatgagcattggcatccttattaggcctgccacagaacgggctagcctgcgccatcatgatgaggctggacttcaagtcaaaatccacgtcccctatgttgacctgttgccttatggccacattgtcagcagagggagcagtgaactcgcgaagagtcttgctggccatagtcttgaaggtcggtggcgctggtacggctggtttctctgtcggtagagttttctgcggagcaacgactcgcggcatgacgatccggaagaaagcttctggattttctttgaagttttccggcaggatgaaaccagtcatgcactaccctgtttccacagcaaacagtgaaaacaaccaaggttagcctgcaaaaagtaaaatgattatacagaggtaaatataaagtattagttcaagtaatctctattatgaatcttccccggcaacggcgccagaaatgcttgttggcatttcttaacaacattactagaaatataattcccagcaatggcgcagaaaaactcctggtatattatggttacagagttcatccacaagcgcatggatataccattgtagaattttacccgagggtattccaagtgtatcgtatttattttatcccgtgggaagatcatgtagagagaactcaactaataatttatatattacttgtgataatcaaattctaagcatgggttaagataatccaagggtagagtgacacacaagcattactactcattctcataatatattatctgagctaagtggaaaggaaagagaaaaaaaaatctattcctatacttctaatatacatagtatccatacattctagttaactgatatactagctaataccctctatccgatgccctcctggtacttcgagaagccacccctgactgccaagttccttacgacaacccgtcatgaccatataaccgggtctaaatacggaggaataccctccccatcgaattaacttcggattatatactggcgcggagcaatacccgtactgagctgtcaccatcagcggcccacctctcatccgcaatatataaccccaaataatgatatcccgtaatctagacaccacgtctaaactaccagatactactctaatatcatcgtcatgacatagagtaattgcataagcaaacattatacccacaccaaagcatatcccagataagctagccatatattcagtataacatgaacataatgtaaagtaggtactcatatacttggaaagtatttcaataccataaatgtatttagaagagtattctaataaaagtacaaagcttacaaaagagaagagaaaacctactagagctatatccgaactcttccgaaggcttccggactcatgatttctactctattcctattccactagctagatattactaaactaaacttgagagaaatgagagagctattgcttgaggtgtgtgttgaagtgaagagagtgaagtccttatatagaggtggttatgacggttgtggaaggggaattgtccgaagtgccctccaaccatcattgggatgcaatcttggacgtccacgccgaaccctgcatccaacggtgccaggatgggttcgaccgaaccatgggctgggccttcctggcccatcttcggctggcggcctcctctattgcttcactttgtagacttgtgaattttgacccaattcatcgtgtcaattctgagttcttggcccattcatacataagtctagttctcgacatcgtccgattgatttatcgtctgagttgatgtcgattctcctccactttattgtcattctctacagaaaggttagtatacctactactaggggaatattattattctaacatatttatgcattgcaagcatcactagttctcctctattctgataatattgacggtcgaaactgatcgataacgaccgtcaacagtgccaacgaaccccacaaaccgatctgggattggcgccgcatctggttccttggcaacacatggggttggaactcgtggttgttggacgcgatgatgcggtggtttgagggttttgaggaagattctgcagcttgtaagatcatgagatctagatgtgtggatcggacagtaggtggctcccgtcggtgaagtacactaaatccctcgttcccaacaggtgtagagtttagcttgcacgtggagtatcaccgggcagccctcgagagtatgcttggttgtcttatgcacaggacaccaagttctcggttttagggtggtcatccttgtcggcttttatctttcacatggaggtgaaattcagctgcctgagggttcctcccaggtattggggccatcgatgttccgttctccacctaagtgggaggaattgtcggcgggttgtcgtttctctcagtcgttgttgtacctctctcgttcccgatgatgattgggccagtcgacattggtgtaatggtatagaccggaaagacaatggatccgacttgagtccacaccagcggtgtcgaggtagaagctccttgatcgatgctggcggtgacattgttgtcggaaagtcttgaagtcatactggtagatccttgagcaccaagtctgcctacctggcgcgccactgtcgacgagtgatactcatggaccggatgaatagagtattggggtacgttggagcaggggtctacgtagtacaacatcaaagcagacaaaagacaaggattatactggttcaggccccttgtcaagtaatagccctaatccagtttatatgggattgatgatgatgaaaacagattacaaagagagtaactgaaacaggcgataccgacgagatcgtagtcgagggattcgacaagacctcccggcaagtcggctccacgtactcctgcttcgtaaactttggtgggtgtgttggcgatgagattcgatgcccttcgcctccccctaggggtcccttttataccgtggaataccttgactcccaagtaagacttagggatatgtaaactggcacgatataaccagagattttaccctttccgagtaggactccggcaatttcttaactcatagagatatttttcataatttaagatagattcctaatggcgtattgtggacccccgttttttttataacaggaatcaatcgtgtaaacagtaccatttccctggatcgagtagtctggtacacacgaattcatagctgaaataccaagtgcacatacacgagtgtctagtacgaattattacatcataagcccgcaggcatagtcttaaatcatcggaccgagcggtctggaatacattccaaaaacagaagaaggtaaggcagcggagttaaggcagcggcacgccattgccacaggcaacgaccgtaactaagacctactgagcaccatcgtcttcgtcaccctcctggtaataggcatagggatcctccgaagcttcatctccggcctctgattaagtttgtatattgcaagggtgagtaccaaccgtactcaacaagccaccacagcaacaatgcatatgacaggggtattcaaaggatgactatggttcttttgcgcaaagcaagttttgtaattcctttcacaaacctaagacctagcacagactgatcaaattttattaccagtgttcatattaaacaatgacgattctgtccaccatccattgtgatcccaaggatagcttcccgccattgagtcgtcatggttttctgaggacgttcaccttcccgcctcttaggaagtggctccattagcatagaaatcatcatgcaatatcccattccacacaagttaagaatttagagtctagccaagtgtaatacatgtcccgatgctcaataaccgcgagcacggctattcgaatagatttgatttacttacactgcagtggatgtacactttacccgcactccgtgactgcccaacacataagcctcgtcccaacacatgggacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattgaattatggttcaagttaagttctctctctcacacacttatggcagtcctacctatagcgacaccgatgtagggcacgcctctcggccctacctcaacggctgtcccaccgtagcgcacctgcctcactcaggggtgaaccatctatgcagggatactgcctccgctcggctatctaatccgctaggtctatacccatacgagaagtacgattgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatatcatcaacatcatggcaatgtggcgctcatgtctccacatgccgcatctcaattaccttcccaaaggtaattgcccaagcatatagcatttgataaatatgagtatgcataaatctagagtagcatttctaagcatttgtcatagttgactagggacttatacgtaaatcatggttacaaggatttaagggtaaacaataatcaaggcatggcataatcacaagtagaatgttcatcattgcatgcaatttttatttgtaaataaaaataatttcgtaattgggatcaacatgttcaaagaatagtgatgacttgccttgctcaaagtcttgcgggtcttgaccatcgcttggatccgcaactccctcgggctctatagttacgtgcgaaaattgatttgaattcagaattcaaataaaaatccaaataaatccaaatgaaagtcgattcctttatattaactttactattcgcgaactaaggcaaacccaatttcgattcaaactattttgcgggtataaatattttgttgtcataagtttttaatttaatctacccgagcattatatccatataataggttagaaatttctatcgcgagctaaatatcggacgaaatcctagaaatattatacgatttaatttagtctatgactaaatgattaaatataatacatggctaaaatccctagtaattaaatccgaatttctaccgtgaatcgattacttatagggattacccaaaaataatctataataatctataagaattcatctatttgtttagtcattaactacatctaaattattaccgcgaattgatttcttatagaaattgccaagaataatccataatttatattaaattttgtaattctacaactataattaatctataattaaattctaattattttaaattttctaaacttccctgatctcccctaatttctatttatttttttcttttcttttctctcctctttctctcttcttttctttcttctctcccagctcctttctcccttcctctctctctcggctctttgccctcccggcggcgaaagcggtggacgcaagggggggaaaaggcggcggcttaccgacagcggcggtcggcggcgacaacggcgacggcagcgcaagccgacggcgacacccggcgcggcacacggtgcggcgcggcggcacaccgagggcggcggcgcggcggtgccaggacggcggcgcggtggagggaaagatgggaggaagaggaaaatggagtggggaacaatggagaggggtgggggtgtttatagggaagaggggaaagagggagataaagggggatgaccc

SEQ ID NO: 23309 - DNA, 35310 bp, Oryza sativa
gatgggatggcgacggcgataggcggcgatggcgacggcggcacggcggcaggcgacgatggcgacagcgcgcggcggcttgaggcgcgaggcggccaggcgcgacgggcggcggcgcgtggtgacggtggcgacagagagaggggaaagaggaggggttgggttaagggaccacgtcgagcacctagagtgcaatgaacagtgtcttttcttatttaacccgattttagcctatttattatttaaatttgattctataaatcctaaattttgcataaatatggtttattcaatatttgtgttattccaaccaatggatccactctagatttattttaccgatattttatttttataaaattttacttgaatttaattagagtaaattcctattcaatcgcatttaaatttaattgatacaaatatggtcgcaataatattttattcatttctatcctcacctcatctttattttaaattatatcttaattatttcttttgccaatttaattttaggttttattcctaattaattattccttattcgttattgataaacttcgaaaccaaattccaatgaaataggcggagaaaattggcatgatgcaatttatttaaaaagtttttgaaggcccatatttttagagtttagattgttgtcgtcgaattttcagggtgttacatgtatacggaaacaacccgtacatgtgaaggtataccttatcgggatgttccataagtcataggatagagggtatgccttattcgtaaccctgacaacttcaaaatttcaacccaaatttggaagtttctgctaacaatttgaactttcaactcgaaattttagaaaacactactcgaatttttgaaacttttcaactcaaaactgaaaccttcaatttaacttttgaaactttgaacttatatattaaaactttcaacgcatctatttatttattattttattataacaaattatgcttagtgcttagtggtggaggcgtggggacacgtgcgtattgtgctaggtgcactcctgacgccattgcacacaccgtacctctatttaagaagagaaagggacattttaaatattgatgtgcaatttgtgccctaccaaccttttggtaggctctattttgtggtttagattgaacacaaaggttagtttggcaacattagctctctacagtggtggacgcacccattaggcagggagggtcggccgggtccagctatgatccgtgtcgccccacgcagctacgcccctaaaccttatttgtagacctatttttaacacattattcatccgtctactattgaataatcagataaatcaaatattttaagtagagacaaaaatatttatgaaaattcgtgacttataagtattatttctgtgtaagtagtaccattttgactgttcctgattttgactatatataatttttttctatttctatacaattcacagtaaatagttaaattggtaaatatataaaaaaatatattttactcacttgaactattttggcgaagcacttaaacccctaaataatttttcatcttgttttataaccccaattgaaagtggttccccttattattatctaacaacatttctctttttctctctctacatataaatcatatatatttgttcgactaccaattttcgttgttaactttctcgatatccgtgtcgtgcactgctgcgccagtgtcatgagccggcgactatggtttgtgtgcattgtaccatcacctaattagagttagctctgccgccatcagccggtgactatggattgtatgtattgtgccatcatctaattagggctagctccgtcgtcccatctatattttaaacctacatccaccactggctctctataagtaacgaaccaaatgtaatcaagtcaactctcagtactaaagaattggtagggttgagaaccaaagtggcccaaagttgaagcatcaacgcaattcttcaaacattattcatggaatttccaagcaatgcacacgcagtaactatagtgtgcgaaaagggactcaaaactgtcttgttttctgaacgagaattattattgatcaaaatttaccatcagatcaatagcgttatcgggagaaaaaacaaaacgtagtttttaagctgaataaaaaaacagaaatgtattgtaaaggattggagaaggagggatgactacatgattacatttactcctgcacaattttacaaggagcatctttctagcatctatatatacctacagctgaagcctcatacctcccacaaatttagaggcgattcggcgaattatacatatatatatatatatatatatatatatatagctaagcaaccaagatgtactatacagtgggagaatatattcattcctgagcttctttgattgtcttccaggcgtgcggccaagctgctcgctagaacgtgggcacgacgccgcagctggagtcggcggtggtggagaagtactggtcgacctcaaggtcggtgtcgctgcgcttggcgaagcgtcccttgatcctcggccgggtctcggcatacgccttccgcgacgcgtacctgatggtcttctcgaaccgcctcgtcttcctcttctccctgtaccggtgcaccctggcctccctgtcaatggcgcccatgaactgcggtggcgacattatgctgtgcgccgccacaggggagccagctgctgccgtgaagaggtcgatggtgctcttggatgacctcaagtaggaggtggtgatgtctggcacaccgcagtctgggaccgtgctcatgttctccagcgatgacatcgaaacctgagcgatcgtcgaacaaggttgaaatgcatactatactagttttgatattccgcgttttgctgaggatatgtggatgaatgcatattttatataatataaaagatagatatatatgtttaaataatgtgataatgatatggagatgataatttcacattgctcgcatattaaattctaaaaatacaacaaaattataaatgatatatcatgtttacatgaaatttaagatactctataaaataattcctagtacgtgatgatgtgacacacttgtatgtgatttaaaatactctacacaataattcctagagatcttttacggtgtttgcgaggtacttagaggtacttaaaggtggatcaacggaggggtcaggtacggaataaaattattgtaacatgataggagatgagtaaatgaaaacgtaaatcatggctaccctgttatttagcgattgattcaatctgtatcggagagagagaaaaaaaatcaaagatcacatttcctttcttctctagctacctttagagatatccatgacttatttacgcagttaattagttgtttatgtagtcaaggaagaagtttcatgttttatagggataaattgataaaatattatataatttaaatcgacgcaaatcttcggtgatattttaaccggtcatgtttttgaaacacaatacaaatctcttctagtaaaaaagatataaatctcaaaagaattaaacggagggattttgacatgttcttgagaacataacgtaaatctagacaagggaacacaaatgaaaacttttacaccaataacgttttcttcggaacaaaacgtatgtaaatataaagaaaatcatgcagatgagaatctcaaagaacacaacataaatctatagaaaatcatgcaaatgagaacagctagtaccaagcaaatcacttaaccggtacctatgcggtaccgataaatttagggacaattctaccatttctctcaacaagtatatttatgtttttacccttgatatctaagtacctatactaatacttaaatacttttcacatggtacctattattgaggagcgttggatttttaccttttttggaatgcaaacaccgtaaaagttctcgcgagcacatacatacatatgtacctatacatttttatttttaagatttttaccacaacttgtagtacttttgtacaattcacagaatagtactataggccatgctacaaactgatttgttgttgtttgtcacagtcttctctgcaggagatagtagttagtaacttgctattcttctttggtgatggtgttgcatgttcttctcgggtccttcacacagagttcatttgtgtgtgtggttgttagtcagaatattgtgtgtgggacatgcaatgtgttcatatgtttggatacttctttgattttggtcagcatttctgtcactgtgtgcagaagttttgatttctttacatgttcaaaagtattagaacttctatatggttcaagtttgtggtaaaagaatttgattagcttgatttgtttactctaattcttttcaaggagagttttagctatgcatggaggatgtcagttcttatccatgaaggtggatgtggattctgaagaaattaagcaacatatcgtccatgggctaatttcctatgttcaggtattgatttgtctattatttactgaaaattagcaggttttgtcctgcaaattcactgatatttgtgttcaaaaatctgaacttgggggctattaatattgggtaaattttaaaagattagtatcagttttgtttgttgtggattctgaaaagaaatcgggcatactatctcaatgtcattttcagtacctacacaaagaccaatcattagcaaaatattgtattcttgtttgctctgtgtttctgtttctgtttatgtttttggttttggttttgtcttttctgtgtttttgttaaccttctaaattttgccaaaataaattgttttttgtgtcccatttgtaatttttctagtacatttttaggtgtactgagtagttgtgctagttctagactagtgtcaagagctccaaaggtagtctttaattagaattgagtaaagtctatcaccggtccctaaacttatatcgttgtgtcatcccagtccctaaactcgcaaatcaaccgttcaggtcctcaaacttgttcgactgtgtcatcccgatccctaaacttgcagatcactcgtttagatcctccaacttgttcagctgtgtcaccccggtccctaaacttggatttgaatatcatatgggtcaaataggatggtctaaatactttatatttaaaaatattcataactttttcatgtgaactctaatgaaaataaactctatatatcaaacttgtagcccgcgacgcgatctacaactttgtagttgaatttttttttattttaagtcatttttgtcccaaaatgtaattttaaaattaaaattacaaaatctataaatatgcaacaatattttgggaccctaaacagttttaatttaaaaacttttcaactacaaagttgtaggtcgcgttgagggctacaattttgatataaagtttgtcttcattagagttaacatgaaaaagttatgaattattttttgatataaagtttttagaccgtcctgtttagggaccgaggtgacacaactgaacaagttggaggacctaaacgagtgatccgcatgtttagggactgggatgatacagtcgaacaagtttgagtacctgaacggttgatttgtgagtttagggaccgggatgacacagcggtacaagtttagggaccggtgatggactttactcattagaattttatgcatgactatgtgcatctgaatacctcatcaataataagtacaaaacaagttctcatgtctagttttctcaactactaacatttctagttttgtgttttgtcagccatttgatatttctgcaaaagttagttttgttttctagaccaaatatctggaaatcagttttgtcaatccttgactagctgagcaattaattttgtacatccgaatagtattgttttgttagcatttagtagttgcatataacatatgacaatgttccttaactagcggttatctaactacatgttttatcaactttgccgaccaaccaccaagaggtaagactgggacaaccattatctgttagccaattcaaattgcaatattccctacattagcccactctatagggcataagctatcacctagaagattttttgttcaaagtgtgtgtaatattcacatgattgttaacctgatcgttgacttgatgaatttgtaggtttgtctgcaacatagtttgctgaatgaattcagacgtatgtcatagaggtagttaggccctatgtgagtcattgtacttactagttttgatacccaaattatagtttagttgcttcatttttcagggtggaaatatgaaagcggcatgcatcgagtcattctccatgccttattagattagtggataatttcttttctataccttgacaaatggaaggtatcctaaaagatgctattaataaatgacaagttggtaatgtaagaatttggtgactcgacctcatttatcccctggctagaaaatcaccagtttggaattgttgatcaattaacccatatatttttggtgatattttttttttgtttagggctgagttagtataggtagtacatgtatcatatgggttgcatttgccatgcatgcactgtagatgttgacttcatatatacagtagtttgtctgagtatgctaaaaaattatcatgacatttgcatattttagtactccatgattgttttccatagatctactgctatgtaaaaagggtttatgctacttttctttatcaatgtaattttaatatgaactatcgtaacctaattttgtcaaccttgtgtgctatctatatcttagtaattacaaaatcagtacactgagcttaaatttagacaatcaaggcatcaagcatctacttagtagtgctagtgcactgagcttgattgtttgcactgaagcataaaaaatttcgagagtaatttatttagtgactactaggcttgattatcttctagcaatttttttggatatctatttcgatctttacactgatcgtactttatatttattaatctttcaggagaccaacaactgctttatatcatccaacaggtcatttatacaatttctttcataggatttgcatagatttcacattttgctccactgattatttggcaatgggaggtggtggtgactttgcactttatctcaacgaatacctgtaatctctgtccttcctcccgccttatcatacaaaacttctggtccatgtttcatgcatttattcccatttgctctattagtctctgcagtcttagggagtgttcgctcctcctggttgggaacactcccctccggcacggaaaacggagcaatccattagcgcgtgattaattaagtattagattttttttttcaaaaatagatcaatatgatttttttaaacaacttttgtatataatttttttgaaaaaaatacaccatttggtagtttgaaaatcgtgcgcgtggaaaacgagagagatgagttgggaaaactgagccttaatgggttttccatgtcagtgagatttaacagtccatgcttatcatggagaaaatcggacacaattagttttgttaacatgagacaaatgttagtatgatgaatcagtacgtaattgctgtctaggaaaaagagggaacacagatccttcactataatgtcagatatttatgtcacaaattaattgcgatgcatacatttaagtttgttgctaaaattgattagagatggtaatatcatttggaattaatctatttatgcatacaggatatgtcaagatttctttgtttgtaaggattttgctaatgaatcttgctagctgagctttgtcacgcaaaagttgtgtgataacaaaatggattcaatctcgctctggtgttgtttcctggctacaaatggaccttctcatgttgggtttgttatgacttaatggaaagaatttgtgtgttgatgtcagacagattttgagcttcttttgaatagcccaaagcaacaatgttaaggttgttcaatatgaaaacaagcccaataaataacaaaagataaaatatgttttctcagtcctgacccaacaatgagtattgttttaatggagaagcaatcgtgagaagggcgctcgcgctcggcggggcgcgctcgggggtgggtgggtgggtggtgattttgacacatgttttatcgcatggctaaaaattcaactgatttcacacaatttttcagcatgaatggggcggatataggagtagggcagctagggcacattctattatactagttcaaccctactcttgagcacattctggctccgccgctgagcatgatatcacagacagccctagaattatgtggataaaattgtcgtaccaaattatttctcatacgtgtgttaccttttttttatttgtacaaattataagtagttgaacttgtaactcattgaattagaaaagtccaaaacaacacttttattttactaaagcgagtataggaaatatactgtatgtcggtataggtatatatctaggatagggatgacaggaccaattcaaacctcatattaaaactaggtacaggaaaattaaagccaaggagagaagtgactgttccattgactattatagcagttttttattcgaatattcttaaataagtttctatcttttaggtattaaaaaaggtccagatagggccgggatgccctaaaaccagcacacataagtattttctggtcattccaactccacatgtggtctaatctaaaattaaaaatcggtagtcaagccaatatgagcggatgcccacatatgaggcattttaaaaaaacaacacctctaagagagtctagcagacaaaccgagccagccctagttttatttattccttgaagttaatctttccacctctcttctctctcagagtccacctcattctctctcgcacttttctctcagagttgatcccactccattgatctctcgccgccaccaccacctcctctctgctgcagctgatgcccctcctatctgccacagatgccgcacgccccttgtcatctccaccgccgccacatgtagcgcctcctcctccaggccagtggatacgccgccacaagctcggggacggctagatccggccaccatgatctcgagggcagctagatccaccgtcacgagctcgaggtctacttcccttctcaacgtccctaccgatcattgtgcctccctcgctctctcgacctccacctcgccatgggccattggtcgccatgagctcgaggtcagatccggcaatttgtacttttacctttccaattcgagtagtacgtaatgcatttgagccaaaatttgtgattcactttttcaatggtgatattgaaatacaatttgggatagatgaagaaccaattgggaaatttttggactcaatgcatgggctcaattggcttgaatcgagccgatcagactttttgttttaaatcatgcacctcatcaataagggtttttgttttaaatcatgcaccgatgagcctgcctcatttatgccccttatttggggtcatctcggaatctggcaccaattagggttcctagccagcactgaaggggggttttgttgtagtgattctgtacatgttgattttgatttctcaaggaaagttgttcgttttcctcttcattgttccctccttactaaaaatgtgcattttttgacctcttcattagcaaagcattttttgaggaatacgcaaaagaattgtgcacctttgcatcaagaggagtaaaacttacaaagagcaaaacaaaagaaataacaaaccaaaagacagaacagaggtagggaaataaaaaggggaaaaggaaaaacaggggaagcttaagtttattctcatgataacagaggaaacaacctagcgacctaaagaactaaggtagcaacgcctgcgacgaaggccgggaaagcttccagagggtggcttcccgcgccattgccgcgaccacttcaagccatgttcgattaaattgattaagcaccagattgttcctctcctttcgaatggaccaagccccaaggggtgcaatcatgtcaaagccacaacactggtccttttggacttgtggtggctagagcacacaaccaatcatggaatgaggagactccggcgaggaagcactagtgtaacccgaggcctgaaaggatgatccatcaaagctgtaatgaattagggccctcaatccacaagcaatcagtcgtttcttcccattggtcatgatagatgctgcaagcggggtgtgggaggcctcttttctccagacgatcaacagtctagcaatgccagtgagcgaccaatcacaaaaagtagctatagcgaggagaggccatggattccagatcagcgagtgatggaatgggatcctgcccatgaatagtgcgtggtagggttagcaagcggagtaggaacctgagctttctcacttatagaggaaggagtccgacttggtccacagatagtgttgtggcacgtaccatcaaccagatcaaaaggtactagaagattggccatactcctagagaaccgcgaagatcgttgatacatctgttgtttcttaatacgtctgcgatcgagaggctccagtggatgcgctccagaacacactcatagagcgcaggcgcctagaaatggatgctcgcaccttgcaaccaaccatcttcccagaagagaattgatttgccatcgcctagcacgcacgtcatggaaacaacagcaaactcgcgttcctgcctagagtacggcatatggagaccttgctagggcttaaattgagatgtgcgttgggccgagatccatcaggacctaagcgcaacacccataagctctagattgtcgatgcctaagccagtacactccaatgagcacatagacctttggcaattaagacccattttggaggatctatggtgattagaaagtagactaagattgtgctcaggaccgctttgataaacgctttcattagcaaagcattgggttcccctttactgagtaggatttgtgtataaacaaatcgtaagaaaagcaaacaccttctgctgccagaacaccactaattccataattttaatcaagtgttgaaagattcgttggaatatgaaactttaaagtcactagtagagtatatgttttctttttattttttacccttctctaaaaaaataaaaaaaactagtaaagtatatcatctaccatataattcatcaactcactcttacacctacattactcattcatcaaatcctcattcatcaaatctaacgacccaggatcattcaatccaatacctcagatcgtccctactatatatatacctatacctatataccctctaataattcaccaactcactcttacacctacattactcattactcattcatcaaatctaacggcccagaatcattcaatccaatgcctcagatcatcccacgtttcccctatcccctccttagcccgcacgcatatcaccccactccccttgcgcaaaaatcacaccgctcgccactccctcacgtgctctccttccccaaatcctctcctcccgcccagatcgatccccctcccctcaccaccgtgacctcctccatcccctgccaccgcaagcgtcgccccgctccccgccgcggcacccgtgatgctgtctcaccccttactccaatcgtcgaagccaaagaccactgagccagcgacgatctcctccgcggccgccgctgaccggctccgccacccgccgaaacgaacgtcatgtgtgtggtgtggctaaatgtgtttgattcaatgaagggcgagagctggtgaagacaacaacaacggcggcgatggttcttcgacagtctgggctggcctggcattgtggcggctgacacaggcggtgccggcggtgggggcgagaaagcggctcaaagacggtctttgcggcagaccagtccaggcctgcggtcgctgccgatgtcgagccaccaatctcacacagaatctatgtcgtggtctccgccgctgaagccggatatctgcccactgtcaattcggacaccccgcattcgcgcgcggcgccaccgacatccgacatctctcacgcaacgccagccgccgcctaaccctaacagtcgtcgccgctccaactattagtgatatgccctaaaggcaatcatagagatgattgtatcatatactatgtttacatatttatccgactttgttccttgaaatagataactcattattagttaatgaatatgtgattctttcatgagactctttatgttgtgtgttgctatttctaaaggatccctgatcaaatatcatatgtggaacaaatatgtttagatgatcaacacatgtattaattgatgatcatgtctcatggatcatggtatagagataccaaattaataatgtggacacatgttggtgaacatgttgttggatagacccaacatgagacactgcaagagccatatatgttgtgtcatcagtgatctcatttagtgttggtgttgaatccttagacttaaaattatcatggttctcaacatgtgtagtagcttacttagggactgctaaacgctactccgtaattgggtagttataaaagtagttttcgggtatgctatgaaacatgtagtgggatatgaataatcaagatgggatttgcccctcctatggagagatatctctgggcccctcgatgttgtagattatggaagtgcatggccatgccaaaggtgattgaggagtcaatcacaagttatataatctatcaacaggttcgagtaaatgattgagctattagaggatagcacatatctaactttgagcttaatcgatatcgtgaggcaaaggggttcatacaagtatacactagaggttcagccgatatgatctttatgtatgcccggtgagtcaatacgttctgctaggagccgctgttgacgcgtggaccgaaaaggagttttcgggttacagccgagtgtacatgaacctacagggtcgcacgcttaatgggccggaataaagggattggatggggatctaatatgagcttaattcagatagggatccgaataggagtcctatgggccttggaggcccgagtgatggatcctatatattcgtgaggggtgtaaccggcggaggtattgcatcacgtaagaaaccctagccgtcactcccctccccgagcaaaaccctagccgcgcgcgggtgctagcacatctacgcgtggcattccgtccctgtacgtgtgaataccggtagaggcgcctctgatttgtgatgctgatcggcgtgggaatacggcgaggagaaggtcgagccggtgcgatcgactacttcctctataacgacacgcgctacttcgcgagaattccttcgatttcttagcgccttccgctgcgcagcgcgtcgagtggtaacgatctatgatctaatacttgcatggttcctggtttacgtgatagaaaattttgatttatgctatcgtagcctacgcgtatcccaacaccaaccgcatcacagcagccgccgggcgccatagattccgacgcccctccttcgcgtgcgacgacgccgacgcccggcatcgcgtcgccatcaattcccgcctccagtttgacgctgttggcaccccctcacacgcctccaaatcgacgccgccggcatcccctcttgccgactgcgtcgcgacgccaccgccgactccctcgcgccgccaaggatcctgcgccatgtgctctctgttaagccaccaccggaatcctctcgaccacgctggggacaaggtaagcatcgctcgatcccgttccttcaaccattacagttcaaatgcaaatttgcgaaaatagtgcatgtgaaataccgagcaaaccaaccaaaacaactccctcaatggcttagacttgaaaataaccaatttgtttttagtgcccacaacaaaagcagccgcagcagcagctgttgcccggactattttgctgttattttgtgagaggatgtgagattagatgagatggcgtgcagatgcaatacagggcttgtgggaaattggaaagacttggcaggattgatgggttaggtctttgtatggttctgaacatatttgggaatcaaactgcacgtaggcagatagtcttcctgagtggtacaatcaattaagggaatttaacactcactagagttcagtttccagttaatcagaagcaataaattgagggaaattgagactcacaagagtttcatttccagtcaatcaaaaggttagttttttttttgttcaacactgacaatttccaactcaaattctgttgatgcatgtaaacaatctgtgagtttagagcacttgaaactaggcaataaaattataacactgaacatttgggaataaattactttgctcaaaccgggacccaacatcaccagcagtaaatttctgaagtaacattcatatgtgagatgttaagttcatcatttttttttgttcagtacgagttttcacagcagatggttaatggtttcaaatttttaggggtattttacaggtgtttgacggttatggtcgtacagacgaagcatcttttgttcggaagaacttacaaaggtccatagttgatgcttggttgacttccccagcagcatccacaatgcagttaggagtgcatttctacatgtttatcggatgattgttgattggtacctgccatatctaactatgtatatctatgtatttctactatgtactcctatattaagtatatatttctgtgctgaaatggaaatagaaaaatggcatagttgtttttaatatgcattgggccgtctgaaatttagaacactgaaatatacattgttattgtcccttgactttgcttcttatatgagtggttaagtgaatttattactaaatggttaatagtttttgaattgtacaatggaaactgggagttttctatgttttataaaagtttgaattgtataaagataagcatttaaagtaacctgaattttttaatattgagcatgctggcagcttgctttcaaaattcctttgaggaattcagaatatataaatgtaacaggtttgctatggcacttccaaggaaagcagcgaacctctcctgtttgctatgggacttcctggttagggctaaatttttgtacaaaatctgtgagtaacagaattgttctgatttgaaacagagacctctggtttagagcatgatcactgagttagtactggcattgttttaaattcaagcactctcctctggttggaaactttgatcagttaggtttgaattatgtctcctctttatgcaaataatttctttctttttaggtaatgataatttgatttagagtttaatttggcacaattggagtattaactctaagtcagggctaaattttgtacaaaatctgtgagtagcataattgtttttgacctgagacagagtcctaacatgatatcagagagagttgcaaaattttgtaacgtctgttagtaccagaatcattctaatttggaacacaactcctctgattaacaactttaatcagtcagtgtgaattgtgcctcctcttaagtgcagataatttctttcatgtcaggtaatgatcatttgatcagtccgccgtgctctcttaggtatcatcatgggcaatcaagtgtggacctccggtcatattggcaacatctacatccagtcagatataccacggcaagcacccagtccttcaaatttccagtgtaagcatccataatcatccacttactacttatatgcatgaataacattatttttcaaaactgaaagatcaaaggtatgctctgctgtggtggatgaacaaatagcccggtgaggatcgtgaaagtggagtgaagacgaagcagagtatgatgtacgtcgtggctaaaacaagagcctcctattatggaaattatgagtatggttgtctcttgaatcctttttttcctgctgaatctataactccaccgtctcatttcttcaccatataagtatgcttgctgaaagagaagtgaagaggcgaatagataacttatagcctagcaggcgatggatcattagattgtattctaccctactacgaaaacaatctttcgtggcggccattttaggtttttgctggcggatatcggagccgccacaaagtaaaggctagttaagatgtagcatctacgctagcagcgacaaaccgttagagaagatcgatttttgctggcggccggcttaacacaaccgccagcgaaaattgtcttcactggcggctggctaagacaaccgctagcacaaatttcggttttcgctgtcggaagataaaacacccgccagtgaaaatattttttgattaaaaaagaagaaaattggaatccagattttgaaaaaaaaaatcaaaatcaccggcgtgcccatcctccatcgccggcgacagggaggcccaaggtcgacgaggaggtgggtcactgccgtagagcccagccactgcacctcgtcgccgagctgccatccaccggtgcgaatcagacctgccgcctcgcaaagctagtcgccgccgttggattcgtcgggcgacgccgccccacgagtcgccccttctccttgtcaccgtcgccggactcgccgcaccgcgccgccccgcgagtcgccgccgctgggcgacgcccccccgcgagtcgccgccgttggatctgccgccccgcgagtcgcctccgccggatccaccgccccgtgagtcgtcgccgccggatccgccgccccgcgagtcgcctccgccggatccgccgccccgcgagtcgccggtgctccgcccgtcaaccaagccgccagtgctccgcccgtcgaccgatgcgcgcgccacgagcttcgtcgtcgctggcggctggatggagaggcagagaaaggagggagaacggtgggtagataggcggagagagaagggagagagttggagaagcgcgtggaataggtggatttttcgcggcagcggattctaataggtggacggtggattttaactcggccgccgacaaaaatctattttcgctggcggtctgtagccccccaccccttgttacgtttttgtgggcggttttcgcgtataaccgccagaaaaataatagggtaacgctatgaaaaattatttttctagtagtgctatgtttctctttatctttttggtttgagcttgagaatgcatttttctgttggtcttggtcttgaactcttgaagtcacacctggatggatgggtgttcggtattctcgtttccttttacccaactcattttatttatgaatgataatgtaattttgataatttaattatccaaaaattgtgggataaaatctttatttgactccgaaagttgacctccattctctcattgacatgtggatccatgaccaatatgtcagtgaattatcatggaaaaattttcaataagagttgcttgtagttattttgcatatcatgagcaaatagtatttatttacttataagaatttctcagtgcatcaaaaaatagatggttttgagtgaagatataaaggttaccatgctattttgcgcacatggttgtctttaaaatataacaactctctattgttcaatctttacgtgagttttaaatttatctaattatatttttgattgtgttaacatatgatagtctttggtttaatgttatcgtatagttagcacgggtaagttactagtgtagataattcattgatgaaaattcgtgtaagattgtaagaaaaaacattaagacttacgctgtggccgagcgatgcgccaaagctgtacccgcgcctgaaattggaggcgtcgtagtcggtaatgtccatactcaccgccccgaagccctggcgctccggtacgggctcgccgggcacggcgaactcgtggctgccctcgctgctcttcccgtggctgctgctgcagtccttgctcgacgacgcgtcctccttctccccggcgcccccgccgaggttgaggaagtcggccaccagcgcgtcgccgaacggcggcagcccctgatccgaggagtccttgagcgggtcgaacagaagccacgacgtcgcctcttcgtcttcctccccagcggcgtcggcgtcgtcatcgtcgtagtcgcacctcctgccctctcggattggccaggaggagttgacaccgcctgcagggcggacgacgaaggctcccccggcgccgggggcagccaccacgcccattggtacgcggcggtggcggcgtgccagcgggttgacggagtgcacgtcagcgtcgcacgtggcacagagcgccgccgaatcggcgaggcaatagaacgcgcacggcgccgaccggcacgagtcgcaccgctgcggcaggccggggaactccggctccaacttcagcatggctgggtgcctgtgcgaagacgtgtttccagcaatggcaaagcttagctagcaactcctattaattgttcaattcttatttttccagtaatagtagtacgtggcttctttacttgtttttcgatcggacatgcgcaaacctgaaccacacaaagagcatggcgtgtggtgttgtgctttgatttggtttggtttcttgaggtcgtggatgcgagtgggacaagtaggcacaaatgcgcagggagacgaagcaggcgaatcagctaggtgaaaacgtggcggttttctagccggtgagagcacttgtaccttatctagtggtagggatgcaagtggatagtcccgctattcgcataaaaacccgcttgttagtctatttttcgtatggtagtataaaatttagaagaaaaaatgaactagaagtgaaataagcggaaaaaaaaaaacctgcttgtccgccccgcttgcatccctatctagtggtctcgactctcgagtggttcctggtaggcccggtcgtgctcgcttgggtcccataggataaagggctattggcatattgctcagctgataaaacgaccgcttctagacaagtgcaaagtttacctgaatcagatgacctttcacaggctctcgtagcaaatatatatgactgaatatttattaaaataatgtagaaattaatatgataaatgatgaatttgatagaaatgtgtgaaaattatatgatgaatgatgatttaggttgggttcttttccccactttcaacttctaatttctcgtttttcgcacgtatgcttttaaaactgctaaacaatgcatttttcataagttttctattgaaaagttacttataaagaattatattagtctaatttttaagttttatacgcttaattgattatacgttaatccatcgcttggtttagcgtgccaccaaataccgccttagcatgcttacatattgatttttataatgtaataatttgtagttgatgtatgcagttacatttaagttttaagttttagtatgtactatgcgtgttgacagtgcttagtgggttgacgtggcttacttatatgttaactacttcctccgttttaaaatatttgataccgttgactttttaagtacgtgtttgaccattcatcctatttaaaaaatttaagtaattatttattcttttcgtatcatttgattcatggttaaatatactttcatgtacacatatagttttacatatttcacaaaaaaatgtgaataagatgaacggtcaaacatgtgctaaaaagtcaacggtgtcaaacattttgaaacggggggagtaatatatatttatactttcatgttgaacttttaagtgttcagtgggttgtagcttcatagaagataccaatcccttatggctggtggttggggacggatataaaataccatgacaatttttaggataatatgatttttattttaatttctataggctttaaaaatatatatcctacatctccaatgttattacatgtaacaagcacctaacagtgtcatatatctcttaaatcatcgatgtagcttgcttgttacctaaaagtacttctcattctcttttttttctttagggaatccttctcattttctttttctagacaatgttgacggacttctaattaactgcatgccagcaccacttccccgtacaccactagctatggctaggggtggcaacggggtaggtgtgggaattggtatttgctacgcacacacataaatctgcaaacacattgatgctgttgtagtactatctaagaacatgattcaacaaaggacaacaactaatgataggattggaaactctatcaagtgctttggccaccggccctcccctggtatgccaattagctgagtccagccttgtcttctatgatgtacctgaatgtggagggatgcaaatgacaaatagggctgtcaccacctgccgcctaccccacttttcttagaccacacaacaaacgaaggtaacatctaagttagacaccacgcgtaagttattgattactactctagccttgcgcaaaaaatttcttctttatccagagtcctagtactagagcacttaattataaactaagcgacgaacccacactgatgagaatatatctcacttaaggaaactaattaaatagtataaaagtatctcgaacagttactttataaaaggaagcttccgccgaggtacaatcgagaagaaggccgacaacccccaagcgcttctccaaaactccgttggaagaatgtcgattaactcggcactcctctgaaaattctgggagagaactccgatattttggggcactccttccggagcttcctctcactttctcactataaaaacatactaaagatgaaactacatgtgagttgtactctacttgagctcaagtggtgtgtgttgcaaatatgaaagcctacttcttatatagtgtgctaatgatggttgtgggtagttggaaatgtcagtaacacccccctcttaatcgtcattgaggaccaatggggagttgacacgtggaagctagcggttagtagcgccgaggctagttcggccaaaccacctccaccgtctctggcaaccaacttccctttgtctctaacaggtgggcccctatggcggttgaggatggtttggcctcactttaggccggtttttagtatcaggtgggccctccaatccttgtattcgcacttgattggtcggaggttcattttttcgcatggcgggtatattttctccttaaatgacctgcatgcctatctttaccaaagctagtgaaaatggttagtaataaactaccaccactaagttgatataatattttacttcttctatgcaggagttgactattaaattttgtacttaacgaccttcaatagtggttggggatgggttgggctggaacgtctctgccctcggtccttgacttcctcacctgcccccacttccgaactgatgatcgggtggaaaatgtctcccatccccatacctgttgggtccctgcaccaccctcggggccctgcacctatgtgtcatcgcatcttttaaggacaacaagcggcgttggcctttggaaagagggagattggaagagaactcagcgcgtggcatgatgcgatcagggaaccggtgagtgagtgcaacaacagaagcgttcagttgggtcgttgtggtacttatgcatgcaacgctgaggccgtcaagtaggcatagaccaggcagcggaggaggggcttagcgcataacgatgctggcccacgacataaagaagtgcgtgatagtttcgcgtaagtgtgagtggcttacctccacttctgcaggtagtgagataggctggtagtggcggctaaggaaattggaatttggaaaggtaccttcatacaagtcaagctggcttgcttgtatttcagccttcgttgggcctactagtattggaccatttcttgtgaataatgactgttgacggctattaagtaccaaattctcaccgtcaatacctgcataaaaccataaatacaaaacatccaacatagtggtagggtttatttctaacaatttccacgagtgttggtgtatattcgtatgcaggtgacaaactacctatgttgagaaaaaatatacatgaaggaggaggagaatcaaacgcgtatccgaacatatcgagttttggacccaaaaatccaattaaacaccttcaaatgggccttccatccacaccaatagaatgaggggcccaaaatgagtgtctaggccgaaaatcggagccaatggagccgtcctaggttcggccgaaccctgagttctgccgaaccattacggaggccgctggcccatgcccaagttgcgttcggtggataacgacttcccaatgatggttgtacctgcagaaactgtcatggacacgtgccaagaggagaaaagagatgtcctttggattccatggaggatctccacattcccaagcaagctataaatacccctctcctctctcattctcacacacacttgaagcatgagctgaattaaaagaggctctagtgtactttattgtatattagaatagggagagagtaaggtagaagaagttgaaggaatttcggagttatcggcaatcgtcttcctatttcattctgctctgtttattactcggattataattgaaatatcatttgagtaatttagttttgctcggtgagaattatttcttggttagttcctaatcagagtacgggatcatcgttcactataattcagtaaaatatagtgactactttagtgagttataaacactagagtagttatgatgaaccctgagttccactcgacactcaaggctgttgttggcccgatctttcggtgagttgatgataactacgatttaggacgaactttgacgatcatactacaactgtacaagacgttgcattgcgccttagcgatcgatacacctctttgtaggttgttgatcttgccggtgcaaatcaaccctattcctgcaagcaaatcgaagaaacaagcaagaacaatataaaagcaatctgatattgcaaataagagttgaatacaaatgataagttggggttctgaagaacaagcatacggatggtctagccgacacacgcgctgcaagcatgaagcaatggctaaactttaatctaacaaaacccgagaaaccctgaaggggtacctagctatttataggggtgggagggcgaccaagggtgccctagggtcgtgctccaccaggttggggtgcaccccacatgggctccacttgggccggggtcccaaacgaagttacaagcccattggcccaatataggtgacacaacaccttgtttcttcaattgcggccgactgagatggaattcggagatgaggctggattcattggaaagaggactccaagagttttccatcaagtactcacgggctgaaaacggaggtcgtatacagattaggcggccgttcgaaaccagcagtgtagcaggtggccgaatcggattccagcacttgtaggacttgatcatgatatcttcttgttcatccatgatgtgaggaacggttgtatccattgtagccatggtcacatcaagttattaattgcttagacacggtgtctaggtagttatttctggtgtttgctccgcatcccccagtaggtgttaggtaggcgtagaggtggtgacagcactcaatatcactgaagtcatccctgtccgggtgcacagtagagcgatatctgggagcagcgagttggccagtgcccgaagtaccacattaggattaaagtttagctttctgtagacatagtttcttaccggtaaaacctctctatccttttgcctatctgtagcttcgtgtccttggatgaactagtgaagagctgacacacacgtttcctgtggaaatcgataccttagaatactcccgggtgaagtgctacattggtattttccgtgagcttgcagattctatctgtgaggttaagaaataccaacaatgactagactttttatgggctttctacaaccagggccccattggtcatttgcgggtggaaattgatccctcaccccgcataacttatgggctctgccccgttcaatccatggatgcactatccctggccccgtaagggcgggttgtgggcgctcgaaatttatactgtccagtgcaatttgtgaccgccacataattttggatgagtcggatccatacatgcataaatagccacacacacctcaatgtgcccatggtcacaaattgacaccaatcgatataaaatacacaatgccgaataatgagcaaagcagatattgttcagactcaacatgccaaatgtgttacacatctctcaggagcctacacgtggaagcagatggtgagaggggccgaagtcggctcaggcgaccttgtggttcggccgaacttctagcccacctcccggccactccttcggctgggagaggctgtctggtgggccctcaatatgctgtaccatggttgtgctcaattttaggtggttttgattgacatgtggggtctccattccgtgtaaacacgtccgattgtacggaggtgtattttgtcacatggtgggtggttttcatccatatttcacctgcatacaaatattcactaagacttgtggaaatagttagtagcaaacactacctctaagtttggtattccattttatattcttctatttgctattatgtaggaatcgatggtcgaattggtacttaaggatcgtcaacaataggctacaattgttgtgtcaagggactcgtacagtggatgagtattacaaggaaatggagttgctcttgatccgtgctcacattaaagaagatgagtcgaaaatgacaagatttttgcatggtctcaatgatgaaatttctgactttttggagatgtttattcaacacttttgcaagatcttcttgatcaagcccaacatatggaaaggtacattcaataagaacggcataattggtcctctagtggctgctccaatgcagtcctatggcatcgcacgcaacaaactatcacttttgttggcgctcgttctcagagagcctccacacgagcctctccactagctgctatagccaagctacaaccatcttcggcatcttctccagctacacgcaatgagtctcgtcggcttgttacacctatagcaaaatcctcgtcccgtagccgcgatattgtgtgtcacaaatgctaaggtcgtggccacattgctgctgagtgccctagtcgaagaaccatgcttgtgaatgagatgggtgaatggaaatctgcaagtgagaccaaggatgatggttagtgtgaagaagagatggttaacgagcaagcggatattaatgtcgttcatgcaaaacttagggctagattcactttcatacacgagttttcacccaagttgggatttgtaccgtatatttaccttggtaagcgtaacacttcacatacattatacaaaccttttctatcctataatgtacaaataacaccatcagttttcttttgcatagacaaacgatggttacagtttacacaatactccctccattttatattatgagacactatgacatttttctaagtcgaacatctttatgtttgactaagtttatataaaatcgtagcaacatttttaacgccaaacaaacatactattgaaatatattcactattaggtttaacggaacaaattcggtgttataagagttactctatttttctataatcttggtcaagccttatagaagcttgacttaaaaggaaagtcaaagtgcattataatataaaatggagggaatcatatcttactataaaattgatgtccactaacttctaaatctcaatgtaagtgtgatacatcatcacccactagcaattattacatagagtatttaaatcacttgcaagtgtaccacatcattacccactaataattattacctagagcatttttaatatcaaacaaatataacatattatttacaattttattgtatttttagaattcaacatacaatcaatgtcaaatcattatctccacatcattttcacattatttaaacatgtacatatatcattctataatgtataatatgcattcatctacatatcccacggtaaaagcgcggggtatcaactagtatatataaatgacgacccagaagtgggaaccggtgataacggaataagacaataatattttcctctactgtgcaccatagtttccttattacgtgccaacatgagggtagttgtcactgaaaactactcatagcaaaaggattatgcgaaaggataatattgtctttatcagcgaaaagctaattatatgataggcattaatggttgaaaggaaaataattaatcgactatcggcacaatgagaaggataggttgcgacccgtactccacttattataggagagagatttctaattttctcgcacaagtaactattgaaaaaaatagatggctggtccaacgatcctttttttttttttgaagagatggtccaacgatcctactaaccttttctttcattatggaatagtttttagatgtgaatcaggtggtctgctacgcattccccattactttctatgttttttcgaagatggcccctctatttttttaatagtatgtttgacttgtccaaaaaattttaaatatgaaaaatataaatcatgcttaaattatacttcataataaaacagagtaaagagtaattacatattttttaatgagacgaccaacacacttatactctctccattcacttttgatcagcttatatataagagaagtgaatcaagaccgaggaaaaaaagcatccaatattccatttagtgcgcatcggtgaaggtatgttgttgtttcaggaagagcaaatgaaacagatgcttcattatgtagttgttggcaatttttttttggcaagaagataaacacatttggaacacctaaacgccttgcggtgatatggagtcgtcaatcatcccgatctcgccaaaggccaaatcgagatgggttccgtagaaaaagctaaaccggctagcagagtcgatttagagatcaaaataggccgatttagatcgatacgaggataactacccgtctcgtgggcaaacgaaaggtttacggaacaaacctacaaaggggtaatcgtattctcgcagcgacgacggacggtttatggcgcaaaccacaaagatggacatagttgaaaagtaaaagtaaaagaacgatttgattttacagattgttggggattggggttgaaccagccttgacccttataaaggggttggtcttgcctcctacaagtcctcctccacgttcaactcagtatagaaaccaatgaaaacccgaaacatcccttaccgagcaagaaaacccgagaaccaatgaaattcgcctcggacgcggactctaccggtctgaccggccacatgcctgcggtcagaccggctcagaccggacatacacctgtggtcggaccagcccgtgaaggaaacccgacgctttcaaaactttagtatttttccgtatttcgttcataggtatcaaatttaggtgtaaacagtagtatatgttgatcaaaagtgaatggagagggtataatattacagaaaattcaacggaccggtgcatataattctattggaaaacgagggaataatttatttacacgatctgcatcatcacataagatgagacctttacttctcttctgtccacaagcaaaccaatggaccggtgccagcattccatccatgtacatcgccatcttgccggtcagcgtgcactcatccgcaattcccgtccagttacatcaacgtgatgcgtcagcctcaggctgggaatcattgctcatccaggaccgtcggatcatcagtttacccctcagcattcgactagtaggctagcgcagaaagaaagagagaccattccgtccattcccctcctgcgtacttccgccgcgcggctcgccgacgcactcatcccgctgccgcgcgtcgccgcatcccgtccacggccgcccgcctcctcgactacccacagtcgtcttgctcgcacctccgccgctgcggtggccgccggtcccggtgagcaatgagaccgagactaaacgttttgttttatttggggtttactgttcgtctgaactcgaatcgtttggttgcaaggaggcggcctccgatttaatggagaagtcctacgcgtcggcgagctccggcgagctcggcgtcgtggcgggtggtgggggcaggtcggtgcgggttataccactgcggcatccacaggaggcggtcgctgggtcctcgccgtcgtggtggtccgtggtgatggtgaaggcgcggggaatggggccgcgggattgggcggaggcggctctgccctgcttgtcgtggatgcggacgtacaggttgaaggaggatctgcaggccgacctcgccgctggcatcaccgtcggcgtcatgctcgtgccccaagtacattctttaccctcgtgattcgcaacatttcgtattgctatgcacggcttcaactgttcctaatcctggttatcaaacgggaaagatatggttatatttgttaatttcaaaactcattgcctcgaaacatgatgtagaatgtccttgtaattacctgattttttggctactgattgaacatgttaatctccaggttattctcttgcttgtctagttagtttgtcatcatatcgccaggaacagttacataattgttttttgaagttattacagtttactgcttggtggtcgctagttctaagatctaattatgtcaactgtagtatgactggattattgaagtatagaatggatgagtgtcaattcgtctcctaaaaatggtctattgcacacggcgctattatttagtggatccaaccatcttttcatgctggcccggaataagataatcccaatttccatatatggagttattttcagcaatgcattcagctatagatggaaagctctatcgaacatgtagcttgcttacatatcattcggctaccccttctgttaacaccattgcaaattgcagtttgaggacttaggttggtttgccttctgacaaatactgaattttctggacatcttttctggtgtttctgcttaataagttgcaaactggtgtatatccttcacataggctgaatttgccaaatggagaacataaattagccttattttgggacgcatttgttcaacaatttcatttctattcatgaactttggtgcatgagaatgtcaacatctttgacagttgacacttgatagtccagtcatctgaattttatcttaagtctgtcgaaactttttaaaagtcttccgatacaaatatgcaatggtcaaagtcctgaaaataataaccaaaaaatgccagaaatgaaaatattaataattagcattgtattgtaggcaatgtcatatgcaaagttggctgggcttcacccaatatatgggttatgtaagtatttatatcttttgcaactcctgtctttgtagttttttatatttgtatgtctttgagcttaatcgttagtatgctatttccatggctgaacagacacaggctttgtcccgctatttgtctatgcaatttttggctcatcgagacagttggcagtgggtccagtggctcttgtctctcttctagtttctaatgtcctcggtggtattgttgattcatctagtgagctgtacacagaattagccatattattggcattcatggttggtgtattagaatgcttgatgggattgctaaggtaattctattctactctgggtagctggtgttcttttttaagtcattttacagtagataggacataatttaagaagtatggacacatctacacatattcctttggaattttacacttatgaatattcaagacaaatgctttattgtctcagcattatagctatgactatagcttaaaattttggaccaccagccgcatatccttatgcttttcaccatgttctgatgatatatcctttacaagattttttactaaagctatagctataacttgttatcccatatgttcatggaaagtgatcatgaagttcatgtagagggcaacagtatataggtcctgctacttttagagtgatactaggatcatttcatgggtacaaaggtgttctgctcttgtggggctctgtttttttggggctcacataaacaaatttgttgtctaacagtcatgtgtgccaatacaaaagcagcaaacgttcataggaaaagctgatatatcacaaccagatatttttgaggatttcatgactatttcatgatgcactgaacaactgtcgtgtccttatgttatgcacacatgctaattctgtggcccaattcatcgctgttgtagtgcaccgaaaaacattagtatgtatttcttgtattttatattctcaagaaaatgattggattgaacattaaaagtttgtgcgtatgcatctatagattctatacttcctaaaatgaaggcactggcaccaccattacctcatcaatttcattttctgcaaattgctccctggattcattatgattacacactggactttccatatgttgtttttcttttcttatttgtccttcaagatcataatttaatacaaaaaggtctaagatgattgaattgttgtgtatatactagtaatatgcccatactaaacgctacggtgtaattctatttgtctttaacaacgtttaaaatttcatctgtatatatgtagtgtgtgaatgaattttcaaaaatgtatgtgaacatttaacgaacctatgtacatttagctagtaccgttatttttctcaaatacgcaagagaattgtgtatcactgcattagatttaaatatttaagacacccactgctgtggtgatggaaaaggaaaggaaaataacaccaaaatcctccaaaaccaagaggacgtgaccaaaaacaccaaaaaaattctagccacctgctacctccaactgggccaagcccctaggtcctgctaaacaccacaaagcccatcctccaaaacctgcctaagaaacaactgcacatatggagagactctgttaaacacaataatttcggtgcttccaaatcagccacactcccaaagtaatgagcgaattcagatcacacttccagtgctttgaaccggagaaatgatctttagccaccattcacaaaaacaaccatcctctggttgtggtgaaagatctgtccgaccaagccgatgaaagaggagatactaaacttgtcatgagaagacacaacctatcaaaatatgttgaatggtttcctcctcttggtcacatagcggacaggtacttggatggggcattagctagtaacatattcatgctcttccatgtttgcacacttcaaactatcttctaagttttagggggcaaaaccaaaatcatttagatatgcttaatttttactatagttatgttgccaatgatatgtgttcttatttacaggctcggttggcttattcgatttattagccattctgtcatatctggcttcactactgcttcagctattgtaattggtctgtcacagatcaagtatttcttgggctacagcgttacgagaagcagcaaaattataccacttattgagagtataattggaggaatagatcaggtgggctttgctgtatctgtacgatcagcttatagactgtttattttcccatttaaatttttctatgcacagtgcatgttccaatgtaatccaattcttcaggtaaaaagcatacataatttgaaatgtttctgtcagatcataatacgctttttggtatttgaactacatatttttcactaacttaatatagcagttccattttgcagttctcctggccaccatttgtaatgggatcaagtttttttgttattcttctcataatgaaaaatctagtgagtttttaatttctttctttatcagtatggttcttctgttattttttttttctggaaacattacaatcaaggggagacttctattttttttttaccttgagaagcgaaacttttttcagggaaaatcgaataaaagactgcgtttcctaagagcttctggtccccttacagcagttgtgtttggaacaatttttgtgaaaattttccatccatcttccatatcagtggtaagaaacacctacattattctttatatttcttactcttagatgttacaaaatatgagcaatggaagtactttataataagaaatttactctgatcacaacattatctacttctatgaatttatgtctatgaagtgggttattatactacacttaccaatcttttctcccttatcccttagaatattatttacactaaaaagttgtggttgctttttccaatggaattacttgattcgttgttattgaatgaacaagtataagtaaatcttattaattgtggtacaatagtctcttagctatggttctctagtttagagctttactttgttcgtaaattgaattgttatagacattcattcatggataaggtattgtccgaagatcgggataaaggcgggatctctcttgtcagcaccgagcttgtcccagttgtccatagactcttatcaagctagacctagctttatgattatttattgcttaattggtagtgggttacatgggacctttttataaggagggtttctgagctacagtagcatgggtactattcacgtgaatccgtgagcagcttaccccctaataatacaatctctacatccttaacaaaccatttctttagttgctaaccaaacggatatgttcctaattaatcgaactcataccaatcaacgaaactaacgatatgtcttgggaataactacgcaataggtattattattcttcattataaaaaagtagatactattattcttgaaggtaaactcctaagcatattactgcagttcatggtagtgtttgctacattatcaacacccacaaaagaatgtttttcattatcatttgactctttttttttgttatatgatgcattgatgcttcttatattcaaatgtgcgtataagatatattttagttgttctttgtatttagttaccttttttgataaacatatatattcaacatttaaatgatttccattttagaagaacgcagaattaggttgttttgttctgtcggttgaccataatttgtctgtcaggaaaaactatactttatgtaatcctctatttcttgagtgcttaggtaggtgaaataccgcaaggtcttcccaaattctccattcctcgaggatttgagcatctgatgtccctaatgccaactgcagtacttatcactggcgtcgccattttggtaaacaataaatctagtatgtattagtcctttttacttgctttagtgttattcaccatttgtatcatacaattttaggaatctgttggtattgctaaagctttggctgcgaagaatggctatgagttggaccccaataaggaggttagttgtaaatcattaactaatgcattgaattcatgttggggcaagctgctccccatttattgtcacaaaaacaatctctttatatattcatgttatgtggtataaataataggttccatgcacaatatcttagaggaggtcataattagtagacctcttctacatgcataaccaaatttattaaatattctttacatattgatcatgttataaaattacacaatgatttttcatgcacattatcttagagagtgacaatttgcagactaaggatagttattagtagactaacggttagtatgtaaattgcatattaattatatgaatagttagtgcaccgagaaatggagtagtaatcatagttattaagaccggaccggtgctcgaaccggtaatacactcggttcactggtttattggttggaccggtccaaccggcggtttattgcggttcaaatagatttgtattatactattatcacatcttggctcatagcctggtggttgatgctttatgcggtgacatggaggttttgggttcgattcacaagtactacatcatttttccctattttctaactccacgtgacgcacctgcaaggctgcaacctgcgcgcttctgtttcctccacgtgacgccgttccagcagttcaaccagctccggtttttgtccggttctttggaaaaccgcccggttcaaccgagttcttgccgatttgattgcacagcgatcttttaggtgaaccggaccggccggcgccctggtttcggttttttctagtcggacagccggtccggtccggttctaataactatggtagtaattgtgcaccaaatccttttttatcatcttatagtttatatttaaatctttttagagcatttgaaatttaagaacaacaaacaagttactccctatgttttatattataagacgctttgacttttttattagccaaacttctttcagtttgattaactttatacaaaattttagtaacatttataacgctaaattagtttcactaaatttaatattgaatatattttgatgacatgtttgtttggtgttgaaaatgttgctatgtttttctatactagcaaaaatgcttgtgtgttttaacaggtgaagacatttttcacaattgataaactctgtcaatttaaacgacaaaccgaaacaagtcaaacaaaacaatggcaaaacaaagtcaaaaatcatatgtagtattgaacccggttacactcgcttcatgtgtcatcacacgaagaatcctttatgtacatctttccatagtctcacaaatcgatcgggtggctattccataagttgacacgtgtattttgctaaacgtcatcgaccaaagattgaaattttgattgttcaattagtgaaagttttttacctgtagatggaaagcatttgcaaagtaacaaacttgccgcatgcacaccttaatgataatttcaaaaggaaaatatttatgagagaaatttggaagagaaaaaaaaggaaaaaaggagaaaaggaagagaaaagagaggagattggaaggagaggaagaggacagaatgatcgtgagaaaagaaaaggagaaatagaaaaaataaaggagagaaaaaaagacgctagtcggggatgcgcgcgggtcaaggcggtgggatggtgtgggttggactgggagggggagggggag

SEQ ID NO: 23310 - DNA, 2230 bp, Oryza sativa
agggggtgtataatagttattctagagtcacgtcgaattggacataggtgacattgaaccaactcaaagatgatgtaccaaaattttggtgtaacatcttcaatttttataatagtaaagaaacttggtaaaacttaaagattgactaggaaaaaaaagtcaaaacatcttataatatgaaaaggagggagaacgccaaaagatgttatgtaaaagtcagtgtgtctgtgaccctgaggaatttttttatattttatacctttttaatataatattttaatactaaaccatctaaaattttattttcaaatgtgaaccttttggccacaccaagctagctggcgttgcctattaactttgccacgccacatgtatattggcgtggcagtactgccacattgtgttatacataacacgtcatcagtgttaccacgccactgtaattggtgttgcaattgtgttctgccatgccattttctctggcgtgacaagcttgccgatggagtggcgcatgcttaagcttcgtgaacggcttggctgctgcttcactgtacctgtaccacatgttgttccttgcttattgctgttgcgtgacttcgtgagctgcttgtgccctctgctacatttccttggcactgcttttgttcaattggcccatacagtcatattagctgcttttatatattctgcttgtcgctttcctttggctattatgtgtacagcaatattgcaaaaacttactcccaagctgatatgggcttttagctcattagcttgataaaaaatggaggtagtatatctttttatgcgtactgtcttctcccggtgaccacctaggcaattactcttttttaaagctaaaagttgctacatttccaccacttgtatttaagtgagttagtgtgtaatatcgtgttaacatgtgataaattggtaaatattaatatttttaagctgatataaataagttaaaacttgttgatgagattagttagttatttcacgatctgagccaaacttttagctcgttaaaattagcaagtcgaattgatctagcttgttatacatgcaagtgcgaagggccttttttgttcgaagccaaattttatcctatcaaattattggtattttaaatagcatcaaaatttatatgatggtttattagcgcacaattaattaaatactccctccgtcccagaatgtccagattcgttgtcctaggatgggtctcatcccatcctaggttgctatattctgctcctaggttgctatattctgggacggaggtagtatcagctataaaaataaaaatgaattaatatgatatttttaaaaactcctatatatgttttttttttaaaaaatggcttattgtttagtagtttgggaagcgtgcatgcgaaaaaagagagaataaaagttaggaaagtatggataagaacacatcctaaatgtataaaacacagtaggatagcagagctagtagttataccagtattcaatcccaccataattaattagtactcttattttttctgatttataatttagcgattacggaaaaatgtagcagcaccatgctaacgcaagttacatgtagcagcaatgagcagctcatttttttcttcggacgaagagcagctcaatcgtgtaacaacaataattacatccccggtactgcagcaagcaagcaacagcctgtacttaagcatgcatgtgattagtctctgccggtggcaaagcttgtcacgccagagaaaatggtatggcagaacacgcttgcaacgccaattacagcggcatgacaacactgatgacgtgtcatatctaatccaacgtggcagtactgtcacgccaatacatgtggcgtggcaaagttaataggcaacgctagctagcttggcgtggccaaaaggttcagagttggaaataaaattttagatggttcagtattaaaatattatattaaaaaggtttaaaatataaaaaattaccgaccctgagtccctcacgtctgtcttaactgcaaactacacaaagtttaacttgatggggttttttttttctgatggctgagttattgtttgattccataatggaaaatgtctcaatccattattccggcacatctttgtataatgcttataagacttaggagtttgtgaagatctgaaaacaaatattgtgtgttgcttacacagaactgtcaggcactcttatacagtaggaa

SEQ ID NO: 23311 - DNA, 6547 bp, Oryza sativa
tatttatctgtatattacataattaaaattcttaattcactagagctaagcttcaaaaagctgattattttgtactattctttcaggctccttttctaggtcagctgtgaatcatgaaagtggagcaaaaactggtctatctggaatcataatgggcataataattggtggtgctctcttgtttatgacacccttgtttacggatatacctcaggttagactccacatgtcttgtttatttgacagcacccttttaagtattggttccatgtagattgccatctgagaatcttttttgcaacttgttttttgtaattactgctctggaagtcgtatttgtttttccatattcctgctgcattttaatgaaaataatgtgaaatttggtgttgcaaacaggtccttgttgtatttgtggtatatttcacagttcaagttaatttgaagttgtacttttagcagatctactgcaactaatttatagtatctcttgtgtataaaagttaataaataacacaccttttaatatattcaagttgtttacagttaagtaccaaacgtaggtacagttttgctttttgaaatgcatttgcttttccattttggttgatgattatgcctgtagatacttactaagaaactgcaacaataactacattcccctgcattaatttggtttttttgtctgtactccatcccagaatataagaagttttagagttggacacggttattaagaaagtaggtaaaagtgaatggtggagagttgtgattggatgagtagtggaggtaggtgggaaaagtgaatggagggttgtgattggttgggaagagaatgttggtggagaagttgttatattttgggacaaatcctgagagctaaaagttgttgtattttgggacggaggtttaattagcaaagaaactggcctatgtaaaatgcagtcttacttgagatcctctattatcagctaaaaataaccacagttttgtactcttgatacttcaaataaaaaacataactttattgcagaaatcaacttttcagccccatttgttgcattaagcctgtaaccaaatgaatcaatgttatgttggaaacattgtactattgtgctaaacatgcactgcagaaaactccatctcagatattttattagctatggtaattacacacattactaatttgatttcatatttcttccttcagtgtgccttggctgcaattgttatttctgcagtcactagcctggtaaggacatcttatttctcagatatatcaaaatacctttatcgaaaaagatgctctgtcaatcttgatgcctttgtagtgcttttttcaaaggaagctactgacgaaattgtgccaacctaaacattttattgaaaaacattgtaacaatttacatattagtgcttttacctaaaaaataagtatagttaatttattttaccctccaccttgagctttcttctctgacatgtcacaataatttgttttgtagctttctcactttatgatgtaaactatgtcaatctgatttgtcatggacattttcgttatttaggtagactacgaggaggctatcttcttgtggagtattgataagaaggatttctttctatgggcaatcacattcattacaacattaatttttggtattgagattggtgttcttgttggggtaagtgtaaatttattgctgattactgacatgtggataagataccaaaatgttctgaattcttttgatggtaacatcttccttcgtaggtcggattctcattggcctttgtaatccatgagtcagcaaatcctcatatcggtgagtaattatgctatactagacctgagggtactcacactttaatagataccacaacatcatttatcaaactaagaaactaccattctatcccaccctgctcctctattggtgctttgcccctttattattattaaagcttggaaaagaggatagattggtagaaatgagaggtagcagggtcctacatttacctgcggtattgctataaatatggcgacatattttttctcaattctcagtcgaaatttttctaagcctttgattggctggagcgccgcttttttcggtggcattggtctcatcaattgcatttgattggctcgaagcactgctttaaccgtagctcgttggcacgttctttcacataagtaatcaatatatgtaattttcaatgcaaaatatagaaattacattgcacttacattataattacattatacttacatatgtaatttagagacttacatatgtaattttaggacttacattgtaaatacactaaaattacatatgtaatttagaaatttacgatgtaaatatataccgactattttttgatgaaaaatatggcgacataaatatagttactccctttacctgtgggtagatggtacccctctttacataaggcagagggattggactatccttctgttaattgttcttgctttcaacaggataacctctcttctcaaaaaagggcttcttaacaatggatctaaaaagataaaggacagaaacaatcccctaaaggaaatgatgaaccctgagttcctctcgacactcaaggctattgttggcccgatctttcggtgagttgtgataactacgatttgggagaaacgttgacgatccgactacaaccgtacgagacgttgtgttgcgccttagcgatcgatacacctctccatgggttgttgatcttgccggtgcagatcaaccctattcctgcaagcaaatcgaagaaacaagcaagaacaagataaaagcaatctgatattgcaaataggaatttaatacaaatgataagttggggtttcgaatacaagcagacggacggtctagccgacacgcgcgctgcaagcgaagtagcaatggctaaactttcatctaaacaaaaccccagaaaccctgaaggggtacctaactacttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatgaaggacttgatcttgatgtcttcttgttgattcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatgcaccaaaaatattcctctatcattatattcgccaaagatatgaaaaatagcattagttggacatggcaaatcagatttagcaaataatttctccttcaaattatcgagctcaccaaaatcatcaaactgaaaatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaagtgacatctcaaacatatcgttcttctcattttggagacttttctgaacttcctgcaaaacatcagtgataggaggcacaagcatatcttgttgctccattggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcataaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatctcacacacactcaagcttttaaccaagctcttacaagatcttaccaatgcaagtggaatggtgatgtacaccgactcaaccaagcaccccaatagaggttggatatatcgatgcctcggcaaacacttgctgtacggctgcaatcaaatctgtggagctctgggtaggcttaaatatgtagcaaaggaatagcaaatgctcaaatcagagaacgcaaaggtgaataattgttcaaagtcaagtaccgtgctggtcctaggcaagaacgtactagagacgcgagcctagacacaaacggtaccacaaaatagcaccagaaacaactcaagcacactctgatgtatgaagttcagctcaaacaaaacaatattttctcttttctttctttcttctttcttcttttcttttttttttccttttcttttctgattttttttggggcggctttttttttcttttattttttgcacctttctgcctttttttttctcactttttttcttattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccggttccgtttttccaaacagatctcgaaaccgacaccaaacaaaaatttgccaaggtgtttgacacaactcggaacggtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaataaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacaatgcaacacaaaattcaacaaagcaaaaactgaaaagaacaatgcaatggcacaatatggctaggtaaatgatacgaattttttttgtatggctattttctggttataggaagataaaaactcaccgagcaacgaaagctctgataccacctgatgaaccctgagttcctctcgacactcaaggctattgttggcccgatctttcggtgagttgtgataactacgatttgggagaaacgttgacgatccgactacaaccgtacgagacgttgtgttgcgccttagcgatcgatacacctctccatgggttgttgatcttgccggtgcagatcaaccctattcctgcaagcaaatcgaagaaacaagcaagaacaagataaaagcaatctgatattgcaaataggaatttaatacaaatgataagttggggtttcgaatacaagcagacggacggtctagccgacacgcgcgctgcaagcgaagtagcaatgg

SEQ ID NO: 23312 - DNA, 23672 bp, Oryza sativa
cctaactactaaagagggggaggacgcccaaagggtccaagggtcgtgctccaccagattgggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtattcatagtagccatggtcacatcaggaaagtaactaatcaatacataaccaaataatcttatccaaagattttgaagccgccatgccatgggtgcaggagcatgtgtatgcatgcttctcctctcttcctgaccccctcatgtgctctacgtccatacatattgctctttgtgccctactgcgaccttgcctaaaccaggatatattgccgtcgacttgggacggaaaccaggactgcactttgcaatccaatcctcatggtgaatgacagcttatgtattatttatgcatgcctctggtgatttccctgtcatgcacctgatttgacccctctgcaacatggatttggatagacttgctatttctaactgttatgttcaagaattttaacttttaggtatcaggttctgatatattattgcagggcaaaaaggtaattctagtcctagtaagtaggaccatgaaaggagttctacgatgattcataaatatagcttcataggatgaggattcctgctctgtcttaagaggacttgcaagagggactcatccaaaggaagtaactagaagtaattaggtcacagtagatgattggaggctgtgattctttgtgccgtagatttttgtgtgggataggaatctgatagtctaaataagtcaagacaaccatattgagagttcaataatcccttgtactgtttggaggttgtgcttgaagaaatttgtagtccgctttgacatatcttttctctcgccatggattgttttgtcgccgttatttttgttctctataggataacagaaatatccagagctgctgcatagtattagagtataacagttgatttaactagattttatggtctgtgtgcagccgtattgggccgcttacctggcaccacagtgtaccgaaatagattgcaataccctgaggcttatacctacaacgggatagttgttgttcgaattgatgcacctatctactttgccaacataagttacataaaagacaggtggatattttttttatctgtatgaacagtttgtgttatcaattttttttcttaccctgatgtcctgatggatgttttgttgattgtgtcccttatcaggttgcgtgaatatgagcttaatctcccaaattcaaaccgtggacctgatgtcggaagagtgtactttgtgatcctcgagatgtcccgtaagatctttttcttatgttacatgatatgaggcacattaatttttttgtcatatcatgtttgcataaaaatgtttctttcaattaagaaactcatgagcatcaagtagatttactagactagttaagataaacaaatactgaacatgcagctgttacatacatcgattcaagtgctgttcaggctctcaaggacttgtatcaagaatacagggatcgccatatccaggttggcacttcttctaattaattgaacgagtgaaaagtagaaacaaatgtgtacaggtatggcattaaatcattgagtactactgattggttgcagattgcaatagcgaacccaaaccggcaggtacacctgctgctttcgagatcgggcatcatagacatgattggtactgggtggtgcttcgtgcgagtgcacgacgctgtgcaagtatgcctccagaaggtgcagagctcatcatcaagttccataaagctgtcgccacaggcatcaggggacctagctgactccgttaccactccaaaggttcaacagcggtatagttttctaaagaacctctggaaatcacaggttggggacgggtgtacaggtagtgaggttcaaccgttgctacgccaaaaccttgtttaacattatggccgactacctttctattagtatctgtctgcctgtttatatttgatgtacatgtatgcatacagtgtaaaggaaaaaaaaggaatatgttattactctcttgcaattttatatagaggaattgagatggggttgtaagtggacagtatatgtgctgccaacacattggttatctacacataaggacgtagaatatgctgtgtactgtacggtgccgcggcttgcctatcgtgaggagttgaaatgttcgcaaaattcttgtttaacttgtaagtttatgtatatacattttcctaggcatgtaataacagccgctttccatctgtatgagtcgtttttaccctattaaggcttctttggttaatccctaaaagaaaaggattataagggtaagaggattaatttcacacctcaatatacgtggaataatttttctccaattccctttcaatcctttatgaatgggcctgagcttggtttgataaaaggaataaggcgtttgacgggtatgcatgcttgtgaccgtaagctgaattataccagtctcctcaattagactttgcatcatagacgattcttaataactggtaacttataaaagtgaattaggataaaaattattttggatgtttttgtcctcatgatgttatatagaaacggtgcttcgagaccataggtaatactgtgggaacatctctgaagaagattttcaatagtataatattgtagacctgtatgaacatctctaaaggagattaatattgatgttgtgtactgatttgtagttggacaatagtaaaatgaggaccacaaaatttgttaggagtgcatttagatcaaaacaatacttgtgcaatgctattcagttgaacattcattggctctaaatcaaactgttcttttatcatgttgactaactcaagtagaatcaaaccaatggccctgggtaagatcttgtcaggcaaaggaaaaaaatagatacaataaattccctaagtaagacattttaggacaatattgttaacgatgaagatgaatggattatgtggcctattatgcatccattgtgggagcagaatagcttgggcacctctgatatctttttttcatataacctagatcattaatttttacagtgttgataggaataaaactatgtaatgtacattggataaaaagaactgaagagagatatttaaagcatagaagatcacctctgggaacaaacttgacaatgcatcatatatatatatatatatatatatatatatatatatatatatatatatatatatatatatatatatatattatatcaggttcttctaattgtgcagaactgtttcctagaggaagcagtagcatagcctgcaaattgacgcaaaaaaaaaagaagaggtaaatacctgtaggtaaacatagatacattgccagctggaaaaagagaatatttgtctacctaaatacatcaacacacagtttagaatatgacaataaataataaggacaaaatgcatcaggaaacatcatacgatgttactcttgctcaatgccaaagcagtactggaactggattcatctataaagttcttagaagcaagagcggtaataagatgccttgtactttactttgggtgatttgcatagatgaaatcatggtgctactgctcctggacactaccataggagagagtaagcgttacataattaattagtaaatagaagatgcagagtgaaatgttttgtggtaaacaatgtacataccttcatccacatacatagaatttgcctatcaatcagtaaccacatggttttgctctgaaccctggttgtaatcttggaaaacaaaaatcatgtccagtcgaagatagaggaaagaagaaggaaactcatagtcactactcaccagtggaaccggatcctctgacgtactttattctacttcaaagggacgttcgaccatggatcgccgttccttgcgcatccgacgacaacaaccgtttcagtcccgtcctttgtctcaggccccacagcgcaatgtctctgcctgctctccgggagaaaattgtgattttgcttatcgcaaaagaatggtttcgctggaatactatccctccaaagtgattcattaaaatgctattctaaacaaaggggtgttcactgaaatgctattttagatctttttggttgctagaaatgattttactctattttaagttttgttctgaccaaaatacccttgtgtccttgtctctattatgttgtgaaccgttgtgaaccatggtacatgtgaaccactgttatattgtgaaccattgttatgtgaggtattttgtgaaccacatgctattcaatattatgtctacatgctgtccaaatttgttctattttgtttttacaattttttcatgcccaaaatttatgggttaagctagcttcaccattatatctttataacttggagtgagaaaaatcttgatctttatgcgcgcttgtggctaaactggactacacaccatttttattgtacaaatgtgaaagcaaaatatattgctctagcaaagcatgtgtcaaaattaactagagaggtgctgtttgactttcaaaccagtgcactagagcttttgtattagtgttaatgatcaattagtatatacatatcatgcagcggagcgtgagccgtgcataggtttcacaaatatatagcaatatattttgctctagcaaagcatgtgtcaacctgccattatcctggcgaaaggaggacatagaggcgagggcattttggtccggagaaaatctaaaagagagtaaaaacattagtactaacaaaaagatccaaaataacatttcagtgaacacctcttagtttaggatagcattttaatgaatcactttgaagggatagtattccaacgaaaccattcttttgcgatagcaaaatcacaattttctcgttctctggcccattcattgatagggacagcagtgccgcgccggccgccggagagctcaggccgccgcacactgctgccggtggggaggtcggactaggacgcggtgctaccgccgtccgccggcgaggtcgagggcgacggctacgcccgcctcggtgtttgctgttggtcccatcgcccaacgactgctgttctcggaaccgtcgccggcgaggttggattggaatcgatctgtagccgatcgaacttccatcatcaggttgccttttctcatggaagaggcagctggttgaaaatcttgctaaggcattcgtgctgtcattaacttttctcagaaactacaagtaacctgaagaataaaaatcagagctaaccagaagaaaagaaaccaaaactttgccaacagattcacagttgaatgcgacatagcaagtctacaattgcaataagaaaataccaaagaagatagtttttttccttgaagaagagatcaacgagtgcagatgttaaccaatgaaagaaatctcatggcatgaagtgaagagaagatgagtaacttttctgttctatttgttccccgtatagctctccgacgacagttccgacaacagcagccgctgggcggagccatcgccgtcgacctcgccggcggacagcggtagcaccgcgttccagtccgacctccccgccggcttcagcgcgcggtggcctaagctccccggcggctggcgcggcaccgctgcccctattaacgaatgggccggagagcaggcagggacatcgcgcttgcggggcctgagacaagagatgggattgaaacagttgttgccatcggatgcgcaagcaacgacgatctgttatcgaacgtccctctgacgtagaatagattacgttagaggatccggttccctcaccagtatcaccattcaccagtcaccaatagcaattaaggcctactttctagagcggaagtgaaagaacccaaagcagcaagtaaagaaaagtaggtataagaaagaggccctacgaaagggcgtcagcaaggctgctataacacggccacacgagccattcatcagagatgcaacagcgtggatccgccttcatcttgaccagcggtagcgatggaggacgaaacaatctccattgatgagatgctagttcgtggtgaggaagaggaggggaatttatttgcatctgaactctatctggacggagaagaggaatgggaatggttgcaagaaaatggatcagtaaaagacaggagggcagggcagtgaggcagttagcggtgagtggaagcagcacgggagcggcggccttgcttcctgttggtgtggcgaggcataggacagacggccagatggggggtcgcagcctcgcagggttggatggacaggtgcgtcgatggggcggggaaggtgaagtggccggcgctagaagggggaggcgaagtggaaccggcgcgcagagtggcgccaggaggaggacgcgaagcggggcacagtgtggatgcggtgcgggggcggcggcgcgagatgcaggaggggagttgatgcgcgtggggccgccaaagcagagtgatgcgggagaggagagaaggggagcgtggagccggcgaagcagcgagatgtgggagaggagaggagagaagcgacgcggaaggaagggctcgatgcggatccaacggtggggacaaaaaaggtgacgtggaagcaccaggaagcagagagttctagtagtggggatgatttgtataggtataggattccagtctcctgaaacatgcaggttttctaaaaagaacataaatctacatcgagaggcctatcgatttgtgccatcgcgcaatgctgggaaagccatccatcccgcgaacaagcgacatggtgtccatcccgtgcgtcgtagcgttctgaccgtgagaagggtgcttcttcctttccatctactcaggttatgcttttacgtggattgactatgtctgatgaagaatttgatactttgatggaggatacttctctagtggagggagttcaatcccaggacaatttagttgaaaagcttgctgctgttccagaagtgatattgtctccatctaagaagagtaagaggagaggtagtgacatcattcaacacgctctagaaagggcagagaagataaaggctgacagaaatctagaaaatcaaaaggctaaaggtaacttgcataataatgtttcctttttacatttttctaatgatgatatttctgcctctttacaaaatcttggtatttttgctgcaaataaggatgttagcttagatgacgctattaatgatataagaagtgtagaacatgaaagacttagggatcatgttagtttaaatgataataatgactcgagtttaatctttgataatgatttcgtagaggatcaattagaggatatctttttactacatcagttatgtagtgaaattatggatgaggtaatggattcgttttcaaactacttcagattctaagataccttccatggacaaaaaaaaaaggcaaaagagtgaggcgaaacaaagtttataaaaataagttataagtttataaaaataagttataatgaaaggagtcttttggaattgtgatgggtttaaagacccaaaaaaaacataagtttatttctgattttactaaggaacatcaacttaattttattgcgttatcagagtttgttaggagggattttacttcttctgatcttaaaaatctttgtgctagtaaagattttttgtggcattcctagggatagatctggagggatgttattaggaattaatttatgaacttttgatattggtttaattgatgagggtgatttttatattaaatttcatttatgtaataaattggataagtttaaatgggctttggtgttggtttatggtctgacgcaaaatgaatttaaagaacaatttcttcttgaattagtgaatatgtgcagatatgaagctttaccaattctcattggtggtgattttaatattttgcgcagtcatgatgaaaaaaataatgataactgtgatgatatgtgcccttttctctttaaagcaactatggatggttgagtcttagacaacttgttttgtctggaagaaattttacttacgcaaataatttagcaaaccctacttatgagaaattagatagagtattaatgtcgacggagtgggaacataacttcccgctatcctcggttgttgctcttaatagagatatttcttatcatactcctttacttttaattacaaactcctcttcaccatgtaatggacaacacattttcaagtttgaattagattggctactatgggatggttttgtagacatggttaaggaaatatggtcctccacagatgaaggtaatactcctaagcgttgacaggctaaacttcatagattaagaaaacattcgaggggatgggataaacatacaagtggtgtttataaaaaagagaaaaaatagttattaaataatcttgatttgcttgataaaaagggtgaaacagatttattaactccgggggagattgatattagatatgtttggagaaatagactagcatgtttgttgagagaagaagaaattaagtggtatcggcgagctaagactaaagatattttagaaggtgattctagtactaaatactttcatttggttgcaaatggcaaacaaaggaaaacaagaatctttgtattacaagatggtgaccaaactataaatggtgatgcgaatttaaaattgcatattaccacttattacaaaggtttgtttggccactagaggactctatcttacaattagatgagagtagaacaaatgatattcctcaaatttctcaaatggaaaatgaggctttaactcaggaatttagtgagaagaaaattagagacatagttttccaaatggaacataataaggctccgagtcctgatggatttccagctaagttttatcaggtttttctggaatgtcattaaatttgatttgttggagttatttaaatattttcataggggaactttacgtttatattctgttaactttggtactatattttatagcctatttgtttacttatgttagttttaaaatttttactaaagttgctataaacataataattggggttgcccaaaaagtcattagtcctactcaaactgcttttattcctggaagaaatattatggaaagagttgttattttatatgaaattatacatgaaattcatcgcaaaaacaagagtggggtaattcttaagattgactgtgagaaagcttatgataaggtaaaatggtcttgtgttcaacaaaccttaaggacgaagggtttctcgctaaaatggtgtcagtggattgcctcttttatccaggggggacatgttggtataaaagtaaacagtcaagttggttctaattttcaaagttataagggtcttaggcaagggaatccattatctccaattcttttaaatatagtcgttgatatgcttactatattaattataattaagagggtcaaggatgatggtcaaattagcgggatcattccacacttggtggatgatggtctttctattttgcaatatgcagatggcactcttattttcttttttttttagaacatgatctactacaagccaaaaatctaaaattgttattattgacttttgaaaaaaatatctggccttaaaattaatttttataaaagtgaatcattttgttttggttagtcaatggaatgtcaagagctttattctaatattttttgttgtaagcttgggaatttttccgtgagatatcttggtattcctatgcattttagaatacttagtaacaaggataggaaaacaatcgagggaagaattgaaaagaaacttagtagttggaaaggtaagcatatgtcaattgggggaaaattggtgttgattaattctgtgctttctagtttagccatgtttatgatttttttttgagattccaaaatgagttcttcaaaaaattaattatagatcacgtttcttttggcaaggagatgagcacaagaataagtataggcttaacccaaagatcaaaggtactcttggagttcataatcttaaaattcaaaatcaatgtcttttgagtaaatggttgtttaggcttataaatgagtagggcgtgtggtaggatctatgaaaatgaaatatctttataatcaatccttaagtcaagttgagaagaaacaaggggattcccatttttggtcgggtcttatgaaagttcagagcaagtttctaaatatgggttcctgaattgtgaataatggtgtacaagtgagattttgggagaataaataggcagggaactattctcttaaggatgggtacccgtcgttatatgctatagttcgtaggaggaattcttcaattgcaaatgttatgtcttgtgttctactaaatgtttcttttaggagagctttagtaggacataatttaaacaattggcataatttatgtgcttcaattgtgcatatttatttgactgaggagaatgatatttttatatgcaattttcatcaaaatggtgtattctcggttcggtctatatacttagctttaattaataatggctacattgagaggaataatattatctggaaacttaagatgcctctcaaggttgttctaacaaagaacaatttagctaggagaaattagcatggtagtttgaaatgttgtttttgcatgagaaatgagactattcaacatttatttgtggagtgtcactatgcaaaatttctttggagagctctatagtttactactggtttatatactcctcatagtatatctcatattttgagaattggcttgtggggggtgataaagaatataccaaacttatccttgctggagcatccgctatatgttgggctatatggttgtatagaaatgatatggtttttaacaaatcaccatcgatgtcgtatacgcaggttcttttcagggcaatatattggctctggtcttagcctcaactactaaagtgtgacgaagaaatcaagtcagtgaaagctgcatgtcgtaatctggagtcaatggttatacagttgttcactaactttggatggagattcataaatagaattcaataatttttgtgatcttgttatgccgtgggagtttttattagtttgtgtgtgcttttgtttattcatgtgtgagtttttgttgaattggtgtaataattggctgtagaaatttgagtaaaggccgggattatattccattattaaaacaagttatgtgttttttggatgaatctcaaaacacagtttatgaacttgatatgtagttacatgtgataattctatgatttttggatatgttcttccggcttcctctcctccaagttgctgtttttcctcctcccctcttcgtgcttctctttttttcaatcgataatgccgtggcggttgtccagaggtggaaagacgacagatgtcctgatgtgtgggggagtccatgctgtcctgggctaaggctcaggccacgcaagatgccccacgcgaagcgcggtagcgcgtgtgtgacacggagcgcatgtgggagaaattccgtttttgtcgagggtcaggggtcccgttacacaacacgctgcgcgcgataaaacttcttggcgcgacacagtgacaaaaaccctagtcccccaccacgaggccaccaacccacctgccctcgtatagcatgagtagaaaagttactcgtcaaataaatccgcatgtatgtggaacatttgttcagttaaaattggaagaattataaatatatcactactttcaccctctaatttataatagccattataaaaccatcaattgcaaatttgccactgaaattagtgcatgtatatggcgtatgccatacgccattgccgtttgatttggtgcagttaagaggaaaaaatatttatagaactaacgtaaaaaaaaagcaacacaataagactattttgtccttctaagattcaatcccctgtttgctctcgaccgactcagatatgtgcacaataaaagccagaatagattgaagtaaaaatattactcaccaataagattgggaaaaaaaagacttatagtagagtaaaaagattagggagtagctatatttatggcgttatatttttcaataaaaaatagtcggcatgtatttatacattgtaagtcactaaattacatatataattttagtgtatttacgatgtaagtcccaaaattacatactaattacatatataagtagtgtgtaactactgtgtaaatttcatttgacgtatttttacctaaaaagttgtcaccatatttttatagctgctaacatcttgcatcattgtttggtttatatcctgtaatttgccacagcatgaatcttagagaagatcaaatcatctagagatctactgtaaacaagccaaaaatatggtgacagtattttaacaaaaccgaaaaattacttcctgcttcaccggttctctctctaatcccccgtggcctttttttcaccactagtaatttctttactcattggtttattctctctctaatgtctcgatagctttgtcagaaaaggttataagattttttagtattgtccacattaatatagatgttaataaatctagatacatatatatctattaacatatatataaaacgaaggaagtaatttattcctatatgccaactaaaaatcgcagtaaaaagatattctaccatcaccatacgtagttacatctcaaacatcaaaatctatccatgaaaaaaaaattgcacacaaataaaatcatctgactccgcgagaaagattacagactatatgagcactaggacatcggcaaatgagcatttgacaccttcactagacctcgtcactatgaataattgttgtttgttgtagcacgaccccataaacgccgacggcatcgccacttgccgattctctagtctcgtgtgaagctcggggcgggctcagttagcaggacatctcagaagtatcggggacacagcttcataaatccataatgctatatgcttgcagtagtagaattccaattatgacgcagtacactttcgctgccttaatgataatcgtatatatgcattttggacactgaacagaagtgcctgccgacatcctgaaacaagcatccataacaaactaagggagagtttagatctaggggagtaaagttttggcgtcacatcggatattgtgtagggtgttgcatggggtgttcagacactaatagtagcaccacattgtcaaatcatagagcaattaggcttaaaagattcgtctcgcaaattagtccccatctgtgtaattagttttttttctaaaattatatttaatacttcatatatgtattcaaacgttcgatgtgacagggtgaaaaattttagggtgtgatctaaaccgggtctaaagttcatactcaggtaagggagaatagtaccaacaacaaagttaagtcttagttaatctgtttttggcagcctgcaattaagtgataaactaaaaattcaatctcaccaagcatactgcaaaggatcgaagccccaatgttcaatcaaatatcaaaggaactcctcctgtctcctgtcctagtgccttccgggcagctggctaaaaatgacgacaacaaaacagtcatggcgtccaccggcggagcaggaagagggaggacggctttacggtgccagagtaggaaacccggcgccggcggcagcgttaacgcacagggaaggcatctgcattgtgccaagcttctacagcacactcttgctttgcctcggagctcttgtttctgctacataaacaagatgcagactaaagcaaaatgcaaacttaccacgctgagacgtgccggccattaacaacaccgccaccagccgtagcaggctgctactcttctacaacacaaccacggaacacacgaggaagatcggcagtgtcgtgcctgatctgacggctacatcttcggcctcctccgaccggtgaagatggtgatcaacggcgctaaagctcagtccataggggaggcctatcagcaggtccagttccaccacctcatagagcaagggacgatgtcccatcctccgatctgcacgggtggtgcgacggaggtgctctatgggccacgacgggctcacctctttctcccgatctagcgtggggcgcacctcctcgatcgctgccttctcgtcaggggcatcgcgatggtacagaggatgatggcatgttaaatctgcgcggagcgtgtaggtgaagttcgccgccgtcgaccccagcttacccgagcttaccgccgccaagagccaagacctcagatccggaaaaaaagggaaggcggtgggctaataaaaaatagagtgggtcttgggtaacagaaaatctactccacggctttcagttgcaacgggagaacttaacttgcgattaccgatagcgattaaccgtgattaattagtgtataaaccgtttttctgaacagaagcgtccagtgcctgtttcattttcccccacccacccgtgactctcggaaaaacagtggcgttctatcgacttcatcggcgtcgttgccgctcacggcggtgaatctccgccggcttccgccgtcctcgtcgtcgcttacgcgtggcggtgcttcgctggcgtcttgctctccctcctccaccggcgatggggaagacggcgccgcgcggagttgctcccgccggctcaggaacgtgcggagcggcggcgaagcagcatgcgagctcttgcgtcgtcgcacccctgccgacgaggaccgcgagctccttcgtccctctaccctcacgcagcagtgtttcacccaccactgcttccctccgtccatccgcctcctcacgccaccagcgctgcgccgctactttgcatcccttccttcgatacctgcaggtacccctcacactccattctactccgactgatttctccgccccccatgtcggcagtgcttcacagccgctttgcatcccttactcatgtgtgtttttctctttttttcttgatgatttccttgctgattttttcttcggcttatatggatagtatcaattcccctgtcctatcctcttgaatcccataattttacaggtaccaggtaccacaggtaccatacactggtatcaggtatcaggtatcaggtatcaggtatcaggtaccaggtaccagatactaggtatcaggtactaggtgtaccaggtatcaggtattaggtgccccccatgtcggcagtgcttcacagccgctttgcatcccttactcatgtgtgtttttcttttttttcttgatgatttccttgctgattttttctccggcttatatggatagtatcaattcccctgtcctatcctcttgaatcccataattttacaggtaccaggtaccacaggtaccatacactggtatcaggtatcaggtatcaggtaccaggtaccagatactaggtatcaggtactaggtgtaccaggtatcaggtattaggtaccagcctgtgctatactggtccggctgcagaggagcgacaccggcgacgaggtatcgcgcgcgtgataccgagttggaaccggataggtatcgtgcctctggtacgtatcagggggagcacacatggaatctcacctatacagatgaaaggaaaggggaggagtcatttaaagtatcccgtagcaacgggatcccgttgtgtagctgctctccttgagtaaaaacggatcagaaaaactagcacactggataccgttcgagctacgggataaacttaagggtgtgttcgctattcctggatccaaaccggatccttccgcacggaaaacggaacggtccattagcgcgtgattaattaagtattagctatttttctttttaaaaatggattaatttgatttttttaaacaactttcgtatagaaactttttacaaaaaatgcgccgtttagcagtttgaaaagcgtgtgcgtggaaaacgagggagaggggttgggaaaaaggaggaaggcagtgggagaataaaaaatagagtgggtcttgggtaaaaacggatcagaaaaactagcacactggataccgttcgaggtaaaggataaggatgtcagttaattaataaagtcttatctcatgttgccactcctccctcaaccactcatctcctgacgccatctgctagagatgaggacgagctcaggtggtacagactgaattgatagcggcgtagccgataaggcctccatcggagctgatgctgatgatacttccctcctctccctcgcctccaaccaacaccactgtcgcactcccctttctctcgttcgccaagagtattgttcttgtggaggtgtggcgtcagcgcaacaagctgatttgtgggcagtcatggtggtggctgagcaaagctgccaatgctggatctagaggcctaggtcatcctatcgctagatccggtctgagcgcacattggggacgagggcagtgagcggcaacgctcttgtgtcctcttttgtcccaagctcgcagcaaggtgacgcccatcaagtccaggtactaaggcagcaagggaaacaaacaagaaagaagaccatcgaagaagactcccataaggtatcagttgtgagccatggtatcacaggtatcaagcatccggtctgataccacaggtagcaggtctggtaccataggtctcataaggtatcagttgtgagccatggtatcacaagtatcaagtatttggtctgataccataggtatcaggtctggtaccataggtatcataaggtatcagttgtgagccatggtatcacaggtatcaagtatctggtctgataccacaggtatcatgtctggtaccataggtatcaagtatgatacctacctaataagtaccaggtatcatagtaccaagagatcagatttggtacctatggatatcatgtatgataccccacgtacggacgtacctagtatcaagacaccgaaaaggaacatgtgccactgcttagtcggctggcgagggtctatcgccaacacctcttgttctcttattcctttcttttctttcctcgattccactatctcttccttgttgttgttgccgtcctgctgtagctacgtccgtgcgccctcttggcgtctagccgctggtgctagcaccgttgcttcctgctagcatcatcaccatgcgtgcacgagggtgggtaggtgtcctcctgctttactcgttttctcacgcatgggatttctcgtaactggagaaaagaaaggggtagggggttcattaaaatatctcgtccttgtgacgggatcccgtactctagtcgctctcaaaacggatatataaatcgcaagaacttattagataataaaaatatcactactgtaaatacgaggcacctacaaatcggacgctcgatattattattattattatttgcaaaaatcgggcattgttacatcaagtagatcgaaattgtttcaatcatttaaaaagctgaaacacaaccaaatcacctcatggaacattttgctacaacgtatgaaacaaaaggtttccaaaaaatcaggtgatgtttcactatatataaaaacaatgtttcagcaaatagcgaaaggatatttcaattcactgcaacatttgatctatacatagttgtcggtgaaatgggcccgggggtacgcacagcaaagggaagtatccttctcatctaagtcgcgtggccacgcggcctcatctccccccgcccctcgggtagcgctgaggtggcaagggcgacctcggggtgccacgtcacacccctcaggccttcggggcgtgctaccctgaggccttcgcccggccaccacatggcggggagagcgggcggggcgagaaacgctgctccatgccttcaatgcgcggtgccacaaccgtcccgcgccgcatttaatgtggtgtgggaggacgtgcggcgccgctcggtctgtgatcggtcacaagcgatgggacgggtggcagtgcccccacgttccgccctatgtcaggcggagtgagggcaggtatgccccatcccatcggcacactgccaggggcaccccccgggcgtggtgagccgccgaagtccccatacaattaatggggaatgacggggatgtcccccgtgtcaggcgggggacggcgctgggcccctcctgaagccgggcaaccgtgttgcttccggttgaagcaaaggatagcgatctgattagggccatgtgggccccctcctgtggaggagtaggtgcaaacggtgcatgtggtatccccttgaactataaaaggagtacctcgcccaccaagaaaggggacgactctcagacaacttgagctcggagaaagaacagctaggtttcccttagagctaaaaacctcttgtcaaaattcaccataatcccacacacaggagtagggtattacgctcgatagcggcccaaacctgtataatccttggtctcccacacagccacgagagcgttttagtagttaagcgccaagcggaagtagggtcttgatcatcgcgccatctcccccgaccgaactcacaaaggggggggtctcacgaccacccgctagaggggatctctcctcgacagctggcgcgctaggtaggaggaaatccgcgcgcttgagaaggaagtcgttttcttccgccctaagtttctctccatcctcagtgaccatggttgaggtggtggaacatgaggtggtggtacgcacacccattcttccgggagtgaggatgcaagtgggagtagcgatcctcgacaccatcaccagaattctccaactcctccgcgccatagcccccgacggcaggaggaccccaatcggtctgggggctcggccctctccccgccacctggtggggggaggccacaccgcgccagggtgcggcgccgcctaacctacggcgacgaaggttcgccccagggcgcacttcaggcggtgggggctcttctgcggcaccccccctgtcaacctagagccggagactcctattcagcgatggttggatgacgtggccaacctggtcaccgccgctcagcgacagctggccaccgatggcgggcccgtgactactggtacctcgcgtacccccactaccctctccttgtccgcaagaaggagggcccgtcgatcggccttgacatcgaagcggtcgacagcccaacgtcgtcgtggccctcggaaagccggaggcatcatgatgacctctacggggagtaggacgctcgaatcaaaatcgagcgccgcagggacgagtgccatgctgcccgcataggggaaggcgcctcctcatctggagtgtcgcgcccctccgcgcgaggtggctcgccccccacgtccattcccggtggggccgggtgcaaggccgtcgtggcgagtctccggaatgtccggtggcccccgaagttccgtcccaacctcaccgagaagtatgacggcagcatcaacccctttgagttcctccagatctacaccacaatcatcgtggtggcgggaggtgatgaccgagtcatggcgaattattttcccatggcccctaagggtcaggtgcgcggctggctcatgacccagccccctgactctatccactcctgggaggactgtgctagcggttcatcacgaacttccagggcacatatccctgcccaggagtggaggcggacctgcacgctgtgcagcgaaaggacgacgagtcccttcgctcgtacatacagcgtttctgctaggtccacaacaccatcccctgcataccggcccatacggccgtttatgcattccgcagcgacgtgcggcacaatcgcatgctcgagaagatcacctccaaggagcccaagaccaccgcctagctcttcgagctggcggacaaggtggctcggaaggaagaggcgtgggcttggaactcctctggctatggtgcggcggcagtggctacccccgagccctcttcccactccaagcggtgggataagaggagaaagaggaagccggcccgctccaacgacgagggccatgtccttgccgcagacggtccttctcggaccccatgcaaggagaaggtcactagcgacaagccaagcatcaccactccccccggcgaaagccggtcagcggataagtggtgctcggtgcacaacacttatcggcacagccttgctgactgccgcacggtcaagaacttggccgagcggtacaggaagaccaatgaggagaggcagcagagtcgccgggagggcaaggccccgcgacctccgctggcgaccagcgagaggaggccaagaaaaaggcccccgccgatgacgatgacaacagcgagaacttggagttccaggtacctcaggggactgtcgccacactcgaccgggggggggcttgtgctcatgcctcccgtcgaagtttcaaggccatgaggcgtgagcttctggccgccatcccaacccacgaggcgggtcggaggtgaagctcactttcgaccagagcgaccacccgacggtgctcacccgtggagggaagctggtcctcatggtctccccgaccatccacaacgtcaagatgaagcgcgtctcggtcgacgggggggctagcctcagcatcatctccccggtggccttccatgccctcaaggcctcggggatgaggcttcagccgtcgctgccaatcattgcggtgacaccagggcacacgtggcctttgggccacatcgagctcccagtcaccttcggcgactccaacaacttccgcattgagcggattgactttgatgtggcgaatctgaatttgccctataatgtggtcctgggaaggcccgcggttgtgaagttcatggccgccacccactacgcctaccttcagatgaagatgccgggccccaatggcccaatcaccatctctggcgatgtcaagatcgccttggcttgtgcggagcagtgtgctgacagcttggcggcggccaccgagccagtggaggccggcggattcccgaaggcctccgcatcccacgcctccaagaagcgcatcacctcgggcgataaggtgcccgtcaaggagccccttggcgatgatctgtccaagaccgccaagattggcggcaacttggacgccaaataggaaagcgtgctcgtctccttcctgcgggcgaactccgacgtcttcgcttggaagccgtcggaaatgcccagggtcctcagggaggtgatcgagcaccgcctcgccgtgcggccggaaacccgacccatccggtagaaggtacggcgccaggccccggagcggcaaggcttcatctgtgaggaggtgacgcggctcctggagaccggcttcatccgagaggtcatccacccagagtggctagcaaacccggtggtcgttccaaaggccaacggcaagctccggatgtgcattgactacacggacctcaataaggcatgccctaaggatcccttccctttaccacgcatagatcagatagttaactccgctgcggggtacgaccttttgtgtttcctagatgcttattcaggatgccatcatatttgcatggctaggggaagatgaggaaaaaattgctttcattactcctgtagacaccttttgttatacaattatgccttttggtttaaaggatgcaggccctacttttcaacgcatgactcgcattactttgagtaatcaaatagggtgtaatgttgaggcttatgtcgatgacttggtggtaaagacgcgccaccaccaagaaacattgttgacggacttagctgagactttcgatagccttaggtccacgcgcatgaaactgaaccccgaaaagtgtgtgttcgatgtgccggcgggcaagcttctcggttttctagtctcgtcatgaggcatagaagctaatcccgagaagatacgcgcgataaagaggatgcgccctcagtaagcttagggatgtgcagtgtgtcacgggacgtatggccgccctaagtagatttatatcgaggctaggagagagggcgctacccctattcaagctcctcaagcactcagggccatttgtgtggacggaggaggcttagcaagccctcaaccagttgaaggcctacctcacctccccttcgaccctggtggccccagttccagaggagccgctgctactctacttggttgcgaccccccatgtggtgagcgccgccctcgtagtggaacgcgatgaacatgacccgcggatgccaagtcacaagcccggacatgggagggaaccaggggcccacttaaccagcgacagcccctcgttccctagcggcccaacgcccaaagccaccaatcccaagtaaggccccgaggccaccgcgggagagcgagaggctatggcggacgacccgagagagcgagaggtctcgaacgtgctcccgggccgtcgcctcaatccccggggggaaatcttcgagtgcgcgccagggaaggatgtcggggtcacgggcctggtggctcgcgaggataagctccaccgcagcccgcgccaaggaagccgatgacgacttcacggcctcgacgacctccttctccagcttctccaggtccaccaccatctcgtccaaccatcatgcgagcaccggcctcgtggaggggagcttcttgtcccggcgcatggagatgcccacccggcgccccgcacgttccagccgttcgatggcgtcgtggagctggccgggcccgatgtcgttggcaagatggagggccgcgatctctccagcctggtcctgcaccaagcgccccagatcggcgagggtgtcttgggccgtggcaagctggctggcctaatcgccaggctgcccgcgcgacgccagttccttctccctagcctccagctcggacgcccgtgccgccatcgccgcgtgtttggcccgggcgccttctaggtggtgggccttgtgcccggcgacggcctcctcacgcttggtgagctggtcgcctagccggcgtgccgccacctcgtggcggttgacctcggccctgcgttcgtgagcgcggcgtcccgctcctgccacgcctcctctcgaagccacagttcctccgcgcgatgggccactacggcctcggcggccgtggtggttcgggtgcgctcggcggcgacctcttcacggaggcgaagggcggattcggcctcggctgccgtcgcctcgtgggcggccaaagtggtctcgcgctggtccaacgcgcgtgcccgctcctcgagcactagggcccactcctccagatcctaggcccgctgcgcttgtgcccaatcgcgcccctcctgcttgcgtttgttgtagtcgaggacctcgatccgccggcgaatcatggcctcgaactcctgtgcggagcgggtgcgctcgtctaaggctttacgctcggcctcacag

SEQ ID NO: 23313 - DNA, 16768 bp, Oryza sativa
tggcgtcctcaaccctctgcaccaggtcgtccgcatgggcctcatactgcaggcggatgttgcctagcgcctcgtctaggacgctcgaggcgatgagcgccgcctgccgctcctcctccgtctcccgcatgatggagtccagcgtctcctcgcgtgcctggatctccgtcagctgggcctggtgcattttgcgccctgtctccaccaggtcgtccacggtgcagcgcccctcatccacccgcgcgcggtccgccgcgacctacgtccactctgcctctagggccgctcgctcgtccgccagggcttggacttgggagttgagctcctcccggacagtggagtcggcggcgacgagcacccgtaggagcggctccatgcttgcgggagtcggggaagagaagggcgtggtccgtccccgggacgatggagtacggctggaccccccgcgagagtgggggctgcactcgggccccctttcacgtggttggacccaagggcgccccaggtgcagaggggtacgattgctgtcatcgcccttcgcctcgggcccccgggccgattcagcctcggcctcgggctcgggcttgcgccccacctcggcctctaggctgtgactcgcctcggcccccgggccgcgccccacctcggcttctaggccgcgttctacctcggcctccgcctctgggccgtgttccccttcggcggtgccctcgggaacgccgccgagggggatctcggtgccgccaccaccgacggtggatggcaccctctcctccctcgagggggcggtctcggccgtggtagattcggagccggacccggcgtacgggccacggcccccgctggggggctgtgaaggattcacggccccggttcggccggctcccagccgccccggccactcggacttagacccccgggggattcggctgtcgaggcccctcgggagggaatctcacaacaggagaaccccagttgcagtatttttttaaaaaaaaggaaaaaaagagaaaaataaaaaaaagatggcgccgtccgtggggaaaacggcgttgctggcgtcctgggccatggcagctgggcggatgcgagcaagaggatgggtgcacggagtacggtggagaaagagaagagcactaggggttggcaagtgtgtgcatgagtatgaaaatggcgagaggaaggagacgaactctccgcattcctccctttttatcctcgcctcaccagtgcccgactcctcgtttctcgccatttcggttgcctcctcgttttttgcacccactcgtcccattcgtcccgctaatcgcacgccccgcgcttagcacgcctgtcaacggcgtggccggtgcgggacgcatgatgattacggttgcggccaggcgggcccaccgataatcccgcgttcccacgcgcctggtggtcaggcggttgacgagacggccagtaatggcaccgggcacagtctaacaggacccctcacttttcctgccttgcgcgcctcgcgtgtggcgcgtttatcggcggtcgaataatcatcacggtggacgcttggatcgagctcgccaacaatgactcctcaaacccccccgtgcaacccattatcatgagacggaagttatgaggcaccacaccagaccaccccaagggggtcgcactcggatacagtgccggaggctactgtcggtgaaatgggcttgggagtacacacaatagagggaagtatcattctcatctaagtcgcgtggccacgtggcctcgtctcccctcgcccctcgggtagcgctgaggtggccggggggcctcggggtgccacgtcacagccctcggggcttcggggcgtgctacccggaggccctcgcccggccactacgtggcggggagagcgggcgggacgagaaacgctgctccacgccttcaatgcgcggcgccccaaccatcccgtgccatatttaatgcggcgtgggaggacgtgcggcgctgctcgattgatgtcaatcgagcttgactggtctatgaccggtcacaggtgataggacaggtggcagtgcccccacgttccgccctgtgtcaagcggaatgggggcaggtacgccccgtcgcatcggcacactgccaggggcgccccccgcgcgtggtgagccgccgaagtccccatacaattaatggggaatgacggggatgtcccccatgtcaggcgggggacggcgctgggccccacctgaagttgggcgaccgtgttgcttccggttgaaacaaaggatagcgatctgatcagggccatgtgggccccccacctgtggaggggtaggtgcaaacggtgcatgtggtatccccttgaactataaaaggaggacctcgcccaccgagaaagaggacgactctcagacaacttgagctcagaggaagaacagctaggtttcccttagagctcaaaacctcctgtcaaaattcaccataatcccacacagaggagtagggtattacacttgatagcggcccaaacctgtataatccatggtctctgacacagccacaagagcgatttagtagttaagcaccaagtggaagtaggctcttgatcatcgcaccatctcccccggccgaactcacaaaggggggggtctcacgaccacccgctagagaggatctctcctcgacaatagtgaaaaattacgagtacacttgctgaaacaatgttggtggaacaaaaattgaaacggattcctttaatagagcatttccataatatgtgggtaatttgttacaacgacgcatgtggtggggcgagtggtggggacggcatggaggtccggaagtggcgggcgcctgatttttctggcgctgatcgggttcccgatccctagcattttcgccgtaaatatattggtgggtgccatggatacgggtgaggggtgagagtaaaaaaatcactattgatagacaaagtgatgggtagatccggggtgtagtggttgaataaaaaattactaccatagacgtaatgatgtgtggctggatgggagtggctatgaaaagtgctatgccgttaggtagcaccatttcggaagatagcgatcgcgaggataagagttcggaagatattttgaagaagtaagtcccacatcccagttgagcattttgagcctactttatacaatgttttaccgtttgcaaataattaaattgcatgtttttctaattacatgggattagggactaccgatctgctcgcttgtgccatgtttacttaatatccatcctttgtcaaattggatgataatttgactagcttgtcacttatgttgacctaggtagaattatatatgcttagccatgcttaattaccacattatctacctttagtatcttgatgagttgtgagttcgagacacctagccatgttttattgctcgaaattatacaactaaaatatggcttaatggtgagctgtgtgtgtatggttttgctagtcgtatccatagcaattaacgaccggttcgcgggaaacctaggtgtatggttttgctagttgtatccatggtaattaaggatcggttcgcgtgaaaccctagaagacttacagtgcttaccacaagcaagaatgggcaactgctggacttgtagtgtaacttttccctttctgacgtactgaggcaagagtgagcgtgatggagtttggatgggccctgcgacggcctttatggcttccggattcacctaggcacaaaaggggttgcctaccttggttttaaagataggggcgaaacttacagtatgatgcaattggtcagtgggagttatgcgaagggtcttgtcacaatcactcaacatggtgacgtgtctggtcgggcacggtgatatgccggtagattgtgtcttgtgggtacagttgtgcatctctagctaaagtaaaactattcgaatagtcatgcccgtgatgatgggcgattaactagtttcaccgtgattagccccactctattaatttgatttaataaattggtgtagttcaggtggtttggttgggtctgttcaacgtggtgtagaattgttcagcggagatttaatattgccttaatcaatcaacaattttgctttttttaacttcaaatgtttacaactgcctttttgcaaatagccataaacctcccttgtattctcttacatgtctgtatcgttggtgtggtttccgagtacggtggttgtactcagcctttgtattattcccccttttcagaagtttgtgctttccgagctgaatacgaagttagaggcccaaggcttataccccagttgattttttgtctgtggagtgtaaatttttgtctcttatataagtatttacgtttggatctataaattaatttgttgttttgtgtatcctggcttggttcctcgacaaggatttatatataaaatagtctgaaaatttgagctaaatttcaaggcgtgacatgctctagatccatccacgtgggtgggttggagagggaaagggtgagagagaggaatgaatcccttctttccgcactggcccgtccaacatggccatcttgccgcggcaagccgccaccacaacaagactaacgcttagaaaagagatcgttgtagccttcaacacccacctcatggtgctaccgtcatcgccgcctcgactaacgcttagaaaagagatcgttgtagccttcaacacccacctcatggcgctaccgtcatcgccgcctcgactagactattcgtgtccaacgaccagcttggtcgcattgccgttgcctccatcctcccacagcggtagcctctgcgccgcgctcgccagctacgagcctccgtgttgtgctctctgcacgccttctcggttggcctcagccgccgccggattcactgcaatagcctccctgtcatcgccaacgcccgctccagcctttcggcaacggagcctcctccacgccacgtcagcctcttcggtgacgacctccttgcctccaccgctgccaaacgcgccggcctcgtcgtccgaccgtcacttgcattgtcctcgtcctccgccatcgaccatgaccgtgcttcgtcatgtcgccctgtgccgccccgctcctccaccgggccgccgtcaccgcgagcgccattgctgttgagggattcggcaccgccggagttgcccgctcccaatcttgctgcaggagggctagatgcgcatccggcgtggccaaattggccgcgccgagtactctacccaccggtgcatgccactccacctcccgtgccgagaagaagcgtcattaacttgttttgcctgccaccgccttcttggttggccgctcggtttccgacggtggcgatgcagcaagaaagagtgaggaaggtggcggtgttttgccgccagccgcccgcgcaagagcaatgctgggacaaggaaaaaaaaatccaaaagtatataacgtgctggactttgactaaaaagcacaattttttttattgtgatggttagcaatgatatttcagctaagaaatgcgatagttaaacatatattccttttgagtttatttttgaaaatatccctaccttacctccgccactgcggccgtgaaattcggtgtatttttcccgcggtactccaccaaaagcttcccgccaaacgtcctttcccgcgcggggggacgcgccaaaacccaccaaaatgtctgcaaccaaaaccccaccccgcgtatcgtcaatctctggaaacccctaacaaattcctgaacacccgccgccaccatagcttcagcctcgtgggtgaagaatctctcgtcgtcgtcgtcggtgtcaccatgaaagggcgcgcggtgaagctccgagaggcgcacaaggccggctcgccagtcttctgctccgttgcgtggggccaaggcgggcagcatgtcgtcaccgcatccgccgccgacgtggccatcctcatccatgacgccgctgcggtcgccgccgccggtggccggagctcgggctccgcggctgcggcggcgctttccacgatccggcttcacaaggatggcgtcacggcgctcgccgtcgcgccgggctccggcgcgtcgctggcgtccggctccatcgatcactccgtcaagttctgttctttcccaggttcttagatctgactgccccggatgcaatttctcctaatctccgtcatttccacggctatatttgtgaaattttgcttcggatttccttccagagggggtgttccagagcaatatcgcccggttcaccctgccgatccggtcactggccttcaacaagaaggggactctgctggcggcggccggagacgacgacggcatcaagttgattgccaccatcgacaacaccatctccaaagtgctcaagggccacaagggatcggtaaccgggttgtctttcgatcccagaaacgattatttggcatcaattgacaccttcggcacagtcatcttctgggatctctgcacggggactgaagcccgtagtctgaagcggattgcgccgacatttggttcagaccactcaatcaacaatgccctgtgctggagccctgatgggcagttccttgctgttccgggattgaggaataatgtggtcatgtatgatagggacaccggtgaggaggtgttcactctgaaaggggagcatgagcaaccagtgtgtagtctctgctggtctccaaatgggaggtacctagtcactgctggattggataagcaggttctgatctgggatgtgaagtcaaagcaggatgttgagaggcagaagttcgatgaaaggatatgtagcttggcttggaaacctgaaagtaatgctgtagcagtgatcgacgtaactggcagatttggcatttgggaatcggtcatcccgtcgactttgaaatcgcccacagagggtgcacctgacctgaactctactaaggttcctttgtttgatgacgaggatgatgaggagaggccgagtacctctggtggactggatgatgatgatgatgatgaaagtcttggtgaattaggtccattcaaccacaagagattgaggaggaagtcaacctatcatgatcactcaaatggagatagtgaagatgaggatctgatacttcagatggagtcacgcaagagaatgaaagatacacatagagataacaaggaggttgctgataaggcaataggtgattcagcaacttcagtaagactggttacagcaagaatgcaaactgcatttcagcctgggtccacaccacctcaacctggcaagcgaaatttccttgcctacaatatgcttggaagtatcactactatcgaaaatgaggggcattcacatgtagaggtaaaatcttctcaccctctatcttataagccattgtatcctctacttgtttgcagcttggatgtgaataaaccatccgaagttactttgtttttcaggtagacttccatgacaccggaagaggtcctagagttccttcgatgactgattattttggtttcacaatggctgcactgaatgaatcaggaagtgtctttgcaaatccatgcaagggtgacaagaatatgagcactcttatgtaccgccctttcagtagttgggcaggcaacagtgaggtaagttaactaaatgaaattgttgtttgccagcttctgagatagggttgaagtttaccactttggtgcttactggactaatttgaaaattacttagtggtcaatgaggtttgagggagaagaagtgaaggctgtggctgttggtgttggatgggtcgctgcagttacaactttaaattttctgcgcattttcacagagggagggttgcaggttttgtaacttcctcaagctttgtatttaagtccttttttcctgatgaatatacttgttagtcagtttgtgaagttcatttttttcctgaaagaaagctgactccttattagttccgaaatacccaaaaaaccaggttgtgcctggtaatcagtttgtgaagttcatttttttcctgaaagaaaactgcctccttattagttccgtaatacccaaaaaaccaggttgctttagtttttttcagtgctatctactagagctttcataaggccaaaatagctgtgaagtattaacaaaagaatttatagtattttaaaaacaattaatgttatagaagaaaattagattcatgcgactctcgacatgtttccaattaaatttattggtcaaggaaacattctatactaccaacatttaaatgctgaaaccattttttatttctacatccaatgtacagccgaaattgtcccgccctaaccatcagaagcacagaaattgttgtactatgtaaccactcatgaattataacttgtggggcacgaattataactttgactttttgcactcaagaaaataattcagggaatgcactttccatgtagatactagtaacttttatcaccatttctcaccaagaagtggtctacggaacacatttacatttttagatcattaaaaatgctgttcatgacattggtcgtgacttacatagcaaagccaaactacatattactaatcttggatggtttttcttgatacatgcgagctgggggttacataagcattcatgaatctgatttacatcattccctgtttgttacttgaagtgggaaaaattcaatttaatttactcattttatattgtacttttacctagcatgtcttgattttcagatgcatatcctcggtccgtggcccaattaaaaactctttaagttttgtcaaacacatctcttgattttcagatgcatatcctctcagtcggtggcccagtggttactgcggcaggccatggagatcagctagcgattgtgtctcatgcttcagattgtctttcatcaggagaccaggtattcagtatatgttcgtttgacttttggagctttgtgtagtgatgatatatgttgtagctagctatcacttatcagattgtcagcacctcctagtgtaccatgattccaatcgtgtgaaccaattcacagtacatatgaactgatggttgaaatggtactacaagattctgaattgaaacatggatttgttcatgattaaccctttcaggtgctggatgttaaagtactgaagatatctgaatgtgctcaatcattgtccagccgacttgttttaactcctgcctctaaattatcttggtttggtttcagtgagaatggtgaacttagttcctttgattccaaggtatgaccaatgaacactgtcaacaattcaacatatctttagttatatcatgggagttttaaactgaatattgttatttctagggaatactgagggtcttttctggtcaattcggtggaagctggattccaatatttaggtatagtatctgcctgacaggttatgcattttactactaccaaagcacacttaataattatatccaactgcagttcaatcaaggcaagaaaatccgaagatgaaagccactgggtggtgggcttagatgctaataatatattctgcattctatgcaagtccccggagtcctatccacaggtatgcctaaatgcaacttctcatgtgtacaacttttgagtgttgatgttccaacaaaaatagtacttctatatgcaattctcaaatattgaaatttgtttgtcgtttgacgtctttgactgatcttatcaggtgatgcccaaacctgttttgacaatacttgagctgtcatttcctcttgcatcatctgaccttggtgccaatagtttggaaactgaattcatgatgaggaaactgcatctctcacaggtgcactgtgtttctttcagttttgaagggcagtatctgtgatattgtttttaatcgttgctgtttatctcagattcaaaagaaaatagaagaaatggctgctttgggtctggacacgattgcattagatgatgaagcattcaacatggaggctgcacttgaccggtgcatcttgaggctcatctccagctgctgcaatggtacaagacttgaactatgctttttacccataaatagtgctttgcattaaattatttcttgttttatttcttgatttcaaaaggtgataagcttgtacgagctaccgagcttgcaaaattactaacactggagaagtcaatgaagggagcattgatgcttgttacacgcttaaaacttcccatattgcaagaaaggttcagtgccatactcgaggtgaaattcacaacccttatactgaacctgcgtacttttagcactctaaaaatggcacattcaatatttaagaatttatcatatgttcaactgaaggttatgcaatggcttcttgtaggagatgatgctaaacaatgcaaaaattgccaatacatctggtgttttctccaatagtaatacaaactactcaccatcaccagcgttgagcactcaagcagtcccaccagctaaggttgtgcaaaatggaaacagcttgaagttacctacattgcctaaactgaatcctgccgcccaacgaagcaatccaactgaatcaaacaaggcagaggtagaacaagcagacaatttgaaagaaatcagtacaaaggtttcacctgcacaaactccgttagttaaaattccaaaaaacagtgaaatgggtgtaaaaacgaagaaagataatgatggagcatcacatgcaactacagttgatcagaacccaaagggaggcagtggtcaggttggccttaaaaacaagagcgtcgatagctgcaatggtgtacagcctcagcggccagttaaccccttcgcgaaatcctcatcaagcaaagaacagccatcatccctttttgattccatcaagaagatgaaggtcgaaaatgagaaggttgacaaagctaacagcaagaaggtgaaagtgtaactgcttgtcattatctcatgatcttcgggagcaaaccagcagttaggtatcctccacctttactgacatatctgtgcttatatttttcatttcagttgtgataatgtaggtgaaaatcactatttacttcttgagctacgtttttgtgtatggcttcagagcttaatttctagttatgaggtggtacacaatgtatgatagtaaacctgtttagatagtttgcttgttccttttgttgattgctttgatatacaattacattttcgtctgattatatttaggatttatgtatctcctacagatatataatggagtgcgcaggttggctgtaaatcccttgattaaaaatttaaaatatgttgcaacttgctactgggtcctctaggatcaaaggtgatacacatgaacaatgagatccttaaattaaacaccaatggaacatttgtcttttatggaaaattcatagcagttaagtgttgtacggggttatttggtcatgtttcatgttcataaacctttagagacaacgtgcaacagtacagcaccatctccaaacatcaaggatggtcactctattaaacctgaatcaaggatggtcttcagatcttcacgtttcaataaactctatgctttttgattaaagtgcatataactttaggtattatgacttgtgacaaataaccttaggtattatagatctaaagtttcacaaaaccccactcatatataagccgtgcacacatctacttaaaattacaattttaaaatagtctatatgaaatatataattattggtttattgattaagcttgtaagtttaactcttcactactttaaaaaacaatgtttcaatatgtggttatgtaccacaagtcataatacatgtgatttgttttttaaaaaaaatactctataaataaatataatgtgaatatttagaaggaaaatgctaaataaatggcacacctttcagatacaaaatggcaagaagcccagaaggttgtgggaggaaatttcaaaactcaaacactaaactttgaaattagtcaccatggcctatttgaatgtgtggatggatgatggatgatagatgaaacgtggtttattaggccattgatatttgatagtgcggtgcgctgtcgtttggcctcagtggtcgtgcgctgtcgtttggcctcagtggtccacgtacatctagttgatgccctgtgtgttgctgcgtgaaaataggggatacacaattgttacaaacaattaagcttgaagaaagagtatccaatgtgcatggaattttgcttccaccagttgaagcatatggtaatgaagtgtggagtcttgcacgatactctgaatctatagaatgtagcagaaatactatgtactatgggagtgaaccatggctactggggattacttaagacagtattctatagcccatgacgaaaacaggcctttgaaagatcagaaaagggtctcttgttgacgcaaattgtctgaatgctttgctattctttatttctttccaactgggtgcatattggagacaatctgtttagtttttctgaaacccacatttgttgtggcattgttacgagacattgtttcatttcttttcctgaaagacctacatttgttggcattgtattacgagacattctgagcaaatgaaagttaaacatcacaggtagatgaattagctgcatagacatatttgatcaggcatttcaagatcgtagtgcacttcacctcgaaacaacaagctgaaaattcacgctatatccatgctggtgaagttaaacctggttcaacaaatcacccacagggcttatgtgagactgtgatactagagtagccggcctgtctatttagctgccaatccctaccaccgccgctaacttcttctccgccacgccaccgcacgagcggcgcacccttggcagccgcagggacggcggcagcggagctctcctccatctctctccccctctctcctgttcccctggcctcgttgtcctatgcggggctgggcagcgcgacgttggaggcgggcggcggcgagccagtgaccccagctgacggcgcggctcggcagagatggaggagagcggtggcggggcttccttctctccctctccgctcccacccgttcccccacctcgtcgtccgggtcgagctggcgccgcgttggtggcagacggcagcagcatccccagctgcagggcggggcgcgcaaatggaggcgggcggctgctgggtgacaacgtaggggtcttcctgcccttttccctacccacccccttgtcgacgtggaaaacacgtgctggcctgagagatttgctttactctagtgcagatctaaagagatcgctttcgagtctaggacgtgtcagttggtttgatcctgcaaccaacaagaaacaaagaaccaaagttaaatctataaacgatagccgatcggctggtttgtcgatgacgtatcgtttataccgggccgatgcaatatagatcagatcggccaagtagtgtatggcgaagggataattgaatgtgctctgtcggctatagatatcagtaatatataatctatgctttgaaatactcttaaaccaagtgattaggatagatcggtcagcgcaccgagacagtataaactacttgaatccaagaacgctttaaggcagggattatatatactcacagcatagccgacatgcaaacccaacgtgtaccagctagtactctgataccactttatactaagttttcgatatagatcaaatacgctaaacagagatcaatccagtgtcagggtaacctaacagactgatagcaggcttaatatatttggcccaaatgagatcttaatgtaaatggcagatttagcatatcaagtaagcatatgaggaacgagataactaaatcaggtaagatcggctgaaaccccgatgctatctctatcgataaccataagacaagctagatattatggttctgaatgttacttaacagatcaaacataaccgatgcaacatcaagtacatagagaaacataagatctaaacaagtttatgaaagccttttcgagatggtagatatactatataatctagttcgtcgcagctatttaaccttatcggctgttttcgatgatagaggctagccgatgagattatatagctagatcgaactagattatatagcatatatgataactcggcggtttacataggcgggactagagtgttataaagatgtaagcactagcccctagaactcaagccgctataacaagctttacctctttgtcagagattgaaatcgatgcagcccaactcgaaagcaagaactcgtcgaaaacaaagaaaagtaaaaagggcggcgatgcaccgagagtgtattgaacttgatgttgtttgtttacatggtctcgggtcatatttatacacaaaaaacatgatatgtccttgctggacacaactctatctctattacaactcaaaaatacgaacaagtcccttaggcggactcttaccgaaaatatctataaggaaactatcaaaatatcctaattaatagatacaattaccttctccagactcaatccacacttgccaatacttgtgtagcacttgaaccgatctcgataatggtctcatgattgccttgccgggatcggctgtatcggcttctccctatctggtttggtatcagccaatgcagacggtagctgatgcaactcgtagccgatgcgggttctgtttccgtgattatggagttcctccaaatccgctttggttctgacttcggatccaattatgatttaccaattttggtcgttaacacatgcctcccaagtctgtgatatttgcgatgttgcggatttgctcgattctgtttccattcgcatctagggtttcttttccgtttcggccgttaccgcgcccttttaaatagtgatcaccgtcttgggatcctacttacgccgccctgcttcccttttttaccgctttcggtcattattccccgtgaagcccccactgtagcaatccctaatctcttggtgatcgttcctcaatcggcgaattcctccaccccgccaactttgttcggacctatggcgatggcatacgtggcggagatccccgaggcaagctccatgttactttgagcaattccctcaatcttctttggatcttcggtgatccgattccttctttccttctgccagcattccagggatcatcttttgattcccaccttctggaattccacatactttttccttgggccgatgggtgatccggatcccaccgagtttatcaacgctgaaacggagaggatccccttcaagcagaccaaaccagacttagctcaatggaaatcgacctttaggtcttggccgtccaagttgaaagggtacaagtcatggtacaagaggatggtggctgctaagcgatctaattgggagaaagtaggaatagcgcaatgcctggctttatctatagcagacataaaaaaggatgagcccctactttccgctgtcggctgcttttggtctgatacattgaatgcttttatcttgaggcagggacctatgactcccactttgcttgatgtgaagatgctaacaggcctggacatcctttcgtccactaatccttttgacttggacattaaatgctcttatcaactgaacacaaagaagaagaacaattgttggtcaggcttcatcgtcgaccatcggaagactggtctagtttcggatgaggaacatgctgcctttctttccctatggcttgagaggtttgttttctatgggtctacttgtgcaccgactgcgaacttccttcacttcgctgaagccctggtgagaaaggaaaaaattcctcttggccgatacctcctaggggcaacttatcagatgttacatgtttcctcagccggtatacttctaaataaaccggtcagttatgggggcccttggtggttcattcagctgtggttgacaattcacaccaacaccgtggccaacagaccttccctgcttgaatcggccttccccaaatatgactctaatgaagatcaatcagaatcccggtcgtgcaagtcttatagggaagcagcttcagtttaccatggtgtcaagccatccgttgaaggtttcaagacatggttcgacatattttacaacaacaatgctactgatgttctctttgcctatgatgcctacaccgagttcaatctcccaatggatctagatctgagccagaaatgctaatcagagattgctcgcctagcgatgggggtagcgatcaattcgcaccccctccccctccctccctccacctggtttcttttttttggcaccgcattacttccctattttagtaaatttatgcacctaaagtttatacaccacaagtttacacatctaaagtttagagacccaatgtttataagtcaaaagtttatatatccgattcaaatttgaatttgatattttttatatatagtatttctatacatctaaagtttatacacctaaagtttatagacctaaagtttagaagtcaaaagtttacatacccgattcaaatttgaatttgaattcaaattttttgtatatatagtatttctatacatctaaagtttatacacctaaagtttatagacccaaagtttataagtcaaaagtttacatacccgattcaaatttgaatttgaattcaaattttttatatatagtatttctatacataaatttttctaacttttgttttttttttaaattttttgtggtgtactgtagtaggaagagaagaaggggaggaggaaggggagaagtgggaggaggtattgcctataggggg

SEQ ID NO: 23314 - DNA, 26319 bp, Oryza sativa
ccccccccccagatctaagcaggctaaatgataaaagaagattcatcatcaatggggaattgcttagcaacaatttctccctgtgttcttcctacaggtgtgtctcagggaagataatctttctcttatgagtgttatcacccaacatcggctgcaagacaactggggcttggccagcttcccatcagtctccctttactgaaagtcgtagagccaagatgtgaagtatcatcagccgatgtcatgaagaaaccgctagaatgcaaattccaagtctcagccgatattggcgattttacactttatcagtttaagcatgtcacctttgacagttggtggtcggattggtcaaaacacctcttctctgctccatcattctattatcttaccaagattgataaccgcatcaaggtaggccgcaatctacttccgactagattatgcccccgtgatctaacttgttttgctccctttttccttttttgcagatatcaaaaccactggcaccgaaacgcagcctgagtgatcggccaattttctatgcccaggttctcaagcattccagagggattaccaagatattgccctccccgatcatttcttctgctccttcaattgaaacactcatgaagactcttactggggtcccggctgccgatctcccaaattttggcaaacgcaaggatccttcttcgagaattgccgggttatcacccaagagggctaaggccgatgattctgctgggacaagtgcctaagcgttagctgacaatatcctgccctctctctcgtcatccccaccaaccagaattcgtcacgccattcgcaaggttgatattcagctttgccaaaaatgtttgtcttcttcatggcctctttgtaacccgtccttttccctattgtaggtgaaagcgtcatcgttgatagacccatcggccccatcggcacaagaaccgtccccatcggctcaagctgctccgtctgtccaagccgttaccgaagaaattacatccacctcttctaaggctaaggtacttcccccacttctaagcttgatcgtcggctaatatttatccatgcctaacccatctcttcctacaggatctgtccaacatgttctcctttgacgttaaagaatttttaaatgagggtgagggaaatagccccgagggagctcagataaccgatgaagttagggccctattggtggaaatcgccgatcggctcaatgcctctttggacacccttgtaacaaactgtgggccgatctgacaacgcttccaggagatccaggatcgaattccagatgatttatccaacaagatagcctcggccgccttcctggagcaatatgagaagcaatgtcatcgggccacaaagaggatagccgatcctcacgaagcccaggctttggatgccacgatcgacacttgccagaagcaaataattgaagacaaagcaatcttagatcaactcgctattgccctatcgccgatggagcacgaacttgccactttgcaggtgaaagaggcagcactggtcgaagagctgcagcaatgccgagccgatatattgtctgtagaaggaaagatcaagaacttgccacatgccaccgaggagcaaaggtctaaactgaaagcctccctcaaacacttggctaatctagtcaagtcctccaaagagatcccagggaccacagagcaagatcaggaggatttagacgagatagaccaaattcgcctgcgtgtgattaacgcaattgttgacggttgttgaatacaaaatttaagcatagtggtagggtttatttctaacaatttccacgagtgttggtgtatattcgtatgcagttgacaactgacaaactacctcagttgagaagaaatatacctggaggaggagaaacaaacacgtatccgaacatatggagttttggacccagaaacccaattaaacacctccaaataggccttccatccataccaacagaatgaggggcccaaaatgagtgtccaggacgaaaatcggagccgacggagtcgtcccgggttcagccgaactcttacggaggccgctggcccaggcccaggttgcgttcggtggataacgacttcccaatgacggttgtacctacagaaaccgtcatggacacgtgtgaagaggagaaaagagatgccctttggattccatggaggatctccacattcccatgaaagcttacactataaatacccctctcctctctcattctcacacacttgaagcatgagctgaattacaagaggctctattgtactttattgcatactagattagggatagagtagagtagaagaagtcggaggagttccggagttgtcggtaatccacttcttatttctttctgctctattaattactctaattataatataaatatattttgagtaatttagttttgcttggtgagaattatctcttggttagttcctaattagcgtgtaggatcattgttcactatagttcattataatatagtgattgctttagtgagttataaacacgaaagtagttattaactgcgtagatgctgtgtctaggtagttgatttccagtgtttgctacgcatctcacagtaggtgtgaggtgggtgtagaggtggtaacaaccctcaatatcattaaagtcctccctgtccgggtgcgcagtagagcgatatctgggagcagcgagctggctagtgccctaagtatcgcgttaggattgaagttaagctttctgtagacattgtttctcaccggtgattcctctatatcctttgcctatccgtaacttcgtgtccttggatgaacctgatttagagttgacacacacgttccctgtggaaaatcgatacctaagaatactcccaggtgaagtgctgcatcggtattttcgtgcgcttgcggattctatctgtgaggttaagaaataccaacagcaatccaaaatttcttgggtctgtaaatatcatggtcttagggcagtttagcctcggtgatagggaacttcagtttcggtgatggtaccctgactgtggagccaacgatgcccgctttgacaatattttgctaataatacttttggttggccctatcttgtccgtaatggttgtcctagaaagttttgcaaatccgtacttcaaattctctcaaggatctcaatcctatccgtgtacatatgctcctttaattttgtagtgttgaaaaagattgacaaaattatattggtctaagggcgatatatataacatatatcggccatctgaagacgatgtaaacaaatcggctatcttgtatcggcttaaatcaaccgatccatagtactgaaatcttctaagggcgatcatacacgtatctgccatctagaggcgatgctttgcacatcggctattatgtatcggcacaaaccagtcgatcatgcattgacccaaatacttaggaaatacttcttcaaatattttccgttgagtgctcttccataaacttctccatcgagcccttgtaacatgtaagctcccttataaactgacttgtagattcagaaaggtccttcccaatttggtgaccatttgtcgaatttattatcacgggtccctatcggcaaaatcaacttccaaactaactcaccatctgtaaaagacttgggcacaactttcttgtaataatgacgggcaactctttctttatccttcatcactttttccaatgtgcgtagcctggattgaaccaattcttccgattcgtctaccatgaggttacggtattcatcggctgttaactcatcttgcaaagcaatccttcttgagccgatgttgatctcccttggtaggaccgcttcatgcctgtaaaccaacttgtaaggaggaactgttgtatcgacccatggcaagccatccgataggaccacaatgcttctgctaacctggtatgacattgcttagggtaatccaaaatcttccttttgatcaatttaattaggcttttgttagatgcctcagcttgcccattagcctgcgcatagtatgatgaggaattcaatacttgattcccatgttctctgcaaactgaacaaattcatccaatacgaagatagatccttgatcggtcgtaatggtctgcggcacaccgaatctatacatcatatgttccttaacaaattcgattgcgtccccagaatcaacatttttcaatggaactacctcaacccatttagtgaaatagtcggtggcaactaacataaacttatgccctttgcttgatagtgggttgatctggccaatcatatcgattccccaacctctgaacggccatggcttgattataggattcatagctgatgtcggtgctctttgaatagctccaaacttctgacagtcttgacagcccttgtaatatctgaagcaatcttccaacattgtcggccaaaaatacccagcacgtcgcaataaccacttcatcttatgggccgattgatgggtgccacatatgccctcgtgtacttctcccatcatgaccttggtttgatgtgcactcaaacacttgagcagtaccccatcaatcatcccataatatagctcatcttccaataaaacatatctcaatgctttatatcacaattttctcgaagccgattgagagggattctttaagtactgaaatatgtcatgcctccagtcatcggctgcaattgtagtgacttctatcccgacatcccttgccatcggcttgtaccccgatgccccctgagctaaatcattagcctcagcattttgcgctcgagaaacatgtctcattgtcacaagccaaaaacaatccatcaattcccggcacctctcattctagatcactaacgtatcattcttgcactcatattcccctaccagctggctaatgaccaacagagaatcgcctataatctcaacgtcatcggcttcaacttctttcaatagctgcaaccccttgaggaccgcttcgtatttggcttgattgttatttgcataaggcttgatggtataggcaaactcaaaacttgcccccctaggtgacacgatcactaagccgatgccacatccgtgagtgcagacggacccatcgaagaatagcgtccagggtactatgaataccaggccgattgagccgttttggtgttcgacaataagatcggctatggcctgccccttgactgccttaggtgattgatatcggaggtcaaattccgtaaggcgaaaatccatttcccgatccttccttttaacactagagccgatagcatgtacttgacaacatcggctttgcacagcacaatgcattcattggacaataagtaatgccttaacttcgtgtaagaaaaatataggcataagcgcaatctctccactggagaatacatcgtctccgcgtccaaaagttttctacttaaatagaaaattgccctttctttgccatcaaactcctggactaagaccaaaccgattgccttctcatcggctgataagtataatttgaaaggcatccccttttgtggaggaatcagaaccggtgggttgctcaaacatcccttgatgttatccaaggctttttgctgctctgcccccagacaaactcctgatcggctttcaacctgagcaaaggcgtaaaagattctatctttcctgataaattagaaatgaatcggctgatgaaatttatcttaccgaccagagattgcagttgtgtcttattctttgggggttggatctccttgatcgcgttattgctactgtgagttacctctatccccctttcatgaacaaggaaacccaaaaactgcccagccgatacatcgaaggcacatttcgtacgattcatcttcaaaccatatctccttgttctttcgaaaacatttcttaaatcggctttatggtctttgaccactttggatttaactattacatcatcaatatagacctccaccaataagctgattagatcgtgaaatatatagttcatcactttttgatatgtagccccagcactcttcgacccaaaggtcatcacaacccactcatataagccgattgcaccaggacatctaaaagcagtcttatgaaggtcttcctcacccataaatatttgattataactagcattgccatccataaaactaccatcgaacacttatcaaagctgaataaaacaaacccttttctagccaaatcaacaattgggtgaatgagactttgtaaaaatagaacaagaggcttttaaattcatcggaacgttattgacatagattaaaatataaaaaaattgggccccctaattttttgggacccaaatcggtcgctcacttagcacaccctcatcgacagccctggttctatggcacatactctaagagctgaagatcgtggacataactgtagatgcacacctaaaacgatgagctctagcagggcttacgcgacggcggatgctgtggtataggtgtgggagatactgttttaggaagcccatgacgccaagcgatgtcggcaaagctcaacctcctcatcgtgccaaatcagaaagctgagaagcactccgttccagctccaccggggttatgacaggcagcgaatcgtgtcgacgacctcgacaccatccctatatgccttcccccttatctccatgtggcgtgtccctactaccagccaccacctcaccgtcgtgctccaacatgtggactccagtactcgagtcgatgacctcgacacgacctccctcctcatcttcgtggagcacatctctactcttgacctcctccttaccatcggagcatccgatgtgcagaggttccagtagtcatgccgacgggtggaaaatcatgctagtgacctcaacaccatccccgtattcttccctcctcatctcggtgtaccatgtccatgctgctagccttttcaccattgtactcctcctccatggctcgcatcccaaagctctagtctcgccgtgtcgtcagagctgcagtctgacgtggaggtacaggctatgacacaaccctcatcgacctctcctccgcccatgaccaccttcaactctaacgacattgtgacagtccgagcatgggagctcggcttcatcctccagtgaaggcttgccttcatggggatgagggaggggatgccgtgtggggcacatgtcaatgaggtggagagaacaagtatagtaggggcattttgggcaatacgaaaatataatggcctgcatgtgggtccaatcacatccaatttctataaaataccacatctaattgtaatgcatggtttctaaaaggtgaatagtaatggtgggtctctaaattgtagaatttgcaatggcattaatccaattaacccaaattcatttctaacgtttttatacgtgaagtttttatgtataaggttgtttctatgtataaattttatttggaaaaagtttctatatagaatgttttccatgtacaaaatttatatgtaaaaagtcatttatttataaagtttctatgtggctcgtgctagagatatatttgtaatattatctccttggtcggtttccctatttctcttgtaattatgtttctttaagtcggttgtaaagataaggatgcatcttgtctatatgtactcatgtccggcatcaatataatttatcacgttgactctcgtatacttttagctcaaaatcacatgtaggtttcgctcacacctaactcctcagcctcacacacggaatctacaccatgtcggctcatatattaggcctaccgatcaaatggcgagtctgaaattctaaccgtctatgttatgacggtgcccaactcaaccgatttctgcgtgtttcccaaaatgtttttggatgaagagatgtgtacatacattcaaaatatgagcagaaatcaatatagaagtattttggaatgtggagtagtttaaataaaaaaattggcatgccaaattatttgacattccttccaatgcaatacttatcaaagcttaattagtctccaaacaataacctagcaaaaattttgctactatcgaatcttgccactaccaaaaacaccccggaatcatgccattaccgaaaacatatatggcggcagaaatggctgggaaagtttttggcgggaatccaaagtgtatttcgcgccgaaatggcaactgtataaaatgcgtactcctccacggtgcgacttctactaagagagaacgagatggaaccgtgtgtgagaagcgagagcggcggcgtcaagaagccgatgacctcgccgccgatcgacgcagtcggcgtggacctcctccgaaagatactccttcgcctccccaacatggcgtcactcgtcaatgccgccctctcctgcaagcgctggcggcgcgcggcctccgaccccgccattctccagcgcttcctcccgctccgccgtcctccgctcgtcggtttcatcctcaccgaccgcggcgacaagcccgtcccccgccactgccccaacataaacttagtccgcaccaccgcccgtaagcccaatctggcatccgccgccgccgattgcgatatcttcttcgaagacctccccgatatcgattcggacgaggacgacgacgacggccgcggtttctactccgacgagtggcgcctccgcggttgcgacggcggccgccttctcctctcccgcggccgctacgggctcgacctcgccgtctacgatcccatctcgcggactgccatcttcttccgcccgccccaaagccttccgctgctcgttccacatggtcaggtacgccattgtcgtcgacgacgccgacgcctcgttccgggtcatcggcatctgtgacgacacatccgccgccatgttctcctcccgcaccaacaaatggaccctgttcgacttcgacgcggaggcggatttgtgttaccgcttcaccgaccgcgacggcatgtccgccggccggttcgtgtactggcggtcgaacaccaagaacaacaagaacgtggagaggatcttgctgctcgatgtgggcaccatgaattggacagtcatcgtggcgccgtttcaggtaggggagtcgtactgcgtcgctgacatggcggagcacggtgggctctgcctcgtgtccagccaggagcaaaaccttcagctctgggtccgcagcagcggcagcggcaccatcaatggtggatggctgcttaagaaggagatctcattgttgcatcagtttgggtacttgaagaagctgcggagtgaggagtggatgaagagggtgcgtgtgctggcagcaaaggctggctatgtctacatggagttctggtccatcaggaaatctaattcctatcttctcgtcctcaatctcagcaccatgaagctggagatgtttcgcaacggttcggatgaacctttcaggggtcctgcatttccattcttgttgcgtttggcacctctgacgacacctagctgggatgatgcaaatgatcttcaggttccatctggatgatggaatcagtttactagctaatattatattaagtttgtttgccagattgcaattcctctgttttagtaggtaatactctgtttaatttgtttgatagattgcaattcttctattttctgttagagtaagtataagcctaatcactagattctggacattattttttaaacaaaagcactagattctggacgatttcctttttagcaggagcactagattgtggactgatgtataggtggtagtcgatttacaaagttatttgatctttgttctgaaccaaatacctctgtgtttggttgctgtgaggatggacaatggtacatcccttttagggcacttttgggattcgtggagctgcaaatgctagaacggaatgagctaatggctttgctggcaaatgttctgcttgcagacggggaagatataattcgatgggtgtttgaaaattttggtgtgattttctgtcaaatgtctataaagtttcatgtttcatggcgcatagatgggttataaaccaaaggatgagaagactttaaatatgtagacttccaatgaaaatcaaagttttttatggcagttattcaatgatgaaccccctacttctcaacaactcttgagaggagaattatgcagacaataacaaactgttgattatatctttttttttcttttctttttgcaacttttgtatgtatttgctgcactgagtctatttggtggttaagaaataagatgtcaattgaacataagttcccttcaaatactagtttggcgctttacaaattcattttcttgtaacagtccaggagcattctgtttgagtggtggacagagataaagtggtagctggcttttgttctgcagttgaaagactggatgctgtcgtcaggaatttagttagcgaatgttcagtgatcttttggtttcattctgtgttggatagggtagtgttggctcaatgttgtctaagcttttggctatggtttgagacctcttcgctgcgctgttaagctgctaagcaaccttttatgttaccttaaaactcttattcagctttcaatagaagctggggtaatatcactttatccaaaaaaaaaaaagagaagggcttaacattcttagctgtgaccatttctctttgatgattgggcaacactactttggcagctcgcttcatcttctctccgggaatatctatagttatcagtcactacagcaattgattgacgttatttattttgaaaggaaacagttttttttttttgctagctcctgcagagaacattattgtccccttttttttcatctctgttagagcaggtacaataaactgactcagcaggctacaaaactgtgccacatcatcctattcctacgtggagggaagagaagtgaagagagagagaagagaacgaccgactaatttgtagcccggcgatagcgatttttttactccgcatcgctcgcctgcagccgcactcagcgattaaaaaaacacaatgcgggtcccacacaaccacaggggatcacgctttccatccgtatcgccctccccgtccgcatcgccctcctctccagatccccttcctctctctcgatcgccgccgcctcctcgattctcagcgcgcgacgcaatctatccccccggctcccgcgcttctcccctccctcccgcgcggttcccgcgcttctcctctccctctcccgctcgcgaaattgcctacctatatgacagagaaatccagttgctccaaaattccccatcgccatattccgccgcttccgatctccctcttccgccggccaccgaatcgacagccacctcgaccacagacccgctcctcttccaccttgtataatctctcccgcccccgcaagaaattcctgcctaaaaccctagttccccaccaccaacaccatgtctcgtcggaggaagagggaggtagcgccgcctcctcaggccgtcgtgagctctactgctccattcgctgttcctacgtcgcaggcagcgccatatccatatgggggtctcgggttcccgccgccaccgacagcttggcttgcttctccacagccacaagccatgcctggctcttctgctttccatcctcctgcggccggcaagactgatgtgcatcctgatcttgaagaatggtatgtctgtcaattggctttgttagttctgaatttgccatgctgattactccttttagtgctaaataaaaaaaaagagcatgtactgatttacttatttaagtgatgtttctttgaaaaacaaagttacaaagcatgcactgaattctatttaggctaataagatttgatatccatttgtgactgaaatctgaaacaatttgattgtggttattgcactgaaattttacagatattgtttgcatttaaaaattgttgacataagtgaccacaagctataagtttcggtgggatcataataaaaacctgaaacaatttgattcgattttcttgcacctaaacacatgcaacccatcattccaaatttaagcacacaatgttcagaattatatttctaatcagcatggccagtggcgaattcacctcccgtgcagctgcccgggcttcacagcgacgatccttcgctaaaatagattaattcccgggcagtgtgtatgctagttagaggtaataacggcaagcatgtaggctgcaaccgacacttgggttaggcctcggctgcctatggcatgcatgcctcacaagtactagcctcaatgcgtcacacggacatgtacagaagcattgaacaacttgctaagttttaattctaataccagttccttgaatgaatagactaacttattgttgctagagtttcaggcataatgtaatatttagatgatatatatgagataagtcttaaaataacagagttacatataagataagtcttaaaatatcacaatgttaatttttatggctttatacaaaaaaaatgaacatatttaaatattgtagcagtttatttgttagctagccttgcccaggcagtttattcagttgaactggtccccaacaaaataaattggctgtctttttaataaaaacccaatagattagtgggcttctgctataccttgtttgcaccaatgtagtataggctcgtctgttagccctttgtactggatgagtgcatgtttattttagtagtgtatagaactccatttacaaactgaatggccattttcttgttaaaatattatattattcggacacaacttgaacaagatttgcatgttcatgtgttctatacggggggttgaatctcgtccgcccggcggtttcgttaattttatcaataccccatcaaaccatgtccatcatgtggccgaagggagtccatcacagcccatcaatgttgtgaatggacatgtcgctaggactgataagcgcttgtcatggatgaaggatgaagacttgagattggtaagtggcttatgtcagctatttatttgttaatggcatgcatgtcacttgcattactggcaataataaatttctttttcctgaaattgtagatcagtgcttggctgaacaactcaaatgatcctatagaatcgaatttcaagaagaatgataaatattggggcgatgtagctgcagcttacaacagcactacaccaaaaaaccgagctagactagttaagcaagttaaggatcgttttggtaaaattaggaagaaggtcgggaatttttgttgctcttggaaggaggttaattcattatatgctagtggggagtctaatgaagatctgatgaacaaggcacagaaaatatatgagaatgacttcaaggatggtccattcttgtttatgcactgttggaatgaactaaaaaaacaaccaaagtggcatgcatatttggagcagcttgacaagtcaaacaaaaggaaggcagattacaatgatgttatcccccttgatgatgaagaagatataccacgaccaataggagccaaggcatctaaggcgcaacgtagttgcaaagaaaagagcaaggtccaagtttgtacaactgagcttgaggatgacatccgtaagtttatggatgcgcatgcagcaaccaaggaagggcaaaatgaagtgttagagacccaaatacgggtttctattgacaaccatgcagccaaaaagcttagtcgccagacagctatgattgaaacctatcgagacttaatgaacaaagacacaaggaagatgcctgacgatatgagatctgagcttgttcacatgctgaaatgcatgagagaagagatattcaacaaaaatcagtgaggtatgaatctctgttctaaaatgtagttagatgaaattaatttgaagccttcaaaaaaaaacatgtaatcagcccaaaaatcaatgcaagttagtacaaacacacatgcaggtagttccctctttcatgcttattaattgcagtttgtccaaaaaaaaagaactttctccaagttcccatactgattgcttattcattgcagctagtcaaaaagttatgtagtcagtccaaaattttgcacttggtccaaattatgatgcagtcaactcaaatattcattgctagtagtctcttatggtgaaattagcatgcaaaagttgtttgcatttaaagtggacctttgtccaaattcccatgttgactacttattaattgcagctactcaaaaaatcatgtaatcagtccaaaattttgcacttggtccaaattataatgcagtcaactcaaatattcattgctagcattctcttatgctgaaattagcatgcaaactactacaacctgtcaatctctatctatatattgactctcccattctggaattcccaaaccattccatccttttctagaaccaccatgtcagattcatcctcaaactcaaactcatcctcctactcaaatgacctagacccatccaaatttcttgacaagtacatttctgatcaaaatgtcctagactcctttgctactcgcatcgtagagaagatcaagaccaagtttgcagctgggctactcaagcgctaaagtggaactaggaagaccattgcaagggatcatgaagaaggtcaccgacgtctagtggctgattactttgcaaatcagccactctaccctgagagaatgtttcgcacaagatttcgtatgcgaaagcatctctttttacgtatcgtgcaagccttaggtcaatggtctccatactttactcaaagagaagattgttctggtcgcactggcctttctccacttcagaagtgcacagcagcgatccgtatgttagcatatggcactcctgctgatgctttagatgaatacttgctaattggcaaaagcacttccttagagtgcttggacacttttgcacgaggggtagttgaggtctttggtgggcaatacttgcgacggcccacaagtgaggatatagatcatatactacaagttaatgaatctcgtggctttccgggtatgttaggaagtattgattgcatgcactggaggtgggagagttgtccgagagcttggaggggacaattcacccgtggtgactataaagtcctaacaattatccttgaagcggttgcgtcatatgacctttggatttggcatgctttctttggtgtcgctggttctaacaacgatataaatgtgctgaatcagtcccctttattccttgaacaagtgagaggggaggctcctcgggttcatttttctgtaaatgggaatgagtacaacaatgggtactaccttgctgatggtatatacccagaatgggccagcttcatgaagacgatatcacttccacaaatagagaagcataaattgtttgctgaacgtcaagaaggtgcaaggaaagatgtggagcaggcttttggggtattgcaagcccgtttcaacattgtacgccgtccagcaaagaagtggaagcgaaagagtgttgggaaaatcatgctagcttgtgtgattctccataatatgattgttgaagacgagagagaggatgcaatatgtgacattgacctcaatagaattcctaggacatcaatagttctgcctcctgaagtaacttgtgatgataacccatgtttttctgatgtgctacgtaggagatctgctattcgtgctcgttcagtccatacccagctgaaaaatgatttaattgagcatatttggaatcggtttggaaataggcagtcaacataaacatggtagggtaataagcatgtggtttttgccttctttttttgtcatatatagatcatcaattaatccttgtgtaatatatttcaggaagatgttctcttgtccaattcatggtgctgaacttcttacaggtaacttgtatgaactaaatttactcctaggccagactacttacaaccatagtttagtgattctctcttcttatttgggatgcagtagcatggcattctcttaatgctcttacatgttgaactcatactgaattaacttgtttatgcatttggatatactggatctctcactcaattaattatctcagcaactatttctttgaaagaactcacactgaattaacttgtttagatttatatctccttcatcacatttttcgtatcctgtactaaggaaaaagcatgcagtagttactccttttagtgaggtttcattgaaaagatgattcactgtgcaatttttagtttctcatttattcatcacacgatgtacatgtcatatgatacatctgtcttttttttttcagcaaatgatggtagttcaggcaatggtcatatgatgcaatggttcaatgaagagtctctctttgattagatgaagaaatcgttatctatctgttagataacatatttatgtattttgcttaatgtcacattgtttgtgacttttggatttgtaaaccattaagtatgttttgttttatcctctattaccttgtcggttatttagacatgcactaccctatccttttgtttagacctgggatgatccattaatctacttgctatggtattttatttatctgttgttggtgccttgtatttttttatactacggagactcttcatcttataacacaaatttggttgatgtgcactgtattgtgttaactatgtggtgttttatgattacttctgtagcatacaaatgttcatgccacaacaaattggctacaatgatccacttcactcttgatcatacacattgacatgtgctagttataattaattatttgatctatgagatgtagccaaccaacagacaacctactgtatgagcagttggctgcagcgttggctataaaatggagtgtagccggcaatgggctatactattagccttgctcttagggcaccgttacatgccatgcgtgtaagatcactaccgaaagaatttctattgaatatacttggttaacttgttttccatgctctctcaaatagttcagtatatttttttcaaagaagcaggtaggagctctgccattttattttatattagaagagactaaaaaaagttttttttttactggagcagcaaacacaaaaaaagaattaaaaaaagacaactttggtaagaagcttttggagctacatttgagccggcgcttctccccttgatttgcacaatagtagtagctatgttgaccacatcttccactgtctcgttataaacgttgttgaaaactctatcattctatcgttttgctccagccaaacgcaccatgacgtgcatatgatgatgccatcaaacatcctttgatgttcctttagagcaagtttaatagtatagccaacaactactagctccaaatcttctatagcgcctgaaaattcactagtaattttcaaactaatttatgcaataaaatcatcatccagaaatcagccgaggtacacaaactaataatttaatatacaaatccatcataataataacactacatacttacaaaagaaaagaaaaaacaacagcggaattacggtctagcgaagctccggcttcacttccataggcagctcaactggggtataaaccaaacgtcttctccttctatttccttttcttcaactgaggtttgattgattattgcaagatgagtacatggaatactccgcaagccatacagcaaatatgtaagtgtacaaggataccaaaggatggcataatatatggctcatttgcaaaagaagcatttagcaaacatttgagaattgtaaaacagtagagtaattaattatcaattttaatcaacactgaacatcatacccatgctgcacaggcccaaccaaacctgaacaaccatacccagctgtacagatctatctccaaaccaggaatgtaccgttccaaaccaggagctaatcaaattattaccagttatagcatcatttattatggtgagaagtgtgagactaatcacgaaagacattgttagatccgcccataaccgcgggcacggctattcgaatagctttactctggccagagatgtaccactgtacccacaagacacaacccaccgtcatgtcaccgtgtccgcgcagacacgtcaccatggcgagtgattatgacaagacccctcgcataactcaactcaaagctgtacaccattcctggatcaataatcacccccttataaaacaaggcatggactcccagcaacccccgtgggtttatctccaccacttctcagtctgccacaccacaatgagccttgctatacaaagtgtccagccgttgcccattctggcttgtggttagcatgattaatgtttcataaccgaatctcgcgaaccggtccttaattgtcatgagcacgaccatcaaaaccatgtgctcactgttgacggtccttatcgatcagtttcgaccgtcaatattaccaaaatagaggagaactagttatgcttgcaatgcatatatatgttagaataataatattccactagtattatgtttactaaccttttgcagagaatgatcattaaatggaggagaatcgacatcaattcagacaataaatcaattggacgatgtcgagaatcagatttatgcatgaatgggccaagaactcaaaattgacacgatgaattgggccaaaattcacaagtttgcataaaggagcaatggaggagaccgccagccaaagatgggccaggatggcctagcccatggttcggccgaacccatcctgacgccttggatgcagggttcggcgtggacgtccaggattgcttcccaatgacggttggagggcactttggacaattctccttccacaaccatcataactacctctatataagaacttcactctcttcagttcaatacacacctcaagcaagagctctctcatattctctcaagttagtttagttgtcttaaactattggaataggaatagagtagaaatcaggagtccggaagtcttcgtaagagttcgggtatggctctagtagctcttctcttctcttttgtaagatttgtaattagaatattcttctatatacatttatggtattgaaatactttccgagtatgttaatacctactttacattatgttcatgttatactgaatatactgctagcttatctaggagatgctttggtgcgggtataatgtttgcatatgcaattactctatgtcatgacgatgatattagagtagtatctggtagtttaggcgtagtgtctagattacgggatatcattatctggggttatatgctgcggatgagaggtgggctgctgatggtgatagctcagtacgggtattcctccgcgcgtgtacatagtcctaagttaattctctggggagggtatttctccgtatttagccccggttgtatggtcatgacgggttgtcgtaaggaagtcggcagtcaggggtggcttctcgaagtactaggagggcatcggatagagggtatttgctagtatatcagagaactagaatgtatgtataccgtgtatactagaagaagtataggaatagattatcttccttttttctttccatttagcttagataatttattatgagaatgagtagcttaatgcttgtgtgtcactctacccttggattatcttaacctctgcttaggatatgattatcacaagtaatatataaattattagtcaagttctctctacatgatcttcccatgggataaaataaatacgatacccttgaagtactctcgggtgaaatgctacaatggtatatccgtgtgcttgcggatgaactctttaaccacaatataacaagagtatttctgcgccattgccgggaattatatttctggtaatgtcgttaagaaataccaacactcacaacccaccagtgtcaagttttagttgacaaattaattaattaaccaatcacgattgaccatcgtgagctacaattaaatatccatcattaggtaatagtgaagcattaatcagcctaatagtgtgctaatgtttctaagcatggctaagcaattagatctaatacatgcaaatgggccataacaaaggaacaggttcacaccacccggtgacattcgaaaataaatgcacagttgaaataaacaaagaaattaaatataggatcaacatgcttaaaggaattgtgtttgggatctgtgtgacttgccttgcaatattcggtcttcaattaatcttcttgaatacttccgacgcactcgcgaacctccgaaacgacgaaaacgacaagctaacacacaaaatgaggaaaaagactaataaaaaccaaataaacagtacatataaagtaaacaaagatgtcgataataaatttagatgaattatgagacttgaatggcctcattgtgacttcatatgaattagttacgaatttcacaagatttaatctaattaaagcctagtataaatattttaattgaattacgacgcaataaaaaattacttttgaaaaggaaaagagatttattgcgtcatcaaggacagtccaccataaaccgggttcacagaagcggtccacgaaaccaacggccgagatctaattgacctaaaattgaccgaatcggacggcagagatcgatccggtctaccacggtctacggctgacgtggcactgcgatcgacaatgatatcatcaccggcggcggcccggcacctcatgctcgccagcgaacaatggcgcggcggcgcaaacggagggcgccaaggcgtagagctcggctcaacgaactcatcggtggctcagacgacgacggatggcgatgatcgacgacggcgacgaggttgaagcggcggagagcttcgagtcggtggtgacggtggtcctccagcggtctacgacggaaacggagggcgggacggggacggtggtgaccttgcgaacccgatggtagccttcccgagcgacgacgacgaccggagcgccggcggcgcacagccggacttccttcggcttcggcggcgcacgggctctagtggctaaggtgctacgggcgacggcgagctaaggagaaggtggtggcggatagaggaggtcctgggggtacttttataggggctaaggggcggtggctaggcccacggcgaccggcggtgagaaggaaagagctagggttttggaaagagaagctaaccaaatcggcatcgaatccgatgatttccaaacgaattagctcaggattacaaaagagaaaaggaagaggagatcgaggggattatttcccctcaattgattcagccggagaaggaacgaggtggccggattttaggaaggaggcggcggcttgcggcacagccagggcgcggttggaggttgaacacgaccctgacaggtgggccccacctgtcagcgggagacagaggggagggagggactgggccgagcgcgagcaggccgagggaaagggagagagagagaattgggccgactttcggcccaaacctgagaagaagattttaaaacctttttctatttaaattattcatgaaatgaaattccatttattaaaaatacttcctttgatcaaataaatcccagaaaaatctaggaactatataaacaatagaagtatataacaaaattttatctagcccacttttatattgagatttagcaaattaaaattagatcttctcttttaggcttttaagattatttctaataattccttttaaacaacaatttataatctaaggatttttaaacaagaaaggcacttaacaaacttataattagatcattaattgataaatttatagattaactaattactgaaacattctttgtattattaaaattaggaattgagctctgaaaaatcgagaaaattccaaagtataattaatcatggagaatttaatacaaattaaatccaaccatgctttatgtttaggaaattttatttcccacatttaacttcacttgtaaattaatgaacatttaatataaattctattaataatttattaaataatttataaatcctaaaacggaaattcaagctgtgacattgtcagttttgcttgttggtgcatttggaagcaacataatggactctcaaatgagattcgtctgcatgtctgcagaatgaatggttctctcacctctttcattcttagctggttacagagcttgtagtttatcaggttttgttttgttttttgtttttctgtacatgactcttcttttttttaatatatataactactaggcaaagccctggtagtaatatctccatccttttcttttctcgtcaagccacattaccttacttttacatttggattatcaatctatatactatttaaattatcataaaacttattaacttatataagcttatattgtttagctattttcatattatttttatttactgctatcatactaaagttaaagttaagtagcaatgcgcgagatttcacttagtatttaagtatgactgaagtacacttgtcttgctgccaggccttcaaccaaacaatggtcactagtcaggctgtgcaaaattcttttatgtttcaagtattccttttcgtagcatattgcggaggttgctaagcaaacaaccaatatcgcataatgttgcctaatatttaagtgcttaatagaaaatataaaactggagaacagagatggcgtgaggagaggggcacatggatggataagtacgatcgatgggtggttggattgacagagggtgccagtcatatgttatagttatcagttttcaataaaccggcacctatagtttgtttattgtatgtacgggttttttttaacaaaaataccggtaccaatattatagttgttggtttttatatagaaccgacatataggtaaccggtacctatattataggtgtcggtttttatttatatctttttctactagcaatatgtctgtgcgttgcaacgcgtgaaaatgatattaatattaacaataaataaatactaataattaaaatttaagtatcacaacatattgaaaaggaatatttttttgctaaatttcttgttggttccacttaggcaaaaaaaaaatcaaagtgcaaaattattcctaaatcgtaattccagtgggccgggggaataaaaaataattaaatattctaactaaacttcctgttggttgtatttagttagaaataaattaaaatgcgtcaacaaaatttactgcaattttatagcttaaaatgatggctcaaattgactaaaattatttataaattaaataaaacagtaagtgattttagagtgaaaataaatgaaaaatgaatttttggccgagaggctagtgtcggcccaaatggcatgccgacccaatgtggggccgatctgagccatccgatctgatggacagcttggatcggtcctgtgccgattaaatcgctggccggaggggggaggggtccaaaaaccctaaccctaatccactttctcccctactccccctatccaatctccagtgatgctagtggtgatggcggtccatcgtggtggagcacgcacacggctccgacttcatcggctggtacgtgttgacgatccttaaatcataatatctgaccgtcaatatctgcatatagtggaataaaatacggtattcaactgagtggtagggtttattactaattatttccactagtgttggtatctatttggatgcaggtgacaaactaccaaagttgaaaggaaatatacataaagaaggaggagaatcaaacttatatccaaacttatggagttttggacccaaaaacccaattaaacacctccaaatgggcccaactaccatgccaatggactgagggcctgaaaatcagtgtccacgaggaaaaacaggaacaacggagccggccagggttcggccaaaccctgagagaggccgctggcccaggcccaagttcagttcggtagcaaaccgctccacaatgacggttatggccattttcaccggtggaaaccgtcatcagctggatacttggcaagaagagaaggaagatgctctttggaagctatggaggatctccacaatcgcaaagcacctccacctataaatagacctcctctcccccacttcacccacacacaactttgagctgaattacaagaggctttattgtatcttttatacattagaaataggtagaggataaggggaagctctggatgagtgcccagaagtttggcgctctcgccgacttctacctcgacaagtgtagctttctaggaggaattctggaggagtaccggggttgtcggtacactctgctccgtattcggagaaacttcttctattaagtaagcattcgggatcctttcttatgttatttaattactttgtctaagtgagatagatttccatctttgcgggttcattgtttagtattcgtactaagtgctctattactaggactttggataaagaaggaagttcatgcgcacgtattcgagtagtaattaaggcatggtgtctaggttagagattatctttgtttgttgtgtgttgacggttgttagtgatcagtttcgaccatcaatattaccaaaatagaggaaaactagttatgcttgcaattcatatacatgttagaataataatattccactagtatttggttcactaatcatttgcagagaacaagtataaagtgaaggggaattgacatcaaatcagacaataaatcaatcggacgatatcgagaatgggccaagaactcaggattgacacaatgaattgggccaaaattcacaagtctgtacaaaggagcaacagaggaggccacctgctgagtttgggctaggtgggcccaacccatggttcggccgaacctcccgtggcgccgatggatgcagggttttgatggacggctgggattgatccccaatgatggctggagggtattaccgaccattccaactgtcacaaccgtcattaccttcctataaaaggagctcctcttctcacttcactcacacacctcaagcaaagatttctcatattctctccaatttagtttagtgttctcaagctagtggaataggaatagagtagaaatcggagtccaaaagccttcggaagagttcgggtatggctctagtaccttttctcttctcttttgtaagctttgtactattattagaatactcttctttatacatttatggtattgaaatactttccgaatgtacgaatgccagctttacattatgttaatgttatactgaatataccgctagcttatatgggagatgctttggtgcgggtataatgtttgcttatgcaattactctatgtcatgacgatgatattatagtagtatctggtagtttaggcgtggtgtctagattatgggatatcattatgtggggttatatgctgcggatgagaggtgggccgctgatggtgacagctcagtacggatattcttccgcgcgtgtatataatcctaagttaatttcctggggagggtattcctccgtatttagccccagttgtatggtcatgacgggctgtcgtaaggaactcggcagtcaggggtggcttctcgatgtactaggagggtatcagatagagggtattagctagtatatcagataactaggatgtttgtatactatgtatactagaagtataggaatagattctatttctcttttctttccacttagcttagatatttcatatgagaatgagtagctccctgcttgtgtgtcactctacccttggattatattaacccctgcttagactatgattatcacaagtaacatataaattattagtcaggttctctctagcctgatcttcccacgggatataaatacaatacccttggaatactctcgggtgaaatgctgcaatggtatatccgtgcgcttgcagatgaactctgtaaccataatataccaggagtaatgtcgttaagaaataccaacaagcatttccggcaccgttgccgggggagattcataatagagattaccagaactaatactttatatttacctctgtataatcactgccttttgcaggctaaccttggttgttttcacttttgttgtggaaacagttgtcacaccccgaagttctcctcccaagcctaaaatttaatttataaaaacgaccccaagaaaatgaaggtgcaatcaagagaaaaccctaagaaagtaatgcaaataataatcggagttgacatgtggaatttttcttgagttctacatgttggaattcattaacaggatttttagtggaattttcagagctctagaaataattttaaccatttaaaa

SEQ ID NO: 23315 - DNA, 17026 bp, Oryza sativa
  unsure (1)..(17026): unsure at all n locations
gttgggttcgcccggccaaggtcaacctcgtccaacccctcctccgtcgaggttcgccgccggagcccaaccccgtcgtgcgccggggagtgacgccatggccgccgcctttctgccggcgccctcgccctctcgcactctcctctctccctctaacccctctccttttgttcgttaggaggttccggagctcgtcccgccgtcgccatcgtcctccgtcgctcgccgtcgtcgatcgttgtcggtgaggtctctcctcctctttctctctctcccgcaccgtttagccgtcgcgccgccgcttagccgcgtagctgccgcttcgccgagacgccgccgctctccgccgccggtcggtcgccgccggccgccgtcttgcgccgctgccgcatgcgcgccgcgccgtcgcgcgccatggccgccgggccggtttgcgccgtgcccgcgcgcaccggccacgagctcccgccgccgtccgatctacccttggctagattggggccatcggttcggctgtcgcgtggccgccgagaggtgcgccgctcctccccggtccgtggacccgatccgccgtggaccgccctccccgagtcactgccatgcgggtcccgcttgccggcgccccttcctccctctcccgagccgctgaccggtggggcccgcttgccggcgccgcgccccgccttgatgacgtcagccctggaatatattgcgcaataaatgatttaaggttttttcttgtatagtaataaacacagtgattcttttaaattcatnctaattaatcgaagttccccttaaccccattcaagtctcagtaaatcaagaaaaatgtgtagaatccattaaaaatggttttgtttcctgtttcagtagtcttatagcctgtttgcaatgtttgccttgtatgtcgctagattccggctctcccgacgctccggtgtacttcgagatagtcgccgaggttcctccagcagcagagcaaggcaagtcatgcttgtcacttgaatatgttgatcctatattgcaaatgctctattgttttctttcaaatattgcattgttttataatgatactatgggttgtttacctattgtcgtagccatgctgttgatgtaccatgtttctttgtcaacttggggttctaacatgattagagttaggactagggattgcttagccatgcctagttcaactagttcacattggggaaaatcctattaatgtttagactgttggttctaatagttttgttggattagtgacaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcacggaaacgtgtcgtggggctgtgtcttgtggatacagttgtacacctctgatcagagtaaaactattcgaatagccgtgcccgcggttatgggcggtcaaccagattcaccgtgattagtctcaccctagtgtaatcttttgaatttggataatttaggtggatggttgggcctgtcgcaatgtgggttagcgttggacagtggatagttgatactaattaattattacaactgtttaaatctttcaacttctgtttataaatgctcgctttatgcaaatgaaccacttcagctcttctttgatgattccctgcatcatacccctattccggtatgacttgctgagtacagtgggtagtactcagtcttgctctacttttcccaaccccagagttcgagttcgggtcagatgaaggtttctccgaggagtaggcttcgtccgtgccgtcgaggatgcctgtggagtggtgttcctgctgcagttttagtcaaggcttagctcctgttgtctttcttttcttccgctgcatttatgtaagacttttatgatgtttgtaagacgtggatctgaatgtcaacattgtcgtttgtgtacccaggctggtcctggacggggaatttaatgcacattctgcttgaaattctattcgggaatttctgggcgtgacaacagtgtagtgcatgactggtttcaacttgccaaaaaactttaaggaaaatccagaagctttcttccggagcgtcaagccgcaagtcgtcgctccgcagaaaactctaccgacaaagaaaccagccataccagctccaccgaccttcaagactatggctgacaagaccctctatgaattcgctgctccctctactgacaatgtggacattgggctgcagatcaacatgggagatgtggatttcgatctgaagtccagcctcatcacgatggcgcaggctagcccgttctgcggcatgcctaacgaggatgccaatgctcatttgcagtagttcctggagatctgtagcacgtacaccatgaagggtgtcagttcggacaccgtcaggctgcggctgtttccgttttccctcctcgggaaggcgaagcagtggttttatgccaaccgtgctactatcaacacctgggacagatgctctacgacattcctctcgaagttctttccgatgggcaaaaccaacgcccttcatggaagaattccaagtttccagcagacaagggacgagtccattcctaaagcatgggaacaaattcaggaatacgtggccgcctgtcctcatcatgggatggacgactggctgatcctgcagaacttctacaatggactcactcccatgtcccgtgaccacctggacgcggcagctggaggagccttcttctctaagatggttcgaggagccattgatctaatagagaagatggtctccaatatgggttggagcgaggaacgactccaaacccgtcggcgatgcatgtacaccgtcaaggagacagaaatgcttgctaccaagctggacctcctcaggaagcaattggacgatcacgacaaacggtcacaaggcaccgtcaaagccttggacttacacgtcacgtgtgaggtctacggcagcacaggtcattctgggaataactgcctggaaacccgtgaagaggtgatgtacatgggcaacaacaacaacaacgggtatcgtccacaaggagtcaggggtggaaccagccatgcccatactatcaaggaggtaacaataacggtaatttttctaaccaaccctccttgaaggatatcgtctttgcgcaagctaaaaccactgatgctttaagcaaaaagctagctgccaatgacaaggtcatagaaaacattaatgtcaaactagatggcttcgcttctgcttttcaaaactagctgagctttaataagatgatagaaacccagctagctcaattgacttcattagtacctgcaaatgaatctgggaggattctggggcagcccgactcctccattgaaaatgtcaaggcgatcacaacaaggggaggtaagtccactcgtgatccgccatatcctaacactaggagctaacggtatctccaaggaagcgccatctagaaatttggctgacgaagaggttcagccagagaagactgccgacgagtgatactcacagacaggaagaatagggtattggggtacgttggagcagggatctacgtagtacgacatcaaaacagacaaaagacaaggattatactagttcagaccccttatcaggtaatagccctagtctagtttatatgggattgatgacgatgagaacagattacaaagagagtaatcgaacaggtgataccgatgagatcgtagtcgagggattcgacaagatctccccggcgagttggctccgtggactccggcttcgtgaactttggtgggtgtgttggcgaagagatgcgatgtcctttgcctctcccatggggtcccttttatatcgtgggataccttgaccctcaagtaagacttggagatatgtaaaccgacacgatatactagagattttaccctctccgagtaggacttctgcaattccttaacttcgtggagatattttccataatttgaggcgaattcctaacggcgtatacggaaaccaaccgtatacgtgaaggtataccttatcggtatattccataagtcgtaggatagagggtatgcttatccgtaaccctgacagtagcccccgacttcaatttaaatgaattatgtgctcgcacgcgacttctcctgatggagcgttgtcgtactcgttggatcgatctcggttatataaccgtagagacatagagttatcgataacgctttcagggagcctatatgtgcgggttttgaatttaaattgaagtctgaacaacggtccccaatgggcctcagaaattttcggcgaaaatctctcccctttcctcgaaatacgaaccatcagatagtgcgcctatttaatgggattttgggatccatttcgagtccgtttgccaaaaactctcactgttccccagcttccccggactctccgtctccccaatctcctacaccctccatcagcgatcttcttccggcaatctcccccaatggcggacctcgagcaatcttcctccgatgccgccgcgctaaagaagctgtacaccggaggagccgtccctccaaggcaaaccatggcgagggaggtaggaggtactgtcccttctcccgttttaggtcgtatggtagcggtagaggatttcatctgatgtggctttctacctcctccttccgaattcctcttgctgatattaaacttctacgacatttctcttttgcacctaaaccccaactccatcgcttttctgagcatatttgttcatctttgcgaggcctacattggggtagtgcctttccttataaaaagcgaaagcgctggacattaagttgtcgcgtaagtttctatccactatgattttacaattgcattaattgaggcagaagaatgactatagcctcctcggttgtacatattcctaaatggcttattagaaaataaaaattaatttatagataaaacttatatatatttgtttatagcgacttaaaagccaacgctacaaagaaattgcgttgaaaatatcataaaattaacttcataattgacgtttgctttggtttattaggcaaatcgatgaggctccttgttgactaccaatatacgtggaataatggaatattgttaggatgcttccctaaccacaagtgtacgttcaggttaattttgtgagggaaaagttttgcttagtctccataattttcttattttagaaacctttcgaatatttgaaatttgatgaagattttatggaaacaaaatatccatggagctaacagaaatttaaaattaatatttcagactatcgacaacgagacacttataatgagttaatccatgtagttaatagaacattaaaatccactcctaacagaaaataagatccagaaagtattttgttgtcatgctacttttgatgaaatggcgagtcaaaaggataaaagtataacgagaacaattattggcgctagaaatcgcgggaaaatatttttggcggcaagccaaagtgtatttcgcgccaaaagggcaaagcgatataaaccaaactcgccaatccaggaggcgagagagactgagagcgagagatggaaccgtctgtgagaagggagcgcggcgccgtcaagaagccgacgatctcgtcgccgttcgacgccgtcagtgaggatctcctccgactccctaacatggcgtcactcgtcaacgccgccctcgcctgcaagcgctggcgccgcgcggcttccgaccccgccattttccggcgcttcttcccgctccgccgccccccgctcatcggcttcatcctgaccgaccgcggcgactccgtcccctacagctgccccaaccactacttcgtcagcgccaccacccgtaagcccaacctggcgtccgccgccgccgattgcgacatcttcttcgaagacgtccctgatatcgattcgggcgagcaacgcggcggtggctacttcgacgagtggcgcctccgcggctgcgacggcggtcgcctcctcctgtcccgcggctgcggcgggtttgactcgccgtctacgatcccctcgcgcggactgccatcttcttctccgccgcaaaacttccatgggtcgttcctcaaggtcaggtacgcgattgtcgtcgacgacgccgacgcctcgttccgggtcatcggcatcgacggcgacatgttcttcgccgtcttctcctccagcaccggtaaatgggccttgttcgaccacacggcagacctgtacgaattcacccgcagcgacggcatgcccgccggccggttcgtgtactggcggtccaacaacaagaagtgcaggtactacgacaacgacgagcggatcttactgctcgacgtagccaccatggagtggacggtcaccgtggcgccgtttccggtggggtagtcgtactgcatcgccgacttggcggagcacggccggctgtgcctcgtgtccagcaaggaacaaaaccttcagctctgggtccgcagcggcagcagcaatggtggatggagatctcgctgttggatcagttcgggtacttgaagaagctgcggcgtgaggagtggatgaagagggtgcgtgtcctggcagcaaaggctggttatgtctacatggagttctggtccatcaggaagcccaattcctatcttctcgtcctcaacctgaacaccatgaagctggacatcatttgcaacgatgcggacgagcctttcaggggtcctgcacttccattcttcttccgtttggcacctctggcaccaagcccggatgataccaacgatcttcacgttccatctgcatctgcttgatggagtagtaggtaatgttctgtctaatttgtttgtcagattgctccgaaaccaaacctgctcaaccggatcaaagcactaagttctggggattttttttagcaaacgcactgaattcgggactgagatttggtttcggagctctatgttcaaaactcattttccaaaagttatttgatattcttttagggaatgcgcataggcagtcgcaccatttgtattaagagttcataggagagtttagataacatccaacaacccaaaaaacataaaattatttgatatttgtcctgaacctaatactctaatagtacttcagtgcttggttgctgacggctgagcatggcatcccttttaggagaacaatgcctgatttccttagaaatagttctggcttcctctcttggatgacttcggtgtgtagatgtagttacgacactaggcaggcgtcaggccccatacattgtcttacgactttacggagacctgtctatttggcggctaagaaatacggagtaagatgccaattgaacataaattgccttcaaatattagtctgacgctttacgaattcattttcttcttatagtcatggaacattttgctttgacaggtggacagcgataaagtcgtggctggcttcgtcctgcggtcgaaagagtgaatgctatatatcttctggaatttagctggcatatacgtccattgatcttttggtttcggtctgttggatagggtagtgttggcttaatgttgtctaatcttttggctattagatggagaactgttagctgtcttgttaagttggtaaccccagccttttatgttgccttaaaactcctattcagctttcaatagaagctggggtgatatccctttatcaaaaaaggaagtgcttaaccatttcacttttatgattggataacatttggcaactaggtccatcttctctttggggattagcttgtccaagcaatgatcaacgtatttgaaagtattcagttttgctagcttgtggctatggtaaaagagaatttctatgatatgccgtcaacaaagactagtcccttttgttccatctatgcaagtgcaccgttaaatgcccttatgtgcttggaaatgttcaatcagtgttgtgagtgtaagacaactgtcaaatgttcaggcactgagctgagcagcaggtaattgattttttgtctaggttataggttaaaagttcagttcgtagtctttagttggccgcaacagaatttttttttaacagaacacatttcagctctgttggttttaacgaatatacctgcttaacttgtttgatatgcccaacagaaaatactgacatgttacaatcatttttgcgttttcttgcaagttgcaaatagttcagcataattaagctagtaccattttgacaaggaagcgcacttgacaaaatttgggcttatctgtctttagaaacaattttgtagtctgaaacttgcgtggaattgacagccatcacaccgtgcagtcgcgccaggaaagttgcataaacatccagcccattttattgcaaaaacaccatccagcccattttaacactgctagagcgaaattgctacccccactcttcccttttgtcttcccacttcgaactatcctaagaagctgctcaagtcggactcagcttatagccacgtgtggagcgcgacctgtctggtatagtggactacaatccatacataaaggaataagccgtgtcaacgactcacatgagttaggtggtgtttttttgggggataagcttatttaacacctctcaaatattacgtttatctaaaacacatcctccaactttaaaatcggatatccaacacccttcaactgtttaacatttcaatttactcccatcatctaaactaggtggtttttactgatgtggtaattcagtcagcaaaataatatagaactgtggaacctatttgtcagaccaagccttctctttctctcttcctttctcaatctctcctctccctcatgacgcacgggattacaatacgagtgccgccagcttggcaccaaaagcctccctgtggtctggagggttgccaacgtgctccttctcgacgaccgccagagttggaatcctcccgagggataccgccgtccaaaaagaaagatggatttagcaagcttgagctcgaggccaccctgttgacacagtcttctccaacatcagcaagggagggcactgtatttgggactcagggatcgagcgccatgccctattgatcccgttttctccgacctcgacagccatgcctcgagcccaccgtgtcgtgacagtgcgactagggcccagtgtcggggtagccatccagaccctacctacatcaccgccccgtcgatctcgacaccaccgccggatatacgccaccacgccgtcggcaccacatccctgtcctcttctccgcctttggttccttgtctctgactagaggcattgacgattgggcagaagtcatcttctccgttgtgcccacggaacccctccatggtcgcttgtcgctgcctctacctagtcctctgctgatttcaacccatcgtcgctcgatcacacaacaggagagaggaggtagggagctcaacggggatggagtaagggaggaggcggaggacgaggggagagagagcttgctaggagctgttgctcgtgtattatggagcttgtcgagagaggtagtagaggggagggtggggcgggggggaggaatagagagcatgggactaactagtgggatcgcatattgacgtggactacttgttgaggtggcatccatcgtggcttccaattataccaaaaatagccccaaaaatcatgctagggtgtaaaatatacgatattggtagtttaggagtgacatatacccggtttcgcagtttagagaacacaaaagtagagggggaataaaatgtacttatcaattttttaaacagaattaatgagtaatagggtgaaccgtaataattggcatagtttatgcaactttgaaaaacgaacccgaatattctcaacgatattattttcaccaaaaataaactgcagtcgagcatgtatacatggctcagaccaaacatcagttattttatatctaaatcttgattttttttctagaaaaaaagcggactaaaaaaaacatgattaataaaataactagccgttaacgccttcaattccagaatccccatcccaaacgtctcaaaacctcgtcaagaacctgaaaccaaaaattctctctcgcctcgcgcgaaatctcccgtcgatccaccgcggggacaagctctagatctctctcctacgatccaccacgcggagaagctctcgatctctctccttcgatcgatagtttcgtcgcgctaagtcggtggtgatctgatctccgcgttctttcgggggagtttcttgctaggtttttctgggccgagctcgcccatggaggcgccgggctccggctcggtcccaacggcgaagcgccgccggctcgtgccacggcctccgccggtgccgcttgaggtggccggcgcgaggggcccgtacatgccgccgctatgtattaaatccaagaacccgtccgcgaaatgctacgtgagttgctgcaaatgactccccttttcttagcttcttcccccaagttgaattcttggatggatttccgtccgctcgttcgggcctgatggaatgtgtggaaggaatccgttgatgccgcaattatggatgttttaggacttaggaggttctcgatgtcgttcttgataatccgagagatagatttgctctgactcaattttagatgattcgctgattcttgatgtctgcagagccaattatattggtctttgttggcttgttttagatgttgaaattttgtagaggaatctgtgatccgtgccccaatcctggaatgaggaaatgttaatgatgtgggaatataattgatcatgcatgattctttttagagtgcaaaagaaattcgaaatcttggtgattttgtcctatactcaatctgttttttggccaaaaattttgtcaaaagaaaatagtcagtgtaacttgttcagaaccaagttcattcgtcagttgcatcaatattcatcatcaatgttcgaagaaacctagcacaatagtcgagtggaagacaatgccaagtttgccaacattagttacataatccatgccaagcataaatcacagaatctagataacctttagtaatcgatattattcctggacctcaataatatgtttttgaagtaatatactgaatacgctgttcttttgttaaacatgacagtgagaattgctcgtaggtcccaatcctgattttcctttgtattcctcaattttggggttgtcctttcacataaaaatcggtatgaatcagtccagtgttctgttaagcttttttgtggacaaatcgattgtgtgcaataaaaaaacaggtacaaactgttcttgatgttttgacaccaacagtatttctcttcagtgaagtactgaaattttcagtcatgtaggaattgttttcttcttgtgtcacaaattcaatcttgtctcttcaatatttgaactttcaacatagtaatcattgaagtatagttgatagtgcaatggtgcttagacttgtgactagtgttattattttgtattagatcttcaaagtggtaagatgactaatttgtatttctatatttatggtgacagggtgacagattcatacctgataggtcagcaatggacatggatatggcatatttcctcctgacagaacctaagaaggagaaggaaaatactgacatgctatcaccagctgaagaagcttacaagaggcttcttgccgagaaactcctgaacaacagaagccggattcttgcattcaggaacaaaccaccagaacctgaaggaattgtgcaacagctattatatgaaactttgacttccagtcagacaaagcctgctaggaagtgtagacacataccccaggtatgcaaattaatttgttgcttcaaacatatttttaggattttttttaatatacatcattcttagcttagcttaaattttcagtcttctgagaggacgttagatgcccctgggattgttgatgacttctatcttaacatattggactggggatgcaaaaatgtgatgtccattgcgcttgggaacaccttgtacctctggaattcagctgatggatctattatggaccttgtaacaattgacgaagatgatggtcccatcactagtgttagctggtcttgtgatgggcagtggattgccgttggcctcaactcttctgacattcagctgtgggacaccagctctaatcgcatggtcagttatctagagttctagacacttgctctgtattgtaagcagattaacttgtactgatagatatgcatatgtataaatgtggcagctgagaacacttcatggtgtacaccaatcaagggttggttcactggcctggaacaagaacatactgacaactggtggaatggatggaaacattgtaaacaatgatgtcaggatgagatcccatgttgttcatatatatcgagggcatgaggatgaggtatgtgggttgagatggtcaggaagtggccagcaattggcaagtggtggcaacgacaacctggtgcacatatgggatgtatcaatggcatcttctaatctatctctaggtcataaccggtggcttcatagatttggcgatcatttagctgcagtgaaggcccttgcatggtgtccgttccagagcaatttgcttgcatctggtggtggtggagatgatcggtgcatcaggttttggaatacacacactggtttatgtttgaattctgttgatactggatcacaggtgtgcggactactctggaataagaatgaaaaggagctgctaagtgctcacggatatgtacagaattcacttgcattgtggaaatacccttcaatggttaaattggcagaacttgaagaccacactgctcgtgttctttgcctggctcaggtatatctctttctattgtggtatagtaatgatgagtaattgcttatgatttgtttgctgatttcgtttttatgctatatggttgcagagccctgatggatttacagtagcctctgttgcagcagatgagactctaaggttatggaaaatttttgaaacttctgaagatgccaaacccgtattcaagacagtaaacactggaatgtttaacagtttcagccatatcagatgaggtatgctcaattgtactccgcatcgactgtatgttgtgaatcgctgaatcctaaaagggtatcgaaaatatgtatgttctgattggactttcgaaaataagtttacaattgatgaatattctttattagttcttttcattcgttaatcacaaaagcaagtatgctaattgtttaaggattttgtgccaggtgaaaaatgccattttagtgtagatattgacagcaaatcctatctgatttgttttcagcatttcttttcacaacaataaccgtgatgttttccatactttcaaaagattgttataataaaacatttacattgttttccacatacatactgtctgttttatctgtgacattcttttgtcgtattttgttgagagcaataagtcttgtttgtatattggtttcttcgtaagaaaattgtactagtaagttttaccagagtccacaaggatgttttatctgcaattactgttgcactataatgaatttataatcaattattgatacagtttgtccttgtcttccaggataatgtgagagttggaccgtggggaactgactgttcatattttcaggatctcatagcattagttgtaaccatggtcaccggtacgaaaggtggagaactggacatgccagagcttcatgtgtatatatacgtttcatttttttttgcatctggatgataaatgttttctggccggcctactttcttttctgtgctaggctgacaagaaactgtaattggccatttcttttatttgctaggctcacagaaactgtaatcaaaagcaaccgttcatttcatgttggtgtattggttcttgatgccatcatgctactgatttgtttggcaatagatactgccttcgttccataaagaacgagcatagtactccctccgtcatattttaagcgcaaccatgaatctctgtgtccaattttaaccgtatgttttatttaattttttaaaaaaaattaaaacataagttatgcacaaggtattatttatattttatcatctaataacaataaaaatactaatcataaaaaaaatttaaataaaacgggcgatcaaagttggacacgtaaactcatcgctgcgcttaaaatgggacgaaggtagtacaagatatgacacattgatacatcgtaatactatatatgtatgtatgttcagatttatggactaagggagtatgtaataatatctggatgctagtatcttttcctatgtgcagtagagatgttgctatgtttatttctgagcgtgattgtattgcaccagacacatttgcgcgagaatgtttcgtttagatattaccctatgtttgagagtagttttgacatttttttacttgttcatttacaaagaaaaaattcggttccagtgtgctgttactgttgttcacacatttgatcgttagttaatttgagaccacgtacaccgtgagatactgaggttgggcaggaaatagctttcactggtgctgactttctcgaccatagatagatatcagtatccctttcatcttgattgtttctatctacgtaaactgcggcaaaattttattaatcctacttaccacaacgattgtgacgacacatgcatctaccaatctgttggcgttcgacgtaaccagtgactgagtacgtacgtacgtacgtagtgatcgatcagggggcaaaataaaagtgtgtgtgcatatatatatatatatatatatatatatatatatatatatatatatatatatatatatatatatatatataggtaaattaactggtgctacatggagtattggctccaagattcaaattaagtatatacccaatttaaatgagtgtgaattttttttaaatgtttagatatgaacattaacttctttactaacaagttcaaacaagattgaactgagtttaaactttttttttggttagattttggttctaggtatataacatccaaacatataattcgttaggtatgtaataatgaattgtgaaataaagttgagtttgagttgttttgttgttaggtatttgtatgaatcaaattcatatacctagatatcgacttacaatttgtaaatttttaaaaatttgagagaatttgtgtgttttataccttagagcccgggcaccatggagtcccatatgggcatcctatatatatatatatatatatatatatatatatatatatatatatatatatatatatatatatatatatatagcaaatctattctacacccctcccctagaataactattctacaccccctctcccatggaccactcccacctcccccactcttcctagggcccaaatcccccctcccacctcagtcaaagactggtcaaagccccctcccaccggtcaaacccgcccattgactccctcccccgcccacctctttgctgttcatgtctcgcagaaattccgcagtaacataatggtcatcgtgcagtaacatgacaactttctcgcagttacaatattgaaaaatagtcaagatggatctagttttgttaagcactattttacgaacatcatggtgcagacggattagaaaaatactatataacatgagagatattgctctctaaagattgagatttaccctttttttttaagctctcgtctctttagaacagcgttgtaacacaacattcaatgtgcagtaacatgattactttccgcagtaacaacattataaaagcatttttgtctcgatcatcgtgtagtaataggactattgtctcgttgcaatctcgttttaaagcattatggtaaaaatggttctaaaaaataatatgcaatgtgagagatattattttttacagattagaattctaaaagtttatttgtactaagctttgctactatgtatctttgtatggacaaagagaagtacttttagcactttgtgttaacttgtgaccatacacatatacttttttagcacttatattttgcacaaagattggatttaaaaatttaactatgcacaagcagtggtactgtggtaataccattactaccatatgttctttgttactacaatttcatcacgatgttactgtagaatgtgcagtaacggcttataaatttcgcagtatatcgtgttactgcacttttacgataatgtaactaccgaatcatagtaacaagatatgattcgtacagtaacataatgggcttgtgttcataaaatttgggcttgtgttcacaaaatttgaacagatatatagagaaagcaaagaatgatctcaaatcatatagtgtcatagggtgaattggttaggagagtttgctttgaacaataagatcatgagttctagtcttgaattcaccaattttttttaatttttctagaaaatagaaggaaaaatgagagatgggagagagatcgggatggggaagaagagaaaaagcgaaggaaaaaacggagagagagatggatgaagcggagaagggagagagagagagatcgggatcgagagggcagtggggccgggcgtgcaaaaacggaggagagagatataggtaggaggcggggcgggcgcgcccgtgcgcgattgggagagatgcagggccgggcgtgatcgggagggag

SEQ ID NO: 23316 - DNA, 8611 bp, Oryza sativa
gttcctggtctggaggttatatttgttcaactggggttggttgttcaaatgtggctgggcctatgcaacatgggtatgttgtatgctgtttgtttaatattgattaattattcaactgttttactattctcttaaatatttgttaaatgctgttttctgcaaatgaactatactatgccatcctttgttatcctgtgcacttgcatatttgctgtgtggcttgttgagtatgttatatgctcattcttgcaatattcattcatcagaagaggagtacttcagtgaaggtgatgatctggaggattaggcttgttctcggtcaagttgcctgtggagtggagtcgccatagccgttccgtcgtttgttttagttttatctttccactgcgtagaatgtttttctttgagaggaactatccacctctgtaataatttattatttgcgagtattaaatagttatttatttgtactctattatgaatattgtcattgtgtgcctcggttgattcctggacgagggtttaacatacatgtaagcgtttggaattttggatagaaattccgggcgtgacatatttccattgatctatttcacctttgggcattaatgtgtaataattgactaagttttttcggttaatagtaattacacaactcatgctctaaatccatatataaatcatctgagctccgttttaacccattcaagttgtaatgaattcgctaaaatgtctagaatccattaaaattggtttattttgttgtttcagtagactttttgcatgtattgttgtatgctttgtttgtcgtttagaatccggcagttccaacactccgattttctacgaagtggtcaccgaggttcctatggctcaagagcaaggcaagtcatacatacaacattgatcttgttgaagctattttataaaatccccgcttttctattaaattgtattattttataatgccatgtgggatggatgcctgtcgtactcaacgttttgttaccttgtgccattgataacttggtatataaatgactagatgattggtttaagaatgctgaggtcaattaatttacaatggggttcactttaaattagtccttaattacattatgatgatgtaccaccatggtaatggtttaattaactaaaatatgctttaatggtgggttgtgggtgcatggtgttgcaagtcgtacccatagcaattaaggaccggttcttgcgaatccctgaagatatacacgtacttaccacatgctagcatgggctccaggctgaatctagagtgtatcttaacctcgtcaatatatcatggcaagggtagaggagatggtgcagttcggacctagctctggtctctgttgttttcggatttacctaggcatgagtggggactacccgctgcctgtttaggagtgggggtaaaacctgaggtgggtatgcttggttagggagagttatgcaaaggattttgtcatgatttccccctttgcagtgccgtggtggtacttcgaggcatggtaacatgtgtggaatcgtgtcttgtgggtaaagttgtatacctctgatcaaagtaaaactattcgaatagccgtgcctgcagttatcgggtggacaactagctcaccgtgattagtatctgttaacgaccaaatttggtaaatcataaattggatttggagtcaaaaccgaagccgatttggaaggagtttgtttctcaggaacatagtacgcataggctacgggttgcatcggttactgtctgcattggctgatactgaatcggacaaggagaagccaatgtagccgattttagtaagatgattctagaatcattgtcgggatcggttgaggtgtttaacaagtattgccatgtatggattaagtccaaagaaggcaattgaatctattaattaggatattctggtagtttccttagagatattatcggtaagagtccgattaagggacttgttcgtatttttgagttgtaatagagatagaatcgtgtccagcaaggacatatcatgtatgttgggtacaaatatgatctgagaccttgtaaatagatgacgaacagttcaataacactttcggcgcatcaccatgtcgcgaccgagaaaattgccttttcccgaacgctagtgtattaatccccgtcccaggaaaagacggggtacaccaaacaaacatggtacaaaaggcacatctttattatatcaataatatttacattattacaaaggcacttcaggcctgacaataaaaaataaacagcagcggactagcgggcctacggctccatcttcacaggcgctcaactggggtataagccaggactccacctaagacttcttctccaaagcttctcttactgaagggggggaatgattgagcaagaatgagtacaaccacagtactcagcaagtcccaccgggagatgcatgattaatgcgagggagtacaaggggtaataatataggggttaagttttgcagtaaacagcatttaaaagtcacttagttgcccaaagctattttgtaaacacgatcctagagctatacaatattattaatcaaggccgtggacccacacgaacctgccttaacccaaggcctacgatgattcagaccgaactggcaacccgaccctgggtcccagctcatcccaagccaacccaggccaaccattccacattttagttgttaagcaggttttaagaattaaaacactaacttgggtacattgctaggcttgcccataaccgagggcgcggctattcgaatagattatactctgatcagaggtgtacatctttacccacaagacacatcttcctcacatgtaaccacgtgccacatacccccacggcatacggacggaagacatgatatagtttctaacccatcctagccatagacaagagtaccgacccaaccccacctacggccggaacctccgggacaggtaggcaggactgagcccctagcaacagacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgcttttcaacagaggcccgaagaccggtccttatgtggccgaggtgctactagcaaaaccatgcaccccgagcccagcctaaaatcattttgagggttttgaatagagggggagatgtgcgtccaattccacaataatccaaccattccatagtgtccaagtgatatgaatattcccaaagtctagagttataaaaccacctaatgttgcctaaataattagcgaagcatctacctaaattcatactagtggaaccatgaaaagagtacccactagttggggtttggtttattctagggtgaacaaggtaataataacaatagcaataataataaggtcataacaaaggtaaataggcatggctaaataaaacagtgataacatgggaatttaaataaagcgataatgcattaatttaaatcaaaataatttcacaaagtgggatccaatatgttcaaagatgatgtgacttgccttgctcagagagaatggcctgctgaaccttcggcgacgaccgcgaaccacgcttcgagaacctccggaacgacagaagctacgcgaagcacaccagcaaagctaaaccctataaagaagcaataacaatacataaaaagaaagcacagggttctttaggttataacaaacattaggagacttgaacgggtcgattcagagttcgtatgaccaagatatgatcatccgaagtttaatgctgttatatagagatttgcggattattataattaggtttttcaactataaaacatgtgtaagcgctagcctggaaaagacaggaaggctgcgctgttgacatgcggaccccacatgtcaacctaaaggactgcggtagaccgagtacacagagacggtccacgggtcgacggaagcggaccccgtgtgtcaaccgaggcgagtggccgacaaacggactccactagacaccacgcgggctgcacatgtggaaacaacgcggctaccgagcgggcacactaacacggacactacacggtcaccacccgcacacgtgaacgactaccgacaccggtacacaggtaccagggtcaacaaccgcacaacgggtacggggcgacaccgaaaggacgaggacagggcagcaagaggagagatccttaccaccacgcgacgaggcgtgggaacgacaacgacgaacgggcgcggcggagacggccgggaacgtcggagacgaacggcgaggggacgacttcggcggcgatccttggacgaagttgcgacgcggccggcacgaggcttgacgacgcggagccgaggacaaagacgatgacggggctgcagcggctcacttgacggaacgcggacgacgaacgcgaacggcttgacggagggacgaacgccacgacgatgaggacgacgagaggaggacgacgacgacgacgactggggccggcgaggaggcgacgagggcagccggtagcggctgcacggagacgaggacggcgcggaacacgccgttacgatgatgacgagggaggcggcgccgcgagacgacgagccggcgaggaggagcggccgaccgaagggacgtcggcgacgacgaggatggagaggaggcgatgccgcggacgacgtcaccggctcgccgctgcgatgccggaggtggtggtggcgcggccgacggcgcacgggtggaggaagggccgaccggggaaattccggcgaggtggatggagaggccggcgcggcacgacggtgttccggcgaaaccgaggagtggctggggaaggagacgatgccacggtatcgaaggagacggcggcgtcgatcggcataccagcgacgaacaggagccggccggagacagcacagtggcgccaacaccactggttgccggcgggggcacgccttcgggggtctccgcgggaaacggagggcaggccgggaaaggggaggcgactgcgacaccgagggaggcgacggcacgggcgaccggcgcgcgggcgaggcggaaggggcgactggagatggccagcggcacgggagagagaggaggacggtggggagaggtggtgcggccacgggagagcgcgggagggggctaaaacgatagaacgcaaagagtgggttccattttataggggaggagagggagccagccacgggagaggcagggaacggcggcggaatttgtggccggcggcaatggaaggtggccggggttggcgcgtccgttcccggcgattgggggcacgattcaagggggaaattagggggaattgatgaggaatcaatgaggattaaaaccccctaatcaatttggaaatagccggcttgaatggggcggatttggaggaggaacggcgctaggttttgcacgggagagagaagaggccgagcgggaggaggaagacgcgcctggcaggcgggtcccacgcggggcacgcggtcagcgcgcgtgcggcgcgcgtgaggggggggccggctcgggaggctgggtggggcggcttgggccgggaggcggcccaggcgggaggggaggaaaagggagctgggccgaggggaaggggaggcccaagagaaggagggagagaaggagagggagagaaagagaggactttggccgcaggccgagagagagagggggaggactttgggccagacttggcccaaagggaggaaggaggatttatttttagtttttattttcagtaaactttgttaattgttgttgttgcttaataaatattttcggtgctctgaaaattcaagtaaaatttgagggctccttttagaccaaggagaatttaacaaaaatctccggactacattcgaatttttcttgtatgtattttagtgtttaccaatttcttttcgaattttaattaattctattattccttttagagaatgatttttaattttgggatgaatttatcaggacgtgacacgccacccttttctattttcattatttcgacgagttcttgcttttgagttggactgcatcggtttcgttctccgacgaaaaggtaaagcttgttatggtagcttgcgttctcgggattagtgcttacatctctatgacactctaatcctgtttatgtaaatcgtcgaattatcatatatgctatataatctagatcgatattgctatctaacctcatcggctagcctctattgtcgaaaactgccgatagggttagatactgacttcgaattagattatatagtatatctatcatcatgaaaagtttgtcatcagcttgtttagatcttatgtttctctctgtgcttaatgctgcattagttaagtttgatttattaagtaatatttagaaccataatatctagcttgtttgatgattgctaatttaaatagcatcggagtttcagccgatcttacctgatttagttatcttgttccttatatgttacttgatatgctaaatctgtcctttatattgagatctaacttcgatgaaatatattaagcctattatcagtctgttaggttatcctgatgttagattgattcctgtttagtatatttcatctatattaatatcttagtataaagtagtatcggagtaatagccgatacatgttagatttgctttatcggctatgctatgaatatatataatttttaatttaaagtaattttagacataagtgatttatactgtctcggcatgctgtccgatctatagcaatcacttggtttaaacatatttcgatgtatagattatatattattgatatctacaaccaatcaggtagatctaactatttccatgatttatatttcatttgacgatcttatacatgttgcatcgacttaatattgaacgatacgtcatcggctatcgttgatatatttaaatttgcttctctttgtctattgttagttgtaggatcaaccaactggcacgccttgaacccgaaagcaaatctttggacctgcactagagtaaagcaaatctctcaggccagtgtgtgtttttcgcatcgacagtctcatactaaataatatgacttaatgaactagtgtagttcaggtggtttggttgggccggttgcaacgtggtttagcgttgggcagtgatatttaatattgcttaactatatctactattttattgtattcaaactatgttttataaatgctacttttatgcaaatatcctatagcctttcatttgtgaatatcttgcaccatacctttccattggtatgacttgttgagtacagtggttggtactcagtcttactttatttttctccaatcccagagacaaagaattattcaaatggagaatattttgaggattaggcttgatctggatattgaggatgcctgtggatttggaagaagctacgtttttgttgagaagatcttcgttttgagttttcttttattttattccgctgcatttgtaagacttatttattacttttgtaagatgtggatctgtgtatcagtttgtcatttgtgtactctggttggtcctggacatagatttttctacacattctgcttgaaattcgggttagcgaatttctgggcgtgacaagagggcacttcaaatcctagcctttccactccttttataggctcaagggtggttgaaaccctaactcagccgaaatctgagccgttcattgatccttaccttttaaggaaacatcggagatttcacctatccttttataggcttaagggtggccactgaaaccctaactcaaccgaaatctgagccgttcgttgatccttacctcttaaggaaatatctgagatttcagccacgtagttggccacagatccaatctcccacagagaatccacaccgatccacgcgcactcttccgtgcagcccaattcgcagctgccacgtatcctggcttctccgcgcgctcgtcagccctggcccacctaacagtgagacaaagcggcgacctccccgtgctcgttccatctgtggcaccgcaatctagagtgacttcctccgcgccaatcacgagcctgtattttatatatacaaactttacatgaataaattcgataagaatttaatttataaaatttcaaaaccaacacaaattgcttatatggtcagcaaggcccatgtgcatggattctcccctcccttgtatttggcatggtcaaaaaggcaaagaagatgggctatgcccgaaatggaaacaaggcaaaaaatggaaattttgaccaatcactggtggagaaaccatctttggtcggtcggccgaaatccacaatagttccgaatccatttaaaaccgggactaaagatgatctttagtcccggttagtggctacaacgggcatatgagatctttagtcccggttggtaacaccaactgggattaaagatcatctttagttccggttgtagagatgtcagacgttgtcagggcccccgggatctttagtc

SEQ ID NO: 23317 - DNA, 4235 bp, Oryza sativa
ctaaagatcccccctttatatatgccttcttcctcctccagctcgagagcaagcttcaaaatttctcaaagaaagaggggaggtcatgccaaaatttcttgtgaaatttttttagtgattatatacaaatcggaggtgtctaaaaggttagtaacttcatcctccaatgtttttgttgttatattacttttggagctatgtttcacacattttttttgtctccaaaactttgttgtaagttgatgagagagaaaatttgtgtggggaagaagaatatatagaaattttattctcatagattaaaatatgatgaaaattaatcttaaaaaatagaaaacaaactaaattgaaaattaagataagtacaacattaatattagtttagatcttcaaaaattgttaataagaattgcttgtcgaaagagtttttaattattttatcattactgtttgactgtcattattgtacgaaaatttatttatgtacgattttttttcatttcatgtagatggatcggcaatggatgtacgctgaccggcggtccaaagagtttatcgagggcgtgcattatttttttagagtggccgaagataacaagcgtaacggttttatttgttgtccatgcaacaagtgtaagaaccagaagaagtattctgcatccaggactattcatttccacttgtttgagtcggggttcatgccaagctataattgtttgagtcggggttcatgccaagctataattgttggataccactctggagttcttgcaatggaaggcaaaaggtggtgttagtgacaaggcatttggcgatttattgaaacttgtcaagaacattcttccggagggaaacaaattgcctgagacaacgtatgaggctaagaagatagtctgccctctaggactagaagttcagaagattcacgcatgtccgaatgattgtatcctatatcgtggtgaggagtacgagaacctagaagcatgccctgtttgtaaagcactacgatacaagattagacgagaggatccatgtgtagttgacgggcagccaacaaagaagagaattcctgctaagatgatgtggtatttccctataataccatggctaaggcgtttgttcaggaacaaggggaatactagaatgatgcgttggcacgctgaagaacgtcaacaggacaggatgttgagacaccccgccgatggttcgctgtggcaaaacatcgacagaaaatttaaagactttggaaaggacgcacgaaacatacggtttggtttaagtacggatggcatgaatccttttggagagatgagcagcggccatagcacttggcccgttacgatgtgtatctacatcctccccccttggctatgcatgaagaggaagtacataatgatgccgattattattcaaggccccaagcaacctggtaacgacatcgatgtgtacctaagaccattggtcgatgatcttaaactgttgtggaaaaaggaaggtgtccccgtgtgggacgaggacaaacaggaggagtttaacctatgagcgctgttgttcgtaaccatcaacgattggcctgcacttagcaacctttccgggcagtccaacaaggggtacaaggcttgcactcactgtatggataaaacataaagtatgtatcttaagcactgtacatgggtcatcgtcgattccttgctgcaaaccactcggttcggaagaaaggcaagcactttgaacataaggcggaccaccgtatgaagcctaaacatcgcagcgggaaaaaaatgtttgctatggttaatgatctgaaagtagtgtttggaatggggcctggaagccagcctataaagagcgaagatggtcacgcggcgatgtggaaaaagaactctatattttgggagttaccctattgggaattcttggacgtccgccacgcaatcgacgtgatgcacctcactaagaacctttgcgtaaaccttattggcttcctaggtgtatatggaaagtcgaagatacactggaagcacgtaatgatctgaagcatatggaacaacgtggcgaccttcacccggaaccaaaggagaaaggaagccattacttgagtccagccagctacactcttagcaaggcagagaaggaaagtatgtttgaatgcttggagagcataaaggtaccatctggatactccacaaatataaagcgaataataagcacgaaggagaagaagttcacaaacctaatgtctcataactgtcacgtgttgatgacacaactgctaccagttgtaataaggggtatccttccagacaatgtccgggcaacaataacaaagctaggtgctttcatgaacgcaatttcgcagaaggtcatcgatccggatagattagaagcccttcagaatgatgtggtgcaatgtcttgtcagttttgagttgatatttccaccttcatttttcaatataatgacgcatctgctttgtcaccttgtcaaagagattggtattctcgagcctgtgtacctacacaacatgtttcctttcgagaggtacatgggcgttttgaagaagtatgttcgttaccgtgctcgtccagaggcaagcatcgccaaggggtatggaacagaggaggtcatcgacttctgtgtagaatttattgaagaccttcgcccaatcggggtacctgaatcacgccatgaagggagactacggggaaaggggactctcggatggaaagcaataatgacggtagacaacaatttattccgtaaagcccatttcacggttctacaacaatcttcattggtggctccttacatcgaggagcacttggctccaattcgcgccagaaacatcggtaagtccgatgcatggattacacggcatcacattgatactttccctgcgtggctacgacaacatctcatgggtaacgagacgattaaccaataactggccttcctggcgaggggaccatttggctcgatcaagacattccagggatatgagatcaatgggtacacattctacacgagagcccaagacatgaagagcacgaaccaaaacagggatgttcgtatcaatgccatgggacacgatggaacaactggcacgtattatggtgccatcgaggacatatgggaacttgactatggtcttctcaaggtccctctgttccggtgccaaagggttaggtttactggtggaggcgtaacgattgatgacagtgcaatgacaacggttgaccttaacaaggttggatactcggacgaaccttttgtccttgccaatgatgtaacgcaagtcttttacgtgaaggacatgtctagcaaaggaaagaagagcaaagggcctgacgagtcgaagcgccatgtggttctcccaggcaaaagaaaaatcgtaggagtagaggacaagactgacgaggattacgatcagttggatgggcaaccccctttcacggtgacgattgaccctagcatcctcctatcaaatgaagacaccccttactcacgtagcgatcacaaggaaggaacaacagtgaggagaaagtacgtgcggtcaaccgtcaccgccaatgtattgtcgtaattattgtgtacacgatgtaaactattttagatgtattgaatatccctataaatcaattgttgtatggcatatgttaattatgtatgtttattagatttttcaacaattttaaatcatgcatatgctaattatatatgattattagaatttttaacaagtttaaatcattcatgtggtatttacgtatgttaattagaatttttaacaattttaaatcatgcatatgctatttatatatgattattagaatttttattaattttaaatcatgcatgtggtatttacatatgttaattagaatttttaacaatttaatatcatgcatatgctaattatatatgattattcgaatttttaacaaatttaaatcattcatgtgcttattacgtattatccacttaatttactacagacaacaataatttttcaaaataattgtcattaattttttgactttaaacaattttaatgcattatttactattttagaaacacatatgtaatgaaattcaatattcagtgctattatctgtagtcccggttcttaacactaaccgggtttaaaaagaatttgaaaatagcaggaaaatatctttagtcccggttggtgagaacaaccgggactaaatatatctttactcccgattcgtaa

SEQ ID NO: 23318 - DNA, 6410 bp, Oryza sativa
ccgggactaaagatctaggggcatatatattccccatgcgcgcccttgtcttctccaccaacacttaaaagtttttttccccgatctcggcttctccttcgccgccactgcctagggcatccccgcgccgacgccgccgtcgtatctcgccatcgtctcgcgggcgtcgtcgtcgccgccttcgccgccgccgcatctctagggtgagccgccgccgcctccctctctctcttgacctcgatctctctctctctctccaaaccgccgccgcctcgttgccgacgccgcagccgacgtcgacgcggccgaccccgactccgcctcccgtcgatgccggccccgacctcgatgcagccgccaccgccgacgatgtcacgctggccctgccgacgacgccgacgccactgccacgccgccgtgccacgcccccaggccacgccacgccgccgcaacgcgacgccaccgctgcgacacgccgccgccgcgccgccgccgtgccacgccaatgccgcgccgccacgccgccgctccgctgctgccactgccgccccgtcagtgaacgaaacgtgaacgaacgtacgtgaacgaaacgtgaacttaacgagaacgcgaacgtgaacgaaacgtgaacttaacgtgaacgcgaacattaacgaacgtgaacgaaacgcgaacttgaacaaaatttaatgaaatgcgaacgaacgtgaatgaaacgtgaatgaaacgtgaaagaacgtgaatgaaacatgaacgaaacgttaatgaacgtgaacgaaacgtgaacaaacgtgaatgaaacgcgaacgaacgtgaacgaaacgtgaatgaaacgtgaactaacatgaatgaaatatgaacggtcgcctttacgacactacgtgaaatacaatatatgttactttgcgtttagactaatacatttttttgtatgttgcagaaaagacgtcgtcgtcgtcgtccctcaagccggagtggtagctagccctcgaaggaattcgcgcaggcaagtgatgtaaagatatgattgttagatttttaatataatttaagattattagattattagacttactaaatgtgagtgttagagattattattagagttttagacttagcataggtgagttagcatatatgattatttgagttctaatatacgacacttagacttagcatatatgattgttagaatttataagattattagatttttaatataggactaataatataagactattagatttttaatataagattattagagttttaatacaaggttattagagttttaatataagattattagatttgtaattagacttagcatatatgattatctagggttctaatatacgacacttagatttagcatatatgattgttagagttttaatagaagattagtacaattttaatgattatctagggttctaatatacgacacttagacttagcatatatgattgttaaagaaaatgtgacctatagacttagcaaatatttcttgtatgaacagatggctgatcgcgatgaggaacagatattgtacgatacaatcgcaaagggaaacagccagtactggaacgaagaagaggggaacgaggatccaaatcagtacttgaacgaggaagggaacgtggagagggatgcggagaggaacgaggaggggaatgtggagagggatgcggaggggaacgaggaggaggaggctagtggaagtcaaccctccgctggacagaagagggcacgcggacaatgaggtgccgcgaagaagctacagggtcgacacatcataacggaagtggacgaagacggccgacctagtgccccagcagaagcagccaagaactacgtacgatacagcggttgggttgtgcaggataacgtgcctgttagtacggtgtactggcgcagaacaagggcacgcggagatcatgagagctttgtcccagattcggagaaagagatgctgtggaccacaatgctcgagacattcacccttcccgcgggtacagagaacatagtgaaaaggtggactctaaagaaaatggcagacaatttcagaacttcaagggagatctgtaccagaaatacatcctgaaggggcagacaccaaacttcaacacattcccgaagctaagggatcactgggacgaattcgttgcttacaagacaagtcaacaaggggaggcgatgatggaaagaaacaaagaaaatgccgccaagaagaagtaccatcaccacttggggtcaggcggctatagcgtcacgatgccaaagtgggaggagatggaggcaagcttgcttgagaggggtatcgaaccggccaccgcttaatggccggatcgatcgaagttctgttactatgctcacggtggaacgttcaacccagtggatggctccctggtctttagcgatcagatacgcgagggtgcgagtcgactaacggacgcagtggaagcctcttctcagggcacgttccgacccgacagagagaaggacgagctgtcactcgccctgcagactcccgagcatccaggacgaacacgagggaaaggggtgattccttggaagattggattcaaggaggacatccacacgtacaggagtcagatgaggagcaagagagatatcgaggcgaagattgcagatcttgagtacagggtatcgagctatgagctcagcatgcaagaggaggtggcaaggaaggtggatgaacgcatggccgcacatcggtcccaggatccccagccgtacattcctcctgcaatggtcagcccatcaggcaatcgtagcagctgcgcctcaacggggcaggtaggatcactcagcggacaccatgtgagctgcatattcccttcaagaacttatcaatcaaggtaagctcgtagtttatagattttagacttgtccattccgcaagttgctgcttatatatgttgattactaatagataatctctcaccaaatgaaggtggcgtcgggcatgaccatcccaacggaaccttcagggacttccactgcaggccgattccagcaggatactccaaggtcgaagttgagtttgtggaagccgcgtatgaggacctctagttggactaccctggaggagacggtgagacgcatctacgagacacaagccacgccattatactatggcgcaagtggtacatcatcctccctgggctacaagcggcgtctcgtgcaccatctcctcctcaggctcctgcaccgtctcctcctcatgctctagcaccatctccacctcaggctcctgcaccgactccttctcaggctcctacaccgactcctcctcaagctcctcgtctggtaccttccaaagtcaagggccccccaagctccaccgcctgcccccacaagggcaacgaagaaggcgaaagttgacgccaccaaaaataaggacccagggtacgattgcacgcaagaggagcttgacgcttatgtggcatcagaagtcaggagacaattgaagcctcgaagtccagaaaagaagattcctatagacctgagtgttaggaacttcttcaagagtatgtctgcacctgccaaggaggccataaagctatcggactatgggcgaacacttaagaaagcatattctgcaaagtccaaaccagtccctcagcttggagagcaaccaaaccaggaggtcgagccgttggtgaccggtgaagaaattggaataaaagaatttatttctgacaccgggctaactacggatcaattgctacgaggcgcaccaatcccaaaggcggaagtgaaatacaagtacgaactcggtaaaccgcttgtcaagcctgagcaactgcagtccctatagacacagatgtacaaattccatcaactgtacatggaaatgagcgccaccggtagagagatgatcagagcgaggatcgacgtctctattatgagttgttggattttgtaagtatcgttcagttagatttcttattacgtttccattaattaattaggtccttgtatataagtacaccatatataatatatacttccttttatcgctgtagaatggagattcaaagggcccgacggcggggggttttcgatactggtttcatcgaccctcggaaaataaacatcgcaatgatcgacaagtatccgcaagccacagaggacaatctcgtccatctcctgaaggcgcaacattacaagatgttcatactattgccgtacaacacacaattagtttttactgtcttcctaccaaatttcattcccgtacgtacatgctaagtgtttcatatgtcatgcatccgacgcacattgcagattccacggggtccttttactcttcgacttggaggcctgcgtagtcattgtatatgactcaatggataaaaaagagtctacgtttgaccaggtttttaaacatatagacaggtaatgtcataagttccaatgttatttctaattttgatataattaattgctactacgaatcatagctttaaactccacgtagggcttggtatcggttccgtcatttggtccgcggcaattggaaagaaaaacttaggcggaagtttaaatttcatgtgagtacacatgcattacatttatattgaatctccaattcaaatacaagcatatatttattagatctctcaccgtttgtcatgtatatatagtgcgcaaagcaagaccagggaactaacttgtgcggctactacgtgtgcgagtattgccactgccttgtagaccaaatcatcaccacaagagagctcaatgtacgtacaaataaattcaaaatttcattgcgtacgtatcgatttgttgtttactaattaatttcatatattcataggttatttgcatgagggataacctcacacacaaggaatttatcccggcggttcaagaacaactcatgtgattcatcaacgaacaagtccttgatcccgagggtgaattctactacgatggaaatacaattcatagctcattagcttctgagataacgactactacgtcgaaatcgtagctagctaggacataatgaattgtaattaatacatgtctatttttctatatgtacacatttactttagtgtaaatatatattttggtcatatatatgcacataaaatgttagtgctttaatatatatatatgcatttgcatacatatatgtataaatacatatatattatgcatgtatatgtattgaaacatataatatatatatatatatatacatatatataatatacatatatacttgtataatataatataatatatatatatatatatatatatatatatatatcatgcagcaacagggccatgcaaataaaaaaaaagggcagctcgatctttagtccagaactacagggggttacgaaccgagactaataagggtttctccaccagtgaatcgtgctcgtgaacagtcaacgaccgctcgcccattagctttctcctcctctctgattgcctcgactagactctcacatcgccgccctggagatatgcgtgttgcactgtgttttgctcgcgtgatgtcgattcgggatggcagctgtcacagccctagtgtatttttttctctcaagctatttgatgctttgactttctttctagggtgcatgattttttttctattcatcagtagtgcatgctgcatcaaattgaaccaaaactacactttaatcggtatgttgggaaaactgttaaatgtgcacaaaatttcatagcagtttagagatgttttaatttattcaaacaaattaatcaggtttgaaccctgtaagattcaaacaaatctcagcctgcgatgtattttattattatgtactaaaagtccattaaacttcttcaaaacactctcacgtcgccacttggcgctctaataaattagtgaaagtactcctagtaattctaagcaaaaggcaaaacatcaagccattgatttttatttaaactagtgaacacataattttgcatcgttagattagattaatctccggggcccctctcctaccaaagccctctctaggaacctgcggcacatagctgccacctcctgtacgcccctatttctttttcttttcctttttattggttgttaagatatttaatggcctattttatatagaaacttaaataaattcacacttctctttttttaacgtgaaggatgagatcggactatgcaccgcttgcatccatgcacttggcatgcatttgtggtttatactttttgagttggtccttttaaaaataaataaacagtatttttagtggttacagcttttaaattgtatataaccaatttgtgatcgatttgaaccattcggtatttctttacttaaacgatttcagctgcattgaactatatttcagaatacaagacaaatatt

SEQ ID NO: 23319 - DNA, 25483 bp, Oryza sativa
ggaaaaaggggcgatcaattccggtcaaaccggcggatcaactccgatcaaaccgatcgacattgatttgagggtaacttttaattccgctataaatttggtttttggtactataaccattcaccgccttttttttgttggcttagttattgctgtttgatcctacaaacacctggtgacagcttgccctcacaaaatacaagatttcgtgaccaggtgacagaaatttgatgatttgatgactgaatgctgtcaccaaatctctttgtgaccgcctttgggcttttggtgatggtgaggggtagtcgccaaaaaaccattctctggtagtgaacgacgtactatactatacctaccgtttgatgtttcaacgagcacactttgatttttttatgggcgaaccggcgaagtcaaacgtgtgaacatgtgagctagtcatcccagtatatgcatgatcacaaattcaactgctgagcaacctctaccacttggaaggtagaattcaaagtgtgaacaatttcgtcgcatacaacgtccacaccatatacagactacatcaatattgtaggagatgaacaaatttcgtcgcaataaaacgtgggaacatgtgacctagtcacctagaattaatcccagtatatgcatgaccacaactactgagcaacctctatccacttggaaggtagaaggttcagcgttgtactatgctacacttgttatagctagttgccagtagtatattaattattgtatgagttgctgatcgtgtaacttctgtagtacgttacgactgtcatggtgtatatataaagatcgagaggggataattgtatttcaacaaatacaacatacgacccagcgtgcatccaagtatgatcagggtgctgatcctcctcaccctaggcttcctagaagcaattgctgagaaaccagcagcacagcagccgacggaactccaaggctgccccgcccccgatatgtgcggcaacatcaccataccccatcccttcggcatcaaacctggctgctacctcgccggcttcgaggtcatctgcgaccgcacgttcaacccgccgcgagccttcctcgcaggcgacccgccattgttcggcgacaagttgccgccgaacgttaatagcagtaaaccattcacggtgacggccaatttctactactctggcacagatgcaggcatgcccagcgaaatggtcaactacacccgagggcctctcgagctcctcgacatctcggttaatcagagcaagctacgtgtttatgcagccatcaactccgactgcagcacgaatgaaacacaccatatcctatttgagcagtcaatcaagcttcagccgtcaggtccattcaccctgtcggcaaatgataattccctagttggcgtcggccaaaacgtcatcgcgatgttcgcggattcatacgccggagaagaatactcgacgatttgcctgtctttcctcagttcagtgtccaaggcgaggaatggaccgtgcgagaatgccacggggcttggctgctgccagcagacactgcctcctggcgtcaacacgactcttgtgagattccagcacaggaacaacagcaagtggagaacctatccatgctcatatgccatgctggtggagaagtcatggtacaatttctctacagaagatctgtttgagtaccctgcttttcccaacaagtaccccaggggtgtactaccggacaagtatcctacgggtgtaccccttgtgcttgactttgctatcaggaatgggtcctgcccacaggaaaatcgtggcccacctggaaaagactatgcttgtgtcagcggcaacagctcttgcctcgatgcaggaaagggccgaggatataaatgcgagtgcaaagagggctacaatggtaatccttatatgcctaatggatgccaaggtatgcatacgacactacttctctctccatcttacaatagctattgttttaggttatttagcacagagtagtatttgattaaaaaatgactaatacctcttattagatgatgtatggttataactgggtaagtggttaaggctagaacttgaagagatttaaatgagaggtgattgatgggttaagtaatacactattatgataattatcttaggataaattttaaatccatataattattttgggaaggagacagtagtaaacatgacagctagctcatcacatgcacagttaattttaaataattttgctatctatttatcgacataaattcagaaataatttagcggatttttgaccgctaattagattttcttcaagattcatgcaacaggcactcctactgaaccccctacaggtgacggctcataggtgtcggttcaattggaactagcttgcacaaaaaaccatcacctatagtttagttgttggttcttaacctaaaaccggcacatatagttaggaatagctgtcagttatttaggcacctatacggaggaaagtataggtactgattccagctccaaaatcagacctataatatattataggtattaggtttttctaagaaatgggtaaccatacaaaaccatccaagctgaataaccgatacccatccatcattatattccacaccaccgcacgccacaccgtatccatccatcctcatccccacaccacacaggctccttgcctccatcgcatgcttctcgcccacctgcgtgcttcccccatccacctccccgtctgctagctagtctacctcctcatcgatccccctcccctgatgcgttggtctacgcaggccgctgtggccacacagcggtctacctcctgtggccgctgctagccacggcgacggtggtagctgggtagcccttccgcatgaagcagcggtgtgatgaggagcagtgcctcaaggtggcgcgcgggcatgtgaagtgcttcgatgaggacccgcgtcaccgtctacgatgtctccgagctcgatgtttgcacctgtcctcgtcctccccttccggtcaccatgctcccctctaccaccatctcattggcgcccacgcagaggactgaggcaaaatgggagcacgagatggagatggaggcagtggtggtggctagaagcgacgcgtagggccaacagcagcactgctgttggtggcagtatggctgtgggccgtctccttcctcgatctcgctccccttgtgcccccgcccctgctctatctgcgttcacggtcacgttcttcgagatcactaggagggctgccatgtcggggcgggaagcggtcgtcctcgaaagaggcacagtgatgagttgtgcaagaacgctggcgtcatcatcccgtgacaactctgtcggtggtccaggtacgccgactgctctgcgcgtctcgactcactctcccccctcctctctgtcctccccctcctctgggcagcggtagcgtcttcctactagagctccacctgacagcagtggcacctcccctagcccatatttttttataattctgaagattattggtgttggttatatatattgaactgccacatggaatctctataggtgctggttctacaaacgacacctatgcggttgggtaaaggtgccggcaaagtgatgccggctgggaaaccgacacctatagtaaggggagcccgattacaagcgaattatacaatagttaaatgcgagttaattataatgaagtacacttataattatactgtatttgtattgagagacaatttgtggataaatggatggatggctcttttcagcctccggactatgggcatttggcctaactgtttgtatagagtatagatatatagtccctagtttaatacgaagagtacatagcttataacttaaacaatctcgatcataaatatatatatgattggaactaatcctaccataccataacaactggattagtaacgttggatgctcacatgctataacaaataacgacggtcctttgtaccgtaacatattctcttctatgtacacaagctttctatgcacactggtgcacatcaactagcaaatgttacgaaaaattctaaaacaaattaaacatttattcttaatatattatacatatatgcaaagtcttgtattcaaatttattataatttagccgtaacaaaaaaagtgaaaaatctgacagttttgagggtaaaaataatctgccagaattttatctttttaaggctaaaatataatgaatttgaagatgagaattcacacgtaggtgtagaactattagaaatatgtgtccaatttttttagaattttctgtgacatttgctagttggtgtacactttatatacacgggaagcatacgtgcatacgatatgttcccaatgaagtaggaggagtaccaaactctacacgttaatgtttttgatgtttttgaactatcatgtatgggcttaggctgagttctaaattctaaacgttaattggcaactttcttgttttccattaccacattttccacataaaagttttattagaaaattcgaataaattagttaatttatgatacgctaattagccaagccattgtacgtgccgctaataagctcaaccaaatctcagtatacaactacacaaaaactcattggtaccggttccaaagaccttataggtgccggttttgggcccagcaccaattggtcgacacatattcctaaaattataggtgccggtaaatcactaataaccggcacctatgagacatatgcgaaacaaaaaaatgcccgccggccgccacctcgctttccaccaccctagcaatcaccagaatatgagaaaacaaagtcaaaatcaaaccaaaaggggatgaagaggaagaggaggagaaggagaagcgggaaaggaaatgtaccgccttcctcaccaccgacggccatactggctgctgtctttgttgacagcgaccaaaccgtcgacctcgtccacccctccctcggagtccgcaaactgcacgctgttgtcgccgaccgggtgagccttgtaccacagcagatcttggcctcgctcgcgcgcccccgccgcgcgcgccgcgtcccccacaacgaggggactgacctcaccgccaccatcgcgcgcgagggcttcgacagctacgtcctcgccgtcctccgccgctcccaccgcgagtgccgcggtggccgctcccgccccgggaagaaggcggtggctgcgacagcgggggaccgagcccggcatcctgaagcgcctccccccgatggatctggcctccctggcctcgaccccctcgcaggcggcggtgcgagctagataagtgaacgtgagtggacacgagggatggataaggttgaggcgtgacgaggagataaggctgaggatgcgaggtggcaacgtgcgctgtgcggctcggctccggccagtttttttataggtgccttttttcgaaggaaccgacaactatggctactattataaaaattaaaattaaagatgtttttctgatactttgttatgtcattcttatttgagtcggtttttaagtttattcaatttcggaaatacagatgcatgtttgagtcaatttttaagttcgttcgttttacgaaatacataaggagttgtataagaaatctctttaaaaatactcgcatgctaatttgagttgatcggactcctaattgcagctcttgattttgtaaacaaaaatatacaagcgaattccagcaatcaatttcacctaagctaaactgtagcacagtaataacattaaaatagccttcacccgttgcaatgcacgaatatttttttctagtatataaaaaaaccaacatctataatattagtaccttttttcactagaaccgacacttataatgtaagtataggtgctggttcttttaaaaaatcagtacctctactatttgtacctatagttcttaaagatgccggttcttatttttttcatcgtgcggaggtagaaatatgccgataggtgtcggttttaaatgaaccggcacctataagactggtgcctacgagggttttgtagtagtggtatcgaatggggtagtgacaatagcctagcctacattaaacaatatattcgaaaaccaaagaacttattatccggttaatattccttttaaaaatataaattatcctatggataactcagtgtatattaacacgtataattcttactttgcagatatagatgagtgcgctcttccgggtattatgagcaattgctcctttaatagcgtatgcgtaaacagaccaggaggctttgattgtccatgcaaacgaggaatgacgggcgacggcaaaagaggaacatgcaccgagaatttcccaccagcagcaaaagccgctgtcggtaagctagtcggcacgcatttaaatttggatttaactaataataagtcatcaacttgttctttcataggctagagtgttgcataatatttgtttgctctaataattcacaaaaaaagttgataccaaattcggaagatgattgttgtcagtctttttctacatttcaatcttgaatttcataagttaaaatgttccccaagacctagtcatcttaaaacaagctaccggtgtttcaggaatatacaagtgtcaactccttctgcaaacatgttggaatttctcctcataatatcatttatgtcctttgttatgaaatttaaaatcttacagagaaacataatatataagtcataattttatcctcatgtggattctgaaaaaaagttcaatctagctagagatattcattttgcttttatcttgcatatatagtattattgacgacttgactggtatgttaattaaggattgctgaactgtcaaataaaattgtttaattactaatgctgacctattttccaatctcacgtgcaggcctttcttccttcattgttttcatcgtcctaatttttatggtgaaacaacacctaaaacttaagaagttctacgaacaaaatggtggtccggtattgaaaggtgtgagaaatataaagatctacacaaagaaagaactgaaacaaataacgagtaactatagcagcgacattggagaaggagcctctggtaaagtttatatggggactcttaagggcggacaacaagtggctataaagaagtccaaaaaagttgatgaagaaagaaaaagtgaattcactcaagaggtcatactccaatctgaaatgaagcacaagaatataatccagctctttggttgttgccttgaagttgatgttcctatgttagtgtatgagtttaccgtgaaaggaagtttacatgatgtcctcttcaaatgtgatgagaatatgaaagggaatttacatgacgttctacccaaatacaatgataacaagaaagggaaagggaaagggaaagggaaagtacacgacgcactcgttgaatgtgatggtaacaaaaatgtgagtttgcatgatgtcctcttcaaatgcggggataaaattgcaatagatacacttctggagatcgctattggatcagctgaaggactaacttatatgcatacagcacgggagactcccatccgtcatggtgatctcaaatctggtaatatacttatagacaataatttcgtccctaaaatttcagactttggaacatcaagatcactggttgcaggtcataaatttaggcctgataaattcattcctgcggacatgaattatatagatccagtatatatggaagatggaatgctcacggagaaaagtgacatctatagctttggaattgttcttattgaacttgttacaaggaagcccgcaaaatatgatgacgacaggagctatgttcgaaacttcattcaggcctaccttgataaaagagaaagggaaaaatgccataaagagattacaccagatgtggaaattaatattcttgaaatggttagtgaagttgctgtggcatgtttagaacctgtccaggataaacgccctgatatgatagaagtagaacggcagctccatcgaattagacacattgcaggccaaaggatagaggaaaaaaaagaggaatttcaacgtgcattccctagaacgggatcggttatctcaaacgggtttaaagcctcgtctctttcaggtagggtccctgtcactaagcaaaggtcactaatgtgagaacatatctcaatcaggcacaaggccgtcacggatgaaagtcatctcaatcaagccaacaacaaagcccgtcacagataagattgaccaagcaacccgagtcaaaccaggcaaggaaagagcccgtcacggatgaccaatcttaatcgggcacactactaagcccgtcacggatgactagtcatctcaatcgggcattaagggaaaggccgtcaccgacaggttgacccacttgttgagtcaaaatagtcacgggccggaggaattatctctatcgggcttatagtaatagcccatcacagatgactatatctctatcggtctttgttggagcctatcacagatggctctatctcttttgggcctagttgaaatgcccatcagagatgagtatatcagcaaaaaaaataaaatttgttttttttgctagactcaggcttttgctagtcatgcctgctgcaaaaatgatagaagcaatatgtatagtcccattcccagcatccattcacatattccatcacaacattgacatattccataacaccattcacatattcacatatttgcatcccattcacaaaatcaaacatatgcacattcacatccacaaacccattcacatatatatgtcattcacatcctatgtgctctacaaaccgccgatatgcatcaaaacctgcaaaaccgagttataaatttgaataagtttatatgtaattttaaatgcaaaaatttacataacatcgtggcaaattgtattagaaagaatatttacataaatccaatgttagtcgcaagcattgtaaatgttcaaccattcagagacgagctagctagaccttaactttaaatattccttgggctgacaagatatcatctagtatgaatcgtgctatttcctctctaatgatatcgatgttgttttccgggatccttgaaagtttttcctgcatgtaaggcgccaagttagtatatatacttggaaagttgtcgtcctatgtctatagtaatcaattgaagcacacacctcaaggtcgagcaatgtcaccttgtctgcgaagctcctcatgttatggctgtaacaccccaggtaaccatgtacctagagtgccacaccaaaataaactcaaaccactaactcccaaaattattagaaatttcggcagaatcttccctgtaaatacgaacatcaacgacaggcaattataagttaaactaataacaatatccttcccacaatacgatccatccttataatccatggggaagaaactattagaaatctaaaacattattacaagaccgaacgatgatatagtttaagtatcattatggacctaggcaatatagtttgatattgtgcagataaatgtgtatataagggtgctacttcccgcccatgcatgtcggtctcaatatgtacctaaaaccaaataaaacacaagagtgagtttaaaaatactcagcaaagtacaatatggaactagaaaacacatatacacatcattggcaataaagcatgaacacaaggctttctttctttgataggaaacacattttcaaacaccaagtcaaagaagatagtagttcccatcccgggcaggcatgaattgaaatagtagtttccatcccgaacaatagtgaatacatcctagcattgccggcaaatccgagtaagcgtgatcagcgcttacccatagaaacttgaataaagatccaaattgcactcccatgactacgcatggtacttgaataattgaaaccggaatcaaagaaccaaactgaaaccatattgcacaattatttaaccagatccaaaatacggaatattgaaataagaataacatcgtaaacataagatgaactcaaaatgtaaatagcgtgaacaataatctgaacataagtagtcacgtataacatagaaatatgtcggaaataaatagatagagtaaataatccatgaatcacacaattagttcgtcatacacttgcctccaacgaagaatcagtatcatgcacgatctgatgggccaccacctaatcataaacaaaacctcagcaaacacattcaaacatgtgtataaaacaatgaaaaaagtgaacctactgccccatcccatcaaaacgcaataacaaggaacgccgcttggactatacacaagactgctgcttcaaacctttatatcttgaaatatgaaaagtctatgattgaaaatatatacattttgaaattctacagaacagtaactacaactttgatgtagaaagcatatttttattctacaatttatatggtctaatttgcgcttgaaagtacgcatcagaatctgtctagaatttcagactgtccacactaaaacaaccataactggagttctactcgcccaatcagggtgtactttaccaatatggaaagctaagaaaaacctctacaactttgtctataggcggcctggctgatttcactgtttatcccctccaaaaacagtttaatctactactatccagattatgacacaaaaacaacagtcatactaaaaaaaattatatctcctaaaccacttgatataaaatctcgccctttggtcagaagatagatccaaacattatctacaacttttatatggacactttgatcagaataaatcattttgaccatgaaattaatggaaaacagaggcgctataaatctgcccacgcccagaactaccaatccgaatcacaacgtccaaaacgcttctctaaccctcctcaaccacgaattaaaccactagaaccaccctagaacaactcatacaataaggggataagcctcaccttgggttcctttagagaacttgtgaggagacaataggggagactccggtgtaacccctccttgtactcctctcctcctccttgttccgtttttccactttacttcttgatccaagctatgaagatggagatctagggagagcaatttgctctagagggggagagatgcaaacacaggaggagaggaggaaggaggcgccggccagggagaggggtggcggcaccacgaggggaggtgggatttgattcccctctctctaggttttaagggagaactaatgggctaggtttgtgggccttctcatgttggcccacttctaaagatatttttcttttatttatttttgttaacatctttattttaacaagtcaacccaaactaaaaaaacctaaatatttttttaatatacggggtattacattgctccccccttcaatcgaattcgcccactgtagagcttgagaaaccgtaagaaggaaaggaatacacaaaacatacatataaagtagttagtactctcaagcaatttcgaggaaatctcctatattcgcaacactgcttgcttctaggtatggtagataataattaactagcataagaaagtatggtagccaacaattcaaaaacagctaataaaccaactcagacctactagacaggaatattggcttgccaaacaagcgcaatgcacatactaaaacacccaattgggagatattcaaaaatcattggaacacatcgtgaagaatcttactacaaagcaatggaacaatttgtgaaaacaacctttacgctcaagggaatcgggaatacaacataagctttaacttaaaatttaaagaaataaacactcacacccatcacatcttattagtatgttgctccccttcaacaactaaaagtctatctttgattgccaattatttagaggtaataaacaatatctaagaagtcagtctcaaggaccataggccacacctgttccacctagaggtaactagaacaaaagcattatcctcaaaaactgctctgaacatcagtagatcttgaattttctaagaaactcaaacattccaaagtaaatgaattaaatccactcaataaaaaacaatttgttgggtgcgtttaattgaaaagaaataatcgaatatgaaaggtcaagcaacaaaacaaacaacataaaaaaatgaatatttagtctcaaacgcggttttcttaagaaatctgagatcaggataatgactacctataataatttcaagaatcacacgtaaagacaatggaaatatttagaacatggaccgagtataaaaccactttttgaagaaaatgcgtagaaggaagcatcctcttcaacttgattttttttaaaaaaaaacgaaaaggaaattttttttaccataaactcatgaactgaaaatcaaagttttgaagtttgtttgtcacctcaaactgcgaatccggacgctattctattaaaaaattcaaataaagattaataatcaaataagtgtgaacttcaatccaagaatatcaatactgcacacagttgtgagccatgtaatgaaaataaatcacttggtaaagaaattcagatttaatacaagttctccataacaagatttaaattagtattttcaaatagtattgtgcatatcaataatttataatttatcagcacaaaacaatcagacaacacttatgtttgaataaccaagcgaatgaaagcaacaaaagtgaaactaaaataaatatttagtgttaattcctttctgaaagtaaaaaacaaaattagaaatcaggagaatatttgtcaccaagtgatgattgcaaagtcaaatgttttccttttggaagtatttcagaacgtgtaccacgaatgagaaattttttttttcatttcctcaaccatagtcacataacagaattcacaaaaaagaaactaataagccatatcacccttgaatctcaagtctgaaaaatagtacatcctcttttttttcttaccttttttctttgcttttcgggtgaagacatcactaccttgatgcgtcaggcataacacatagacacatcacaccagtgtaagaaaagaatagaatgagtagatgtcatgggggccaatccatcccgtacccaaactattaactcggtacagtgatagatgtatcacgacctaacactcacactcggacaacctcacttggcattgggaaaaaaaataaagagtaaaagttccctcctctaaccactttgcattgcctatatggaagaaaatttacctattcttaaaggatcattaagtcttatagcatacaacattaattacttctataaaagagattaacacaagttagatgcagaacattaattacacaatacggatagtccggtgaagttcgtgcagaatttcctggagaaggaaataaagatgcccaggaaccgttattggaaggcgccggtcaaatcaagcacaccggccaagaagctagagcagtcggctgcgaggaagccgtcctccgcaccaaaaccaaagaaggtgtggaacgaaaagccaaagacgctcgctgcatcacctccggagatgagtagaaattcgcgaactaaactggaaggaggtacggtcttgcacatcggacctaaaatgacgcgaccttcgccaacaggtaaattggtatgtatcctcgtatttgtttttcagcaatttaaatttttgcatcaacacatgtttgaatttcaaaattgcatttaggtttgaggaaattcttcaaatgaatttttcagagcaaattgcccaccaggtgtatacttaaatcaagtgattgagatagatcggtctccatgccgagacaatataaatcacttagattgtaatatatattaataacataactatatatgtttatagcatagccgatcaaatatatctagcatgtatcggctagtactccgatacgactctatgttaagatgttaaaacaagcagaatataccaaacagaagcttaattgtcacgcccggaatttctatccaaaattccaaacgcttacatgtgtgtaaaccctcgtccaggaatcagccgaggcacacaataacaaattgataatagagtacaattattactctaattattaagcgtataaaatgtcattacagaggtagatagttcctctcaatcaataaagatctaagcagcggaaaaaaaaaataaacagcgcagacggctccactccacaggcagcttgaccaaggctacacctaatcctccacaccatcagcttcaccgtagaactcttcttctgatgaacgattgcaaggtgagtatatgacatactcagcaagccacgcagcaaatatgcaaatgcacaggataacaaaggaaggcataatagggtttcatttgcaaaaagcagcatttagcaaacatttgagaatttaaaatagttaagtattaattaagcaatattaagccaacgctatacaacataccctgttgcataggcccaaccattctgaacaaccatcccggctgtacagttctatctccaaaccaggaatattccattccaaaccaggagctaaccaaattattaccagttatagcattatttactatggtgagaagggtgagactaatcacgaaagacattgttagacccgcccataaccgcgggcacggctattcgaatagttttactctgatcagaggtgtaccactgtacccacaagacacaaccccacatcatgtcgccatgtgcctcaatatcaccacgatacctcggaaaggagttgtgacaatacccctcgcataacacaatccactgcagtgcaccttcctggatcataatcacccccttataaacaaggcatggactccccagcgacccccgtgggcttatctccgccacttctcagtctggtgctccgcaatgaaccatactacacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactaacattaagccatcatgaaataatagtgaatcattagttatcccaatagtgagctaatgtttctaagcagggctaagcaattatatctactatctagttgaaccagtataaataaagctcaaccagtcaaattataataacccaaggtatcaaagaataaggtaaacaagaaaaaggggctataacaaagaataggttatttccacccaatgacattcgaaaataaatgcagaagttgaatgaaaacaatagctttaaataggatcaacatgctcaaagggttgtttgggatctatgtgacttgccttgttggccttggaactcttcaaactcttctccggcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaatcgggttaaaacacttaaatcggttaaaattgaattatgacgcaatattgaattatttttgaaaaggaaaagagggtttattgcgtcagcggctagggtttgggtggaccgggcgcacgggcggtggttcacgcgaacggacggccgagattgatccaatccaaatcggacggccgagattgattgggtccacggcggttcacggcggacggacccgatgacgccagcgatgacgtcaccgacggcggcagcggctcggcgggcggggacggctcgggcggcacacgcttgccggcgaacggcggcgcgaggacgcacacggagggcaccaatgggtagcggacggcacgacgaactcaccgatgaccacaacggcggcggagaagcaacggacggcgccggcgacgaggaggaaacggcggggctcttcgggttgacgacggcgacgatgctccagtggtctccgacggcggcgaaggggcggacgaggacggcgacgcgacggcgaacacgacggcggccttcccgagcgacggcgacggctggaacgacggcggcgcacggctggagcggcggcggcggcagcgaagctagggcgcatggcgctaggacgactccggcgacgagaggcgaagacgagggtggcgacggaaagagaagagcacggggatccttttaaaggggctcggaggcgacggcggaggcccacggcgacggcaacggcgaaggaaactcgcggcttggagaggaagaaaaccgatccgaatcgaactcgattccaaagctttccaaagcgattcaaccgacgattccaaagggaaaaaggtagaggagatcccggagagtatttcccctcaaccaattcggccggagaaggaaagggacggccggatttggaagggaaacggcggcggcgcgggctagggttttcggcggcggcggccgaaggaggacgaaggagaggagagagagaaggttttgggccgactttcggcccaaagccaaaagaagacttttttaaaatctttttcaatttaaattatttcttaaatgcaattccatttattaaaagtacttccttagctcaaataaatcccagaaaaatctaggaagtatagaattaagcaaagtatttaatgaaattttatctggccacttttatattggaatttatttattaaaatttgattttcttttcaagcctttttaaaataaattctagaaattccatttaaacaacaatttatatttttttgaatttttagggtgtgacattaatatacttagatgcaataatatcttgatataaagggcagatctaacatatcaatgaagcatgtagagcaaatatagttaaatcagagaagatcggctgaaactccgatgctaccctaatcggtaatgagaaggcatgctagagattgatattctaagcacgacttaatagatcaaactcaactgatgcagcattaagtatgaaaagaagaacaatatctagacaatcaagccgctggaagtttcatagagtggtagatatcttatataatctgaaccaacgtcgatatttaacctaatcggctgccctctatcaccagatgttagccgattgtaggttagatggcgatattgttagagattatgtaagatatatgataactcgacgaattacgtaaacaagattagagtatcataaagatggaagcattaatcccgagaacacaagccgtcataacaagttttacctcttgttgaagatcgaaaccgatgcagctcaacctgaaagcaagaactcgtcgaaataaaactaaagcaaaagggtgacgatgcgctgaaattgtattgaacgtgtgtgttaataattacatagggctcgggttctatttatacccgagaattacaagatatgtccataccggacacgactattatctctaataaactctaagatatcataagtctttgcggcagacttttgcccatatttatctctaaggaatttacataaaatatcctaattaatagatacaattgccttcccatgactctatccatgtatggcaatcatcttgaagcacgtcaactcaaacccgatgtcggatacaagtcgtattgtcagaatcagctgtatcacttaacccagtcctactcggacccagccgatcctaatcgtagccgatttggattccagtcgattcttgctctgttctcgaatcgatctccgccttcgactccacttcgatctaattctcttttccgatgctgatattaccaaatttggtcgttaacacaaaccaaaacaaaattttcaacgaaaattcattgtgccacgaccacactgaccgttggaatccaacggccgaaagtggggccggttgggcccaccaggggttcgcccgaactagccatataacagctacctgccacttttggcaggtaacagctagtgggtcccacatgtcatttctgaccgttgtgggtaccctattaaagccagacgaccgagagagggaattcaaccccatttcaacacattttcattccctccccgaagtttgctctcaagttcattcaagcttggatagttttccctcaaattcaaacacttagctgcatatatacaagttgctttggtgaaactaaccggcgggtgaaacttgtgctatttctaacccccgccgagatagtccgttctagctccattgtgcagaatgaggaggcaactgccttgtctgttcaagcagtccggctcttcatcaagtcatcatgacgagtctagtactggttcattagctgatgtctcaatggatgatgtcgacgctccgcgacgtctcctgaacgacgccgacctcgaccttgtcgatgatcgggaaagacaagcctactacatgctgagtgaccgagagtatgctcacacgcgagaatactctccggagctgttgaaaaggataggtatgtgtcgacgggggatacccgtagaccggatatagagggtattggggtacgctggtataaggatctacgtagtacgacatcgagcaatcaaaagacaagaattatactggttcaggccccttgataggtaatagccctaatccaattgatatgggattatatagtggaaaacacagattacaaaggaaaagacggaactcaagggatttggcgagattgtagtcgagatgattcgactttctctcgtcgacttggctccttgcaggctctgacttcgtaggctgtgtgggttgtgttggctctgagattcgatgatctatgcccttcccggggggtcccttttataccgcaggttgggtgctctccgagtaggactcgaacataccagacttggtacgatacgtgggtaacccaattcttttccaagaaggtctctcctcgtccattgacttcacgaagagtttccttagatgtcaaaggaactatccgtgtacgcgtggatatgctatgtcgatacgtgatgtatatcgaggggtagagggtatgcctgacccgtaaccctgacagtagcccccgacttctgttcaaaaatgaactcgtgcgaccatttgcaacttcaggtgtcgagaacgttgtcattccaggtgcgagaaccacggagatgacgtgtagtcgagcataccgatacgtgatgtatatcgaggggtagagggtatgcctgacccgtaaccctgacagtagcccccgacttctgttcaaaaatgaactcgtgcgaccatttgcaacttcaggtgtcgagaacgttgtcattccaggtgcgagaaccacggagatgacgtgtagtcgagcataccgtttgaatcccaacggtcacgagtgaattttgaactgaagaccaaaaaccaccttgcgcaacggacctagaaatttccggcggggatttctcttaattccttggaattcgcaccgtcgggagtgcgcttatttaatgggattttgggtgcgcgttttgaagtccgcctacttcgttaagcaaacactgctcattaacgctcctcgccttcttcgccaccgcaaagaaccctatcttcgccaatcttcgtccatctccggtgatcctccggcggcgatggatcttggcaagtcgacttccaccagcgcgaccctgaagaagctccaagaggagggcgcccttcctggccgcgaaaaggcggagagggaagcagcaggtactaatccacagcccctcttaggtcgcatggttgcgatcgaatattatgttgtctgcgggtttcttcctcccccttctgaattcctcctgctagtcttgaatttctaagggctttcacttttgcatttgaaccccaactccattgctttccttagcgtctttgtgcatttttgtgaggcctacattggggtagaaccttttcttgatctgttccgtttttactacgaattgcgctggatggaacccaatagggtgtctggttgcgtcgggttccgacctcgtgatggaatgaagtcgcgctatgtccccctccagtgtccctcttctcgcagtaaatggcggaacaggtggttttatcttgaaatcaaggattcgaatccggtcctcgttgttcctgaggagcaaccggacaagattccgatttggaccgccaagccccctttgaccccctctctccaatcgtttatcgacatcatcgatgatctccgagaacagggcttatcgggatatgaagtcgttgcagacttcgtcagtaggcgaatccagccgctccaggcacaggcccacccggcatataactattccgggccagatgaagcgacccgggtttctccttggggtagccttcttgcattcattttgatatgcctgtactcgcgttacttttcgacttatcaaaaattaattctttcttgacaggtctgagtagcgacggcgtggagcggcgcgttggtcaagtgatgatcagcggcccgacaaccgtgtcacatcctgattttcgtttcaggatttataaattatttaataaattattattagaatttatattaaatgttcattaatttacaagagaagttaaatgtgggaaataaaatttcctaaatataaagcatggatggatttaatttttattaaattctctatggttaattatactctctggaattttctcggatttttcggagctcaattcctaattttaatcatacaaagaacattttagtaattatccacatattaaattaatcattaaatggtctgattataattttgttaagtactttgagtgtccaagtattttcaggatttttcttgaaattatttgagcattggaagtatttttaacaattcaaagatcattttagtgattattttaattgaaaaagtttttaaatccctccctaaagtcgttcggccgaatccggcccaacactcctctctctcccgtgcggccgagccggcccagccacagccgcccgccccctcctcctctagccaccgacaggtgggccccacctgtcggaggcatcttcctcctccagccatccggccgagccggccgaccgagcccgagtcggccgtttgccgcaccgtttcctccacaatctctccctttttgttccgattgtttgagggattttgatccccacatcttcctctatgtgtaccccaaaaatcggagcaaattgttgggtattttatccgaatcgaactcattttcgaatttatctccaaaaccgagtttttgatttcccagatcgatttcttgcgggaggagtccgatctcttcaatccaaggctataaataggaccccctagtcctgctctttcgtttgccccttttcccgagctctctagtgccccggagctccggcgccaccgccggccgagccgccgccgccgtccacctcgtcgtcggccaccgtcgttcgtcgtttggctcgagggtgagtaccgttgggttcgtctcgtcgtcctctacgtgtacatgtcctccaaagtcgcagccgaccatccaatctccggcgaggtcgccatcttggtccggccattatgatgtcatcatgatgtcatcatctcctctttttcagtttttctttaatagattaaatagattaaaacttcggaaattcataactaaataaccgtagatccgattcgagtggttcaagttgctaaatttttctaaaatcaagatctacatgttaaaaatatccacatgtactgtttatgcttgtttttgtactgtttttttgatttttgtttaattgctttagtttccgatgttccggaggagagtgtttctgttgaggaagattccgaagcgtttgcggaagctcaaggcaagtcacacagatcccaaacaaccctttgagcatgttgaacccgtttaaagctattattttatttcaacttatgcattattttttaatgtcatcgggtggtgaaccttttcccgaataattaatggccgaagatgaccttattttcctatgggttataatttgattagcatgaaccttatatattggattggttcagctaaatgttatatgtattttgcttagccatgcttagaaacataagctaactaaaggggttaaatataaattatattatattattcttattaattatggttatatttaatggtagctcacgatggttaatcgtgtgatgttaatcaattgataattaaaacctggttaaggtgggttgtgagcatatggttttgattgttgtgctcatgacaattaaggactggttcgcgagctactgttgtgaaacatttaccgtaccaaccacaagccagcgtgggcaacggctttaccttttgtatagcatgattcattatggtgtgccagactgtgaagcggcgagaagttcgtgggggtcgctggggagtccattgcctctggttttgagggggagattatgatgcaggaacggtgcactgtggtgagttgtgttgtgcagagggtattgtcatagcctctattcgggtactttccagtatcgcgacgcatggtagacatgatgttgatgctgtgtcttgtgggtacagtggtacacctctggccagagtaaaactattcgaatagccgtgcccgcagttatgggcgagttgagcaatgtttttcgtgattagtctcacactactcattaatgttaataatgtgataattaatttgactcctggtttggaatggataattcctggtttggaggttagatctgtacgaccggggttggttgttcaggtttggttgggcctgagcagcatgggcgtgctgtttagtgttgattaaaattgatgattaattactctactgttttacttctcttaaatgtttgctaaatgctgcctttgcaaatgagcctatattatgccatcctttggtatccttgtgcacttgcatatttgttgtgtggcttgttgagtatgtcatatgctcattcttacaataatcatcaaacctcagttgaagaaaaaggatccagaaggagaagacgtttggcttataccccagttgagctgcctgtgggagtggagctgaagccatcgttagatcgttatttcgctgctgtttttcttttcttttgtaagtatgtaacgttattattaagatggatttgtatattaaattgtcagtttgtgtacctcagctgattcttggacgagggttttatgcacaaataagttcggaaattactagtgaatttccgggcgtgacaaaccgcaagcgacattcccgcgcccctttgtgaaaggggagcggcagaatgtgacgaagccatcaatgtgagttcatttaataagcgtccgccttccttactcaaaatcggcttatgacgtgatttagcgtaggcccttcccttgactgatgtcatcggtccgctcgcggatcatcaggtggcgacgtctctgaaggagaaggtcgtccaggaggcgtccgacgctgccaccactagtggtggcaaaactccgactaaggcgaggaaattcttgtctgtactcggaaatcgccgcaaggcggaaactcccttggtaatttcctccttgtcgttaggttgtgcagcgaggagaatttgttctcactctatatcggttgtcttgtaggcttccgacgtatttcccccgcctgctcgacgtcaacgtattgtgacggtcggcgagaagtaagtgaaggatttctagactcttatgtcttctgttcgagcggagttttgactcatggcggttaacagggaggcgaagtcgaaggctgctcgcggcaagtccgggggaacgtctagcgcgtccgctgtcacggcgtcaacggatgttgtgcccgtggtcgggagtcgggaggcgacgccaagcggctccgtgggcgatcccgtcggcggccgtggtctgtcagaggccgtcctcacctgggaggagctccatgtcgagatggggcgtcttctcgaggccggtgctcgtggcgttggctgcgaggtctcggaggtgagggcggagacggtagcggccaacgcgcgtgctgagcgtccggcgcgggaactggccgaagcccgtgaagacctcacgaagatgagggagctggtggccggcaacgagtgccagcgcaaagggctcgaggactgcatgtcggaactcgggataacctctccgagatccgaggttcgctgcgggtcacctacaccggtctccaccaactcgccgaggagtgcagcattaagtccacgattccggtgaatcccgacgagttctcgttgacctcttcccttgcggagatggcgacggcgatggggaaattccctccaagcacgcggccaggatcatggaggagacgtctaacggtatctataccgggacatgtcacgtcctcgcatgcgtgaagttgtcgcgtcctgaactcgacctgcgtgaggtcttggatcagggagcggcaagtaacgcacggaaggaggtgatggaggaagtcggtgatctgggggagtctatcctccccctttttgaagagtaggacccatgtattttttctgacttgtaaactttaaattctagttgcctttgcgtgcatgattaccatccttgttcactattgatttcgggaatctctcttgttgattgtagagatgctgatgatgaggatgtctagcagcatgggcagcccgagtcactggcaatgattccggtactcgagtttgaaccacgcgcctctcatgacgtcgaggacgaaactcttgatacggaggtcgaagtaacagcaactgcttcgagtgagtagcctatcaaccttgatgatgttttggggttttccgagttgtcttagtggtcgttacgtgtcacgaccggaaataacccaacgggcgttccttacgtgcgtgcattaatccttgtcccaggaggcaaggtacaccaaaagttgatacaattcagagtttaacaagcagaagcgtaaaatagttaatttattacatgggcgacgaaggcccagcacacacaaagacaaacgagaagcagcggaagactagggcgacgaccacaggcgcttgacggcaggcacgagctagacaccgaagccttcatcaaccaggaactcctcttctggggttgggaaaaattgagcaagactgagtacaaccaccgtactcaacaagacacacccacaagtgcggaataaatgcaagggagtacaaaggagtcatactataaaggggtagggttgcagtaaacagcatttaaagacatttagttgcccaagctattttgtaaacacgattctagtactatacaatgttattaatcaaggccgtgaacccacacgaacctgtattaaaccaaggcctatgatgattcggaccgaactggcaaccc

SEQ ID NO: 23320 - DNA, 6938 bp, Oryza sativa
gaatccgtgggaatgacgggcgcaaaaccggctagggatcgggctccggcggcgcggcggccggaggtaagggaaggacctgacaggtggggccccacctgtcagcctccggaaaagaggggcgcgcgggcgcggaccacggcttgggcccagctgggccgagcgcgggagagagagaaaggagggaggagttgggccgaaatcggcccaacggcctaggaggggagattttgaacttttttgaataaaacaatttgtaaaatgttgtttcaattattaaaaatacttcccttgctcaaataattcccagaaaattctagaaaatagaggagcaagcatagtatttaataaaattttatctagctcatttttatgttggaaattttcctagaaaattagggtttagcttgtaggcttttaaaataatttctaaaaattccaattaaacaccaatttaaatatttaggatttttgggatgtgacatgccatacggtagggtcgcttgtacagaggagtggttcctggagcaagatctatccggaactcaatctctcgcttgggcggcataccgggtagttcttccggaaacacgtctccgaactccctgactatggggatttctgacagtccgatctgatgcagttctgaacttctgacagaagttgggggtgcaaagaaaacaacaggttgttccggccctcggtacagagtgacagtgcgtctcgcgcattccactactccttggaattgagccaaccaattcatcccaaggatcacatccaagttcttggtgtctagcagaatcagatccgaggggaaaggaatcccctgaatttctataggaacggcagggctataatactttgctgtcataacccctccaggagtggtgatgagcagggggttcctaagcctttctacccccaactgatttctccccacgaatggcacagatataaaagagtgggaagctccagagtcgaacaaaatggtagcagggatggaatgaatgaggaacgtaccaactatgacgtctggagttgtcagcacgtcctcggccgtcacatggttcacacgaccccgaatgacatccttcccaccgttgttggagcggggaggcgcttggccttgctgacgcctcggctttgggcatttatccgcaaagtgcccgggctcgaagcagttgtagcacagacgctgcggaccttgagcgtccctgcggccttgaccagactgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctgggtagggattggtgtagcggaccctttggttagcaccctgttgattgcggaaattcgccaagcggcgcttgtgcgactccagctccttgtgcttggcttccaagcggatgctcttgtccaccagacgttggaagtccgggtagtccccggagactagatggacggacagctcagggtccattcctgccaagaacttctcttgcttctcctcatcttcccgcacatcctccggggcataacgggccaggttgttgaactcatgcaaatactccatcacggagcggttgccttgcttcaactctcggaattcccttttcttaagagccacgactccggcgggcacatgggtcctccggaaagcggcggtgaaacgggcccaagtaataggctgcccctctggctgcgtagcctggaaatggtcccaccatagagatgcgggcccctgcagctggtgggcggcgaagatgactttctcctcatcgctgcactgcacggtgtctagctttttccccacggcatgcaaccaaaccaacgcatccacagggttgttggagctagagaaggtgggtgggcggatgcggaggaactcggcgagtttagagtgttggggaggtggtgggggagcattatgttgtggcggattttggaggtggtggaggaaagccgtcatcatgttggcttgctgtgcgaggatttgggtgagaatggcgttggtatctggtggtggtggtggaggcggaggaggaggtggaggtgggttgccctggtggttgtggttgctgccttcgggttggttgccatcaccggtattagcatttctcctggtcgtcaccatctgaaaaccccacacagaccagcaaacagagagagctgacaattaaaactaaccacccacgacttccataattcttgaatttattactgctattaaattggttcattaaagttcaagttgcttaggcaaataaaataaagacaggctccgacatagttatgccacacactggcataaccatgcctcacacaactccaacaagaagacaaacgagaaagaacacacgcgcaagcctactaactgctcgtctaccgctgcgacgggccagggcggaaggtgagcaacagcgcatcctccgtgctaccaacgccggaggcttccccctcctggggaaccacgggcgcgggctcggcacgaggggtctcgacgaagcaagaccacaccagggactgacgaacaagctcgggcctggaggtgctcttgcgggcggtgatcttctggctgcggcagacgcggcgacgcttggggcggcagacctccccctgggcgatcttgagctgatgcagctgcgcctccaccgcgtctaggtccttcttgagctgcaggttctcctgacgcagctctaggattttcaagttgttctcgaccatcccacggcgcaccatctgatggaagtcgatacgagccgcgtcgtacgcctccaccatgcgcgctaggtgcacgatggtagcgtcatcctccgagctagcatcccggaaggtggcgtagtcacgggctcctccgcgacgagggtggtagcggtagggcgagtgctgcaactcgtccaggtagcgctggtgaagagtgccgatggcgaggagtgcggcgctctggcaggcggctgggaaggaatctccacccgcggtgactgccagcgaagtccgctagggagagccagagaggatcactgcagtgacctcccaaccagcatggggctctgcatcgtcaccctcctgctccggaagcggcctggcctggtagtccactccatgtggataccccaggacaatgcacatgccccgcagctccaagacgaagccagtcatgtccaaaccacgatgggtgacgctgccggccatctaaaaaaaacaaaaaagaaaaacaacattttagagatcagattttggcgataaatgaagcagcaagacagagagagactagaggattttcacaaataacaaaggatttttatttcgaaaatactgctaaggcttgggatctacggctcgtcctagggtcaagggggctttgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcgacgaaggcacagcacacacaaagacaaacgagaagcagcggaagactagggcgacgaccacaggcgcttgacggcaggcacgagctagacaccgaagccttcatcaaccaggaactcctcttctggggttgggaaaaattgagcaagactgagtacaaccaccgtactcaacaagacacacccacaagtgcggaataaatgcaagggagtacaaaggagtcatactataaaggggtagggttgcagtaaacagcatttaaagacatttagttgcccaagttattttgtaaacacgattctagtactatacaatgttattaatcaaggccgtgaacccacacgaacctgccttaacccaaggcctatgatgattcggaccgaactggcaacccgaccctgggtcccagctcgtcccaagccaacccaggccaaccattccacattttagttgttaagcaagttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctggccatagacaagagtaccgaccaaatcccacctacggccggaacccccgggacaggcaggcaggactgagcccctagcagcaggacaccggccctgtgccatgacatctcgactatcgggccacagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggtcgaggtgctactatcaaaaccatgcaccccgagcccagcctaaaaccattttggggattttgaatagagggggcggtgtgaagctaattccacagtaaccaaaccattccatagtgaccaggtgatatgaatattcccaaagtctagggttgaaaaaccacctaatgttacctagttaaaagcgaagcatctacctaaaatcatactagggataccataagtagagtgtccactagttggggttttgtttattctagggtgaacaagggaataataacaataacaataataataaggtcataacaaaggtaaataggcatggctaaataaaacagtgataacgcgggaatttaaataaagcgataatgcaataatttaaatcaacataattttacaaactggggttcaatatgttcaaagatgatgtgacttgccttgctcgctttcccaaacgtcggcttcgacttccacgaagagcgggtcttccgaagctgcagcgtctacacgaccaacggaaaagaaaaggctattactctaataaactccatataacaagcagaaacaaagcacaaaaatgggttcttgactccttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagtcgggagagagggcgcgcggaccgggtccacgggagtggggcccacgcggcagcctcacggtccacggtggaccgggtgcacgcgtcttgcgccggccggcggcgtgggtcccacgcgtcagccgcacccgagggcgcgggcggctgacggccgggcccacctggcagccgcggggcgcgcccgaaggcggcctcgccggcacggccgacgggaggcggcgcgcccgcgcccctatggtcgccggcggcggccatatgcacggcggagcggcggccgagagaggggagggaagggggaaacgaaatggcggtcctcggctcaccccgggtcgacggcgacgacgggaacggcgaccgaagcggagagaggcggcggcgcggctcgggtcgacgaggacggcggtgctccggcggtcggcgggcgaaacggaggagtggacgaggtcgacgagaacgcggcgaagccgaaggaggcgatgccgaagcgggaggaggtccggggcgacgacggcggcgaaccggagctcggtggcgacggcggagagagaggacgacggcgcgggctcgattccgacggggagagacagcggcgagtggcggaaacggaggagggaggcacggggagcgtttaaatagggacgggagtgagagagagcgggcggatgagggggaatcggccgcagaagatccggccgccattgatgcgccggcgaagttcgcgggagtaaatccgaacgaatccgagggagagagagagggaaaagtggggggaaagagggagggaatcacggggagtgatttccccctctttatggcgcgcggggacggcgggatgcgacggattcggcggcggcggcggcgctagggcacgggcgggcggcgggagcggcgcgaggtaggggatgacgggtgggccccacccgtcagcgagggtggcgggcgggcccgctcgtcagcggcgcgcgcgcgggggaaggccgatgggccgcgggggagaggagacagagggagggagctgggccgagccggcccaagaagggaaggggggaaaagaagactttttagggtttttttttttataaaaccattttaactttgtttatttcttctcaattattatttgtgctctgaaaattccactaaaatttatttacgcattttaggtttttaggaaatatacaaaaatcctccaagccttatttgacttttaaatttgcacattttaattgttggaggctttcacatggattttaattattctcggcataattttgaggatgtattttagagtcgttttgggacgcgacattacgttcagcagatctcgaggatgcccttgcgacccaagatcgtcgtatccaatattggaagacgaattttgaagtggcggaactcgagagagcaatgctgtccgtaaagaaagatcaagctgtggaaacgctccgaggccgcgaggtgtggttctcgtcttatctgaagagttgttgcacctcgatggccagggtgtgccgggagttagccgtttgagttgtacactctccctagccctcagccttgtcgtcggagggatgtcctcgggtgacaaggcttctggacccttggcctgtcttggttgaataagctctgatcttagcctccagccgtg

SEQ ID NO: 23321 - DNA, 21127 bp, Oryza sativa
atgggccgcgggggagaggagagagagggagggagctgggccgagccggcccaagaagggaaggggggggaaaagaagactttttagggtttttctttttataaaaccattttaactttgtttatttcttctcaattattatttgtgctctgaaaattccactaaaatttatgtacgcatttttggcttttaggaaatatacaaaaatcctccaagccttatttgacttttaaatttgcacattttaattgttggaggctttcacatggattttaattattctcggcataattttgaggatgtattttagagtcgttttgggacgcgacaaacctaccccccttaaacggaatctcgaccccgagattcggaagaactggcgaagagatcgggatgggctgccttcagctcgtcttcacgctcccaagtagcttcttcttcggcgtggttgctccactggaccttgcaaaaacggattacccggttcctggtcctgcgctccatggtgtccaggattttcactggcctctccacgtaggtcaaatcttcgcgaacttcaatttgctttgagtcggcctgctcggatggcactcgaagacatttcttgagttgagacacatgaaacacatcatgcacgttgcccaaggaggcgggcagctccagctggtaagcgacttccccgcgccgagcaatgatacggaaaggacccacataccgaggtgcgagcttcccctttgtctaaaacctgtgtacacctcgcaatggcgtgacccgaagatacacaaagtcatccactgcgaattccagatcacggcgtcggttatccgcataatttttctgccgagactgggccacctttagattctcccgaatggttctgactttagcttcagcttctctcaggatatcagtcccgaacacttggctttctccaacttggtcccacaatagtggtgtccggcatttgcgcccgtacaacacttcataaggtgccatttgtatgctggcttggtagctgttgttgtaggagaacttggcataggggagactcttatcctaggtcttcctgaaatctaggacgcatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcagatacgattttcctgggaacgccatggagactcacgatcctagcgaagtagagctcggctagtttgttccctccataggtggtcttcacaggaataaatcgagctaccttggttagtcgatccaccactacccatatagaatcatatccgccttgggtttttggaagtccggtgatgaaatccatcccaatttcatcccatttccattctggtacttggagaggttggagaagtccggccggtcgttggtgctctgccttgacacgctggcacacatcacacagggccacgaactctgcaatttcccgcttcatactaacccaccagtatttctccttcaagtctaagtacatcttcgtactgccagggtggatggaataaggactttcgtgagcttcctgaagtatcagctgtttaagttccctgttatccggaacgcatacccgatttccgttccatagggttccgttaccaggatgatagtgaatttccacatcataatccttgatgagctcttaccatctcctctgctgaagattcaggtccgactgagtgaagatgtatttcaaactcttatgatccgtatatatttcacagcgattcccaatgagatagtgccgccagatttttagagcatgaaccaccgctgctaactccaaatcatgggtagggtagttgccttcatgaggccgtagctggcgtgaggcgtaggccaccacatgaccgtcctgcatgagcacgcaccccaatccttggcgcgaagcgtcacaatacaccacgaagtccttgcgagtatccggcaagattaacaccggcgaggaaaccagcttttctttgagagtttggaacgccttctcgcattgcgggctccacacaaatttctcctctttcttcaacaactgtgtcatgggtcgagcgattttggagaagttctcgatgaatctccggtagtatcctgccaaacctaagaaactgcgaatttgggtgactgtcttgggttgcttccaatcagtgacggcggtcactgtttcggggtccacagcaactcctttagcagatatcacgtgccctaggaatttgacttcggacaaccagaactcacacttgctaagtttggcatacaattgatgttcccgcaactttcccaacaccagacggagatggtgctgatggtcttcctctgattgcgagtatatcagaatgtcatcgatgaaaaccacaacaaacttatccaagtattccatgaacactttgttcattaagttcatgaagaaggcaggtgcattggttaaaccgaacgacatcaccgtaaattcatacactccgtatcgcgtggtgaacgcggtcttagggatatcttcctcacggatacgtaattggtgatatccggaacgaagatcaatcttggagaatacagtggcacccttaagctgatcgaacagatcatcgatccggggaagaggatacttgtttttgatggtgacttcattgagagctctgtagtcaacgcacatcctcttcgtcttgtctttcttctccacaaaaatcacaagagcaccccagggggaagtactcagacgtatataccccttttctttcaactcttccaactgtttcttgacttcggccagttcatttgctgccatgtcacgcccggaatttctatccaaaattccaaacgcttacatgtgtgttaaaccctcgtccaggaatcaaccgaggcacacaatgacaatattgataatagagtacaaataaataactatttaatactcacaaataataaattattacagaggtggatagttcctctcaaagataaacattctacgcagcggaaagataaaactaaaacaatctacggaagagcgacggcaactccactccacaggcaacttaaccagaataaactcaatcctcaagatcatcaccttcactgaagtactcctcctctgatgaatgaatattgcaagaatgagcatataacatactcaacaagccacacagcaaatatgcaagtgcacaggataacaaagaatggcataatatagctcatttgcagaaaacagcatttaataaatatttaagagaataataaaacagttgaataattaatcaatattaaccaacaccatacaacacacccgtgttgcataggcccaaccccatttgaacaaccaaccccggctgaacaaattaaccctccaaaccaggaattaaccattccaaaccaggaactaaattagttaccacaattaccattaatgagtagtgtgagactaatcacgaaaaacattgctcaactcacccataaccgcgggtacggctattcgaatagtttaaactctgatcagaggtgtaccactgtacccacaagacacaaccccacatcatgttaccatgtgcctcagtaccaccacggtatctcggaaaggaattgtgacaatatccctcgcataacacaactcaccacagtgcacctttcctggatcataatcaccccctttaaaacaaggcatggactccccagcgacccccatggacttctcgccacttctcagtctgatgcactataatgaatcatgctatacgaaaaataaagccgttgcccacgctggcttgtggttggcacgataaatgtttcacaacagtagctcgcgaaccggtccttaattgccatgagcacaaccatcaaaaccatatgctcacaacccaccttagtcaggttttagttatcaattagttaacatcacacgattgaccatcgtgagctaccattaaataaccacaattattaacataaaatatagtttaccattaacccttttagttagctaatgtttctaggcatggctaagcaaaacctatgaatagcatttagctgaaccaatccaatatataaggttcatgctaatcaatttataacccataggaaaataaagtcaacttcggtcattaattactgggaaaggctcaccacccaatgacattcgaaaacaatgcacagttgaaataaaataatagctttaaacgggatcaacatgctcaaagggttgtttgggatctgtgtgacttgccttgagcttccacaaacgcttcggaaccttcctcaacggaaacgctctcctccggaacgtcggaaactaaagcaaataaacaaaatcaacaaaacagtacaaaaacaagcataaacagtacatgtggatatttttaaatttgtagatcttgattttagaagaatttagaaacttgaaccacctaaaacggatctacggttatttagttatgatttttcaaagttttaatctattagaaaatcgagaaaaaggaaaaagagcaaaggatgacgtcagccctgacgttgatgacgtcagccctagggttgacgtcggcatgacgtcagcgacggcggccggctcgggcacgcgagctcgccggcgctagggacatcggcggcgagattggagggcaccaacgcgaagagggcgacgagacgaactcaacggtacccaccccgacacgagacgatgcacgacggcggccggcgacgaagaagaaggcggcggcggctcgggtcgacggcggacggcgggctccggtggtcggcgacacaaacggaggggcggacggccttcctctcctcacgacgaagctaacggcggtgacggcgaccggcggcgacgacggagacggcgcggcggcgttgccggagaaggccggcggcggcggcgaacttgcgacgcgtcgcggcggcgctaggaggcacgggaggactcgggaaagggggcaaacgagagagaagatcacggggaacatttatatgagctcaaatcgaagagatcgagccgcaaacgggaggaatcaaatcgggaagaactcggactcgtttttggagataaactcgaaaccgaattcaaatctcatccaaaactcaaccatttgctttgattcttgggggaaaaggaagaggagaccgagaggaacaaaacccctcaatcaattggacggggtcggatcggaatcggtcggaatcgacggcgcaaaaccggctagggttcgggctccggcggcgcggcggcgggaggtaggggaaggacctgacaggtgggccccacctgtcagcctccgggagagaggggcgcgcgggcgcgggcgacggcttgggccgagctgggccgagcgcgggagagagagaaaggagggaggagttgggccggaatcggcccaacggcctaggaggggagattttgaacttttttgaataaaacaatttgtaaaatgttgtttcaattattaaaaatacttcccttgctcaaataattcccagaaaattctagaaaatagaggagcaagcatagtatttaataaaattttatctagctcatttttatgttggaaattttcctagaaaattagggtttagcttgtaggcttttaaaataatttctaaaaattccaattaaacaccaatttaaatatttaggatttttgggatgtgacaaacctaccccccttaaacagaatctcgtcctcgagattcagaagaactagagaacagatggggatgagctgacttcaattcatcttctcgctcccaagtggcttcttcttctgaatgattactccactgaaccttacagaaccgtataacgcgatttctggttttcctctcgcttacttccaagattctgactggcttctcaacataagttaaatcttcctgaagctctatacaatcaggatctgcttcctccgtaggtacacgtaagcatttcttcaactgagacacatggaacacatcatgtattcccgccattgacggaggcaactctaactgataagctacttcacctcttcgactcacgatcttaaaaggtcccacaaaacgcggtgccaatttccctttggtttggaaacgatgaactcctcgtaacggcgtaacccgaagatacacataatctccttcttcaaaaactaaatctctgcgacgattgtcggcatagctcttctgacacgactgagcaacgcgcaacctttcttggataatcttcactttttcttccgcttctcgcaatatgtctgtcccgaaaacttgacgctcaccggtttgatcccaaagaagcggcgtacggcactttcgaccatataatgcttcattcggagacatttgcaaactagcttgataactattgttatatgagaattccgcatacggcaaattcttatcccaacttccaccaaaatctagaacacaggctctcaacatatcctctaaaatttggtttactctttccgtctgaccatctgtttgagggtgataagccgtactgaaattcaaacgagtacccaattctgattgtaacttctgccaaaacttcgaagtaaactgacttcctctatctgacactatcttcttaggtacaccatgcaaacataccactctggccatgtataactctgcaagcttatgtcccgtataagttgttttgactggtatgaagtgagcgactttggtcaaccgatcaaccactacccaaatagaatcatgtcctgccgacgttctgggtagaccggttataaaatccatccctatttcttcccacttccactctggaatcttcaacggctgtaatagaccggctggcttctgatgttctgccttgacccgctgacaaacatcacatagagccacatattctgctatctcacgtcgcatactggcccaccagaattgttgctttaaatcctgatacatcttagtgcttccagggtgaatagaatacaaagtttcatgagcttctttcatgatagtatccttcaactccttattttctgggacgcaaattctttctcctaaccatacagtaccttgctcatcttctacaaaaccgatggctttacctcttctcatgttcttctttatttcctggatataaggatcattcacttgagcctctctaatttgatcaaatagagtaggtttagcttccaaagcagctacaaaacctttgctgactattcccaagttcaacttttcaaattcttggcataactcccaaggtaaacatctaccttctgacatattgcagtagcttttcctgctaagagcatcggctacaacatttgctttccccggatgataatggatttccatatcatagtctttaatcaactctaaccatcttcgctgacgcatgttcaaatcaggttgagtgaaaatgtacttcagacttttatgatccgtatacacctctgtacggttaccgtaaagataatgacgccaaatcttcaatgcatgcaccactgctgccaactctaggtcatgcgttgggtagttattctcatgaggacgtaattgcctagatgcataagcaaccacctttccttcttgcatcaacacacaacccaaaccgagtcgggatgcatcacaatacacttggaaacctttcctcgaatcaggcaaaattaacacaggcgcagtcactagccttttcttcagttcttggaaactttgctcacaatcttctgtccacttatacttcacttccttctgaagcagacgagtcattggtctggcgatctttgaaaagttctcaataaacctgcggtaatacccagcaagtccaaggaaactacgaacttctgaaaccgtcttgggttgcttccaacttaacactgactccacattgcttggatctactgccactcctccagatgagatgacatgaccaagaaacttcacttcggacaaccaaaattcacatttactgaacttggcataaagctgatgctcacgtagtttctctaaagctagacgaagatgctctttatgttcttccttcgtcttggaataaataagaatgtcatcaataaacaccacaacaaacttatccagatattccataaacaccttgttcatcagattcatgaaaaaggctggggcattagtgagtccaaatgacatgacggtacactcaaacaaaccataccgagtcgtaaaggcggtctttggtatatcctcctcacgaattcgaagttgatgatatccagaacggagatctatcttggagaaaactgtagcacctttcaattgatcaaacagatcatcaattctgggtagaggatacttatttttgatagtgacctcattcaacgctcgataatccacgcacattctctgagtatgatctttcttctccacaaagataactggtgctccccatggcgaagtactgggtctgatgtatcctttctgaagcaaatcatccacctgtttcttcacctcagccaactcattagctgccattctgtatggtctcttatggattgggttggttccaggtaccaagtctatccgaaattctatatctctcttaggtggcatacctggcaaatcctccggaaatacatctgggtagtcttgcactataggaatctcttgtagagcaacttggtttaagacctcaccatgagatttaggagaggacgcaaagaaagaaacagtttccccattgctactggttaaagtcaccttacgattggcacaatctataactcctctgtgacgagataaccagtccatccctaggataacatctagatctttggattctaacaagataagagaggatgggaaaggaacttcttctatttctatagtaacagaaggacaataccgtgtcgaaaatgcttgattgcctggggtattaactagtaaaggtctcccaagactaacaacttccatcccatgtttgattgcaaaacttttacacaaaaaggaatgtgtagcaccggaatcaaaaagcacagttgcgggtatagagttaacaggaaacgtacccaaaacaacatctggtgcattctgagcttctgcggctgcaacatgattgacacgagccttcggtgctggaacattgaagttgttcggggctggagcgttcttcacacgccgaggcttcggacacttatcagcataatgtcccggatcaccacaattgaagcatatcactggcttgcttccctgttccctcctaacgggctggttctgaactggagttgctgcaggacgagcaaccacattacggttgtcattgccacgattaccagtattgttgttgtagaactggcgttggggacggacaactgatgaagatcctccttgagggtacgatggaacttgaggtccagtaacgagacgcggcctctggttactgccctgttgtgccttaaattgggcagccctgcgcttcttctgctccatacggttatacttgtcttcctggcgaatcgctttgtccaccaactgctgaaaatcctggaaatccgtagacatcaaagcataagacaacttatcattcagtccctccaaaaacttctcctgacgttcctcatcagtgcgaacatcctctggagcataacgcgctaaacgattgaaatcatggaggtactcggtgactgaacgagatccctgattgagtgctctaaactccctcttctttagagctacaacacctgacggtatatgcgtcttcttaaaagcagctgtgaactcctgccaagtgataggttctcctccagccctgccttggcgaaaatgatcccaccattcagcagcgggtccatgcaactgatgcgaagcaaaagaaactttctcttgctcagtacactgaatcaaatccaacttcttctccactgcatgcagccaatctcctgcttcaactggattggtggtgcttgagaaggtagggggtctcacacgtaagaaatctgccaatttgttttggggaggtgggggtggattctggttctgattatttccctgctgattctgtgcctgctgcactaacagattgatcagttgtgtttgttgggccagaatctgggctagcgttggttctccctcattgttattggctccacttccacttccacttccagtgccggtgcgcgtgttcaccatctgacgataagcagagacaacaggaaagaaagacagagagacaccttagaacgaagttatttaattaatttaaatttctatattgctcttaactgtgtatgattacatttaagttgcattaacactacctcaccaactttcttacactctgacaagcaaaagaactagactcatgctgttacatcccacccatgatgtaagcagcaactaaaacccacacactcacaagcaaacttaagcaaacaatctaacacaacgttctaaggcaacgatctaactagacgactacttccaccttgcgtcggaacgaagcgatgaatcttcttcctctggagtagctggctctctttcttcaggatcttcctcctcttcctcatcacttatgatgtcgatgacaggttcagcacgatcgggcacagcttcacccatcacgcgaatcttcgaagctaactggagacgaggtggcggacaggttctctttcttgcgacgagacgaagcttgggtgttggcggcggcatttctcctttaagttcagctaattccttctgtagacggtacaccttgctctccaacttgcaaatcttgcctcgattccaattttcccggtcatgagctgctttgtctcgctccacacttactgcatccatagcactaagcatatgcaccgcatgcatcagagtagcactctcttcaccatcaggacagatataggttccatagtcttgaccatgaggcttatgaggatgatactggaaagctgatgaatccaactcttcttcaaagtgttgtcgcaactctccaatggccaccaaagctacttcttgacaagcatggcagtacgatcttcctccagcttcaaacttaaaagatggaaggtcttcactatcactagccaacgtcacacgaacacgacacttctcctcgtcggggtcatggggaatctgacgatactcaggagcaacctcatagcctacttcaaaagccatcaacctcagctccctgacgaatcctaacacctcgatcaaatttctcggtgaatggcgaggcatctaaagagacatagaagagaagaattaaagcatattttaagttagctgcaccaactagactcaactgattttgaccaaaaaggtagaaaaaataaaagagaagacacatacaaagctattttataaatattttttttagaatttaactttttaaacagaaacaaatatattttttttttgacaaataattaaaataaaactgaaataattatgatctattataagcacggtacagtgtcaccataggaaagatgagtagtactagtgctaacatgattaaatcgataccatgataaatgtacagtgccgaccaatcaataagatttggtaaaaagtaaaaggaacattttgaaaagaacaactttttgcttttaacagaaaagaaattgaattaaataaattttgtgcataaccttgcatatgctgccaacttaattaatttataagagaatagagaagagcagttctattttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaatgacaatattgataatagagtacaaataaataactatttaatactcgcaaataataaattattacagaggtggatagttcctctcaaagaaaaacattctacgcagcggaaagataaaactaaaacaaacgacggaacggctatggcgactccactccacaggcaacttgaccgagaacaagcctaatcctccagatcatcaccttcactgaagtactcctcttctaatgaatgaatattgcaagaatgagcatataacatactcaacaagccacacagcaaatatgcaagtgcacaggataacaaaggatggcatagtatagttcatttgcagaaaacagcatttaacaaatatttaagagaatagtaaaacagttgaataattaatcaatattaaacaaacaccatacaacatacccatgttgcataggcccagccacatttgaacaaccaaccccagttgaacaaatataacctccagaccaggaactaaccattccaaaccaggaactaaattaatcaccacattaatgagtagtgtgagactaatcacgaaaaacattgctcaactcacccatgaccgcgggtacggctattcgaatagtttaaactctgatcagaggtgtaccactgtacccacaagacacaaccccacatcatgttaccatgtgcctcagtaccaccacgatacctcggaaaggagtagtgacaatacccctcgcataacacaattcactacagtgcaccgtacctggatcataatcaccccctttaaaacaaggcatggactccccaacgacccccatggacttctcgccacttctcagtctggcgcactataatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttagtcaggttttagttatcaattaattatcatcacacgatcgaccatcgtgagctaccattaaataaccacaattaacaacataaaatgatgaaatagtttaccattatcccttttagttaactaatgtttctaagcatggctaagcaaacctatatatagcattttagctgaaccaatccaatctataaggttcatgctaatcaaattataacccataggaaaataaagtcatcttcggccaataaataactgggaaaggttcaccacccgatgacattcgaaaacaatgcatagttgaaataaaataatagctttaaacgggatcaacatgctcaaagggttgtttgggatctgtgtgacttgccttgggcttccacaaacgcttcggaaccttcctcagcagaaacgctctcctccggaacgtcggaaactaaagcaaataaacaaaatcaacaaaacagtacaaaaacaagcataaacagtacatgtggatatttttaacatgtagatcttgattttagaaaaatttagaaacttgaaccacctaaaacggatctacggttatttagttatgattttgcaaagttttaatctatttgaaaatcgggaaaaaggaaaaagagagagagatgacgtcagccctggcaaagatgacgtcagccctagggttgacgtcggcatgacgtcagcacgacggccggctcgggtcgacgagctcgccggcgctagggacatcggcggcggggttggagggcatcaacgcgtagagggcaacgaggcgaacccgttggtactcaccactacaccgaaagatgcacgacggcggccggcgacgaagaagaaggcggcggcggctcgggtcgacgacgtcgagggtgctccggtggtcggcggcgaaaacgaaggggcggccgagcttctccacaccacggcgcacctaatggcggtggcggcgaccaaaggcgacggcggagacggcggcgcgacgcgaccgaagatggccggcggcggcggcggacttcgtgcacgcggcggcgacgctacggggcacgagagagcacgggaaagggggcaaacggaagaggagatcacgaggaagctttatatgagctcggattgaagagatcaagccgcaaacgggaggaatcgagtcgggaagatctcggactcggtttttagagataaaacaaaacgaactcgattcggatccaaaactcaacgatttgcttagcttcttgaggggaaagaaagaggagaccgagaggaacaaaacccctcaatcaatttgaagaaacggaatcggattaggacgaattgagaggagaaagggcggctagggttcgggctcgggcggcggcggcggccggaggagggagacgatcccgacaggtgggccccacctgtcggcctccgcgagaggggcgcgggcggcagcggcttgggccggcgtgggccgcgcgcggaggagggggaggaaagagagagttgggccgaattcggcccaaggaccaagaaggggaacttttgaacttttttgaataaaacaatttgtaaaatgttgtttcaattattaaaaatacttcccttgctcaaataattcccagaaaattctagaaaatagaggagcaagcatagtatttaataaaattttatctagctcatttttatgttgaaaattttcctagaaaattagggtttagcttgtaggcttttaaaataatttctaaaaattccaattaatcaacaatttatatatttaagatttttagggtgtgacaaacctaccccccttaaacagaatctcgtcctcgagattcagaagaactagagaacagatgaggatgagctgactttaattcatcttctcgctcccaagttgattcttcttctgaatgattactccactgaaccttgcagaatcgtataacgcgattcctggtattcctctcgcttacttccaagattctgactggcttctcgacataagttaaatcttcctgaagctctatacgaccaggatctgcttcctccgtaggtacacgtaaacatttcttcaactgagacacatgaaacacatcatgtattcccgccattgacggaggcaactctaactggtaagctacttcacctcttcgactcacaatcttaaaaggtcccacaaaacgcggtgccaatttccctttggtctaaaaacgatgaacacctcgtaacggcgtaacccgaagatatacataatctccttcttcgaaagccaaatctctacgacgattgtcggcatagctcttctgacgtgactgagcaacgcgcaacctttcttggataatcttcactttttcttccgcctctcgtaatatgtctgtcccaaaaacttgacgttcaccggtttgatcccaaagaagcggcgtacagcacttgcgaccatataatgcttcattcggagacatttgcaaactagcttgataactattgttatatgagaattccgcatacggtaaattcttatcccaacttccaccaaaatctagaacacaggctctcaacatatcttctaaaatttggtttactctttccgtctgaccatctgtttgaggatgataggcagtactgaaattcaaacgggtacccaattctgattgtaatttctgccaaaacatcgaagtaaactggctacctctatctgacactatctttttaggaacaccttgcaaacataccactctggccatatataattctgcaagcttatgtcccgtataggttgttttgatcggtatgaaatgagcgacttttgtcaaccgatcaaccactacccaaatagaatcatgtcctgccgacgttctgggtagaccggttataaaatccattcctatttcttcccacttccactctggaatcttcaacggttgtaacagaccagctggtttctgatgttctgctttgacccgctgacatacatcacatagagccacatattctgctatctcacgtcgcatactagcccaccagaattgtagctttaagtcttggtacatcttagtgcttccagggtgaatggaatacaaagtttcatgagcttctttcatgatagtattcttcaactccttattttctgggacacaaattctttctcctaaccacacagttccttgctcatcttctacaaaaccgatggccttaccccttctcatgttcttctttatttcctggatatcaggatcattcatttgagcttctctaatttgatcaaacaaagtaggtttagcttccaaagtagccacaaaacctttgctgactattcccaagttcaacctttcaaattcttggcacaactcccaaggtaaacatcgagcttctgacatattacagtaacttttcctgctaagggcatcggctaccacatttgcttttcccgggtgatagtggatttccatatcataatccttaatcaactctaaccatcttcgctgtcgcatgttcaaatcaggttgagtgaaaatgtacttcaaacttttatgatccgtatatatctctgtacgattaccgaaaagataatgacgccaaatcttcaatgcatgcaccacagctgccaactctaggtcatgcgttgggtaattattctcatgaggacgtaattgcctagatgcataagcaaccacctttccttcttgcatcaacacacaacccaaaccgtgtcgggatgcatcacaatacacttggaaacccttcctcgaatcaggtaaaattaacacaggcgcagtcactagcattttcttcagttcttggaaactttgttcacaatcctccgtccacttgtactttacatccttctgaagtagacgagtcattggtctagcgatctttgaaaagttctcaacaaacctgcggtaataccctgcaagtccaaggaaactacgaatttctgaaaccgtcttgggttgcttccaacttaacactgactccacattgcttggatctactgccactcctccagacgagatgacatgaccaagaaacttcacttcggacaaccaaaattcacatttactgaacttggcataaagctgatgctcacgtagtttctctaaagctagacgaagatgctcttcatgttcttccttcgtcttggagtaaataagaatgtcatcaataaacacaacgacaaacttatccagatattccataaacaccttgttcatcagattcatgaaaaaggctggggcattagtgagtccaaatgacataacggtacactcaaacaaaccataccgagttgtgaaggcggtctttggtatatcttcctcacggattcgaagttgatgatatccagaacggagatctatcttagagaaaactgtagcaccttcgagttgatcgaacaagtcatcaattctgggtaaagggtacttattcttgatagtaacctcattcaacgctcgataatccacacacattctctgagtatgatctttcttctccacaaagatgactggtgctccccatggcgaagtactgggtctgatgtatcctttctgaatcaaatcatccacctgtttcttcacctcagctaactcattagctgccattctgtacggtctcttatggatagggttagttccaggtaccaagtctatccgaaattctatatctctcttaggtggcatacctggcaaatcctccggaaatacatctgggtagtcttgcactataggaatctcttgtagagcaacttggtttaagaccacaccatgagatttaggagaggacgcaaagaaagaaacagtttccccattgctattggttaaagtcaccttgcgattggcacaatctataactcctctgtgacgagataaccaatccatccctaagataacatctagatctttggattctagcaggataagagaggatgggaaaggaactccttctatttctatggtaacggaaggacaataccgtgtcgaaaacacttggttgcctggggtattaactagtaaaggtctcccaagactaacaacttccatcccatgtttggtcgcaaaacttttagacaaaaaggaatgtgtagcaccggaatcaaaaagcacagttgcgggtatagagttaacaggaaacgtacccaaaaccacgtctggtgcattctgagcttctgcggctgcaacatgattaacacgtgcctttggtgctgggacattggagttattcgggaccggaacgttcttcacatgccgaggcttcggacacttatcagcataatgtcctggatcaccacaattgaagcatatcaccggcttgcttccctgttccttcctgacaggctggttctgaactggagttgctgcgggacgagcgactacgttgcggttttcattgccacgattaccagtattgttgttgtagaactggcgttggggacggacaactgatgaagatcctccttgcgggtacgatgggacttgaggtccaggaataagacgcggcctctggttactgccctgttgtgccttaaattgagcagccctgcgcttcttctgttccatgcgattatacttgtcttcctggcgaatcgctttgtccaccaactgctggaaatcccggaattccgtagacatcaaagtataggacaactcatcatttagtccctccaaaaacttctcctgacgttcctcatcagtgtgaacatcttctggagcatagcgtgctaaacggttaaaatcatggagatactcagtaaccgaacgagatccctggttgagtgctctaaactccctcttcttcagagctacaacacccgttggtatatgtgtcttcttaaaagcggctgtgaattcctgccaagtgataggttctcctccagccctgccttggcgaaaatgatcccaccattcagcagcaggtccatgcaattgatgcgaagcaaaagaaactttctcctgctcagtacactggattaagtccaacttcttctccactgcatgcaaccaatctcctgcttctactggattggttgtgcttgaaaaggtagggggtctgacacgtaagaaatctgccagcttattttggggaggagggggtggattctggttctgattatttccttgctgattctgtgcctactgcactaacagattgatcagttgtgtttgttgggccaaaatctgagctagcgtaggttctccctcattgttattgtttccacttccacttccacttccagtgccggtgcgtgtgttcaccatctgacgaagcagagaaaacaggaaagaaagacagagagacacccctagaacagagttatttaattaatttaaattctatattgctcttaactgtgtatgattacatttaacttgcattaacactacctcaccactctgacaagcaaagaactagactcatgctgttacatcccacccatgatgtaagcaacaactaaaacccacacactcacaagcaaacttaaacaagcaatctaacacaacgaactatggcaacgatctaactaagcgactaattccgccttgcgtcggaacgaagcgatgaatcttcttcctctggagtagctggctctctttcttcaggatcttcctcttcttcctcatcacttatgatgtcgataacaggttcagctcgatcaggcacagcttctcccatcacgcgaatcttcgaagctaactggagacgagggggcagacaggttctctttcttgcagtgaggcgaagcttggatgttggcggcggcgtctctcccttaagttcagctaattccttctgtagacggttcaccttgctcttcaacttacaaatcttatctcgattccagttttcccggtcatgagctgccttctctcgctccacacctactgtatccatagcattaagcatatgcaccacatgcatcagagtagcactctcttcgccatcaggacaggtataagatccatagtcttgaccatgaggcttgtggggatgatactggaaagctgacgaatccaactcttcttcaaagtgttgacgcaactctccaatggccaccaaagctacttcttgacaagcatggctgtacgatcttcctccagcttcgaacttaaaagacggaaggtcttcactatcactagccaacgtcgcacgaacccgacacttctcctcgtcggggtcatggggaatctggcgatactcaggagcaacttcatagcctacttcaaaagccatcaacctcagctccctgacaaatcctaataccttgatcaaatttctcggtgaacggtgcggcatctaaagagacatagaagagaagaaataaagcatattttaagttaggtccagttggtgcagctaactttactgatttttgaccaaaaaggaagaaaagacacatacaaaaaccattttataaatgtatttatattttttttttgacaaaaataaagctaaaacaattatgatctattataagcacggtacagtgtcaccataggaaagatgagtagtactagtgctaacatgattaattcgataccataataaatgtacagtgccgactaatcattaaggtttgggtaaagggaaagaaaaccttttgaaaagatccacttttgcttttaaaagaaaagaacagcttttgcttttaaaagaaaagaatttgaattaaataaatttttgtgaggaaccttgcatgtgctgccaacttaattaatttataagagaatagaggagagcagttcaaaatttttcaaaatattttgaaggctacttaaggtttaccatttggcttatcctacggtcaaggtggctctgataccaacttgtcacgcccggaatttctatccaaaattccaaacgcttacatatgtgttaaaccctcgtccaggaatcaaccgaggcacacaatgacaatattgataatagagtacaaataaataactatttaatactcacaaataataaattattacagaggtggatagttcctctcaaagataaacattctacgcagcggaaagataaaactaaaacaatctacggaacagcgacggcaactccactccacaggcaacttaaccagaataaactcaatcctcaagatcatcaccttcactgaagtactcctcctctgatgaatgaatattgcaagaatgagcatataacatactcaacaagccacacagcaaatatgcaagtgcacaggataacaaagaatggcataatatagcttatttgcagaaaacagcttttaataaaaaattaagagaattataaaacaggtgaataatt

SEQ ID NO: 23322 - DNA, 7873 bp, Oryza sativa
taggatatggcggatatcgagtggaatttcctctcctcgtggtgatcacctttacattttctaaggaaggttcgggttgccccgaaatccttcccgtctccttagcaggaactagtgcggctagctgcgcttgctgagtttctatcattttattaaacctcagctggttttggaaagcggcagcaaagccttctaacttaacatttatattttccaggattttatcattggtggcaagcttttttttatggcatccatggttttagcttgcgcaaagactaaatccttcaaggagggctgattaaagttaccgttattgccgttgttgcctccttggtagaaccggggaggggggggggctggttccacccttaacgatagccattgttccccatgaacatggcttcttcacgagtctcggggtagtcattccccatgtgtccggtgtttccgcagacctcgcaagtgatatgtgaatccaatgctttgacggcagcctgtggtttgcctttctcctgattgtctagcttcttcactaggaggtccaactttgtggtcagcatttccgtctccttgacggtatgcatgccacgttgacgggtctggagtcgttcttcgctccagcccatagtcggtaccatcttctcaaaaagatcaatggccgctcggaccgtctttgagaagaatgcaccaccagcatagcatcgaggtgatccctggatgagggagtccattgtagaaactctgtaggatgagccagtcgtccatcccatgatgaggacagcggccacgtattcctgcaaatgttatcatgctacgggaatcgtctcatctctggtctgctggaaacttgatatccttccatgaagggcatttgtcttgcccatcgggaagaactttgagaggaacgcagtggagcatctgtcctatgtgttgactgttgaccagttcacgtagaaccactgcttcgccttttccaagggtgagaaagggaacagacgtagcctaacggcatccggactgacacccttcattgtgtaggtgctgcagatctccaagaattgttgcaaatgagcacttgcgtcctcatttggcttgtcaaagaactggcttgcatgtgccatagtgatcaggctgctttaaaggtcaaagtcggagtcttcgatgttgacagccaggccaacaggtacgttgtcagcaaacggtgcagcgaactcgcgcaatgtcttctcgcccatgttcctgaaactatgtgacgcttggatggctggtttctaggccgagagctttttcttcggagggacaacatgtggtttgacgctctggaagaaagcttctgtgtgttcgttgaagttttcttgcagattgaaactagacatgcattaccctgttttcatgacacaagtgaaaagaatcaattttagcctacaaaggacagcaaccatgcagacgttattatatatgtataattcgctaatagtaatctctttgctaatcttccccggcaacagcgtcagaaatgcttgttgatattccttaacgacattactagaaatattcattcccaataatggcgcagaaacaatcctcgtatatttatggttataaaagtaatccgcaagcgcacggatataccattgtaacatttcacccggaaatattcagaggtatcgtatttattcaatcccaagggaagattgtgaaagagagaaccatgctctctctctctctatatatatatatatatataggacactcatatggggcaccatggtgcccgggcaccatggtttcaaatgcacaaaatcactcaaatttttcaaaattttctaattgtgagtatatacctagttataagaattcgattcgtacctatacctatccatgattacatacctaactaattatatgtatggatgctatatacctagaatcaaaatctaacaaaaataagttcaaattcagttcaaacttgctttgaactagttagtaaaagtagttaatgttaatacctaaataattaaaaaagtttcatactcattcgaattgggtatatactcaatttcaacaatggtgcccgggcaccatggagcaccaaacaaatttactacatatatatatatatatatatatatatgcactaaaccgcaccaagggtgcgctataactaaactactctcctcacatcacccccttccctcccccaaccccctcctcccccccaacattttcaagccttccgcacttcccaccccgcaccttttgaaaataaacgtccaataaaatgattactaagcctctgtatgtgacataatatactgtaagtaaactaattactatgcatacgaatgggatggtgtacccatcccacaccttttcaaaataaacgttcagtaaaatgattactaagctattttatgagacatagaactctataagtaataaaattactattcggggaggaggggttaatatgctcatccccgcaccatttttaaataaaggtccagtaaaataattactaagcctttatatgtgacatagtacacaataagtaaaaagattactcataggtcgttgtcaactctcctcaattgtttcctactcttagtaaatggattactctcatgttgttctcagcccttctcttagtaatttgccagtaaataaattactctcatattgttctcagccctccttttagtaaatatattacttagcatatatagtactactcccaattggttctcgtgccttctcgcagtaaataaattactttaatattaacacattgatattgctgtaagatcaaagtgtgttttgattcttattctttgatgaataattggcatatgtgattattggttttgatatttggagattatcgtcgaagtggttttggagataatcaattttcaggtgatgatcagattcactgttattttatgtgaccggtccgaccgggcggaggttgccggtcagaccggcgctatgtgagcggtcagaccggcttgcccgcggtctgaccggccgacgttgtgtcggtttcagtttcgggttgtttgtttttatatccgtgattgtttcatgattatggcttctagatggatactatacgtatgtaatactgttgtttgctaacaatgagtcaagttggagatagcttggtcttggaatatggtttctttgtttgtttcatgtgtaggtgactcgatgcctcgggagagtatttgcggtgatggaccgggagtcggcttggtggtaagacgatgtccgtggtggtcagatatcatgtgggatactaaggctagagttgatgcacgtggttgacggagattccatatggcatacgatggaggtattgtgtacgtatgggatgcggagtcgaatttggaaggagtccaaatttggtatgattggttatgtaaagtttgtttcttgtactagagggtttcctaaggtgtttaggactcttagtatgagtttggttcgtggctttaggctgccaacatcatgtataaatagagggggagcgtgaggcttcccggtatcgcttttgtatcgcttttgagagcaattgagttgctagtttagttagggtttcgagtttagtcgaaatttttgtaaggagtgctgttggtgcactttgtaaacataaagagaagcaataaagttgtcatctactttaagagttcttcgatttgtgtttcaccgggtttcggcggtctaaccggcaactcaccggcagtcagaccgacggcattgcggtggtcagaccggtgggagcacggtggtcagaccggtggcggcgacagcgagcgacaggcgactttggcggttcgaccaatcgttctacatctgtcagaccagcggcatccactcggttagactgacagatcaatctcggtcagactgatctccgtcgatttcgagggtaacttttatttccactaaaagtttttggtttttgggtataccaaccattcacccccctctggttggcttagttcttgtgattcgatcctacaatcgccacaagatttctcttagtaaataaattactattatcacgttcttaacatactgatcttgcaaaaaaaattataatcatcgtaatataatcaacatcaaggtgatatcatgacaaattgtatatgataacaagaaaacaaatgagaattgagcatgttagctagctagcttagacaaaaagattcagcagctcgggctccctcttgccgccgccgcacatcgtgacggatccatcggagttcatcgatcgacagcgtgctgccccgccggggagccacaggccgaggtcgaacgacagttccgtctggggcgctgccggcggcgccatacacaccggggttcttggtcgtcgtcaaacgcttcgccgtcgagaacatggaggacccgcccacggcgtgcctcgccgtggacgcaaacacatcgcggccaccggcaccggtggcttcgtctcccgccgcgtagccggcatcggtctgatcttgcatgcataggtgcagtgtttgttggtgaaacttgtatgcttaaattgacaaaaccgaaacaaacttttcttgcacaaaaagggttgaaaacgtatatgtcagtgctgtacctagcaagaaacaataactgacttgctgctctcatcatatgactaaatgagttgactggattatatacatgaaaatgatgcaacaaaagttaagatgcaattaagaagggtgttgatcatatatatctacaaaaattgtgattcatgaatgatcatcatcttgattaagttgagattgggagcaagactacaagaattaatgtcatgtatgtatatcaacaaatgctttgtgacatggaaaagaaatttgacataacttttttgagatgtctaaactatataggttttgtcgtatcacccagcttagcattgcatttcttgcctgaagggatgatctctggaacgttctgaatcaagaacacatggaattgaacatcaaaaaggaaaaaaaaactcatcgaatttaagcatgggaaattaagaagctaatttagttaggggtgagaggataaatgagcttagcagtcccactgcagctgctccatgccattgccggcagcggcatcgccgccaccacagaacatcccacacgactcgccatcaggtccagatcgaacgccggcgccgtcgtacacggtacaccgccgacgagatgtccaccatctccacgctcgtcttattggagaatactttagtaagacggtacacgaaccatagaaagtttgggttcttgagacgtgctcaccatgcgtacgcaactatatgatgcagcaatcagatgtgtctcgatgttggatcctagaaatgccatgaagaaagggatggggggagggcgatagatggcggccggaggacggggaggcaatgacactgttggttggtcgccgttgccgtccttggtcgccgccgccttggacgactgggatacgccgcctcctgcctctgtagatccaaaaaaaatcgggaaaattgatcagtggttagttacgatgtggaacaacgacatatatgtatacgatgatttatatactgctatcagtaaaacaattacttacggtagaattcgatagtgccattagtaaaacaattactggaattgaggggggcaggggtgtgtatgtggtgggggtgaaaaaaaaaagggggtgttgcgtgcggtgtgtggggtgggttgtgctacagctactacaccctaggtgtagtgtgtgtatatatattacttgctttcatcgatgttttggcaggggttaatttaatataagggtagagtgtcacgaagcgaagcttatagaattcctgaagtaaataattctaattaggtggaagaagattccctatacttctaatatacacccaaactctaatctacatttgctagtatacaatcatgtggccaatacccctaacagtgccctcctggtgtttcaagagaccaccccgggttgccgagtttcttacgacaacctgttatggtcgtccaaccgggactaaatacggaggagtaccctccccagaaatttgtcttaggttttctcataatcgctatgaggatcatccctgaatatgggagcacaacccggagcttgaatgtctttggaatccggcgatggcttcagggaggactctttagtcagacccgaacatgttgaaggctcggtttcaggcttggcaaaagaaggttcctcacttcctgacacaaatgcctctggatggggttcaacacactgcccgacaaaggaggtattttccgatatgcgatcgagaatttccttgccttcggcgggagttttgtgcatgaatgaccctccagcagttatgtcaaggtagaatgcagactccctatctaaacccgtatgaaaatgctgcaatagcacgtaatcgggtatagacaggggtgggctagactgaactaaattagtgaatctggaccatgctgcaccaatcgattctttatttatctaccggaaacttagaatttctacacgaagagtagtaatacgggttacagcgaagaatgcgaggcagaacctgtctcgcaatttctcccagttaccgtttacacactcgacggtagatgtgtaccattgtttcgctctctcatgaagagagaacggaaacaatctccactgaacaacctcttgcttcatgcctcgaatcttaaggcacgagcaaagctgctcgaattcccgcagatgatggtaggggttttcctggcctaaaccagagaaagatttctccctaaccatactgatgaatttgggacgaatttgatagccaggtgataaaatatgctccgatgaaggaggtggctcgtaaaattcgccccgaggaacagataattggaagatagatagtggctccatcagttgagaatgtttttttaggaatacttctttggggtacgggtgaaggtagaagaaaggaaaataaaaaggatacgaggatgaacaaggttcggagataaatagcaaccgttccccggcaacggcgccagaaatgcttgttggtatttcttatgatcacagatagaatccgtaagcgcacggatataccgatgtagcacttcccttacggagtattccaagggtatcgaacccaagggacatgtgtgattatctcttcctccggttcatccaaggacacaagataaatatgggcaaaggatagagaggatttcctagtgagaaacagtgtcaaaggaaagcttaagtttaatcctaacgcgatacttcaggcactggcaacccgctgttcccagatatcgctctactacgtaaccggacagggaggacttaagtgctcttgagggctatcaccacctctacacgcacctctaacgtactgcgggatacgcagcaaccaccagaaattaattacccagacaccgcgtctatgcaattaataactactctagcactaaagcaatcacgatatattactggactatagtgaacaatgatcccatatgctaattaggaactaaccaagaataattctcactaagcaaatcttaattactcagaatgatatttctattaaagcagagtaattaccaaagtacaagaataaggagaggattaccgacaactccgggattccttcgacttcttctactttactctctccctattctaaatatactatagaacatataaagtagctaaagtatacttagagcctcttgtaattcagctctacatcttggtgtgtgtcaaatgagggagaggagaggggtatttatagtgtggagccttcttgggagtgtggagatcctccatggaatcctatgagcatcttcactctcctcat

SEQ ID NO: 23323 - DNA, 26048 bp, Oryza sativa
gcccatttggaggtgtttaattgggtttctgagtccaaaactccataagttcagatacgagtttgattctcatcctccttcatgtatatttcctctcaactttggtagtttgtcacctgcatatgaatatacaccaacactcgtggaaattgttagaaataagccctaccgctaagttggatgttccacgtttatggtcttatgcaggtattgacggcgttaatttcgtacttaacggccgtcaacatccacctctactgtcccgcagcatatatgcccagataatgatatttactaatttaagcaccatgcttacattaataaatactactctacacctctacagatgatataaagcaaccgataaatcggacattaaatccacaccattgcacctctctggtaggctacccacataattatattggcacaaatataaagtaagagtagtattcatactaggtaaagtactgagaatataagaagtatttcattaattccaacagtattacggaagagaatataaaagctactagagccataccgaaactcttccgaagactccgaggactattctattctactccacttagcactaaaactactaaaataaagtatgaagaggaatcttgaacttgcttgagtatgttgagaatgaagtgagctcctccttttatagggtcggtatgatggttgtagccatgcgaattgtccattttgcccttgcaaccgccatcagcaagccatcccgatcgtccacgtgcagagccaacctgagcagacgcagccagggtttggccgaacctgggctggcccagaaggcctccacacttctctgggtcactgactggtgggtccttatgacggttgtggtagttaaagcggtttccaggacagttacacctagcttgtgggtccatcttatccataagcttgcttaggagtgaggtttcctcatttcttcattattttatttgctcaattcctgcaacacagtattctccaagtacaagtgaaactatattattgtaaaacaaatatgtattataagcatagctagttctcctttattattgtcatattgacggtcgaaatttgtctgtaacgaccgtcaacatctcacaacttcaccttctcttgccaaccgaagcttttatgtttccctgcaggttacataagtatatgtgtggcggtaaaagtgtgatggttaagcgaacagaagaccaagatgacgtaaacgatgttttctttttggagcttggtgggggtaaaccaacactaagcaatctgaaatctagttgttgtaaagataagtaacaatccaaactagaagttcattgctaagtgctgatccataatgtttggaatagaaacaccaactcacgcacaagagaaagatattttgatgcaaaacaaaggattacgctagtgatagatggacgtcatttcaaacctagcaaaatttgcaccgacctctaattttgcagtatggcgtaaacggttcagcacatgcaacacaaatagatcgttctttcctcctttctcttctcacaattttttcacctcttttttaactatttattttttttcagcacctttttttttctgcaatttttttctttgcacaaaaaaaaagactataacatgtataacactctcacaaatgatagactaaaaccaaaaatatataactagcaattagagcataataggatcaaggtatacacaaaggatagatatggttttactatttttttgtggggattttcctagagaaaacaatatatcggctcaaaggacacgcgaaggaaaatagatcaacaactaaacaaggactctaatgaactgaaacttaaccaaactcactagaataacatatgcaattataggctatggaataaatttttgtaggctttttctggataagaagaaaacaaatatatatacatagggataaaaaatcctaccgtgacaacgaaagctctgataccagatgatacgacccaggtaggggtgatgtcccgatgttcacggcgtaggatgaagaaccgataactagcctcgaagagatcgagatagttagttgcaagcagctaagatatcggtgcaacctgacgatcgtattcgaagccaaccaccgtgtctattacggcaagctgaatcgatggttcacccaaccacactctaagttaccaaccaacacaacctggaatcaatcgaggaaaaatcctcaaaagggaccaggagcaccaatttggggcgttgaacaccgcttctttaatcccacaaggaaatcacaagagcaaaggattagagatctctctctgaatttgttagcacacagctaaacaaagggggttcatattctcattttcaaaagtcttccaaatgataaaatataggagatatttatactaggaacaaacctcataaatgggaatgaaaggtcttgagagtttactgaacataggctagctcaaaggtcacaataagtgaattcccaaaaagactcgcgcgtctgtttgctttctgggcagtcctcaatgatttatccattactccttattgggaagtagaaatgacgacccgtctgttggatgtgaaactagacttaaatggtcgcacatatatattaagcatggagattgttgattggctgggtcacacatcccttgatgttggagcaaatgtttggagacagtgtactctaaattcagtatgacataaatggtcattatctttacgtaaccaatcatcactttgaacttctagctcttcgtcgatgcccagcaagtcttgtgcatgtgtaaacctaagtaatagcaaagtacttgatttaggtagtatataattcttgtcaatattgaaatatgtttcagatacgagtgagttcacctcttgtttgtagtttctttgcacggctacatgtaatcagttcttgaaatggtgtaacggattggctctcatcagcggctaagtcagatgattgtcttgtatgttcatgtgacgagggctggggcatatcaaaaatcttattgtgggtgataagaaattgatttggccaggactatcacggtccacagaggtaatcagattcatttccctggtttaatccagcatttctcaacataaaaactagggaaataattttttatataaggctgaatttggtgtagaaaattgtgaaggctgggacgtctagcttgtatatacttataatttataaaacacatagtcgtaatttaaatcttacgtacagatcttaaggcgacgttgaattgttcattgtctgctgatttggtacagtagagcaaatggacccatcagaaaacgacgcaaccattgacaaattttatttttaagccacggtgtaaccatctatctatctatctatctatctatctatcttctatctatctatctatcttatatctatctatctatctattatatctatctattatatactaaaagtccatgagacttcctacaaacgctctcaagccgccaagtggcgctctaataaaatagagaaaatcctagaaattctaagaaaaaagcaaaaaatctacccctttcacttaaattggtgggtccaatattatacaccattagataaaattgatcttaaaacaaactaaatactatgggtcccacctatcctcctcctgtgcgttggcaggtggcaggtttgtacgtacatgtacgtatgcttccttcctttcttttcctttttttccttttttttcttttttccatatatatatatatatataaatatatatatataatggatatttttttaaataatcataattttacaaaacaaaagaatctaccatcatataacaaagaaacttcctttcaaatattgcactattttaaaataaattttacacatttatattctatacatattaaacgcactcaagccgccaagtgatgctctaataaaatagagaaaatcctagaaattctaagaaaaaaataaaacatctaccccttgattttcacttaaattggtttgtccaatattatacaccgttagataaatcgatcttaaaacaaactaaatatcatgggtcccacctatcctcctcccgcgcgttggcaggtggcaggtggagtatatacgtacgtacatgtatgtatgcttcctttcttttcctttttttcctttttacatttatatatatatatataatggatatattttttaaataatcataattttacaaaacaaagaatctaccatcatataacaaagaatcttcctttcaaataatgcactattttaaaataaattttacacaattatattgatatgtacctattaaataaacaatatctatattaattaatttatacatgcacataaattgatggccccattacataaatcattagatctacttttcattaccttggtctattattccctgtttcaaaataaggtctacaccattatattgttacccattaaattaacaacttaaaatctatattaactaatttaacttacactagaactggtggacttattattataatcatcggatctattgtttgctaataaataaagcgtccaaaattctctttttgcccactgcacaatacacatatgcacctttgcctttcgcatgtgtgacaaagtgtagtgtctgagacatataaggtgatcacaaccgctgtagagctaccactttgccacaaatcaaatcatatatggagatgattaattttgttaataacatgaaaagaaaattaaatatgtgatgcagtgagagaataattaagtaccatggattgtgtttttctcaacactaattagctctgtttaagttgaaaccgagagttgattacgtaataattataatgtatctatgttatgtcgtatttggattttgtactatttgttcgtataggtgaaaggaatcattatgttataaatgtgagcgcaatattgacgaatattgatagaactcttactacgacaagggtgataaaagggaatttaaggccctctctttttttcccgattccatattttggaattttgtttgcatgctttccaagtttctaaatagtgtcttctttaaattaaaaacattctaactttttagaagtcaattcattcatttataccctcaaaaaaatatcacataaattatataattcatccatttcaaaaaaaatatcacataaattatataattcatcaatttcagctatcctaaaccttaagtactacatttttttttcatgcgagtcatggtgataaattattaaagtcgtacgatgaatatgtaagaggtactttgaacaattgtaaataggtgtcaaaattaattgctattaattagacatctaatggcttgcaagccacaaaattaatttcactcaacatgtatataaacatggacgaagctggaacaaatattaccatatgtcccatacatatatattgcacagttaatattctaattacatgtgttaagcatttaacattccttaaaatgctctcaagctgcgacgtggtgctctaataaattagggcaaatattagaaattctaagaaaaaaacaaagtatctatttcttgattttcacttaaatcggtaggtccaatattacaaaccgttagattaaattgatcttagaacaaactaaatagtacgaggtcccatctctcctcccgcggcataggtacggacctacgtgcatgggtacgtacgcttcccctcccttttccattttttctctttcttcctttttttcccatgcatatgcttccctctctttattactatatcatgcgccttcatgagacgatttaatcaaaagaattttgagtatcttgcactcgcatttttcatttgcggtcatactacacggtatgcgtatagatggattatatgataattaactagcaatagttttttatttactcaagaaaaaaagaaacatgattcaaaatcgtaagtacttaatccatctcctacttaagtttgtgaatggttttttaagatacgttaagaaaaatagaacccttaaattattataaaataatattatccaaacttatttagtttgcccttaatctatgagacaaaatttctgaacaaacaataatcttacctttcaataatataagtgcccgtgcatacgcgcgggccacctttctagttattatgtactaaaagtccattaaacttcttcaaaacactctcacgtcgccacttggcgctctaataaattagtgaaagtactcctagtaattctaagcgaaaggcaaaacatctagccattgatttttatttaaactagtgaacacataattttgcatcgttagattagattaatctccggggcccctctcctaccaaagccctctctaggaacctgcggcacatagctgccacctcccgtacgcccctatttcttttccttttcctttttattggttgttaagatatttaatggcctattttatatagaaacttaaataaattcacacttctctttttttaacgtgaaggatgagatcggactatgcaccgcttgcatccatgcacttggcatgcatttgtggtttatactttttgagttggtccttttaaaaataaataaacagtatttttagtggttacagcttttaaattgtatataaccaatttgtgatcgatttgaaccattcggtatttctttacttaaacgatttcagctgcattgaactatatttcagaatacaagacaaatattacatgttggacccaagaccactaaattaaagacaatcattaaaaattctcaaacttttttttatggaactgatcttttgacggaaaatcatggggcaaaacatgcaaattttccaccgttggatatgctttaagatgcatgcgtggaagtgagaaaaaaatcaaatggcgcatggataccaaggatcgaactggcgatcgacgcacaaaacactagagcatgtgttcactgccaagctttgtaacattttctattttacattactccctccaactttttctattttacaatactccctccatctatttttgatagacatatttctaaatctaaaaaaatttacttttgataggcatatttcaatccaaccacctatcatcttattgactttctcggatttaatgcgtgactctctattattccacacaatattggctacatgggtatcgaggaatataaatattaataaatcacttgtttacgaggaataactagtagcatgtttaaatggttgataagtataattacttatccttggtcgttatgacaagatgaaatatggctattaaaagtagatgaagggagtaataattacatctttcttgtactgcagttacatacgagttacaaatgtaattacactgctattttatgataattacatttgccagatttttagggggattttctaccgaatgttagataggcggcggttgcgcggcgtggcggcagctctagcagcggcggcgcgcggccagagattggctgcggtggcggagctcgggtgtggcggcgagagcgcggtaaagggcacgggagaagcggggcaaaaaaaggaaataggtggaggaggatgagggtagctttataggggtttgggaggggcggacgtggcagggaggtggccggattcttcgccaacgacgtggggaggtggagagagagagagatgggggatttcgaatccccgccatttgcgggcgcgtgcacgtgcgggagaggcgggggagtgggcgggtgacgtgggcacagagcgtgggcgcacatgtggaagaaggggagatcaactccggtcagaccggcggatcaactccgatcaaaccgatcgacattgattcgagggtaacttttaattccgctataaatttggtttttggtactataaccattcaccgccttttttggttggcttagttattgctgtttgatcctacaaacacctggtgacagcttgccctcacaaaatacaagatttcgtgaccaggtgacagaaatttgatgactgaatgctgtcaccaaatctctttgtgaccgcctttgggcttttggtgatggtgaggggcagtcgccaaaaaaccattctctggtagtgaacgacgtactacagtatacagactatacctaccgtttgatgtttcaacgagcacactttgaattttttatgggcgaaccggcgaagtcaaacgtgtgaacatgtgagctagtcatcccagtatatgcatgatcacaaattcaactgctgagcaacctctaccacttgaaaggtagaattcaaagtgtgaacaatttcgtcgcatacaacgtccacaccatatacagactacatcaatattgtaggagatgaacaaattttgtcgcaataaaacgtgggaacatgtgacctagtcacctagaattaatcccagtatatgcatgatcacaacctctaccacttggaaggtagaaatttaaagtgtgaacaatttcgtcgcaatataacgtccacaccatgtacagattacggctttgtttagattccaaaaaaaatttagctaaaaatatcacatcaaatgtttatacacatgcatggagcattaaatgtggacgaaaaaaaccaattgtatagtttgcatgtaaattgtgagacgaatcttttgagcctaattacgctatgatttgacaatgtgatgctacagtaaacatttgctactgatggattaattaggcttaataaattcgcaaagcagtttacagacgaaatctgtaatttgttttgttattagtctacgtttaatacttcaaatgtgtgtccgcatacttcaaaaactttacacccaaataactaaacacaccctagatcaatattataggagatgaacaatttggtcgcaataacacgtgcgaacatgtcacctagtcacctagaattaatcccagtatatgcatgaccacaactactgagcaacctctaccacttggaaggtagaaggttcagcgttgtactatgctacacttgttatagctagttgccagtagtatattaattattgtatgagttgctgatcgtgtaacttctgtagtacgttacgactgtcatggtgtatatataaagtcgccggcttcgaggtcatctgcgaccgcacgttcagcccgccgcgcgccttcctcgcaggcgacccgccattgttcggcgacaagtggccgccggacgtgtggacttgtacctttacttaattatttccaaactggggatgccagccaaagaagatgcggatgacagcgcagagacgcagcaatatgtgggcatgaaggggctataaatagatgagatggacatttatgatggatcatgcataaacacgtacacagactcaaatatttatgcctagctgctgtaggttatacatatattgagcaaaatgttgatgatcctgccctgtagattgctgctgcgtctagtcctcgcaacccttctgattttggctgctagtacagatcaacatgtagccacgctgccgccgataacacttccaggctgcatcgacaagtgcggcaacatcagcatacccttcccgttcggcacgaagcagagcagttgcttccttccaggcttcgaggtcacctgcaacgacacattcagtccacctcgcctcttcctcggaaattctaatcctggagacaggcaaaactatcaggaatttgaagagcgctactacttgacgacggaggaaggcatgccgacacatctcatgactgatgattttttgttcatggagctgatgagcataaacctcacagagggcgtagcacgggcatatggccctgtgagctcggattgcagcctcaacgacacatatcatttggtgaagaggcagatgacgggcttggccgggccattcctcatctccacgcgcaatgctctcacagccgtcggctggaacatggaagcaaacctcgcgagatcggtgcgtggatccggcttcctcaagacctgtggtgtgcggctcgggcaacctgaatttgcaacgaatgggtcatgcctgggaggaggctgctgccagggtgaaatcactcaaggcattggctctatcgcggtgtccttcctacggcagaacaactctttgtgagggattactccctgttcctacggcatggtggtggagaaggactggtacaacttcacttcgccggacctctattccgacaacttctccaagaaatatccaaagggtgtcccgctagtgattgacttcgccatcagggatggtttttgcccagcggcaggccaggcgccgccggcgaactatgcttgtgtcagcagcaacagctcatgcgtcaacgtgaccaacggtgatggttacatctgcaactgtagtaagggatatgatgggaatccttacatacctaacggatgtcatggtgcgttctcctcctctctgtaactctacatccatatattatcgttcttgatgacattgatgtgatatactcactccgtattttaatgtacgacgccgttgactttttgacaaacgtttgacctttcgttttattcaaaaattttatgtaattataatttattttattgtgacttgatttatcatcaaatgctctttaagcatgacataagtatttttatatttgcataaaatttttgaataagatgaatggtcaaacgttggttaaaaagttaacggcgtcatacattaaaatatggagggagtataacaatattacaccatgagtacacggatatgtgaaaattaattgctgtttgcgcacagatattgatgaatgtgccctccgagatagccatcctgagctccgagtcctgtatccttgttcaagaaatggaatctgcatgaacagaccaggcggatatgattgtccatgcaaacgtggaatgagcggtgatggcaaagcaggaacttgctcagagaaatttcctttacaggctaagattgttgtaggtacgtgacattatattcgcggtgatatttttctgccatcatgaaggaactcataatgcatggatacaaatcccttcatcaacaacttcgtttcgaaaagaaccgttctacatatatactattgctttacagtcaagaaaacacttcgtttcgaaatacatctaatgatcctagaaaataaccattctactatgatctaagcatttataatgattatacaagaatgcaatatgtagctttgtaatagctctacttggctgagttagacaaactaagttgggaactcatctctcacgtacgcaaaacgaagcgactcattagtgcatgattaattaaatattagctattttttaaaatggattaatatgatttttaaaataacttttctatataatttttttaaaaaatacgcaccgtttaaccgtttaggagacgtacgagtgaaagacaagtgggatgaagttgagaacactgagtagagaacgcaacccgtaattgataggctcacaaatttttgggagcatatggtgtggtacaagggcacttgtcccgggtggactttattcttgtagaacccttttacagtactccaacatacctctagggatgtaacaggctacaattgttactagtatatttttcctaagaaaaatataattgctcctttcatttaatatatcacagaaaaaattaaaaagaccaacgctcattaattgcccttccataactcaattatgcaagcttgtagaagttaggaactatagatatgtattgaaatgaagatgagcacgtcaatttattcttaaaatatgtatatgtgaaatcatacatgaatataatttaaatactgtacatcacaatttttttactatacatttaaattagaaatcgcataatacttttctaagtgtctatatattttagtgttctcaaatcagattagaaaagacttgcctttatggtccagtcttgattttaaatatgattgagatttgattcaaacaaattatattcagggtgctaaacataattggcatatttgtatttcaaatttgtaaacagaaatatgtgatatagttttacaaattacaccacgtgtcctatgaacagtgttaattttaatggcacattaagggatatatttcattccttattctgaggtattacctccaaccagataagggcatgtaaaaagctagagttcgatttaggctcttagttaatacatatcacttagagcaagtcatatcagctcctatatgttgctcataaaatttgccacataggattagataatgacgtagaggaaagaagttaggagagaaaataagccattcctcatgcaagggataacttccacataattttcaagcaaagtgcacgatggtgttagggtttgtgtattagatgtgatacgttgtacttgttacctcttaattaatgagtagatgatatgatttaaattagaggtgacatcaacctccactgtaaaacttgcttttagagactttttctataataattaagacaacaaaacatcttacccattaatgcacgaaagtaagtttttattaccctagtttccttttctttaaccccatgcaataaaattttatctaataaatgctaagagtcgactaaaaccgttgtaatgcgtagcaactatgtttccctttccttcccctctctcttccacatcggaaaaagagcccgttattagataccgttatacttttttttaagataataataccgttgtgcatgccctaatagatcacacgtaccattgcttcctagtataatgaacggcgaaaaaaaaactgagctccttaaaaacttcattttattaagataaccataagggtgaattatatttttatataaactcagtcaaacgtttgatttacggccagacgtgcttatatggtcttcaaagaaaaaactgtgtactcggctgtactcgccagcatataccagaggatcccctcgacgaggctgctgcccaggttcccgtcgttgtggatagaactgcagcctgattcccacactgagcagatcagtcctctgtctagcataagattgatatggactgggagttcgtaatccagacgcccacaaagctctattacttttccttccctcttgtctcatccctgagttggtgaatttaatcaatggcagcacggtttagtaattcggtccgttgtgtcaggtttgatgtaggctacatataaaaacaaaacaaaaaaaaaaacagatcagcttacaaggatttgcttttgggaactgttctcttttagatcgatcttggaccatcattggcaagaatggattcagggactaattttagtccctatcacatcagatgtttggatactaatttagagtattaaacatatattaacaataaaactaattgtataaatgagagctaattcgcgagataactttttaagcttaattaattcataattaacacaagtttactgtagcatcacataggctaatcatggattaattaggctcaatagatttgtcccgcgaattagtccagggttatggaatttgttttatcattagtctacgtttaatacttttaattagtatcaaaaatccgatgtgacagagactaaaaattagtccctggatccaaacataccctcagttgttgactagaggtttttagtttgcgacggtggcgagcaggacaagttcccagtatgctttggtgtggcctccggacttgtaggaacggagattaactccctcaaggatgatgtttatactattaagtacctcttcttcaaaagttgtgctgtttttttctttgaagagcataaaagcacatctcgtatttgtagtacccttggtaaatgtaacgagcattttcaaggtgattctatatgatattttaaaattttaatgtattaaagatttatccatgtaccacatttagtatttacaagttaattagtcattgacatccaagcaatttaaaattttgttattcatttactctaaacagtatagaaacaataaaaatatcattgtaaaactcaatccgtcagtttaatatttatagcttcatgatacattattgtggttcgtttcaatgatattgagtactctattatatattccacatgcaggtgcaataggtggtctctttattgtcgcagtccttgtgttccttgcacttgttcacagagagaaaaggaagatgagagaattttttgaaaagaatggtggtcctatattagaaaaagtcaacaacataaagatattcaagaaagaagaactcaaaccaattctgaaagctagcaatattattggaaaaggtggattcggagaggtttacaaaggccgtcttgctgataacaaactggtggccgtaaagaagtccatcaaagtcaatgctgcacaaaaggatcaatttgcaaacgagatcatcatccaatcccgagtcatccataagaacattgtcaagctgataggttgttgcgtagaagttgatatcccaattttagtatatgaatttatcactaatggcagtctcgatgacattcttcacggtagtaacggagaacctctcagtttggatttacgtttggatattgctgccgaatcagccgaaggtctggcatatatgcattcgaaaaccaccaatacaatcctgcatggtaatgttaaaccagctaacatacttttggatgacaactttgttccaaagatatctgattttgggatttcgaggctaattgccgtagataaaaatcaacacacagataaagtcattggtgacatgagttatatggatccagtttacctacaaacaggactattaacgaagaaaagtgatgtctacagttatggggttgttctcttggagctcatcagcaggaagaaggccacatattctgacaacaatagcttagttcggaattttctagatgctcacaaagagaaaaggaaagcaactgagctgtttgataaggatatcacgctggcagaagacttggacgttcttgatggtctcgtgaggattgctgtggaatgtttaaaccttgacgtggatcaacgaccagaaatgacaaaagtaacagacgatcttttcatcttgatgaaatctcgagctaaagagaccaagcagtaaccagacaaaagttgcaagatgcataagatattctacatggttcagaggatttggggaggtaccatgatttctagcttatattttggtatccttgttatgcgttcttagtgttaagataccttgatgtatcataaagtgataaataagatgtcgtaccatcttaaaagtattgtaaaattactcttattgttgcattgaatctgtgtctgtaaaataagactgaggccaactatcagtgtggttgtggaaaaatggcactacgagacattgaatgcatcagtgtatataacttcagtggggttcacatcctatagcataatggcactaccattatagacattgacgtatggtgcaataggagggtgagaccccataccagtgattgtaatggtagtgacattatagtagaggatgtaaaatcaaagtgtgtttgattcttattatgtgatgaacaaaatgacatatcagattattggttttgatatttggagattattagtgaagtggttttggagatgattggatttgcaggtgatgaataggtgctgttggatgttaggtccggtcagaccggacattggttgccggtcagaccggcgtgtatcgagcggtcggaccggctagcccgtggtctgaccggccgactttgtgttggtttcggtttcgggttgtttcgttggatatccgtggttagttcatgtttatggcttctagatggatactatacgcatgtaataccattgtttgctaataatgagtcaagttggagatagcttggtctcggaatatggtttctttgtttgatatatgtgtagttgtcttgatgcctcgggagagtattgccgatgatggatcgggagtcaacttggagataaggtggcatccggacagttagatatcatgcgggatacttaggctaaacatcaatgcacgtagttggtgaagattccattgtgtgcatatgggatacgaagttgaatttggaaggagtccaaaattagtatgattggagtttgtaaagttggtttcttgtacgggaaggtttcctaggtggattaggatttcttgtatgagtttggttcgtggttttatgctgcctagctcatccctactttctataaagttaatgccattcacatcacctcaattgtttttagcctttgcatgattcatcaagagtgtaaattacatatcttcccccaaaagacacaccatacaacacaaccatttataacctatggataattgataaaggcacaaagatatataaatacatgaaaaaaatcatatagtaggtaagaaaattttttttggaattcatatctactatattatcacacagttctcccatagcaacgcgcggggtatccatctagtgtataaatagatggagggtgtggcatcccagtatcgcttttgagagcattgagttgagagattagttagggtttcgaggttagtcgagattttcgtgaggagtgctgttgttgcactttgtaaacatagatagaagtaataaaattatcatctacaccaagagttcttcaatttgtatttgctcgggttcgacggtccaaccggtgggatactggcgatcagaccaacggcattgcggcggtcaaactagcggagtaacagtggtcagaccggcagcgacaacagacattggtgacaagtttcggtggttagaccgagagatcaataccggtcagaccggcggctacggttcggtcaaaccggttaatctacaccggttagcccgtgattcatcgattcgagggtaaattttatttccgctaaaatttttgatttttgggtactacaaccattcacccgtctctggttggcttagttcttactgtttggtcctacggagaattctcacccaacttcactgttatacctcacgcttcaatgaagcattttcagaaataaactggagataagggtgaacattcagcttttaaagcattgcttggatagacgatgtctaactgtaccaaacagaccatacttgtgctacaattggagttccgacgaagacatggcaatcggtgaacatggggcatcacatttctctttttttccccgttaaatatatagtggcacattgcggagtgaaatggtaaacttaaaaaccagagttgaatatattttcccagcccatcaaacacatacgggtcatctcaacatcttaagcacgtgaaagaccggtgcctgctatagagggagggtgaatatggctttctaaaaatctttacccaaatactcgctcaaaattcttccacaatatctcccttagacagaagctatgtgataagctagatttagcagaaggttgagaaaagatacaaagaatctagttgggatgagaacttcaacctcccaaatagctcgaaagtcatatgaggttgcctttccgttcatcgctaggaaaacaagagccgatagaattagaaggagaatagaaacacactccacataaatctagaaagggagggggcaatacccataaattgatatagtataaatttaaattatacgaagtaaatacaaaatttaaattgcacaaaataaattcaaatcaactcataacaaaagagtgttcgcatgttagggttagggtttatgcgccacccgggtgaccgggcggcggcagagctctcgcgtgtggcgagatgggtctggatggagatctcctccaatatgctcctgatgtctccgggggttttacccgccgtgggttgttctgggggggatttcctccctgtgttgaaacgtgatctggtagggtggcttgatcatactcgtataggagataagttgaaggctttccctttaggcggattgatctatgggaagggttcgttctctgctttccatattgttccagtggatctgtggcccttgcgaaattctggaagggggaggagattgaatctgttttggcatccgaagttcgagttgtattggaatcctaattctgtggctttgcagtataaatacaaggcacagtggtggccgaaggtgcggttcaaagtttttccggagatagggctaggcgttgtcaaccccgtctctttgtttgttggatctagcggaagtcccatggcggccaatgtcggtgggggtgataaagggatcgtcattgggataatttcccacccgaagccgacgagcggtaatgagacggacgcggtgattctcgacaggattcctctgaagatgatcaagggagcagcgggcacatctgatcagggccaggaacacacaacggctgcgaggaggggatctgcagagaacaaccaagttgatgcaacacagggtcctacggtgttcaccgaaggagatctggtggaggatgatgaggatgtggttgtggtgaatattgaggatgatgaactgcagactgctggcctgtggacgatcttggcgaggttctattctctgagaactccgaaccaagtggccctgtttgacgacatgcgcagagcttggagattgagagcagatataagctacaaatcactacgtgacaacatgttcatcataaccttctcggcagagggagactatgattttgtcattaaagggggtccttggattcatagaggagatgcgctcctggtagcgagttttgatggcattacgtgcccatcaaacgttcctttggatgttgttccgatctgggtgcgcatatatgacctccctctggtgttgatgacaaaggtaagaggtgagatgtttgggagcaaactcggcaaagttcgtgaggtagacgtgggggatgatggacgcaacaaacatgattttttccacattcgtgttgatctccctgtcaagcgtcctctgaaatcacagatagctataaggatgactgtccaaggcaaggaggtccttcgcaggttcgatttacattatgagcgggtaccgcacttttgctttatctgtggttttattggtcattccgacagagattgcaatagaagatctgctaatgaggagcaacctttccaattctcagctgagctacgatgctccccccttaaaccttttgagaagaagatcagtaaagtgaaagctgcccaaacatcaagtgttgcacgtaacttgttcttcagaggggcaggaagtgctagttcgttgtcctccagacacaaacaagatggtcagatgcaggaagcaataccgcccagagttgatgcccatgatgggtttgagtttaaggaaagggaaggggacactgcaatcgatgagatgttagctcaacaggctgggaagatggatgttacgggggacaaaactcagggaacatcgatggttgtccctgctgggaagctagcccagcaacaatcggagaaggaagcacccaagaagactgatggtgatgaaatttctgcttctgagatgataccagccatgaggaaccttcaacagcaagcctcgtttggggaagtgtcatccgaggagatcagcgatgccaataggaagaggatgccagaccagtcaggactccagataaaagggagggttcagcaagcattgttggaataccaacaatacacaggtggcagcaattccatgcatggggatatcggcaaggcagctagagcagtgaagagactcaagaaggctgtagagggtgaggacacagacgatatggaggcaaccagccatggggccgctggtaaactgacgggacctgtgattgggtcccgtcaggagcaatgagttgcttggcttggaactgtcgcggtatagggaacgcggtgacagttcgtgacctttgtgccttagtgaaggaggcaggttcccatattgtgtttttaagtgagactaggcaaaagattgagaaggttcgtaggctgcggaatagattgggtttgaggggttttgctggggttaacagtgatgggatgagtgggggtctggctttattctggcatgagtctattcatgtggaaattataagtatgaatgagagatatattgacgcgtatgttcgtttatctgtgaatgctcctgtctggcatgctacttttgtgtacggggaacctagagtggaaaacagacatcgtatgtgggcgttgttaaattcaattaagcaagtttcggatctcccgtggttagtggtgggtgattttaatgagactctttggcagtttgagcatttctctctaaaacaacgaagtgagctgcaaatgcaagcctttagggatgtggtccagagatgtgatctccatgatctggggttctcgggggtgccatacacttatgataataggagagaaggacgcagtaatgttaaagtgcgcctagaccgcgcccttgcagatgatgggtggaggggactgttctctacagcacaggtgtttcatctgtcctctcctagatcagaccattgccccatccttgtcaagtgggaatcctgtgaagtgtgtccattatgaaatttactgggaaagagaccctgcaatctctgaagttatagcagaatcttggggcgtctccggagttaagcaggatttgagcgacattagtcaagctctgtttaggatgatgtctgatcttcgcacatggagtaagaaaaagttcaggaatgtcagccgggagattgagaaaaatagaaagaaactatctaaacttcttctaagtaatgccaacaacagggaaataagacgggtgtccgattaaatgaatgaacttctgtaccgtgaggagatgatatggctgcaacgatctcgaattgcttggctgaaagaaggtgatagaaatacacgcttctttcacaacaaagcagtgtggagagctaagaagaataagattacaaagctacgggatagtgacgatactgttcacagtacgacaaaagagttggaacgtatggcaactgagtatttccaaaggctgttcactgccgaccccagtattgatcattcgagagtcactagcctgatgaagccgaaagtcacagatgcgatgaatgaggaactatgcaaaacctttagtgaagaggaaatagcaaatgctctgttccaaattggtccgttaaaagctcccgggccagatggattccccggtcggttctatcagaggaattgggctatactaaaggacgacattgtgcgagctgtacaagaatttttctctttgggtaccatgccttcgggggtcaatgagactgccattgttctgataccgaaaactgagcaaccacaggaactaaaggatttcagacctatcagtttgtgcaatgtggtctataaaatagtgtctaagtgtttggtgaacagactaagaccaatcctggatgatctggtgtcacagaaccagagtgcctttgtccctggtagattgataacagataatgccctgatagcattcgaatacttccaccatatacagaggaataaaaatcctgagaatgcttacagcgcatacaagttggacttgtccaaagcgtatgaccgtgtagactgggaatttttggagcaagcaatggttaaactgggtttcgctcactgttgggttaaatggattatggcatgcataaccttggtgagatatgcagttaaacttaatggaaccctgttgaacacctttgctccatcacgaggtctgcgtcagggtgatccgctttcgccctttctattcctttttgtggctgatggactgtccttcctactagaagagaaagtggatcagggagctatgaacccaattcatatatgccggcatgctcctgctgtgttgcatttactgtttgcggatgacacaccgttgttctttaaagcggcaaatgatcaggcggtagtgatgaaagaagttctcgaaacttatgcttcctgcactgggcaattgataaatccttccaaatgctccatcatgttcgggcaaagctctcctactgctgtccaaaatcagataaagcagaccctgcagataagtaactcctttgaagataaatatttgggctttccgacgcctgagggtagaatgaccaaaggaaaattccaaagcctccaggagagattatggaagagaattatgctgtggggggagaaatttctgtcaactgggggaaaggagattttgattaaagcggtcctacaggccatgcctgtttatgttatgggactcttcaagctcccggaatcggtctgcgaggaattgacaaaactggttcgtaatttctggtggggagcagagaaagggatgaggagaacgcactggaaatcctgggactgtttgattgctcagaagttgaagggaggtatggggtttagggatttcaggctgtttaatcaggcgcttctagctagacaagcctggagattgttggacagaccggacagtctctgtgctagaattttgaaggccatatactacccgaacggttctctcattgatacaagttttggaggtaatgcctctccaggctggagagcgatcgaatatggtttagaattactgaagaagggcatcatatggcgcattggcaatggtaaatcagtcagattgtggagggatccctggattccgcggagctattcaagaagacccatctcagctaaaagaaattgcagactgagatgggtttcagacctgattgatcagtccgggtcctgggatactgacaaaatctcgcagcatttcctgcccatggacgcagaggccatcctaaacattcgtttatcttcaaggctggaagatgatttcattgcttggcatccggataaactggggagattttctgtcagaagtgcttatcatctggcagtagctctggcacatgttgatgaaggctcgagttcgtccgggaatggaaatagcagagcctggaatgccctttggaaatgcaatgcgccccaaaaggtgaagatttttgcctggcgagctattactaacagccttccaacattggaaaataagaagaagaggaagcttgaagtttcagacatctgaccatttgtggggtggagtcagaatatgttgctcacgctttgtatcgttgcccacatgcccggtaattctgggaagcgatgactgttgatatgaagcttaaccctctcagtaacattcgcaatggagatccgaaagtgatcctggacctgttggagcagtcgcagccggaggatcaggtcatgcttttaatggtactgtggcgaatctggcacacacggaatgaaatagtgcatggcaaaccagctccaggaatgctagtgtccaaacgtttcattgaaagctatgtgctctcccttgctgagatcaagcaacacccccaagcaagtcctgagaaggggaaacatgttgtggatgtggttcaaaagaagttgcacagcatcaaacggagtcgagaacctgttcctgacaaatggttgaagccgctcccaggaagcatgaaactgaatgttgatggctcattccaggagagtgacggcaagggtggtataggcgctgtgttgcgcaattgcacaggagaggttatttttgctgcttgtggacatgttgattgttgtagcagtgctttggaaacggaactccttgcctgcagggatggtcttgctctcgccctacaatggaccctgctgccaatagtgattgagacagactgcttggcgatgatccatcttttccgcgatgcaacaggtgctaaatcggagctggcgtttttaatcagggagatagattctctcttggtgggaaatagggatattagcttcagtaagtgtcttagaagtcaaaatcatattagccactatttagcaaataagggccgttgtgacaagatcacacagttttggccggacaataagtgtacttttatctcgcagtttatctgtgaggaggctaatgagtaattatccctttcccctgcaaaaaaaaaaagagtggaaccaacacactcaaagatacaccttcacattatatttgaatttgaactcacacaaaaagccctagatacactctcccacaaagcacaagggacacctcaaacctgcaaaaaagggcaccaaggggggcaggggtgagtttacctcttttccgtagtttctaaatcatcgataaatcgtctataaaaaatactctgttaacctggaggaaatcctattgaacattacggttaataattggaattatcagggagaattttttttgaaattctctatgcttaaaatcattaacaggactttaggggaatattcagagcagaggaagtaataatgttaatttaaaatgtcaggatttgaattaataattctttcctccccctcccgtggtcgtgaaccgttcttggttcactgtccccgtgcgcggttcgtcgtatccaccgacccctttgccgctttgctttcgttttatatgacgagccgagtcctattcctattcgagtcccattcccttttcctttcctgaaacggcactcccactttcctttttaggttccccttctcccgtattctttccctcctccccagccgtgcgcgcgcgcctttccctctcccactcgaccgaagccgcccccacctccctctcctttgcgcgcattaccgccggtcccgccaaatccaactccacctccacctatataagtcatcataccctctcttttttttatttctatcttttgccgtcaaccctagccgcccctctcccgtgtgccaccctagcttgccgccgccctagccgccgccgccgctagttgtcgccgccgtattgccggtgagctcacctccctattatccatctcaccggtatggtttattgctgaggtttttccgctagggtttaatctagtctagactaatctgttgttatctagcgtcatcgttgtctccgggtgttgccgccggattgccgccgtcgtctcccggtgaggactccttttcacgccatgttttagttttgtgcgtcgccgtcgttgtgtagtcactgttgcgttgttgccgccggcggtgccctagcggcgccaccatgccatgctgctgctgcgcgcgctccgttgccgccactactgcaccgctgccgcgagttggccgtgctgcagcttgttgagccaagccaagccatgccctagtgccgccggtgccgcccgcgctagccgcgccaccgctgctaccatgttgtgggcgtgtcgctgctaaaccatgtcgtcgtcgctatctcgctgctgctcgtcacgtggtagccaagttgtctagccgcagccatattcctaagcctctaccagccttgccacagctgttcattagtcgttaatcattgttagcacgtagtgtagccaaagtctcgttcgttcggtcgttttgagtcgttctgagctgccggttccgttcacctgttcggttgaccatttgagtggtcccgtgtcacggtaggttgattcgttgagtcgctaacccatgaggctcgcttaccggtgttatattttgtcacaccctaaaaatcttaaatatataaattgttgattaattggaatttttagaaattattttaaaagcctacaagctaaaccctaattttctaggaaaattttcaacataaaaatgagctagataaaattttattaaatactatgcttgctcctctattttctagaattttctgggaattatttgagcaagggaagtatttttaataattgaaacaacattttacaaattgttttattcaaaaaagttcaaaagttccccttcttggtccttgggccgaattcggcccaactctctctttcctccccctcctccgcgcgcggcccacgccggcccaagccgctgccgcccgcgcccctctcgcggaggccgacaggtggggcccacctgtcgggatcgtctccctcctccggccggcgccgccgcccgagcccgaaccctagccgccctttctcctctcaattcgtcctaa

SEQ ID NO: 23324 - DNA, 2709 bp, Oryza sativa
ttttcacacgcaaatagtagtaaccttctgccaactacgcattgcatttcgtgtaggcagtcatttacaatcttacatgttttcagctttaaaaaaaaactgtcatctgataggccccttcattgattaaactatacataatagtatgccaactaatcatactactccgtagtagtagtagtatgctagtttgagtatgccaaccatttcatttcatctcgtatttggcaatttgagtatatgccaacttaaaacatacgagtattaccagtttgagtatgccaaccatcctatttcgtatttggcaattttaagtataccaactcaacatactagtattatcattttgagtataccaaacatttcatttcgtatttggcaatttgagtaggccaactcaatacactagtattgccaatttgagtatgccaaacatttcatttcatatttgacaatttgagtatgccaacctaacatattacttcatcatactttttaagctaccaggcctaatatatagctaataaaattaaagccacactttaactatatattagcgattctaatcaactgattcctaagattgatagatgagcacggtctcgatcgactctcgacagcacacgacacgcacatggtgctgaactaagtgtgtaggtattatcttcttctgcctaccatgttgctcctatatatataaggcggacatccatagtggccacacgtctccaaaagactcgggagaagagatctaacagtcaactcgtaaaatactccctacgtttcatattttaaattatttgactttttttagttaaacttgttaaagcctatgtttataaaaaatatattagtattttaacataaaataaacatattataaaaatatgtttgagagtagaaacagccggcgaagcgtgacgatggacgctcgacggcggcggctgtccccggtggtggtcgtagcggcttttcttttcttccccctgttcttcggtaaggctgcgatttccatctctctcttcttcttttctttttccctttttttacattttttgtttggttatgtcctgaaagggagccagccggcggcggcgtacggcgaggcttcaggcgccggcggcatgacggcactgcagaagcacgcggcgttcttcgacaaggacaatgacggcttcgtctccccgaccgagacatacgacggtgagcttcaaaggccttctaaatttctagtactttctcgtttcgcttgtgaactgaacacgatttggttggtcttggtctgcgcgtattttcgcctcattttatcctctcatggttgcatgcatcgcagggttacgcgccctcggacttggagctggcttctccatcttaagcgctgcgttgatcaatggcgtactttcactcaagaccagacctgtacgatcagtatctctctctctctctctctctctctctctctctctctctccggctcaaaaaactatctgaagtttttatcgttttatttactgaatttaaggtgcctcactagtcactacaatgacgtgccgttttgagagttgttatcatcgcttaactactgatgacaaatactccctctgtccctaaaaaacgaatctaaaactgaatatgacatattttagtactatgaatctggacatatgtatgtccacatatatctagatttgtagtattaggatttatcattcagtactaagttgatttttatgggacggagggggtagttgtgtagtgttaggctatcaactcagtagtggcttagtatagttcgtgtgccaattttttttagtatacggatacatatttgaagtattaaacgtagattaataacaaaacaaattacagattccgcctataaactacgaaatgaatttattaagcctaattaatccatcattagcaaatgtttattgtagcatcacattgtaaaatcatagcgtaaaagattcgtctcgtaatttacagtcggactgtgcaattgtttttttttcatccatatttgatgctctatacatgtgtgtaaatatttgatctgatgaaaaagttgaaaatttgaaggaaaaagttagaatctaaacacggccagtattgaaaatctaacccttccatgtacttcactgctactgtcctgatcagacctcaattctggacagccgcttttcttctacagtaatgttctataattattatttttttctctaagatcgttagaacgtctctccatgtactcgttttaggttataagatgttttgactttggttaaaatcaaactgctttaagttttaccaagtttatagaaaaaaatagtaatattttttaccaaagataaatttattataaaaatatatttaattattaatttaataaaactaatttagtaatgtaaattactatgtttgtatataaacttagtcaaacttatagaagtttgactttgaccaaagttaaaatatcttataacctaaaataaaaggagtatgtttttaagtgaaccatttccaatgaatgacacattacatacaaaaaaaaaaggcgtcaaattaatcgttggatcatgttgaattcacgcaggacaatgcaacatcaccacgcttagataatgggaacttataaaacccggcttctacaccaacggggatgtatacagccacagaaaatccgaccaaacaagctgggctgcagga

SEQ ID NO: 23325 - DNA, 1183 bp, Oryza sativa
tcctgcagcccattttttacaaagagtttcaaatctaactcctgattagacaacagttggacttcagccttcttttctagcttgtctgctttgctatcaaaagaaccttctccctcttgttcgccccgctaacattcttcgcccaccctctcaaaaactgtcagagcctacgaatcttaaattgccatttttccaacatattagaccctctactttcctttctccaaatgtctgctactagatccacaaagccatctcttagcaaccatccaagctcaaacttgaacaacagttgtttattagcatgtgtcccagcccccgtatccagcaacaaaggagtatggtcagagagttctctattaagagccctgacagttgctaacggatacttttgttcccattcagtactcattagcactctatccaacttctcaaaagttggattgtgcaacgagttggcccatgtaaattttcgaccagagagttctagttctctcaaatccaggctgtctatgacagcgttgaacaaaaaaggccactttacattaaagttattattattcttttcactagccttccttatgatattgaagtctcctcccataagaataggtatagactctttattacaagcattaacaagctctacaaggaaagcctccttatattcttcttgtgttgccccatacactgccagaacgcaccattggaagccatctaccttattttgcacatggaactttacatagaaatctccctcatctatacttgcaacctcaaagaattccaaattaacccccaaaagaatacccccaggtctccccttcggtcttgtccaatgccacataaaatctttaccaccacaaatattttttagactagaatatgaaaaatcatgttttccagtttccaaaagagtaatgaagtctagcttccactccttggaagtctctgaaaggaatctaaatttagccaagtcacctagatctctgctattccaaaaaattcctttcatgacatacttttcttatttttcaagatcactttcaccttttgtcccttgtttcttttgaagaatgacttggacttataaaccttgaaacccttttttaagtcacaacttaggtgatcgggttcttcgtccataacttcgtccactaagccaccacataagtgaccaagg

SEQ ID NO: 23326 - DNA, 9301 bp, Oryza sativa
cctgcaatctatagattgcagactgcttatgatggaagcctgtttgcgaagctggtgaaggcgaggagataggagcaaaaccaggcatgattgttgacagctgacgagagcttctgcattgatcctcctaattaagcatctcagattatgtgccactgtgctatgtgaacggctgactgtgtattcttttactccctctctaccaatatacgagacaaagcttttgccctcctttaaaaaaaagagaacaattgagattatgtccttttttttcttttcgagaatacgaggagacgatttgtaccggattttaaagatgagggaggccctatacttggttgtgtgattgatgcttgatgaggttattcaaccagcagatagaaatcagggatgctaaatagacttattcagcaaatatacgcttggatgggttgttatcgtattacaatccgttggaaaaggcccattaccaccgggaaaactacctcggagcccacgcaaaaattacgacagaaatccgacccacactgcgctcctagtcttccactcttcctcgcttcatccgctctgcgcctctacccctctgatacatgtctgggaggtctttacctgtataccattaagggctcgttcggattataggataggaaaaacttaggataggaaatttataggaataggaaaggaatttaagtgtaaaatagaggaatgaaaaacaaaggaatacaaaagttgagagcattcagatcacaggaaattgattgcctaggatttgcatgcagaaagcgaaaaaaaagagctcgaggtggatggattttcctgtacttttcctgtgaaattagcatcaaaggaaactttcctttggatttcctacaaccagttttcatgatccgaatgacaggaaaggaacaaaatcctatatacagtattcctccaaaaatcctgtgaagttcctctaatccgaataagccctaagaaagatggtgcctgcctctgtgccactaaaaagtttgaaccttcctctatgccatcgtcgaactttatcacgccctccacaccattccgtcgctattctgtgtgagtttaaccgtttggcagctctgacatgtgggcccgggcaggaaatgtcgctcttgcccttttagtgtctgcttcgtttcaaagagaggccaggcggcgtggcggacaagcagccaagcgcggcattgaggcaagcgaccggtgtggcgggcggcaaccagccgagggacggggtggtgtggcggccaaccgacacgagcagcgaggcagcggatgaggaggtgaagaggcccgtcccggaggagaagtcgaagcccgtcatcgtaagtagggtgctggtgcagacctcgatctacacaaaggaagaggtgaatgccatcctgatccagtgcggccggctcagccggagctcgtcatcgtcggggatgcgcctcgtcgtcgaccgtcgatcccatcgtcgtggcgcaggttggggctgacgctggtaggagggtcgtcgtcggggatgcgccggctcctcgccaccatgggggccgccgaggaggccgcggcgtccgcggccgccgccgccgccgtcctggcgctctttgtcggtggcgcccccgtcggcgggatcgatggtctcatgggcctccacctcagtggccgtctcgtcccgcgcttcaaggaggtaggctagcgcgcgcgctctctctctctcaaccctaagggcaacaaagtcatttggttgcgctgttacccgccgttgggacaaaaacggacggaatggtgtggatggcgcgataaagttcgatgatgacataggagaggctcgaactttttagtagcacggagacaatactatcttttttaatggtatataggtaataaaaacctcccagtctggcagtctcctccgccttgggctcgtgtctccgtgcagcgcgccgcctctccccaccgccgccgcctacacacctccccacaccaatacaccatcatcccgtcgccgccaccatgctccgctagttcgctctggcctaaggctgctcggctcctctcgacatccccgtcgcggcagcctcaactgccctcgccactgtcgaggcggcttcagtccatgccaccgccgtatagacggccttgatctgcaatgttcaaacgaggtctcccgcccccgcctcatctgtgataatggcatcggtgtgatgaccacagaggatggtcgctggtcggcatcggcggcatggctggacagcatcggcggcaagactggaagctgcccacgcccaggatacatggtggcatgctgatctatggctctaagaatgaaattggcagtagctttgatttttggtctgcaattcgatgagatgttcttgattttcgattaccaatgttcttgatttccagatgcttgatattatccacccaaacggtatatacgaggggttcttttactttaccggtaattatgagtaacacaaagttaaacttatatttggattacaagggtataaaggtccctatcctgctagagtgtttgtctgtttgataagcaaggaaaaacagggctgaaatgaatgatccatatttaccaaggaaatcctcggaagtcatatgcatttgcgtggggacagaaacttagaaaccgttcaccaaacggtggaaaagcagcggccgtaagaacaacgtggttatggccttttctggcttcctcacacgaacaacctggctcatttgtatttaagccgttgttgttttctcgctgtcacggagcccaatcagtaattgttactctcctcaaacagccagtcaaaatagtaaacctttttccaaccatttaatttcgcgtagccagtcatgcacactatacaaattttacaggtttcctattcagcgagaaaaacccagtcatctgatagacaggttcatcaattgaaacataacaatctgacgagaaatctgtgacagatacagaatgacagcgattctcgccaattgattccattcctaagattaatggatagatgaatggctagattggtgggaggctaccgtaaacatacaagagacacctaagaaggcactccgcactttgatgttgttggtcgcctgggagatatggaacgaaaggaatcgcagaaccttccaacagaatgagctttcagctacctcccttttagccaagaacaagaaagaggccaaaacttgggccttaacaggagcgagaagttttaatagctggctttcttttagttagctcggaccaaaggtcctagctcctttctttttttcttttactttataaagttccccttctctattcaataaaattggcgctcgtccattcgttcaagaaaaaaaattgagcactgtctcgagagtacacggcacgcagcaatgttgtttaagagtgtgggcattatcctcttccaaatcgtggttaaggcctggtgtcaaaaaaaaatcgaggttaaggcagtgtttagttccttcaaactacaaaaaattccgtcaaatcaaatgtttggacatatacatgaagcattaaatgtgaacgaataaaaaactaattgcacagtttgcatgtaaattacgagacgaatcttttaaagcctaattacgtcatgatttgacaatgtaatgctacggtaaatatttactaataatagattaattaggcttaataaattcgtctcgtggtttatagacgaaatctataatttattttgttattagtctacgtttaatacttcaaatatacgtcgatatatatattttggtacacgaagtaaacccggcctaagctggcgagttagggacctgacatatctatcatgttgctcgctatatatagcgcggatatctggacacagaggccacacgccgtcgagactcgagagattcaggaacagaaaccgccgagagagttcgtagcagtcaacgcgcgaggcagggccgagaagaaaccgccggcgacgcacgcgcgatggacgctcggcggaggcggttgtccccggcggtggccgtggcggcggctcttcttttcttccccatgttcttcggtgaggctgcgatttccgtctctttttttttgtttcgttttttcagttttgttttgttgcggcgctgtttgattttgctcgctcgcttctgaatcctgaaagggagccatacgccggcggcggcggcggcgtacggagaggcttcaggcgacgccggcgtgacggcgctgcagaagcacgcggcgttcttcgacaaggacggcgacggcatcgtctccctctccgagacatacgacggtgagctccccatctcgtttcacttgtgattttatttgtgaactgaacacgatttggtctgttcatgccgtgtcgtccttccgaattttcgcctcattttttatcctcatctcggatgcaccgcagggttacgagcactcggactcgggtctggcctctccagcttgagcgccgccttcatcaatggcgtcctttccccaaagaccagacctgtacgcttccctctctctctctttctctcactctggctaaaatgttactatctgaaagtctttatgtttttattactgaatttaaggtgctttattagcctgtaattacttgcagagaattcttgcttgtttacatcactacaatgatatgctgttttgaaagttgtcatcagcgcttaactatctgatcacataattctgtattaggctatcaacttcagaagtattgaaaatctaacccttccttgtacttcaccactactgtcgtaatcaggcctcaattctggataagttcggtatagacagtagggtgtgaattgtgatgtaggcgtgacatattgattaggattagctgctactatccttctttttactgtgatctatagctattttttctctaagattgttagaacgtctttgtacgtatatcgatataagtgatccatttcctatggcatacgaaaagagatgttcaattaatcgttggatcatgttgaattcacgcaggacaatggaacagcaccacgcttatctatctacatagagaacatctacaaggggattcatggaagcgattcaagcgcctatgattctgaaggaaggtaattaagctgcggttgcagactactttctgctttcaccttggctcttcaatttgacccttctcatccaaagatcattcgattcatttcacagactattttcactccggtgtatctatttcagtatgattgctaatatttcaagttttcaggttcgttgctgaaaagtttgaggagatattcgccaagcacgccaagaccgtgcctgatgctctgacatcggacgagatagacgagctgcttcaagcgaaccgcaagcccggtgactacactggatggtagtaattaattttctggctattaccactcaaaatattaatgaactttcatgtgatcttactactgtatatgctgctgttcttgctcgaattgaaatgcagggtcgcagcatcgtcagagtggaagattctgtacaagatcggcaaggacaaggacggccttcttcgcaaggaggccgtgcgagaagtctacgatggaagcctgtttaccaagctggcggcggcaaggataaacgacgaaaaccaagcatgattggtgacagctgatgggatcatctccattgattctcctgattaagcatctcaaatcatgtgccactgtgatatgagaacgattgagatgatgtctgaacacaaaaagatagtcatgcaagatagaagtatgaacaagtgtggacagaatctgcagatggggatggatcgtttagttctgtccttttttgttggtttcttggggatattgaatgtttatattattatacctgcaaatggttggcagtgcaaggctgcaagcaatggcacactatttatacatttggcgtcccttagcccgtagttgcccgtgatgccgtgatgcttgtcttatctgaactctgaaagtctgaatcagttagcagcattatcttcgtgtgtgcttggcaggtcgaagagcttccgttcctttctctacttgcagatcgtgatcgcctggtactgttaacaaatcgcagtgtttctatgctggcaagtcacgcacaaggggaacacattagttgtcaatcatctcatcaggtggagcttctatgcaaaatagttgtttattcagcgaattaggtgggttttctactgttaaatggcgcttagagatgatgaggcaaattaaacaaagtacatttaacccaaaaaaaaaacagtatgcaaaatcctacttgttctgttgtgcaggtgaagccgaagaaagtggtccaggttgaactgtgcaggccagctaatacagtacatatggtccatggactcggataatgtccatatggtccacgaaacgaatggaatttccatggactcggaccagtcaggcccacaattgttgcgctcagcccaaccgcgacatcgcgagacgcaaaaccgccggacgcgtgggcctgcacacggaatctcgcctgatatcaggcccatctcacgcgatccggcctacctggctcgcctcaaccgacgtaaattcccgcacgcgcacatgctgctctaaaaactcttccgctccagaggcttcacagctttctcctcccgtagagccaagccaaccaagcgggagcagcatggctacggccacgtcgacggcgacgagcgtggcggcggcgctcctcctctcgctcctcctggcgcgcgcgcggggcgacgacgactactcggggttcgtgtacgccgggtgctcgcaggggcgctacgcctccggcacgcagtacgcgtcggacgtcgactccgtgctcacctccgtcgccaacagcgcgccctactccccctacgccaacttcacctcgccgacgtcgaactcggtggtcggcgtctaccagtgccgctccgacctcccggcctccgtttgcaccggctgcgtccgctccgccatctccaggctctcctcgctctgcgcctgggccaccggcggcgccgtgcagctgcgggcctgcttcgtgcgctacggcaacgacacgttcctcgggaagcaggacacggccgtgctgttcaagaagtgcggcggctcgccgggggacgccggcggcgccgccatgcgggactcggcgctcggcgcgctcgtggccgccgcggcgcccgccgggggaggctaccgcgccggcgggtccgggggcgtgcaggccatgtcgcagtgcgtgggggacctcggcgccaaggcctgctccgactgcgtctcggccgccgccggccagctcaaggccggctgcggctacgccacggccggcgaggtgtacctcggcaagtgctacgcgcgcttctgggggaacgggggcggtggattcagcagcggcgccgccggggacgcgtacggatctgggcatcgcgtgtccggcaaccggttcgttctctccgtcgccggcggtttcttcacttccttggcctatatatttgtactcatgtagttactgaattacagttgcagtatgatcaatgatcgtgaactagactactagagtgcctgtgtctgtgtgctttatgcgtggtatgtaaccactaatcagcatatctgcatatgtgatgcgatgcaggtttactccttgtgcttgaacaaattaaacttgatgctttctaacttaaatggacttcttatcaagtttgtaactgtaaatttgatattctaaaattgcagtatgtgtagctcctcgttctaaaatgatcaatcatgttgatctgcatttgcagtagagttcctttaattcggtggtgctgttaaagttccacctcgtgcacaaacagaaactcacaaattgacatgcagcatctccctctctgtctgagcgtgtccacaaatgacaaaaccataactctaccgcgctaagtctagtcttgttgaaatttcactggccagctcagatatcataccttcagttgtttaatcgactaatcaccagtatctaacaattcgaacgtgctgtacaccaattagaacactgcagcataccctcctccacatagaccctgaatacctggtctgatcgtctggtgtctgaactgataatgcagtgctcaaaggcatgctactggcaagaagaccaaaagtgctttaattctcctcgcctttatctttgctctgagcttttcttgataggaaacttttgacatggacttgctttatcgttgtgatcactatgaagttttagtagaatatctcaaaggggattcaaatgattcagcttttcgcttgattagcattgaaatggagggatatcgctggtatccctcacattgcgagcagcgtagtgtggtttgctttttgtaagctttaggaggttaagctgccagccctttcactagttactaggcctgttagctactactttggattaagttaatcagtactactactatcccgctgaatgccgtatctgtttaagtttcaccgtacattattgtcacctctccagtataagcttgttgcaaggtcgccagcttgcatgctatgattggatcataccggtggctttttgctggaacgccgcctttccttttgctgtccttgttcttattaccatacatgccttctcttttggtatgcaatgggtcaaaggaatgaacaccaagcactagggctggatggaacaagctagagaaaggactccactccactgtgcttcatgtggagagaagatccagctagatcacatagctttctagccggcgatgccacccctgcatcggtagtggagaaaatttgtttgcaagcaatacactttaactttgttaggatagttcttctccttactttcgccgggagatagttctccatacttgttcaaggaagctagttcactagctgtttcaggctttcagcttggacatgccatttggaccagagataagggggagatagagaggtggggacgctgatatgtgagccctatatgctaactgttgagttaatcggttcgaccagatcaatgagtcatgtcaacaaatattgctgtaaatagtgttctgaaaatcaaattacattaacggttaggagatcaaatattcagtattagagttgagagatacaaatcagattgaacttatatttgagagattcaaatgaacttgctcctttcactctttcagtgcagtgctgcagttcagacagtggtaacgggcccacggcctgacccaacttggccattgacagttttagcccgtactggcctggcccaactgcactt

SEQ ID NO: 23327 - DNA, 1404 bp, Oryza sativa
tcctgcagcccgacaaaattgaaaataacagtaatggtttacagccaaatatctctcttttcaagaaaatgtatccacctcctgaattatgagttgtggtgttactatgtagaattttctacacttaatcagtccatattgcctacccagaatctaccggagaatttcttttccatgaattctagatctaccaggcaatattttatatcaaaagcatagtgatactttcatattccatgaataaggacaagtaccaagtaccttttgtcatttgtctccaccactcatctatctgtttgcctttctgaagctgatcactgttcaaatgctctctaattgaagtgttgaaagaccaaatccgcaaagtttggctgctacttatgaaatcaagaagaatactttgaggactgatattatttggatcaaggctcttgtcttctttgtggaacgaaattatcttccttgtagtttcaacctggtaacagaagaaataccagaatggtatatagagttatagacggtaaattaagacaaccacaagacatcatgaaaggaaacattagaagtattaccaaaagtttgtatgtatttaaagttttatagcaattggatgtgagattagtttagctgagtttgtcgatcgctgttattacttgttagtccttgcagttcccaaaagatgagcacgaaacaaaataaagcactctgaatattttcatgaggaaatctttttttggtaccaaaatcatgtcatcaactaatcaattgaatatgattcaccaaaagaaagaggtgtttgcagatgatcttagaaagagacatcaccttcttgggtccgaactaagggtgttcatcacaatctcaatgcggataatctgtgcgagtaaccaagtgacatgattactgcgaagaatctgttgatcactatttgttactcgagatgcaagcttgtccacgaaatcaagaaaatcaatacagccacttttcatcagaaagaaaaaaatgtcagcaaataaaagccaatcttgccagcactgagtctctgcaacagcataaaaaagaaagaatgaatataggcaacagacagttaccaaagacttgcacatatctgacaataatggtaagcaaatttaatttcttgaggtaaaagtttcacgttctaaaagaaaaaatagtgaaaagggtgcatcaatagaacatttgaaatttatattcccatcagctgtccacttgaaaaaggaactttattatattgacaaggtaaatggttaactttcaaattctaacctgagttcgtgagcctcagtagttcaattgtcctgtcagcaactgcctcaccgatcatatcaggtgagaaaacagctcctggcgttgatgattgttgaggatgttgtctataacaag

SEQ ID NO: 23328 - DNA, 8952 bp, Oryza sativa
tcacctctagctgtcagaccaagctgtccagggctagagaattctgctcccttaatgggtgagacatttgcacctatgggttggtcgataccagattgagtgggagatcctatagtgttcattgctgacaatggagatgtgggatttgaagggtgaaagcttggggcatttggcactgcaatagctgatgaagaagatgttgccgggccaccagtagtcacagaaaccccttgccccattggtacctccacggaggaaactacattaagtagagaaggaaggagactgtcccatcgaaggtggcctcgagcacacaggcaacgtgtggcaaagagcaagaactcagattgtggggcgtggctactacactgcaggacaaatgagatgagaactgattccgtaactgcctgcagctgctcttggtcctgaagaaacatgcaaatcaaataataaatttgttctgttctcatgacataaacaaaagtacttgcgtaatgattctgcttactgggaactgcatgtgcaactgctcaaaatccgaaatgaattgctcatctcggggaggcagatctctgttcatagcagttactctcttctgcaacttgttcctgaggaaattcaatgcccattatgcattacagttttagaaaagcttgctgaattgacttccatcgtcaaactaccatatcaaattttgtccaaaaactaccatatatcaaaatgaacaaggcacgaaaaaccgctagagtacagcacactagttccaaaattgcggcaataatctccggatattccagaattcctttcaaaaaaaaaatctccggacattgcagaagccatcgccttcaaaggtaaagttgaacaaagcgcgaacgacaaggacaaaataatccgacctaacctatcataatgtttcatgtgctcgagccctcgagcaatccagctagccctaaaaagtaatccccaattagaagtccaacaagtgggaaatcaaacttacgaggtctccctagttggatcctcgacccgctgcttcgagttcatctgcaaatcacagaaacccagggtctgagctagcgttcacaagtgcaccacggttagagattggggaggagagacaaggcacgcacgccgaggtatagggtgaagagatcggcgatggacgaccgcgccgggtggtggtggtggtggtggagctgcatctgccgctgctgcgggagcaccgccgaagcagagatcgccggagacatcggctgcctctgcccgtgcgccccgtccatcgccgatgcgccgcttccgtcgccggcgactggagtggtgcggtgggcttgctccgaccgagggtttaggagtgtggcggacctgacctgatgagctcttgcagtttgggggaaagggaacagatcaacggacggtgggatgtgtagtctcagctgcatggagacggatccagaccgctggtatgcattctacctttctcttgggtcgaaaaattgaaattgaaacagaacaaaaacatgttctctggtatatttgtggttcaaattagtggccatataatcgaaagctaccaaataccatccggttatatactcctttcatttcttttttctttaacgtaggtggaataggtagtatcatgcttggtctcattattttacgtacagctaattataagtcgtgatgattttatattaaaactttaatatatttgtccttactagaaaaaatacacgtacattgcaacaagtaaatgttattttaattttattattgttacacaatttagctaaggtaaaattcaatgtgggaattcactttgatatttattgtttaaaaaaaatcatgagctgcaattaggagtctgtatttcatctcaagttagcatgcgagttttttcaaaagattttttatacgattccttctatacttccaaaaggaaacaaggttaaaatccaactcaaatacggatatgtatttccaaaaacgaacgaacttaaaaaccgactcaaatacggatgacgtaccaaaataccggcaaaaacatctttaatttttataataatagagatagagaagagattgaataaaaaccaatgctgaaaataaatcacgataaaaaaaactactatgaaattaaatttaaaattttaatttttggctttgagtgataaaacgaaaagcatcgatgctaggactcttacaaatattggagtatattgaactcaaggatgatcctacatatcacacatctgatatgtcccattgggatggtcccaaaaacataatttgaacgaattttgtgaattcgaccagctactagtacccagcaccggcgcttccaagaacaatccgcgcgaacgagcacgtacggcgctacaaaagtacacatcacaattgacacactacagtacgtcgtgatcggtgaactaaggcgcccgagacggcgacggcgccggcgacgcggcgagaggggtggtggcggcgcccccgctcccggcgctcggcatggcgtcccagaggaggtcggcgatgacccggttggcggcgtcggaggtgtggtacgcgtcccagaagacgaacgccttgcggtcgctgcagggccgcgagttcggcaggcacaggccccccaccgtcgtgtccacgttgcagcacgacgtgtgcgccgtcgtgaaccctgcacacacacacacgcacacacgcatcgccaacggtgagacacgcccgccgacacgcgccggaagtttgcgttgattgattgattgattgattaattaccgtgtttttcggggtggacgatgagctccatgacgacggagtagcagtcggcgagcgccatccgcgcgccgggcagcttggcgttcatgccgtcgagcagcttcttggcggccgcgttgaactccacggcgtagccgttcacgtggtccaggcacttgccgttgccggagtggacgcgctgcgacgggatgcagcccagcggcggcagcgagttgaacaccaccttcctcgcgccgagcccgtacagcctctgcaaaaacgaacaattcaaccaccgccatggacgatatatcaggccacctctttaaaattggctaatgggggggtcactgtcacggcgagattggtgggtgttctgcctttagttgccggtccagagtggtgatgaggaggcggatgaacgtgtcgtgcgtgtacgtctggccgtccgccatgaacggctgcaagaagttgttgatgtagtcgttgctcccttcagaaacagcagtgtatttcacgtcatttaacggctaaaaatccagctaactatctgatcaaatgcggtcaaaactcaaaaggccgatcgattcacgagaggaaaatattgtaccaagtccaatttggaacagcgccgcattgacggcaacctcggcggcctccttgccgatcttggcgatcatcgccttcttgaccatctcgaagcacgatatctgctggtcgaatgagaagtactgaacctgcaaatcggcacgccacgttcaacaaacagtgccaacaaaagtaacaaatcgtaaagcataacgatgatgcgatatatgcgacttacaaagtagacgcccgtctcgttcagaatgccggcgccgccggacgcgaagttgacgccgccgaggacgtcgtcgtagaccattgacagcgacaggaacggcggcggggacgggacgccgaacttgtcagctgcatcaaccgaaatactgaatcaggtcgaatgcgcgtgtggatcatcagctagttatctagcaagttgaattggttttgcatttacccatgtagtctccgatggttcttccattggtgaacctcccggtggcgacgccgttggggtagtcgatgccgtaccaggggtagttggacttggcgagggagagcgggaagtagttgttgttccccacgtccgacatcgagtcgccgaacacgtatgtcaccgggcctttggccggtggcggcgccgcggcggcggcggctgattgggcgagcacggcaatggccacgacggcggcgagagcttgagctgccattgttgcttcggcttatcagtatctgcgcctctgtgaatgtgttgtgcacttgtgctgatgctgtgcttgtgttgcatgacgaggtggcacgcacggatttttatagcgcgcggatgtacgcggtggcgtggttaagtcgtgccattctctacaagtttgggttaatctaagcgcaccgtttcaagtttcccagcttgtcagcttgagtgcagtgatgaaccgtgcaacatatatctattcgtgtggccatctgaagaacgaattcagagaggaattggcatgtgtggtagctgaggtggttgaagaacttggctctctttgctctatagagcagctttgacggtttaaatcggtagtgggaagggtatcagcgacctttgcaatcaaatagaccatatgactgaacaagaggtttccctttttctctgaataaatttccccaaactatagaatttttaagagttctcattttttaattaaactattacagaacactatatattcaaaatgaaacttaccgatttaatatcaaacttaatactacaaactatataattaagctggagtgtcgcaaaattacaaatttagtaatcaaatcaacacataactatatgtctaggtgtcagtttaataacaaattttagatgtttataactctaacataacattagtgatggtgaattaaattctaaaacatatagtttgtgataacattattattaaatctatagttttgcaaaccttaaacatttatggtaaatttggtattaaagctgtacttaataatttgatcgaagtaatagatttcaaatttaggcactgttcttttctccaacaaaagttgaattaaattttggatactcgtggcacgcttttcaaactgctaaacggtgtgtttcgtgcgaaaactttctatatgaaaattattctaaattataagattaatctattttttaagtttgtaataattaaaactcaattaatctcacgttattatcatctcgttttgtgtgaaacacttcatcttcatcttcaggagattgcgtgaaactcctttactagtagaagctagcatctcatacccagcgtgagcctgacctgggctggggcaatgcctggttttctttgggctaataatccagtacgcagcagcccattacggcccctataactcccatacacggccagacagatcggccttggactattttgggccattatttcccagttctaacagatgagatggaccgaaaatttccgacacacgaaggccgataaaaaatctggaaagcaagagagccccccgtcgcgtgcgaggatagggagagaggtgaaagagacacggaggagagggaaaccaaggcggcgaggcctccgcctcactccggtggcgacacggcgggctcgccgccatgacaggagctctggcgatgatgccatccacgtcctccccctaccctctcctcgctccgccgacctgctcctcccgcctcccgcctctccgctgcttcgtcggcctccggtggtccgctccccgcatccaggtaggcccgtttccccgttccccttcttccgagaggagcaactgctgtctgaccacagtagttatacagctgggtaatcgtgaggctagcctaggtggcgttaccgttcggctctgttgtttgattctagtggctgcttggtacaggtcagggagtatccggatgcggttgcagggattgccaagggtgcgggtggacgcggtggtcgattcaggttggttcacctatctgctccatgaactatggcaacgtttgaaaacgttcagttgttagattgctgctactcggacgaattcatagtaactgtgtcgtggtagtgggcaatggaagatggttggacaatatgtattggttcccattgctctccacaaactaacaccagcgagatatgtacctgttgttttagaagtgtcacttgatgtggtaaaagaagcgtgaaagttaagacatctgtcaggtgacagaatgggctgtttgcgctttgtcacagcgatatcctgaacatctggaaatataaactgccatgcttgtcaaagaatgcaaatatgcttggtttgctagcccatgtcagaaatcaatcactttgtccaactccctttttgtcaacaatctctgttgttaattcatctggtcacaagcagaccacaatttttttttctacttaggactatctctagtgaattttgttgagttgacattccattttgtaaaaatgtaactttttaagtaatagctgtgatcttgatgcggggtgatatttcattctagggtttagtagagttggtttagtggaaattgaatgtgttatagatactacctctaggatcttatgtcctgattatttccatttaatgtcttttttccttatatttttcagagcacctgcttcaagtatctcccaaccttgctctagaaccatcatcatcacaaatgaacatgttcaaaatgctgattttccacctaattactcgaaaagagagaagaaaccatttccaataccagtattggagttaagacgccgagcaaaagagagggcaaagaaagctgaagggaaacccaaacgatctttaccacctccaaaaaatgggatgctgatcaaaagactgataccagttgcatacaaggtgtataatgcaagaattttgctgatcaacaacttgaagaggcttatgaaagtaattccagtgaaaggatgcaagtaattctcctgttccatcccatcctgatcattatatacacagatcttgtttgtgttaattccacatgcattggacaacagaattgtacttccatcttgacataaaccacacaacacattgggatgcatacaacgcatagaacaataaggaagtagaaattattctataaaacaagatgtaagaaacttcattatatatcaatttgctgacttgtatttgtatatggcataaattatgaagatattcagctgcttaatcgatgtattgtgccaattctctaatgaggctttctattagacatagatcattcaagcatcaagtccaaaatgaactgcatggcatctgtggtgactcctctattattcatagttgtattttatctgattattgattgaagctatgaaacagtatctgttccaagaactcattaattgttcgcattgagtacatgcatttctataagtttagatattattagttccagataagcttccattttgctttataaaagtctgcattttggaatatctgcaattattttgactatagtttctgtttagcgtaatttaaatctcacgaccgccttggataaactttctgactattttggcttatgatgaggccatcatgctcatgatcctagtactgtttctacttggtagtaccatgttccatgatccatcattttgagtttgtaattttgacaattgtgtaccttttaattgttttatgttaatatgcacttttcagttcaccgacaagcacctctttcaatgaagattgtgcacttctattttgtgggaggaaataatgtgtgtttatcttgcagacattgcagtgagatacatgttggatctgttggacaccctttccgaacatgcaaaggaatgtcttcagataaacgtagggggcaacatgactggggaggtactttggttgaagctgtttttgtgccggttgaagcctaccatctagaggatcgcttagggaagcgtatccctcatgatcagaggtttgctgtacctcgcatccctgctcttgtggagttatgcattcaagctggagttaatcttcctgaataccccacaaagcggcgaagaaagcccattattaaaatcggaaagaacgagtttgttgatgcaaatgaggatgacctaccagacccagagccttacaaacttgagcatccaattcttgaagaactaaatgataacgagattattgccccagcaagcccagaggagattgttgctctagctgaggaaacactcgaagcatgggaggtagtcaaggatggtgccttgaagcttatgaaggctacgcggagcgggtttgtggatactgcccagaggttcatataggagcaagtggccacaaagcactgaattgtggtgccttcaaacaccagcagaggaatgggcagcatggatggcaagcagcagtgctcgatgacttaatacctcctagatatgtgtggcacctgccagaatccggggaggacttgcagagggatctaaagagtttctatgggcaggcacctgcgattgtggagatatgtgttcaggctggtgcaaaggtgccggagaagtacaaagccacaatgagactagatataggaattccaacaagtttgagagaggccgaaatggtcgtctgaacaaagacgtttctattgtcacctcaagctccagtttgtctgaccagaggttcacagttttactcatgtatataccaggaaggcaggaaattagctcaaacagaatttgtctaggtctgtattgtttgtaccatatgctcgctatcatttaccaaattcttctttgtatgaggcatggatgtttcttacagcagttcgagatgcatttgctaatgctgatatggtttatatggtgagctgtgttttgtgtgaaaagtgaacaccaataaaatatcctggtattaacacagtcagcaattcttgccttgaacaacagaaaatgagtcacaaactttcatctgattcactgcattctgagggattgcatgacaatatacacccatttgtgctccctggccagcttctgttcctatctgaccatccacaaggggcgacagaaatgacagaaatctaaggtacaccgcattcagccataaactaacagaatcagggctgcagga

SEQ ID NO: 23329 - DNA, 7662 bp, Oryza sativa
gcatttgggatgttttcacagcataaattcatgaactaactgtctgatcttcacaatgcggttggggctccacggccgtcctgaacaacagtatatagaccttatcaacggaaaagtacaagaatccaccccgggcatgggtgacatatgaaccgaaactcgtccctacgatgcagtgccaagctggtccataagcagtgtcaaactcctgcagcgaaggataagctcccatcatttatatagtattgcatatggaagtagatgaacatggacaaaatgacgagttatagaatttgtggacaaataataggaagtgcggttgcttgataagcatggaccaaaaaaattgtggaatggtcccagatttggttgctgattggttggagattgtgcaggattcaggcacgcggagaagattttagggttagttaggtccaactagaattgcaggatgaaaaataaaatgttttgcctactggtcagcatggtcaaactaagccaataagctaaatagctaataacacgtcctatgtaaaacattcggttctgttagatcccttatccaaggtacagatagaatttggacgttattctcacattgggcaagaactgaatatttatgagtggcagacaaaactttaccaagatatgcaaattaaagttctataggctgtgtttagatccaggggtgaaaagttttggcgtgacacatcgaatatacggacacacatttaaagtattaaacgtagattaataacaaaacaaattacagatttcacatgtaaactgcgagacgaatttattaagcctaattaatccgtcattagacaatatttattgtagcaccacattgtcaaatcatggagcaattaggcttaaaagattcgtattgcaatttacacgcaacctgtgtaattatttttttatctatatttaatactccatgcatgtgtccaaacattcgatatgacagggtgaaaagtttttgcgtgggaactaaacagggtcataatcgagtgatgcattcccatgctcaaacttgcaattccttttgcacaagacaaagagtcaatgacagatcgacaaccagatgatatgaccacctgattgcgcaacgtattaatgctagcaatggtagttaggagtacatgctagattgcatgaggaaatcttagcacacccacaacgaagagccaaagtttcattcagcttgaccctactgcttaggtgttcagaaactgatacttgagctgcctatgattctctgacccttccagttttgccatgacaaacaacaggccaatttgggtttcaggtgcatgaagatagctacagcctacaggggctaccaaaatcatcatttacgcaacaaccaaatggggtgatcaatcagcatggacatgaatgcacttgacaaacatcttaaatccttatcacggtaagccagtaataaggccccgacaaaggatacgtgctactggtacatcagttatgactgcgttgccgtgagaagcatgtgcaagcattgtgcgaatgcatttactccaagaaccaacactgctcgacgcgatcagttaagcacctactatcggaagcttaattagtcatggcaaggaagattctgtcctcactgaagaacagtctcaggtaatctaatgaacaagtggagaaaaacagcagcggacaaatgattaatcagttaattccattggctaatgcatctttgggagcaaactgactactcgagggccctgttcttccagatacgcaagctaactctacaaccaatttgcaggtacagtaatggagttctggtacttacgcaaggtaagtacaccggctaagaaatgtactatactaaccttcttgagggcgagggcgaggcgcttgggctcgagccgccgcggggagcgcggcatcccggcgagctcgtcgcgggcgcagcggaacgcgcgccgctgcagcgcgggcggcatgtcggccgccaccaccctcaccaccgccttcctctcctcgccgccgccgtcccccgcccccgccttcctcggcaatcccccctcggcggcggcggcgccctccgcgatcgcgccgaggccgagcagcgccctgacaaccccaccccggcgccccgccgcctgcaggccaccctcctcctgctccctcatgctcggtcgccgctcgccgttcccgccggccgcgccgggagctttgactcaccggaagcagagactctctctcactctcctctctgtgttactgtgtatgtgtcagtatgtgtgtgtattattattattatttttttggcgcttgggcagcggttggggcggctttatcgttcgttggggttcgttaaagttggcgtcgtggcgtctccgcttttctttgttttttgttttccctctctgcccggggagcgcgccggcgggatcaccgaccgcgcgcgagagagagagcgcggcgaattccgggtcgcctcgcgttcgcgtacgtattcagcccgccgatgcacgcggccggtcggctacacggcctccgcgagatcgcgaccgagcggaccgttgctcgcgcgggacgggggacgagcactagcagcgcagcctgcgctgctgctccgtgccagtgtaccgctgctccgggtctatttactgcgagaccgttgggacggacggacacggagagcctgagaggcgttgcgtcaccgtgggggtagcagtaaactcggatggagttattgctgtgcgcctgtgctgttcatgtggatcccacggtgcatcgccctcgcgcgatgtggcgatcaggtggacggcgtgggtgacgtatacggttccgttagttgttgggctttgggatcatggcccggatatggcggatgggccacttggtggtagcgtccctcggtttatccgatttggagaaggaataagttcactttagatctcttaatttatcgtcgagtgtaaaattcgttcctaaaccgcaataccagatatggcttgtccgtcaactcttaaaactagtgcaaataaggttagcagtttggatggcagttttggcaaacccaacatcatcacccccaaccccctatttcccttcttctcttccttcctcctctctctccctttccttgtcatcattggtgcacccgcagctacggcatcggcaggaccgcatgagcatggtgtcagcgtcggcgcaggaggagggcatcaacggcgtgggagcatctccttcgaccacgtgcctcattccccttccttcccccgcggttgtgtcggcataggaggagggtgtcggtggtgcgggatggcgggaacagctcccccctccccatgctcattgggttggccaagttctttccacgttcgtagctgcctgacgagtttatcccccgcacccggggtcggctaggtccttcctgcccacgccatggctagtgagctcctccccgtctgcatgtacatccaactgccctcctccgagcgcgcggatgacggatccgaccgagaagcgatggcgtggcacggatgtggttggcggacgatgagtcgggagaggatgaggaaaaggtcgccgttgtcgagctagtccctccatggctagctcgttactccatggcgagatcgtcctcgcatgccgtgccctgcccgtgggagaggagcggtcgtggcgcctttgtcgcggcgaagcatacgccatcgctctgccgcagtagctcagccatcaacatgtgtggggaggaccgacaaactgctccctgttgatgtagacgaacgacactacgggacagacgtagcagcatatgtgacttcggatcgctacagctcgcgctgctcgtgcagcaagagatcaagcagagaatagccggagcgtcaccatcgaccagagtctgcagaatagggggagaaatagagtcaccaccgccgctcgaggatcagacccgggctcgccaccaccattgagaagcaggaattcatcgctaccgtgcccctggctaaccaccgccaaactctatctctatctctccctaactaatccatgtgtgtgtcgatcgccatttccagtccggcgctctctcatgtgccgcttgcccagctcctctcccgccacatgttgctcgcatttggggagagatattgagggaagaaggcgcgccaacccagaggagatagcgaggggacgaggtgaggtggatgaagtggggcttattaacatgtgggtactactattttttatctttctatttgatttctccatatttttttaatcttgcttcgaatgccacgtcaacatcacgtgagacgaggactaagtcaaaccagccacctaggtgccacatcagataaaaacgccatccaaaccgctttgggacctcgtctgcactggtttgaaaatttgagggacgcattatatctattatgattcaaaaatatgatacaaactctacgtcatgatgagagatctaaagtgaacttattcgtttggagaactaatggatcattgggctggtttcattcattcgtgaccatacaggcctttcagattttgcaagcaactttgccgaaaggctcaaataggaacacgacccaacaacagccgacagatggccatcacgtgctcacggcgccggtccctcctccagtcctcctcccaaattttttccaggttagactcgattcttgcagcactactgtactactagatggacagtgacgtttgctaatgaacaggaaagctgccaatccaactccagcaatattggcgctggataatgctttttttttctttctctagagggtacaaacgaacggatatggggtagacatttcatgccactaatgacattatctagtatgagcatctttcttatgcaacatataaccccagcggcgtatttagaatttatgatatgggtggtccaacttataaaaatttttaaacattgcggatataataattttaatatatacaatataaatataggtaatagaaccatttcttccgcatcttgtttaaagtatactcttctgtcataactaggaaaggaagtagagtaattcagaagcattttttttacatgtttctgaaaatgagatgaaatatctacatatctacgaatgtttcaagaatctacaatacaatagtataattttagatgtatgagttgggtcaaaactgaaaattgaatgcctaatatggttctaatctgctaatcagtaggagtaattaattgctctttgttggttccttcccttgcagctcgcgcagatcccagttggccaatgccctagatgcaggcgctgatcgctgcacgtcgccgtcggccgccgcagccgcactagcactccggcgcccttgcttccttgcgcttgttgttggcccatcgtcacttgatccccaggaagtagggaagagaaggagcagccagcaacaaaccgccgtgctatgcacgcgtgatggcgccgctgctacaaccggtcaatcgcgcgaggagaaggagatggagtcgcggtagcggagagggagcggaaacggcgtcgcttcgtttggaagcttcagcctcacgggatttttttcctttttcttttttaccaaaaaaaaaatcatgttgggtcgctaatttttttggtggtctggggaccaccggaccacccattagatccgccgttgtataacccgcgatatttttgaaaatgacaatataacccataatctcgttgcaccaacaaagttagaaatgtggtgagaatggaaagtgggaaggaagctcttcgggttcttatctagttttggaagtactaatgtgtacttaagggggacagttcgttctgatgggggtaacctaggatgattaggcagcaatgtgcaccccatggctctgtggccaatctccttgcaatgtgctttatttattagccattaaccttgctgtatcatataaaatctatagcttttgccgtgccaaccacaatcgtccatcactgtgtgctactgttttactgtcgcatgacgataggagccgctcgatccattgtcagcctccatccagccgtttgttttttccattgcgttccaccagcttctaggtattcccacgagtgtacgcatcgacgccgccgccgcggcttgggacgattctccgtatctgctcctgcgagttccttcgcgtatctgccatcgccgctccactgtgctcgcctttcccctctccaccatgccaccttgaccttgctccccgacgacctctaccacgccactgcttgtcctactgaggaagcggtggcggcgccacgcctccaccaacacccggcgcccgtgggtgcacgccgcgccgtcacggacgcgggacgccgttcctcgcatcgcctcagcgcctcgcggggagccagcgacggtggccaactctctccgctctctggccgggcggccggcggcagtccggctctccgcgactccgcctgtccgccactcggacgaggcggcaactccgcctctcctcgcgtgtcgttgtgcctcgccggtcgcagccgtctccgctcccactctgcctctcctcgcccgcataaatctctgctccaactcccgctatccgtcgcgccgctaccgcctagccagccaccggccgccgataccgggagccagggaggtcgtggcgtgtagcacagcaggcagtagcagtgcgccggtgccaccttcggccttcgcccttcgattccggccttcccctgcaggtactttacaggtctgctcctttacctaatatgctctatactgatttttaattgaaacttgctctgtgctatcaatttgttatttttgattgtcgatttgtgattgtctattagactactatcataatgtcattgccgatttgtgattagtgaatatgcattttttgtgggccattccatagtcatgaatatgtggttacaacatatgtttgcttatttacacggcaagattattatatcgtgtgccccaatgacaggaaaaattagtgcgtaaaatgggaagtgttttacctagcctatagtgcttacttctttaatcagtagattgggagtttaggactttgcctttctgaatgctcaaattgtattctcagattgcatttaggtgcattcacaatcttttatggcaatatgtcatggttaattacatattctgcatgtagcatccaacctgaaaaccatacaattactgcagcatttattcctagcaatagagcatctctgcgagcagatgatgacatctttgtgctgtaagctatttctgtagaagtatatgtcttaaaagttatactatttggtaatgtttctaaatctatccattttcaaccttgagttcagctttctgcagtacacgatcccttcaaacaaaattaaatagctaataatttaattaccggtattcagaggacactttgacttttgtacttatcactgatggaaaattgagaacacttccctttttctggatagaatctctgctttgacctgataactttattataacatgttaaggtatggtattgcatatacacattgaaaaatattcccgagataaccaaacatggttactaatgaaaagtttgggaatttacaacctgtctatggctattccttcatgtcctgctaaacaaaaatcaaccatccaattcaatat

SEQ ID NO: 23330 - DNA, 8502 bp, Oryza sativa
taataatttcaaaaaattttgaataagacgagtggtcaaacgttacaagcaaaaactcaaaatctcttatattatgggacggagggagtatatgtgtggagctttccaagtccacaaaacatttaagttttcttttacctatcagtatatgctatattattctaatatgtgcatagatatatcttactccgttgcaatgtctctttgtaatttcaaatttatttttgtatagttcaaataactaatgtggttacaagcattacccgcagcaacgcgcggggccactgactagtttctaatatgcacacatggctctgtggccaatctccttgcaatgtgctttatttggcctttaaccttgctgtatttctaacatgcagagaatgtttttttttttgaaggaaaaaatttggaatactaagaaggaatttagcattcaatattgatagagaagaaattggtgagaaaacctgcgttcgaagggattcgaacctaggccagcacgttgctcctggcagctccctgccagccgagctaggtgccgttctcaatatgcagagaatgttgcacctaagcatcttaacaagactggtcgttccacgagggcaagagcaatacaagctcctcgtaagagggaccttgtgcctaaaaggtgtgccatgtggtaagagggaccttgtgcctaaaaggtgtgccatgtgggatgacgctactactaagaaactcagttcacaatggagatcaactagatatttctattttcctctccatctccctctcgtaggttcccctatccgcctccctcttgtgcatcgctgtcgctgtgatcctcttcgctggtcgcgctcctcccctcttccatatcggacccccgtgcatcccctcctccattccggccgttggctatccttcttttctatgccgccaagtcttcctttcctcctccgtgcatggatccatgttcattgttaccaaaatgagtttagacggcgcgaatcgttcttcggcagtgtgaattgagctcgggtggggcgaagcaatctccaatagtgctaatcgagctctaacggtggatcgagactgagcggtgtggcagatcaatctcgggtagcatagagaggtggacaatggcgagctccttaccgcggtggtgcagttcgagggatgacaggctccctcccaagccgtcgagacgagctccctctccagccaccaagacaagctctctctccggcctccctctcccttccccttgcggtgcgggatgtgaactatgggtcagacctgacgaatcctgacacattctaacgaggaacgtgtgctcagactaggatccgcagacgtggcatagaatctttggcgtggcttgttggtgcagaatgatacctactcgcattgtgaaagccctgagtacatggtccagcgataatgtgcagcatggtaatctttcttgagccatttgcgtattgtggtgttttccgtgaacacgtacgaatggtctcggcatggccaaaagcaactcgagaacatacagttccggccgttggttggcactcaacatgccatttcacctactagaaagtacgggcaactttccaatcttatagactcggtcacgactcacgagctgtctcggacgttcttaaacgcacgcaccaaaactgccgttgccactagtgatatcactgcgcgagccgcaggctgccaggctcccccaccgctccaccgccgcgcgctgtgtccgtcaaaagcgtcgaagcgtgcagcgacgatctttccgtcttttcccggcaagaaccttgcctagctttagctagccaagctgcatcagagcgtgcaagccaagtggcggtagcctcaccgaactggctggacgcgaagtggacgggaactcgtctctttacttctctagccgttggatcgatcgatcagccggtcagatatacgcggacacttgccatcgcccgtccgtcaatgcctgcaaaattccaagaaaacgggttttgcaagggcaggccggcaggcattctccttccttcgtcatcttcttctccaggtctgctttaacggctctccgtccttcgcctcagcaacctagtaactgcactctcactgtgccgggggatccatgctacggtgccctttgcatgccccggcccaacggtcacatttaacaaaaaccgccggatctcatgacggcgatggccgaaatgccgtgggaccgggtcgtcagctcctctgtctctgccgtgattgatggtgtcgtagattgcaatgcacggatcgatctaaaggtctactgtgcttatggatgtttggcacgcgattaaagcctagaactacgcttgttataaggacagtatgcatgttccagattatgggcagaaatagcggcattagcgtagaacaaaaaaatagtggcattagagtaacaaactttcaacggagacgctgagcagattttatctcagtgggtaaaaatactgaaggacgagcaaggtgaaaagtgaaaacacgattgatcacggggaggagcaatgacccggcattgaaaaacaacacaccacgcagagctgtataactaatggaatgaaatgtaaaagtcgaaactctagctgtcgcttgtagtactactcgtttcaaagagcctgtttgctggagtatactactgatcagtgatcactggctgcccgtacgcccaaatctggcaattacaacttcggatagaacaatccaaggtttccaaaaggtcagacttcgtaggagtaaaatacattcccaggtactaagggggtgtttgggagagaggggctaaaccccctaaaccgcaccattatactccagctgcagtctttccagaggtccaacggccgaaacgaaccaaactaaccaaccaacctttcacagcacagtacgcctcctccgccgcaacgttcgccgcatccacgcgtcggcgcctcactggcccttgccccagcatcctaggctgttttttctccccatggtccaacggtcccacccgtcattccgtccgaacatgtctgcggccgtcacgtgcagtatttatccgccgacccgttcggctccggctcactggcatccacctcactcgcctccctggcattattaaaccccgcctcgttgccaagccgatcactctgtgcaacaccgtgcggtagcagagcaagagcagcaaaaaaaaaaaccaccacgcctcgttcagtcactcgcacgctcgctcgatcacccggccgccgcgaagcgtcgaccgaagtgtatcgcacatttcgaaagttcttcgcgggcaacagaaagcagtttgtggtgtgcattgccgatttgccattgcgttgggttcatttcttccatcggcaatgctggcggcgtcgttgagagtcgaggcggtggcggtggttgctgcggctgtgctggtgctgctgctctcgccggctgcggtggtggtggtggccgggcagcatgattacggcgacgcgctccataagagcatactgttctttgagggacagcgctccggcaggcttcctcccgaccagcgtctccgctggcgccgcgactccggcctccacgacggcgccgccgccagcgtacgtattctcgtcctataacttggcgttaagaatgtactactggtgaagcagcattgtgatttgtgagtaacctgctgtggccgcgtgtaggtggacttgaccggagggtactacgacgccggcgacaacgtgaagttcgggttcccgatggcgttcacggcgacgctgatgtcgtgggggctgatcgacttcgggcggagcttcgggccgcacaaggaggaggcgaggaaggcggtgcggtgggcgacggactacctgatgaaggcgacggcgaagcccaacaccgtgtacgtgcaggtcggcgacgccttccgcgaccactcgtgctgggagcgccccgaggacatggacacgccccgcaccgtctacaaggtcgacccctcccaccccggctccgacgtcgccgccgagaccgccgccgccctcgccgccggctccatcgtcttccgcgacgccgaccccgcctactccaagcgcctcctcgaccgcgccatcgccgtaagtacaccagtgcgcgccaccgcggcagcattgatttcgattgtttcctcatgtccacgttatctgcttcgtgtactcctaggtgttcgagttcgcggacaagtaccggggcccctacagcagcagcctccacgacgcggtgtgcccctgctactgcgacttctccgggtacaaggacgagctgctctggggcgcggcgtggctgcacaaggcgtcgcgccgccgcgagtaccgcgagtacatcaagaagaacgaggtggtgctcggcgccagcgagtccatcaacgagttcggctgggacaacaagcacgccggcatcaacgtcctcatctccaaggtaaatgcaccattcctccatgattttactactgtgtgccgatgctgacgcgcttttcaaagaagcctcgtcatttttggcagcttcattatgccttcgtctttcacaaagagttgcccaaaccgcaagttatccggtagtactcttgaaacctctttttactgttaataataaagatctactaatgactgcataactgactgcgtacggaattgaaccttttaagttttaacccttttagctttacatgtgggctcaatcaggtttgttctgaacttctgatgcttgtctttgaatactcaaagagtcaaagtaagccagtacaccctgacggccgtgacaggagaactgatagtatcacgtagagtacgtactccgtaatactatactgctagtaatagcgtactttgactagcagcctaatccatcatactccctccgttccataatataaagtatacatgtatgtaagtaattaactatgacttattctctattaattattttttaatcctctctcatgttctctaattttaagagcacccgcaatggtaaagtaaagtgctctctataaaacatgttcatctcagcaatagactagattaatagtaaaccacctcaatagtatgtctacatgggtatctatacctctctcatgcattgcctcgtttttctctatagattatctctaagttagtagatagctttgctctctctattcatttaatatcttccaagtaggaaaatatgctgacatgaatctcttgtagagagcttatagataaccattgtgggtgccctaatggatgcatgcaatgtatttattaggatgatccatactacaatatgataataattattttttggtatttgggttaagggtggttatgccttagaacaagtataatagtgagctataagcctactataagcttaggtggataagagagatactgaaaaatcaaagttgtgggctctcatgcaagagctagcttatcacaagatccaagacaaatacattaaatgcataagtgagagatagagagaagataagaaaaatataaccaatcttatagctaatctattatatatattggctttaagatgaattaatagtaggaactgagctagtatactgctattatattttggaacggagggagtactagtagagtagtagtgtacgactactgtatgagcatgcttgtccgttgcactgcactcctcctatgatagcctcctaggtccttgtgctccggttgctgcccgtgctgcagtctactgtagaagtagcagggaagaacgcttttcagtgctcacggtcacgggtcgatcgattctctcgtgcaatgtccaaaacaccctgagttctagccttctaggggccagtactacaaacaactgtactaccagtaggagtattactgtactgcttacgttaattaatcttgcgttactccaggaggttctgatggggaaggacgagtacttccagtcgttccgtgtcaacgccgacaacttcatgtgcagcctcctcccgggcatctctaatcacccccagatccagtactccccaggttaatcaatctctctatcaccatctctctctctctctctcttttctcagctagaaccgcagctcttaaatttgttgtgttggcattgcaatgcaggtgggctgctgttcaaggttgggggcagcaacatgcagcacgtgacatcgctgtcgttcctgctgctcgcctactccaactacctgagccacgccggcgcgcgggtgtcgtgcggcgcgggcggctcggcgtcgccgacgcagctccgccgcgtggccaagcgccaggtggactacatcctcggcgacaacccgctgcggatgtcgtacatggtgggctacggcgccaggttcccgcggcggatccaccaccgcgggagctccctcccgtccgtcgccgcgcacccggcgcggatcgggtgcaagggcggcgccgcctactacgccagcgcggcgcccaaccccaacctgctggtgggcgccgtcgtgggcgggcccagcgacgccacggacgcgttccccgacgcgcgcgccgtgttccagcagtcggagcccaccacgtacatcaacgcgccgctcatgggcctcctcgcctacttctccgcccacccaaacccagccgagtgggccgacgactagaacaacccgccaaagtatatcagctatacgggcctgggctattgtttgttttgtcagggccgaatcgggtgattattgcctggttgattgatactacttgtgtaaccaaatatagttaacttcctctacaaaaccccaacaaagtatagttaactgcagccacctcctttcatgcgaaaaatatcggccaggaggaatgcataggctttattaggctgctactcctactagcaatgttgtaacagtactgtagacatagttacacttgtactgctatggttcagcgagtggattatatataaagtgcaccaccgacgtttcctctgaacaaatgctgcaccctgtgtactgaattcaccctgtcagacgctgactcaggcgactagtgacaatccaatggaccagcaaaggcagcagaggcggggatcacatgtcgagcttctgttcacgggtgaaatccgtgaatctctccgctgcgtacttgtgctggcacctggcgggcatcactagaacggtgtggtcggtgggtctcgatctctctcaatcgtcatgcctattttcaactacatcaggtgcaaatttccaaattcttggtagtaatttcaatcacgaatacgcaggaaatcattgttcatcagtaatgcttgcttgctatcgtaagttcatttactcaaacttaaaagcagaacaagtgtaatgacaaatcaggctccgccgctgcagatggcggtgagcagcaccggcagcctcactagcgacgacgacgtcgcctgcgccgacctccgcagctgccacttggccctctcctcccgcgcaggcagcgctctcccgttgtcgaacagcggcgtcgacgacttcctctcctccacgccgtcgccggagagcagcccggtgcccgcgagctgcctctccatgtgcaagaagtggcccagcgacgtcgtgccgccggcgtcgtccctgcaaaggcgccaccagctgccgccggcgccgcgccagcgcctacgcctccacctcctgcgccaccgccgcccgtcctcctcctcctctgccgcggcggcgcggggcctctcactctcctcccctccgtcccgcgccgcctccccctgctgctgctgctgctcctcgtcgtcgtcgaaggaaacgcccatgagcgtccccagcgtcgtgctccggtcccgaaagaacgacgaccccgtggactacaacagagcaacatccacacccatatcaagatctccaaaacaaatgaaatggcacggctaatgattctttgtgtacctcggtgtcgacatcggaggaagagggtgacgtctcggcggaggacgaggtcggtatcatgccagcgtcgccgtccatatcctctccttccggccggcggctcaatgggtgaagtgtgatcgtgatgtgctctagaaaaacttatctgcttctcccgtcgaatcgagggaagtatatggccgcggtagtggtgttttctatgcgggctgcgactgcgagccgcagacgcgggggtcgcagtggcgcaaggcaacaacggtcaagggaaatgaatgaatactccagcttgagctttgagcctctgacagtctgactgaatgtggggtagaggcaatcaggcgaagagcgtaggttccctacaataagcgactttcaaggcggtgtttgactgaactgttaacaaacagtgagctcctgccgattatattaattaagacaccttctaatcagactcgttggattagagcaagtttaatagtatagcccactaataactctaattcatatatagccaatctaatagcaatttatacaatagttgcttactatactattaatatatatacccacttgtcagggctgcagga

SEQ ID NO: 23331 - DNA, 12571 bp, Oryza sativa
ttcctgcagccctatttatagttggctaatagtattctattatacctgctgctctaagcacgtggatactgaatgatcgtacagcagaaaagagctgcaagcgggtactatacaggaatacatgccaccactacaccgctacgcaaggatggaacgtatcggtatttttcagcccgaagaatcaaatcatcagcggtgcagtgccagtgcgcacgatgcacacatggagtcgacctgcaatggcctcacgtatgatggatttctcacgggcgggcacgcatgggcggagcgtcacgcgtccgttccttccggtgcgcggagccgtgcaaaatataataaccgtgtgggaatcccaaagtcaataggcagtagtaaaaaaagaggaacagtcgtgcagtaaaaacaaaaattagttgctcacctttaacttcggctcatgcaaacaaaacgtaaacgcggtaatttggagtagatagatactcctcgttatgtggtggctgtttaagcagcgagaggaaatcaactaagcagttaaaagtttttaaaaatcaactgacaagtatggttattctgttattctgcaccagataggtccttgaaacgatcaatatatcaagcagaatgaatcaaaaaaacatttatcaagccgaaaagcaatactcaagtttgcatacctatttcattgaaatttcccatgcatttgggatcatgcattggcatatcaccatatcagtattcatctaactgccctttcagccaaaaaaaaaaaaacccgctcgtttcattgagattttccaatacatttggactcatccatatcagtattcgtcaaattaactatgctttcaccaaaaaaaagtcccaagtagtttcgatctgaccactaaaaacgccacacgaactaccaaaaaagtcccaactagtttcaatctgaccactaaaaacgccacacaaacttagttgggtgaggctaatagatcgaagcaattagaatgcgaaatcctaaagcgaatcctgattaacaactggggctaagttcagtagtagtaggtacatacgacgatgcgcggcgagtgacgagacgatggccggtcgggtggatcacgcctgcttgctcatcatggccttgaactcgtcgaaggagatgaccccgtcgccgtcgctgtccacggccgcgacgatctccgcgcactgctcagccgtcagatccatcccgtcgaggttcagcctacgcagcgcgcggcgcagctcctccgccgtgatcacaccgttcccgtcctcgtcgtactcgtcgaacgcggcgcgcagcgcgtccaatcccccgccctccatcaccgcgcggagctcctcgatgctgacgaacccgtccccgtccctgtccgcggcggcgaccatctcctcggcctcgtccaccgagcacccgtagaactccctcatctccgcggccgagatgaggccgtcgccgtcggtgtcgaagcagcggaagacgcggatcagctccggctcggcctcccgctccaaggacaacggggactgggagggatccaggacagccgggggcggcgagcggctgcggctgcggcggaggcgaccacatgaggcggcggcggaaacgacgagacccatggcgagacagatggtgcggcgcgcgtttccgttttgatcggtgtgtaggtttgggggtttggggctctcgggcgatggggttggttttggtcctcttttatttagcgcttgagtcgcttgaccagagatggtcttcaacggggcccacaaaacttgccgctgtgtgtttggctggcgacaagggtagtgccaatctgtgccatgctaatattttggaagtttgaaatatcattttggtagtatttggattgtgactaatttttacatagctaataataaatctactctatcaaatttagtagtgccaaaacttagtaccaatattttggtagggcctcaaaccaaatctagattacggccagcttgaaactggtaaatcgaccacaaacattgttgaagcgaatgatattggctaagagtgggtgacataagtagatagaaattactatatcaaatttgcgttgaggtgaaggagatataagataaaagagaaaaatatggtctataaatttcaaccgtatcacggactcgtgggttagatattaataatttagtatatatatccataacaaacagttgtatgagtatatctataccgagctattatataactagactataagattgacaaaatatgttaattattacatttggtacgtattaactataccaccgatcttaataactcttaaggctctcttagtttcatatgtggtatgctattgttgccatcaacgaatagagctttacattaaatgtgaagagcttttttttttaaaaaaaatgtgaagtaacatatatccacccgatgtacgaccagggagacgggtgatgcgatggtgctggcgtggtcgccactcgcactatcatgactgcttctaggaagaggtgtggagtgttaggtggaatagttggttgccatgcagcccgaccaagccaatgactcccttgcacgtccttttacttgaggccgacaaagtggacaccacaaacatccgcaagtacaccggttgccttttccatatcccatacgtgcgcggaggacgtgcaacacgcctccaactcagctggcttgaaaaggggcctatgtggactcaagaattgggttcacttgtcaataaggtacaagaataatcatacctaacccttgtgcataagaattcatttgtaaggagatggccaatgtggtatctccatgaactgtgagggtaatagcaatgtttaaggtcttagaggaaataagttaggtcccaccataccctatgtttatgacgacaatgtttaaggtaagaatagatgttaagatgggtcccgcgtttatgtaaacaaattttacattaaggtgggtcccaccataccataatctattctcatcctctttagtgtgcatatgtgatttatctcattattttattttttaaggttgagccataaacttatggctatttttagcatttaatgtctcatggctaatgctcataatgtatatggctagtcataagatcttatggctcattattatggcacattgtggatgccctaagaagagaggcatgaccacgtagaaaggggaccccagatctaaaccaagaaaaaaaagaataaggaaaagcaactcttaactcttgactactaccacaaatccaaaaaaggaacaccacactagggtgttatttatgcttctcagttacctaaaccaatataatttctttgctctcgcttgcatttacaccatgattactcctaatcatgaactcctgtttcttgggctgaacttagctgcgacgagagggggtggggtggggtcatccatttctcgctagagtagttcaatttccaacaacggcactcctccgccctattcgatcccctcctcaccccgccgttctacgtctaaagtgtaaggataatttgtattttcccgacaaggcccccgcgtcgcctcctcgtgagggcggcacgggcggcgacaacccgagacgccgtcgcaacccagcgccgtcgccccctacctcgccgccgcccgaacgaggtgccggcaaagccagcggctcgcgaggacggcagcggcggggttcacaactcccgtttctccagatccagcgcgggaagatctcgagacggaggttggcggcaccgtttcggcagcgggtggagacggcggcttgcgaccgagagcaggcgacggggtgggtggaggtagtgagaagcccggctggcgacggggcggaggagacggcgctggtggctgtggcgccagcgccggtcggcgtgtagcccgacaggcaacggagagggggagacgacggtggcggggtagaggaggcgggggcagcgacgggacgttggaggaggtgttgcgctgtggcttccccctagccacgctggcggtggaggaagaggccggcaaatccgcgccttgatctggcgggcaggcatccggcggcgccccggtggttgactagcggcggcggcggctgcatctgtggatgcggtggccggcgtcggggcaagttgcgggcgtcgatggctgcggctggcggtggagggagcgtcggcgcggcggcgctggaggccgtgatggccgtggaggggcaggaggccacgccctcggcggagggcggcatgcggggggccggcgtggtggaggcgcggctggcggctcgaccaagagcccgtctttgccattgtttacgaggtatggtacttgcgagtcattatgcgagaccttctatggccgtcgatggggtgcttgtgtgggtgatatgaagacgctggcgaaagccttgccgtgcctttggccggtttgacgacgacgcccgtaggcgccgtttcccttcttggaggtgttgtcgtggcgtttttcttctatatcgcccacaaatatctaggtaaaaaccttgttccggtttcggacgagcggcgccgatgttatgcatcatgtcctccttggcggcatcgcttcagagaagttcctatgaatcgatgactgttgatggtctttctcggtcaaaagctttcataccttggtgttcggcgaggcctttgtcttcttgagtccacttagttcttgtggtgggcaacacgctcttcggttgtttctactgatgaagtcggagctgctcgttgatggggtgcggcgatgctcgacaacgatgacatgctgcagtctcttctatggagttggtgctagccgtgtgaaggaagtggctccttggtggcttggctgatgtccatcgttagatatcggagctgtttttcgctttggcgactttcgtggcttagtgtcactgcggttgtgaagtcggcgctgctagattgcttgcgcgattagctcggcaacgataacacctcttctgcgatgtcgaagccgttgagtcgcttttgtgattagcttggcagcgatgtcctgcggttgggctccgccgtcgttgttagttttgtagctaggtcccttgctcttctctgcgtggtgggttttagccagtttcccacaattaaccgtgcaattgtttgtttttcgggtccggttttccttataaagtgggtcaattctcttcttcttcaatacaaagacaccttgcgtggtttcaaattttttttcccaacgacgacaatctaaacatgtatcaaatatcaacctcatcgtaatacgacttattagagattgcaaaaataattttaagagtatttttttatatactccctccgtttcaaaatgtttgacaccgttgactttttaatacgtgtttgaccattcatcttattcaaaaaatttaagtaattattaattctttttatatcatttgattcattgttaaatatactttcatgtacatatatagttttacatatttcacaaatttttttaataagacgaacagtcaaacatgtgctaaaaagtcaacggtgtcaaatattttgaaacggagggagtatttgttattagatatttaaaaacaaatgttggaaaaaataattacgttgaaaaaccccaaaattaagtcttaaattcagttttagaatttaaatttacgattttgcttttatgcggaaggcggaacgatagggtgttatcaaacttaccatgttttggttttgctaaaatttagatgagttcattttggcatcaaattaattacacttttagtgcaaggagagacgcgaatgacttgttctatgacagtgctagtagtgtgccgaaggacgatgatatccacatgacgatcatcagcaaccaagccctgatttcgacgattctgtacacgcatttgaaactggaaactcgaaatcgtatgactaggcagaaaacaagaccaatctatcaagtagaaaaacaatatctcctctctctctctctctctctctctctctaaaaaaagcaatatctcttgatcgatcgattcgagtttgcatatctatttcgttgaaaattccccatgcatttgggatcatgcatatcatcagtattcacgtaactaattaccctttcaccaaaagaactgtccgtcttcgttgaaattttccaatacacatttggagtcatccatatcagtattcgtccgattaactacggttgcaccaaaaaggtcccaactagtttcgatgttcgatctaaccactgaaaacgccacacaaacgaatcctggttaaattggggataagttcagcagtagcaggtacatacgccgatgcgcggcgagtgacgagacgatggccgatcgggtggatcacgcccgcttgtccatcatggacttgaactcgtcgaaggggatgacgccgtctccgcgtacttggccatcatggccttgaactcgtcgaaggagatgacaccgtcgccgtcgctgtccgtggccgcgacgatctccgcgtactcctcggccgtcagatccaccccgccgagcctatgcatcgcgcgccgcagctcctccgccgtgaccacaccgtccccgtcctcgtcgtactagttgaacaccgcctgcagcgcctccgaatccccgtcctccatcactgcgcggagctcctcgatgctgtcctcgtcgtactcgtcgaacaccgcatgcagcgcctccgaatccccgtcctccatcaccgcgcggagctcctcgatgctgaggaacccgtccccgttctgcctatccgccgcggcgaccgtctccttggccttcccgcacccgtagaattcccttatctccgcggccgagaggtgtcgtccgtcgccgtcggtgtcaaagcagcggaagacgcggccgcgctccggctcggtctcccatttccagaacgatggatgaacatccagcctatccgagggcggtggcggcgacaggctacggctacggctacggctgcggcagaggcaaccgcaggagaggacgagacccatggcgagacggatcgtgcgccgcgcgtttccgtaatgatcagtgcgtgggggttttgggggctcttggccgatcggccattggcttcagggtttaggtgctctttaacggttttcctataaatttgtttaacagattttatcctcaaaatcacacgatttttttgggttaaccacgtcatgacgtcacaaccagattatgtgaaaaaaattgataatttaacacttttttcgttgttcaattgctctaatggacacttgtgagaatgacatgtgtgaccatataagcgaatgtaagtgggccatgatgtcaaataataaaaatccattttaaggagtgttaaattatcaaatctctatattatgggtatgtttggagagcttgaaattttgagaaacagttgattggtagctagcttttaaaaatttgtttatggcttctaatttatttttagattatacaactacagatcctcgtaatctgaacaagaagctagatggtgtcgtttgtttcccagatttgtactacatgttttaaccgtacaatgtgcattgagatccgtgctatgtataagtcgcgggtacgctttttaattaaaccagggcactatgtatttaggtgaacaaatttatcatgtaatctactccctccgtttcataatataagagatttagggtgtatatgacactcatattaatataaatctagataggatatgtcacatgacacatcaactaaaaatctcatctcttatattatgggacggagggagtatatagtttgtcggtgacatgggaccgggagtatcatgaatagaggcttgagacagacacaatcgcccacgtggcctggcaccctcggggggcgtcgggcccgagggtgatgtgttcgccctcttctttgtctccccaagggggtcggaccgctcccgcctcggccccgagggccgaggcgccccgacccctcgtgggttttcgctccgcgtgtatgggttaggtgggcacagtggggctcacctaaccacatttattgcggtttggctgagcgtgtcacgccgcatgtaacgcggtgcagtgcactcatttatccggtctgtgaccagtcacagaccggtcagatcgcgggttaggtggcgacaggcgatctgacgcacgcctcgccccatcccgtcaggacgagggcttctaggcactcgtccccagctggagctagcgtgttacctcccagagatggcacgttagtcctggtcagatatatgccaggcttcatcctaaccattacaggcaaaatgttgtgtgaagaagggccaacgtgcagattgctaagctgacgcgtggtggacaagaatgaccgatttgtgaccagtctgacaccggtcatgtcgtcagcagacagccatgattccgcgtcgcgcctgttcccggcgaaagtggaggtaggtgcgggccgtcccatcagaaggtgactcgaacggcaaccatgcaaatctccgtccatttatgaaaaggtagggtaagtccccacagagagggggggatggtgcatgtggtatccccttaagatataaaaggaggaccttgcccactgagagagggggagttttttcttggactggacttttccagattaggaacccagaacaagggagaggctggctcatactttgtagctccttcacacacgaatccaccaaaacacgggagtagggtattacgcttctaagcggcccgaacctgtatacatcgccggcgtcttctgtgcttcctatctcgcgaaccttccacacacagattgggagcttagagtctcacccagggtccccggccgaaccggcaaaggggggccagcgcggtctcccggtgaggagccccacgctccgacatctggcgcgccaggtaggggactctgcgagtgatcttctgagctcttgcactctttcgtgtgcgccaagcttttcctgttcagcctcatggctgagcaagcaaaggcgcacaacctctctccgagtgtgagtggcgacgacggggagccgaacccacgccgtcgagctcgtactccaccgccccctccacgccaaagtcctaagcagggggaggcgctcgagagggccgaaggatccgcgacttcgacatccacaggaggtggaaaggggcggcgagatggggagcatcgcctcctcgtctatggtgacggcagcacgccccagggcgcgctccaagctgcgggcgcgctcctacgtcacccgcccgtcgcccatgacccggagtctccagcccaacgctggctggacgatgtggccaaattggtcatgactgcacggcagtgtatagatgctggtgggcggtcctccgccaccaaggcctctggtgctgctaccaccggctccgcgtcgtcaagacgaagggcgcggcgagcggcagccgccgttcgccattcggccaccactccttcgtcgactccttcggcccggaaagatctgcgagggaggccggacgcccgcaccagcatcgagcggcggcgtaatgaccgacgtgctacccacgcaacggagggcgcttcctcgtccagagtgtcacctcagcacagacgcgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtcttcacgaccgggattgaggccgccgggggtgacgacagggtcatggcgaatttctttcccatggccctgaaggggcaggcgcggggttggctaatgaacttgccacccgcgtcagtccactcctgggaggatttgtgccaacagttcaccatgaactttcagggcacatatccgcgcccaggtgaagaagcggacttacacgcagtacagcgaagggatgatgagtcacttcgctcgtatattcagcggttctgtcaagtccgcaacaccataccatgcatccctgcacacgcggtaatctacgcgttcaggggaggcgtgcggcacaaccgcatgctcaaaaagatcgcctctaaggagccccagactaccgcggagctttttcagctcgcggaccgagtggctcgcaaggaggaggcatggacctggaacccctccggttccggtgtggcagcttcggccgcccccggatccgccgctcagacagggcggcgtgacaggaggaggaagaagaggtcagcccataccgacgacgagggtcatgtcctcgccgtcgagggcgctccgcgggccacccgaaaggggaggcctgcgagcgacaaaaagaaggaagccgacgctccctgacctcggctacttggaagagcgaaggcggcgcgcggcccttcgagccgcgcgctaccagcagagcctgcggcgctaccatcagcgccacgtccgggcccgatcactctgcgtcgacgacctcgtcctacgccgtgtccaaacgcgtgctggactgagcaaactctcaccaatgtgggcgggtccgtatcgagtgatcggcgtcccccggccgggctccgttcggctggccacgggcgacggcacagagctgcctaacccgtggaacatcgaacaccttcgtcgcttctacccctagtgggggttgggtgtcaggtcttgggctcgggccaactccgcacccccccggcgtgcagggttggccgggggcttatcttttttctcttccgtatttcaataaaagcattttcgatttcctaaaggctgtgtctgtgcttttgtttccttttgaagaatcttgacttgaaataggtcactcgtgctcaatcctaccctcgggggctcgggtcggctaaaatcgccaaaaggggcccagaaccgagccgtgccccgggacgtggtgaactccgggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgatcgcagattaaatcagcctataacaagaagggggcccgaaggcctcggaagaagaaggaaaagctattaagattggcggaggcctgggggctcactccgacgcgcccgggtagccggcctcgccgtcgctgttgtccgcaccgtcgtcaccgcactcctcgtcggagttgaaggcaaacgcgagccgaggggccgctcattattgtcggtcggttttcccttgctgatgcgcgcgatttgcgaccgccgggattctgcccgaagagagagagagagcagggaggagaggcccccgagccgaacggtggcccaaggcccccgacgaccggagcaggccctctgcccgcttgtcagacggtgccaggtgcccccgacccccaggatggccccgaggccactgcgggaaggccgcgcctgtcgccctctgaccccgaggtcgtcggcacagaagccgagtgcgccccgcgtggcctctcggatggagagcgccctggagatgtggcccctgacgaagaagatcggccccgccgaaaggtgcagcggcccgtctacttcgttagcgaggccctccgggacgctgagacccgataccttcaggcccagaagatgctttacgctatcctgataacttcgaggaagttacgccattatttccaggcgcatcgggtcacggtggttacgtcttatcccctcggccaaatcttgtataaccgagagggtactggacgggtggtgaaatgggcaatcgaactctctgaattcgatttgcgctttgaaccaagccacgcgatcaagagccaggccctcgccgactttgtggcggagtggaccccagctcccgagctcgtctccgcccccgaggccagctcgagcccatcgcagctgcctcacaccgccctctgggtgatgtagttcgacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgaatagaggcttgagacagacacaatcgcccacgtggcctggcaccctcggggggcgtcgggcccgagggtgatgtgttcgccctcttctttgtctccccgagggggtcggaccgctcccgcctcggccccgagggccgaggcgccccgacccctcgtgggttttcgctccgcgtgtatgggttaggtgggcacagtggggctcacctaaccacatttattgcggtttggctgagcgtgtcacgccgcatgtaacgcggtgcagtgcactcatttatcccgtctgtgaccagtcacagaccgggcatatcgcgggttaggtggcgacaaggcgat

SEQ ID NO: 23332 - DNA, 4607 bp, Oryza sativa
  unsure (1)..(4607): unsure at all n locations
ccgcgtcgcgcctgttcccggcgaaagtgaaggtaggtgcgggccgtcccatcagaaggtgactcgaacggcaaccatgcaaatctccgtccatttatgaaaaggtagggtaagtccccacagagagggggggatggtgcatgtggtatccccttaagatataaaaggaggaccttgcccactgagagagggggagttttttcttggactggacttttccagattaggaacccagaacaagggagaggctggctcatactttgtagctccttcacacacgaatccaccaaaacacgggagtagggtattacgcttctaagcggcccgaacctgtatacatcgccggcgtcttctgtgcttcctatctcgcgaaccttccacacacagattgggagcttagagtctcacccagggtccccggccgaaccggcaaaggggggccagcgcggtctcccggtgaggagccccacgctccgtcatagttagtccctatattaatttagcaccaaccagagtattaaaggtggtcttcagcgggtccaaacaaaacgggtggggctaattggctagcgtttgcgggctgtgagcctgtgaatgggtcccaacaacctagcaacctattagccccaaatctcctactctctcgctaccttttagtcttcccattgtgccaataaagaaagtcttcttcttatgttgattatgaaatatgccaagagtgacctttcggctttggcggtagagtaggatcaggacgtatggcgatggcatcgacaatggcctctctttggtgaactccctctgctctcccttttgcgcgaggtccaaatcagaaaaaaattcccccaaggggncctttnttnttggattttcctcgccttcttcgttgccaccacctggcttgtcggagccaaaaggcatcaacgtgccgccgcagctccgcctgaccagccttctacctatcccctgtgccgccgcagctccgcccgacaagtcttctacccatccctttgtcctttttcctctccttcgaccggtccacgttagaaattgttgtatatggctatctatttagatttgatggggtaactgtaaaatttctaatacagtaactggggcagcagattcactatcaccatcactacattattccttcttctaaaggagtatagatacacatgcttcttttaagaaattgtagaactctcgaaggagtatagacatacatgcttcttttaaacgaagaaattaagaaattatataagtcgagaaaaagaagaactgatttcttttatggtataaaccaaaacatagtaaataccccgacaaagaaattgaggtgtggcacaattttacaacgaaaatttttgattggagaaatacgtgcttctgttctgtgcgtggcctaattggcacacctgaacgcttgatctcgagttggacggccgaagatttccagtaaaaacatgccttgaataggtcagggccagccaaacccggcccaaacctcactttatccgagagcccgtcgtctcttccaggcttcaagccatctccacccccaaccaaccccactgctctgctcttcgcgcgcctccaccgccgaaccccatggccgccgccgccgccgcgggggcgacgccggcgacggcgaggaaggccctgctcacaacaaccgccaccctcctctcctcctcgctcgcgcgcagccggcgcagcctctcctgctccgcggccgctgcctccgccgccccgcgcatcgcgcctcagccgccggacctgctccgatgggtgcagcgggagggagggttcgtgcaccccgccctccgcgtggtcgaccatcctgagcacggcctcggggtctccgccgccgcggccgagggagacattccccctggcgacgtcctcatcgcgctacccggccgcctccctctacgactccgccgccccgccggcgctgcggacgcggtcctcgtgcagctagcggaccaagtacctggtaatggctctcctagtcctggctcagattttcaattacctctgttagtcacgttgtggaaaccagtgtggtagattcatgtttgtgaagagttgctaatgcatcaaaagtaagatctatttctatataagaatcaggagcataattggtattgattctgctgttgacgtcggatcaattgaactgacatcctcctagtattgcgttttagttcagtagcaattttttcgccagcgcgcaaaagctttgcacgccaatatattagagttcagtagcagttgggttttacaattttgagaaatgcggttgtcctgaacacctaatgtctaatggcgaatgctgttttctcgtgttaaattgagtaagattgagtcaggttttcctataatttacgctacacaacctaatcctttgtgtagctaatgttgtattttgacataattgctgcacgatggaactattctacatgtgcactctatgatcctgccctcttttagtgtatgagggactttacattctagaaaattaggctaagtacccttcagtgactaacaaattcaatcctgcgggaagcatgtgacagaggaactatgggctatgcgactgggcttgaggctgcttcaagaaagggcaaaatctgattctttctggtggccatatatcgcaaatctgccagagacttttactgtaccgatattttttccaggggaagacataaaaaacttgcagtatgcccctcttctccaccaggttgttataaattattgtagttcttattgcatttcccctcttcttttttgacttattatatttcaggtgaataaaaggtgtcgcttccttctcgagtttgaaaaagaagtgaaacataagcttggtacagtgcccttggaagatcatcctttttgtggacaagatgtaaactcatcttcccttggatgggctatgtcagcagcatctactcgggcattccgtttgcatggtgaaatcccaatgctgttgcctcttattgatatgtgtaaccatagttttaacccaaatgctaggattgtccaggaaggaaatgtggatagcctgatatgtcagttaaggcaagtatcctgaattgtttgtgtacttctgagcccaagaaattttgtatttccttaagacaatttttgttaattgaatgccctctgttagtagctttgtttatgcataacagcataagtgacatgtgaatgcatttatttaactgaattcatggataaatgtagccttttatgttatcttaccatagatgcaagtaactctgaccaccttgaccttgcttataggttgttgctgagacaaaaattgatcaaaatgctgcggtaacactgaactatggttgctaccctaatgatttcttccttcttgattatggatttgtaataacatcaaattcgtatgatcaagtggaactgagctatgatggaactctcctagatgctgctagcatggcagcaggagtttcttcgcctaacttttcagctccagccaagtggcaacaggatatcttgtcacagctaaatctgtatggagagggtgctattctaaaggttttgcacacattcttactgatcctatttattttttgcaatctattgttgaattcaagtcgtccagtatccatgcagcaatctgaaccttcttggttttctgtgggtatcacttgtaatttcttttcaggtcagcataggaggtccagaaatagtagatgggcgcttattggctgctttaagggttattattgcagctgatccggacgctgtgagtggccatgacctcaagactttgatgtctcttaaggagaaagctccattaggcccagctgttgaagcttcagcactccgaactgtccttgcactttgcacctttgctctacaacacttccacacgaagataatggaagacgaggccatactaaaaggagaaccacctcttactactgaactagccgtgcagtttagattgcagaagaagctgcttctcctggatgtgatacagaatcttagtcgcagaatcaagatgctagctctagacaaatccaccgtgtaggatttttcacgttttggaattgctttctcggacaatcaattaccctattgtactgattctggagatgacaataaagccccaaattttgtcctgttttcttcattgtccagatgccagagtccaatatggcacggatggttaacaatcagattgaattgatcgcaaattataatcaagtattcgttgccagttgcatgtgctctaaaatctaaattatatgtttttcactgtaaaagtatgttttctttagacaaaccggttcatcggagagaggaagatcatcaagaatgaatgcatcacagatgcacaattcaaaatagctaggctacataactttagtatttacagaaccaagatataactttccattaatcctaagaactgaaatttccttgtctcaacgacaacgacgacgacaataaaataaaaagattaatgtacgcagtacagccaaagaatgatcctaaaaaaacatctgctcatgttcggctgctcaatcagtcgggtctaaccatgacgagagaagaaaact

SEQ ID NO: 23333 - DNA, 2496 bp, Oryza sativa
agagaagaaaactcaaggagatcgcggcggcgcccgtacgtctccatccaatccggcaatggggtggcgcacgtacgtacgcctcacgagtcgccgccgatggagatcgccgggcgggcggccctcccgagcggcgagcgggagcgctgcctcgcctccatgtcccggagcaccaccatccgccgcatctccgacacctggtgctggtacgtctcgtccaccttcaccttctccccctcctcctgcttgatccgcctcacctggctgtgcaccaccaccagccgcctctgctgctgccctgcatccacgtccctacccatctccatctcagcgaaaacctccctcggcttcctccccctcttgatttttttttattctgtctacagagacgatggcgatcacgcgacgaggcgaatccagaccattcgaacggtgcgttgcatgagaggggcgtataaatagcggccgcatcgcgggtgtggatggatggatgggatcaggggactgaccggttcccccctctcatccgcgccgttattgcggaggcaggcgcagcagctatacacacgtgtcctgctatcccgagcggtttagacgtttacccgatcgattggtcgccgtctcggcgccaattcaccacgtacgccgatcctccatgtgtacggggttgacgtcgcgaggccgccgagtcgtgccggtctgtccattatccagagtttccggacgggatggacgtttgccgatacgattttgacattttctttcttttttctgcatgatttgtaacgatgtttgataactatgcgtgtcatatccttttctatccgaggtaaacgcgtcgtgccagttgttgcaaaagatatataaacgcgtcggttaattacgtgatatggagccgatagggactcgtcgcacaacgaagcgatcgcaagtggcaaccgcgcgagagaaacgtgtgggaattggaacagagagtcagagcctatggcaagctgggttgatatccggcagtacgtttaggacaatgtttaagtcaaacattaggaatataaattataaagtttaaaaatataaaaattatatgtatagatttgtcttgaaaaattctttcataaaagtatacatatatcacttttcaataaatatttttatagaaacaagaagtcaaagttgtgttttaaaaacggtgtcgctattgtaaacgacttcctttacgagcatggagcgagtacgttgcaacgcgattgaacatcgtcgtctacagctcacttcgccgagtccccggcccatcgagaggatgcatttaattctgttatttgttatttttctcaaacgagggtaaaggtgatctgagttaatctcagatccccgaaagccgggatatctttatttatttatttatttcaatggagagtaaggcggttggagttttgatctccgatattcatcgatcgtatagtcatatttacgtactgcaaagcgatcgagtgcaacggtcagagttttcatctccgacctccctggagatcgagtccctatcgatcgcatctggtgatcggatcgaaatctcgcgcgaaaccaggcgcctacgtaacggtgcaaaacataccgtccatcggtctacagctcgcctagccgagtcgccgaggcttttcggccgagcctcaatcgagggcaaggggattcggagattaaaactccggtttccgaaccaccaggaaagataagatgattgaatcgatgtcttgcgccggaattaccaacggatgcaccaatcctccttctagagaggattctacgctcagagacaagtcgctaaccatgtcgtgcactggcgcaggtagattttcgattttctcgttgcttgggtcacagtgatatataccaactacctggtagaaccagaagccggctacggggtttcaaaaaggaagaaaataaaacgtgaaatctatttcgagagcgctctcggtttagctctatagcgtgacgcatctcatagccgtctaactgtgcacgtcgtcatgatgtccacccatgtgggtgtctttttcttttcaaataaagttctcgtgggtatctttttcctattcaaataaagtttcctctcaaattacttatccgatctacaatccgattacaccattgtgttcgttacaattaaatcttcacaaacaagatcttacatgattatgttacgttgaaaaaatatttatatttataaattacttttattatatacataagttacttttatcatatatataagttatttttagatttgactaaattacttcttagacatataaaagtaaattcaataaagtctaaaagtaatttacatatattctaaaagtaacttaaaataaaacagaagtaactttgtcacgacattagaagtaaattcgttgtaggggataaaatatgactttttagttaattccataatttgtgctgattaatttaatttatagatagagtcatgtttttatctct

SEQ ID NO: 23334 - DNA, 6005 bp, Oryza sativa
ttaggattcgcttttggccagcgaatgtgcaagctttgattcatcatatttacgtactgcaagcaaatactccatttggtcaggattcgctgcaggacggccgcgcggcacacggctgacacgagcgcacgctgcgcgagcggcgaacgtgcagaaaacaccgttcaatcgatgcgcccggccacgcgatggccaggcgtatgacacgcacacgctcgtgacagcgcgagatatcatcatatcaagcggccgaactgccaaaataccgtactccaacacgagatgatttcaatctctccccgctccgctaatcgtttgcataccgagattaaaaaactccgacccccggtatgtgtggccgaagttctcttttgtaaattgtaattaggagtattttggtaagggatgcaatgggatgtgagttttaatctcggatcctcgggagcggaatttcgtttgtcacttttttcaagcgagggcaaaaggagaggccagaattttttgtagggaggcgagggggttcggactccggagtattgttccccgaactccatggatcgcatcggatggtcggattgacacctcgcacggtcgcacctaccgcgcgcggaatcaccacttgacggcttcaccccacgccactccttaaccagcgagcgtatcggatggccactccttcaccagtcagccgtgctcacacacgactgacacgagcggcgaatgtgcaaaaaaaaaaaaaaagaccgtggaatcgacgtgcccggccatgcgagtactcggtgtgtatagcccattcgtgacactacgagtacgagatatcaaaccagccgaactgccgcaaatacctaacacgtatgggtacggcaatacgaatccctgcaaacgcgacgttcgatcgtatcgtatgtacggtgtgcttcagagttcagaagagctcgcgaggcagctgcgtcgtgcatttgtccattgtctctggacgggatggacgtgtgtttgcggcttgcagatacgatttggcattttttgcgcatttggtagcgatgtttgataagctatggattagcataactgtgcatgatttggtagcgatgtttgataagctatgaatatatatgtgcgtggcattcatttctacgcaaggaaaacgtgtcgtgccggtttttacacgggataaacgcgtcaacttaattacttagcactcgtatgtgatatgtggccgacagggactcctgaagaaacgaaccaatggcaagtggcaaccgcacgagagaaacgtgtggaattgggacagagacacacacggagccatggcaagctggatcgatctctaattgcagtttccggtaaatcacgaaattaaagcccatgggcttagctcgtttagagcaccacgagcagaaacggacgggctttaaggccgataggcccggctgaatgctacgttgcgactactaccattcacagagccgagtctccatcgagctagtttttagttattttagttatttttacaaacgagggtacggtggtttaggggctgttcaggttgatgtcatttttaaccatattatttttgacataattgttaaaaatatatctacgtttagtttgttgtcaaactttgataaatatataagaaatcctgccaaaatttgtaaggtttattttagctacaatctaaacagttacttaatcttcaatccacgaaagccagaatttctattgttaattttcgatctagagaaaggcggttggagttggcctggtttattaattacgtacatcgagagagggcacaagtcggagttttcgggtctattcattttgatgtcattttcagccatactattttttttataaagttgtaaaaaaatatctacgtttaatttgttaccaaatttggtaaatacataagaaatcttgctaaaattttagcaatattaccatcttgccaaaattttagcattgccaaaatttggtaagatttattttgactacaatatgaacatgccattcatctcccccattcatctccgaacccccccccccgggagatggagtccccatggatcacatctggatctggtcatcggatcgaagccttgcacggaaccaggcgagccacgcagaatgcatacgtgaaacgtaccgatccagcggtctacaggattacaactcgcccatacgatcgaggccaaggggttcggagataaaggggcgttttggtttgatatcaaaatattgccatactaatttttttagtttaaatagtaaatgtgatgatttggtttgaagccaaatatttggtaatgcctatactcagtttgtcacaattctagaatattcttcaaaacaatttaaaattggctctcaattggcataaatctaaagacacccatttacaattctaccctaccaaaatattggtagtgctaaaacttgcctagggttcggcactaccaacatattggtagggtgctaaaccaaacaaacccaaaaactccgaaccctaggacggatgattgaatcgaggccttgtgcagaatcatccctgcgagccgatcggattggatcccccacctttctggagaggattctacgcgcagtcaacacacacaagtcgctggccatgtcgtgcactggcggaggtatattttcgatgcttggccgacagtgatacaggcataaagcctaccaggctactagcgctgcaagtttgtgatcgaataatgacgagtactcacgtgtacagagaaggcgcacagcgcagtactcaactcaaattgtgtgcaaaacgtgcttgttctactaccaatactcaccgaatcaaagttttaaaacaaatactcaccgaatggcacgttgaatcgagaggatgcggacctccacgtcgccctctcgcgcgggcggcacggagggcaaaccctagcccccgccgccccctcccttcctctcccacccctcgccgccgccggagcgcgccgacagagttccgcgcggccagtcgtgagggcggcggcgaggcctttccccggcgacgcgacggctcagcacgaggacgacgacgcggcgcgcgatgggcgggcgacggcgacggcgcggcgcgaagtttcggatccggcagtgccgccaccggatctggcacccccgtggctggattcggcgccctgccgctggacctggccggaggcgagcgtcattgccgtccgcggcggtgtgacggggcgcggagtaagtggggcggcggtgcatgtgctggcggccagcggggtggaggccggagtggatccgggacctagcggtcggatctggcgttgtcgcctcgtcgcgtggcgcggtggacggcggtggcaggagagcggcgctgcgtcgaagcggccccggcgccgagggcgggttccggccgacatgtgcctagggcggcgtgcgacgcaaggacggtaacggtggtcggtggcccagccctcggtcgaggctcaggggcctgcgtgcctccggagatgccttggccggtggtgcgacgacttggcggtgcgtcctgtgggtgccgtcgccaccgcaccctcgtcttcctcttcccctccccctagtatcctcgtttgtctagtatcctcgtttgtgtgccctcttccccctagttccaaacatcactagtgatcttgcccttcaacttcttctcaatctagcgtgcttgtttggaaattgtgctcctctagtagctcggattgttgcggttctatgccctcctccaaagttgccgttgatgtccttcctctgtaagaatccccttggccatttctccttctgtctagcccctgctcgtctacaccctcttcctcgagatgtccaggaccgcaaggatcagtgtttctccctcctttgaggcttccttcccttgaatagcgttggagagagttgatctaacaagcaacttgataaagcctgattaaagaagacttaatgcgggtggcctcgagccacaaccttcagtggccctccctcctttggggcttccttcccccaaagggcgttggcgagctctgatccaaacagcaacaagatcaagtcagcttctggatagcttcatgcgggtggccttggacttcaacagcattcccttggcctctcttctcttccgacatgcttgtggctgtgtgaggaattggatgttgattagttggggtttagcagtaggtttggaatttggcaagataattttgcatgtgtcgttcatcaattgtaatctttaggaggttttttttctctgttctctcctcattgtattctccatgtattctgttctactatcctccagggtcactgcgcttgcgtaggtaaagcttgccctgtgtaagatcatttggctcaatatatttaggtggggattctctccccccgtgatttagtaaaaaaaaaaaatactcaccgaatctcttagcttttcggagaggatttgctgccggtcgccgctacctcgtggcggtgacatggactggagtcactggacggccgcgcggcacacaagcgcacgcgcgccgcgagcggcgaccgtgcaaaagagaaaaaaaaacaccattcaatcgccagacgtataacatgcacgcacacgctcgtgacacggtgagacgatatcatcaacatcaagcacccgaactgccgaaatactgtacctaacacgagattattttttaatctccctctgcgcagctaatcgtagcacgtatctaactatgcatggtttgcataccgagattaaaggaaatggctatacatgttacccgtgccatgtgtacaacctgcattcgactaacatgcacaagcataacttttgcttgcgtggtcctacatagagagaaaccgatcatggtgattggtggacgtagcatggttggacgcatgttgtatacaacacagttgtacgaacagcaggactgcaggagttgagattaaaactccgacccgcaaaggctgatcgaattttattttttttttgccgttaggagtattttggcaagcgagacaaggggatgtgttctcaaaaaagacaaggggatgtgagttttaatctcggatcctcaggagcggaatttcgtttgctatttctttaagggaagaggcattcataggcgtccagaacattttgtcgttccgtttttcattgtttcaagctgatgcaagggggttgggagttttattgtccgacccccaagcccaagggatcgcatcggagtcggacagacggatcggcacctccaccagcaggctgcgcgcggcgattgtgcaaaaaacaccgcggaatccacgagccccggccagccatgcgagtatgtgacagccaagcgtatagcccagtgacacgacgagatatcaaacagccgaactgccgagttaccaaacacggaaacacgaatcactgcaaatatggtgtcctaattcataagagctcgcttaattggaacctttttctggtcgccttttcccagccgaattttgactcgcagctcatatacgccttttcaggctacgtagaaagagtggaagactgcttccgacgtactagtagcagacaaaagaacggcgtattagagtactcacaatgtctgatcaggcagagctttcagggttcaactattcggaaactggatagccaaagcccaaaacacaggtccacggcaagctactggccacactggcaagcgaatcagcgattggctacagctctctgctcggcatataggccggcctagctagtggcacacaaaagcgggccgcactggtcaagacatttctccagagactgaccgtacgtcgtcgtcgacgccgtcgccaatatttgattggtgaccggtcctgcttggcaaccttgtacgtaagggtgtaagtgggtaggcttatgaacccatttctaatataaataaacaggtaactcatcgattatccgtttatttgtactataagtaaatttatagatttattcgcttgcacacttacctgtaacatcgatc

SEQ ID NO: 23335 - DNA, 4738 bp, Oryza sativa
agaagagggccttgtccacatcgcgaggacccgttcatcccaggcatgctggtgatgacaacgaaatcatcccgatctctctcgactcctccggtcctcccccgataataatcaacaagattatattttactccctccgtctcgaaatatttggcgccgttgacttttttaaacatgtttgaccgttcgtcttattaaaaaatttaagtaattattaattctttttctatcatttgattcattgttcaatatactactattattcaagtttttgaataagacgaatggtcaaacatgtttaaaaaaagtcaattgcgccaaatatttagggacagaagggagtagttctgaaatgaaaaacattactcccattttaccctaccctctagaattgtctgccatagaatgttgttcagctacacaataaaacgatcaatgtccatccgcccggtgctactgcacggtagagtacttcagcaacccaatgtccactcggtatgatcttcatctagaaggaactgaatagaggcgcggctgagcttcttatatcctatgctttgtctctcataactgatataagccgtaaacggtttatcaacaactaaaaaattaatctatacataaatgttttatatattggcgtgttcggatgagagttttgcagcagcgttgcggctgcagaatggctgcagcttgcagcgattttcaactgccgcaggcaatgggtgccaaacactcaccatgtatccttatcgatttaaaaacagatactaagaatagactatgattaaaaaaatctcaaatcaaaataaagaattaagtttcaaatttaaattttgatggcaacttataagctgaaacacacacacaaaaaaaagtagacatgtagcaacacacaactgttgaacgaacaacactgctaccataggtgccggttcctaatggcccataggtccggattttcatccgacatcaattagtcggcaccaataataacaaccgacatctataacgaaaatagaaccgggacctttaccattgctcgagccagagagagagagagagagagagccggctcgaattcgagaagaactcaccaagcgccgtcaccgggcatgcgccccaaaccccaaaatcatccacaaatcatcaacaaaataaattgaatcacataatgaacatattcaacaacaaattcacacagacatcaacaaaaaatctacaatagactggggagaggcgtagaggggagggcgccaccgctgcccgccacctgtcgcctcccctcccgccggatccagcgaaggggagggcgccgtcgcaacccatcagctgtgtcacaccctgaagtttcccccccttttcttgctttaaaaattggttaaataaattgcccgaagaaattatcttcattaacctagagctaaatccctagttaataaatgcaattaataatcagaaatagcgtggtggaatttttcttgagttccccatgctccaatgcattaacaagatttttagtggaattttcagagccttggaaataattttaaccaattaaaaatcaccaaagtgcaattttaaatcccaggaaaaatcctttcttctttttctttttcttttccttcttttttctctattgggccgtcggcccactccctaccgcgctcggcctccttcctttgggccggcccgttcccctttcccctctctccgggacgctgacaggtggggcccacctgtcaagtcgtccccttcctccagccgcctaccccacgacggcaaccgtcgccgaaaccgtccgcgccgccgccttctccgctccacgccgcgcccccactccgcgtccccacgtcgccgccctccccgccattcccgcccgcacgcgcgcccgcaaatgggcgggattcgatttgaatcccccccactctctctctctccccccacgtcgccggccaaatcggggggtttcccggccatgtccacccctctcgagcccctataaagcttccccgcatctccctctcccttttccccttttcgccgcgctctcccgtgcctcctaccgccgccgcttccggtcacgcgccgcagccgctagagccgccgccgcgccaagccgccgccgccattagcattgccgccgcgtgagccacctcggccgccgttcggtttccgctaaaccccaccggagcccagttctcctcgcacaccggtgagctatccattctccttcgtctccggccaacaatggtggccgccgtggtcaccctctctactcctaatccttctcaactccctccgtaggtgccgccgccgcccgtccgcccctccttatcgccaggtcatcgccgccaccttcatcctccgctccggccgccatactcgccggtgaggatcccccctccctcttcccctctctctcgtttgcgccgactttctccacgagctcgccgtcgccttcggtcgacgccgccgtcctttaccctgtccgccgtcgcttcttgcgccgccgattgccgtcgccggcgaccgtgcgcgtcgccgccggttgccatggccggccggccggttttgaagccgtgccgagccgtgcctagctgccgccgtgccgtccgatcggcctcccggccgatccggaccgtcggtcccgtggaccggcggtggaccacccgcgtggtcccggtccacggtagaccggccaccttgagccactgcccgtggggcccacatgccggcgcccccttcctctcccctttgagccgctgacccgtgggccccgcctgtcggcgccgcccccctagatgacgtcagccctgggtattattgcgcaataattaattaaggactttttctttattagtaaaaacacagtttatcttctaaaattcataaataattcatccgagctccgtttaagtccattcaagtctcagtaaatcaagaaaaatgcaaagaatccattaaaaatggttttgtttcctgtttcagtagtcttatagcatgtttttcttgtgtgatttgtttgtagagtttcggcagtttcgtcgatccgcggtttatcgaagacgttgctgaggtctcatcagtttgagagcaaggcaagtcatgcaatacgtttgatcatattgtacccaatttaccaatatcccgcatttctattaaatgttgcattcttttacaatgtaatgtgggatgagtcctattcctcagccacatattggttaccttatgccattgataacttgggtatcaaaatgactagatgttggcttaggaaatgcttagccatgcttagttcaactagtacacaaatggagatcacattattacatagactctaactattggcatagctttagattggtgccaccgcaagggtgtcagttaattaaaatattctgaatggcgggctgtgagtgcatggttttgctggtcgcacctatggcagttaaggaccggttcacgggaaaccctgggagacttaccgtgcttaccacaagcgggaatgggtaactgcttgatctgaagtatagctcgaccctttcctaggcaccggtggcgagggtgggcgtgatggaattgggtcggccgaggtgttcggttgtccagctgccgtattcaccgcggcgcaagaggggaccgcccactgccttttgaggggtgggggtgaaaccttagcgtggtgtggatggttaggggagggttatgtggagggtcttgtcatgatttccccctttgcagtatcatggtgatacttcggggcatggcaacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggatggttgggcctgttgcaacgtggtgtagcgttggacagtgattggttaatattgattaattactacagctgttttactgctttcaactactgctttgaaatgcctgctttatgcaaaagaacccctagcttcctttggttatatcctgcatcatacctcctcttccggtatgacttgctgagtacagtgggtagtactcaatcttgctctcttttcccccacaccagagttgaagttcttctcagttggagccgtctcagaggttggttttgttgctgccgtcaaggtttgcctgtggagtggagtcgcccgctgctgaagtcaagcttcccggtttagctcgcttttatctttcccgctgcatttgtaatcttttatatttttgtaagacgtgggtctgtatatcaacaattgtcgtttgtgtaccctggctggtcctggacagggatttaatgcacattcagcttagaaattctggtgtgacaagctgccgcctgccgcctcccctcccgctagatccggcggaggggagggcaccgccgccgcccgccgcctgccgcctcccctcccgccggatccagcagaggggaggccgccgccgcccctctagccacagccacacgctgagagatgtgagagagccgagagagagagggggggcaagagagagagacagacgagagatgtaacgccccgattttcgttcgggaataaaaatcaattaataatacattttctagaaattaaataaaagttaaatcaacttaatcaagtgaattattgagggaattaaaaatttcctttaaaa

SEQ ID NO: 23336 - DNA, 2652 bp, Oryza sativa
tccctcaagtctgttctgcctccccagccggcctctccctccctctctcttcgacaggtgggacccgtggaccccacctgtcatccctttcttccagctccaactgccgccatggccgcctgagccaccccacgacgccgcttcctccgcgcgcctccacgctcccgcgcgcgtgcagacgtggtccaccccacgtcctccccttcctccactttctcccccatttcccccccaaaaatcggcgccgttcgagccccactcgcccacgtcgccggagctccatccgccggccgttgccgcccgccatggccacgatctccccctccggggcctataaaaatgcaccccgacctcccctcatccgtttccccaactcactgccccctcctgcgcgctctctcgagctccccacgccactcccgtgtgccgccgcacgccgacgaccctccagccgcgcgccgtcgccgcttccgtcgcccccgcactgcgccgctgccacctatagcattgcagcgtcccaccgcaccccggcatccgctccatttcccctccccgcctctgaaacaccgtcgccacgcgcaccacctctctccaccgtctttaccacctccagccgccgcttggcgccgctcctaaccaccccaagcagcgccgccgccgccgctcgcttcgcagcgccgaggagcacctcggccgccgcttttcacggccaggatcccgccgggacacggttcccctcgcgccggtgagcatctgccgcccgttctcacctccgaccagcgattcatgccgctgggaggcctctttccccctcctaacctctcccccatcctccctaggtccttccagccgccgtccgctggttcccgctcgcggaacgccgccgggccgccgttccgccttcgtcccgaggagcgccgacgccgagctccccgcctttccccgccccttgtcgccgcgtccttggtgagctcctcctctccctcctctgtctcccgtgcgcgctgccgcgccggtggccgcctgtcacgcccagaaattcccgagtagaattccaagtagaatgtgcattaaaatccccatccaggaccggccggggtacacaaacgacaatgttgacattcagatccacgtcttacaaacatcataaaagtcttacacaaatgcagcggaagaaaagaaagacgacaggagctacgccttgactagaactgcagcgggaacaccactccacaggcatcctcgacggcacggacgaagcctactcctcggagaaaccttcatctgacacactctcgtactctgggattgggaaaagtagagcaaaactgagtactacccactgtactcagcaagtcataccggaatagaggcatgatgcagggaatcatcaaagaagagctaaagtggttcatttgcataaagcgagcatttataaacagaagttgaaagattaaacagttgtcacatttaattagtattaactatccactgtccaacgttatcccacgttgcaataggcccaaccatccacctaaactatccaaattccaaaagattacactagggtgagactaatcacggtgaatctggttgaccgcccataaccgcgggcacggctattcgaatagttttactctgatcagaggtgtacaactgtacccacaagacacagccccacgacacgttaccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagcgacagaggccgtcgcagggcccgccccgctccatcacgcccacccttgcctggatgcgtcggctcgaggagagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccagcatcaaagcggtggcactaatccaacaatctgaacattaataagattttccccattgtgcactagttgaactaagcatggctaagcaatccctagtccaatctctagtcatgttataaccccaagctgacaaagggacatggtacaacaatagcatggctatgacaataggtaaacaccccatagtaacattataaaacaatgcaatatttgaaggaaaaaaatagagcatttgcaatataggatcaacatgttcaagtgacaagcatgacttgccttgctctgctgctggaggaacctcggcgactatttcgaagtacaccggagcgtcggaggaaccggaatctagcgacatacaaggcaaacattgcaaacaggctataagactactgaaacagagaacaaaaccatttttaaaggattctacacaattttcttgatttactgagacttgaatgggcttaaacggagctcggatgaattagttatgaattttagaagattcactgtgtttattactataacaaaaatccttaaatattttattgcgcaatattttcccagggctgacgtcaacac

SEQ ID NO: 23337 - DNA, 2652 bp, Oryza sativa
ttccacaggccaattccgaattaatattcgcattgatttaaaagggtttactcttgctttgcaccggtattttcttagggtcatttataaattaaatttaggcttgggaggagaacttcggggtgtgacaccgccgccggcgaccacctggccgtgcgccgccgccccgctcgcctgggccgcccggaccccccttgtcgcgccgcgtcgatctcgtgcgccgccgccgcccatgcgtgccgcctctcccgcgccgcccgtcggtcgccgtcgccggagaccgcgctaccgccgcgccatggctcagctaggccggctttgtgccgtgctgtgccccagccgcgccgcccctggccgcccgatcggcttgggccgatccggaccgtcggttcccgtggaccggtggtggaccggcgcccttgtgccgctgaccggtggggcccgcttgccggcgccgcccctccccctttgatgacgtcagcaaccgtcttttcctttggaaaaataaataataattgcgtcataattcgttaataattctagaaatccatttaaatggctcaaaacttctaaaattcatatctaattcattcgaactccgaattgagccgttcaacttgcaaaattcatctaaaattgagctctacatgtttgtttagtttttatgtactgtttccttggtttttattagagtttttcctcgttttgcgtgccagcgtgtagttcccgtcgtttcggaagatcgcgttcgcaaggataagagttcagaagatccaagtgaagaagcaaggcaagtcacacattccctttgagcatgttgatcccaatttataaatgttttaccgtttacaaataaatatgcatgttttgctaattacatgggatccgggtattacctatctgctcgcttgtgccatgtttacttgatatctgttctttgtcaaccttagataatgaatcgactagctcatgttacttatgtgacctagctagaactatatgcttagccatgcttaattaccactagctcagttgatgggataattacagtattagacctttttagtatcagagtgagctgcgtgctcgagacatctggccatgcttcatggtcgtaattatccaactaaaatgcgactgaatggtgggctgtggctgcatggttttgctggtcgcacccatggcagttaaggaccggttcgcgggatgccttggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcctgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacagctctgataagagtaaagctattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttataaccgcctttatgcaaatagccacaaaccatccttgtatccccttgcacatctgcatcgttggtgtggcttgctgagtacggtggttgtactcagtcttgcttttattcccccttttcagaagtgtagtacttctgagctgaagacgaagttagaggaccaaggctcagaccccagttgagttttgcctgtggagtggagctgaagccccgctaggatcgccttttccgctgctgctgctttcgtttcggtgcgaggactaagtgcctcttttgtaagtattttacgctttatttacgtttggaactgtatattacttgtcgttttgtgtaccctggctggtcctggacaaggatttaatacacaaaatagtctggagatttgggctaaatttctgggcgtgacaagagagatggagaggggataaggttcactcatataggggataaggccgatgcgtcggcctagattggctcggcagctcggctcagtttggataggtgccggtttttttaaaaaaactgatacctaggtgcctttttaattaaccgacacctttaatatattaaaggtgctaggttttaaaaaaccggcacctatactatagatgtcggtttttctttagaaccgacacatatagttgcttaaatgtgtcggttttatgtgttttcagcctgtggaggaggtaaaatcactataggtacatgttttagttgttcccgtacctatagtgctgatttttatggatttttttttagtagtacaccgtcatgacttttgcaatgcatgataataataccacaccgtttctagctaccaaacggctccaaagaataggtcacattgtcatcgccggaaatattctccaaccgagatgctctaaccagta

SEQ ID NO: 23338 - DNA, 644 bp, Oryza sativa
ttcaagcctctaactgatatattatcttctgataatttcttgtgttctatgtccgtacaagccattaggatgccaggctttgtggatttggagatatttgtttttttcaaccattacacatctgtcattgtgccaatttggtttcaatggaagtcatgaaaacttagcttgctgccttactttagccaatttgtgtcattatgctaatttgtcttttcaatgcagttacccccccttttttgatgacattgctgctcgtctgcttctagtcatcccgttgataatttataggcttattgagaacgatgccacagatatcgcagatagagtccttgcagtttattctacctttctggccttccatcctctaaggtttacatttgtgcgtgatattcttgcatatttctatggtcatcttccatccaagttaattgttaggatcctcaacgtgctgggtgttagcactaaggtagaccctatatactctttgagttattatggtgcttcctcctgcccatcttggttaattctttactaatgtgtgcaatttatagacacctttctcagaatcatttgcccagtatctagcgtcatcaaattcatctatttgtccaccaccggaatacttcgccaaccttttgttt

SEQ ID NO: 23339 - DNA, 1665 bp, Oryza sativa
catgaatggcttgaatctacccataccgtcatcaagcatcttcggccagtcaactcagttgccatgttaagaattgctttccgcatattgggtcccttgttgcctcgtctagcctttgctcgacctctgttcatgaaggtattcttggtttgcttaccacttcctgatggttagatttttgcattaataaattggaattgattttgagttaactgctggggacaacttcgtatgatattggcgctttgaactggatcaatatatgtttacttgcaatcagtagctattacaggatcgtgctttgtctcttaacatcttcaaaattttatttaattacatcttttggtggcataacctactaatcgaacacagaaaaaaaacattatgtagttttctgtattgctttgtgttgtccttttatgcaattaagctaaaaaacgaactgcagttcacttttgctttattactctatggtccatgtacatcctattacgagatttgttcatcttgacctacacaccacagtaattctatatgaagaaactactgtcttccgttctctactaatttagtatatgctgctgggatctacagaccttggctttgctgttcaatgtgttgggggatgtatttgggaagaattctcaggcttcacctcctgtggaggcatcggaaattgctgacataattgacttcttgtaaggcgcacttcatcttttccgcacttgtcatcttccctggcatgcagtttgtttcagttctccttctacactaattgttactgcataactcattctgcattatattctcactgcatcgttctctatatatagtcttataacagttattttttttctttgttgctaaaataggcaccatgcagtcatgtatgagggtcaaggaggtcccgttcagagcactagcaagcccaaactagagatattgacgttatgtgggaaagtaatggaaattctgaggccagatgtgcaacatcttctatcccacctgaagactgatccaaactcttcagtttacgcagctactcaccccaagttagttcaaaacccatcttagtattacaaggccatggaggagaactgacatatttcagtcggaaagatgggaggttgttcgaatgtgtttctagaaggcgagattctaattgccgctgcttgttaaatgaaaatttgcttgctccttatggccatcacaaattcatgaatgaaaattagcctgttaaatgaaaattacaagttcatgaatgttgtaaaatagaccagacctcatcccctagatcttgctggagggataaaggttgatgatttacagtagttgtaactaatagcttcattaggccgggatgtagattgagattgccctagtggttagagagagacattattctcccgatccatgttttcactttgtagctagcgttgttgtacatgaatgtaaaatacttgattcacaatttataacataaacaccaaattctatcaggccaggcataccattattcgttactccattcaagttgcagctcgtcagagctgtatttatttgcacgacctcaggaatgcgcggcaatcagtggagtgatgctattagacaagcacctggttgatggtcaaagtcatgcctcgccatccatgtacggttcttatc

SEQ ID NO: 23340 - DNA, 5889 bp, Oryza sativa
  unsure (1)..(5889): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacaatgcttcttatctcattcccatgaaatgcaacttaccacatgcagactgtaaaccaccacgaaagacatcaaaaggaagaagtgaatacctccgtgagaagggaagcttcaggagtagcgtcgacattgcattaatcatgtctggcatgtaaatgaactgcatgatcacaatctgcaggatccaaaaccacaagttcttcgtaatcatctcagcagcgtgccttgcaatagcatgcccaacctacaacaaaaggcacaactgtcagttccaaatctccaatccaccgcaactaaccaaaatcacacatgaacccggaaatcccaagtccacctcgtgcccaagcacagtagcaatctcagcatcagtcttgaaatggttgagcagtccagtaaagactacaatcttgccaccgggcaagcacattgcattgatgaggtcatctctgacaacgatcacctcccaattgagcccatcaagatgcctcgtctccggctgtgctccccgtgccttcccacggtcgcggctctcggtgacccatctgtcatccagaacctcctcgtctcgctgggccgcggcagccacgctcgcgttcttgttgccacgggaccggccgagcatcacgtcttccgcgccggcctcgtggttcttgatgacgacgtcggtggagatgtcgccgtaggaggcgtcatccgcggcgaaggcgtcgtggtgccttccagcgaggccgcggtggacggcgcggacgacctccgaggcgatgaggcgaacgcggatgctgtcggggtgtagcggggggaggatcttggggcccagctccttcttgagattgttgaactgggactccccgagctggcgctcgagcgggggcgagaggaggatgaggtgggtgcgattggtgtaaggcacggtctcgaggttgccgaagtagacggccgccgcggcgccgcccgagacgacgaccaccgtggtgagcttccgcgggtcgtggtaccaccgggacccgcgccggcggttgaagtggactaccttctgccgctgcggggaggtgtagaagtaccgagacggcggcgcctgcgcaggccgcggcggcggcggcgggcttcggaggagcactcggccgaagcggacggcctccgggcgactcggggaggtgaagtagtacccagcgggaggcgcctgcggcaacggcggcgacggtggcagccgcgggcagccggtgggcttgtggcggaggagcctggagaggacggagcgcgagttcttcaagtaattcatgttcttgttctatttttgccccgtattttggggatttttcgggggcggcgtttgatcgctgcggggaatgggtgagggggtttcaagaggtttgccaggtggcatatggcggtgagtcgctgggcccgggagaaacttctaggcgcgccgcccaagtcgctcatttcgggccgaccgctcatgggcccaacaatgcaatttccggcccaatttggggtagcgctcaatccagtcatacgaattgttgcacctctattaattacttaagctcgagctagctcgtaatctctaacgagctttgaagccagtttggctcgttaggaaattcaaacgagtcgagctaagttgagcctagcttgtcatgaaccgagcgagctaacgagccacgagcttcctgtccattcctaagcctacctcatggctgagcaccgtggctgctagatcggcgtccttccggcagaatctcctgaggtaccaaccgaataccacgatcagtgttgatcacacgcaccctccagttgaggccgcggacggcactatacatgctcggtcctctccgacagccgatccgctgctcgaaaacctcgtcctcgcacgccgccgcgatgatgtgggcggccacacgccgcacccggactcgtgtcggggtggccgtccgggagggcacgggttaggagcctaggagcacctcgtcgcacaatgtcaagctcggcctactcgcggagactttgctgatctccttgcgcaaccagacgaccgcgcggagccgatcgacacgactgccgccgcggccgcaacgcgtggaaggagacgacaagccaagcacctagggctgcagtgctcgtgttgttgtgactcaaaaaacacacggagaaaaagcggaacaaagcggactcaaaacacacggatacgacaagccaagcacctgggccccgctcgctcgctcacatcgtgctttgctcctccgcccatcgtgctcgctcgctcgacgacgacggcgcgctcaagcgacgtccgcgccggatttggtggtggtaaggggtcgacgcgcaatggcaaatccgtcggtgtcggcatcgaatcagaagtcgggcttgggagacggcagagaatccggcggtggtggcggcgaatagcaagcaggggagggcggggatggctaggtggcatcggcggagaatccgaatacgcgctcggacgacgccggcgaatccggcggcggtggcggtgaatccgaagccggggagggcggggatggcttggtggcggtggcggtggcaaatccccgtcggtggcggcggtgaatccgaaggcggggagggcggggatggctcagtggcagcggcaaatccacatcgccgttgtctctgacgtcggcgctactcctccttccgcccgcgccaatggtcaccgctcctccttccacccacaccgccggtcgccgtgccgctccgctccttctgccgtggtgctaacgttactccaaacgacattcatcccatccctacccatcccttctaccaaataaaaaaactagattattccatccaataaaccaaacaagtaaataaatggaatcaatccatctctaaaatcaggatggtatcatcctatcccacgtagtctcctaaccaaaacactaccaggctagcgatcgagcctctgtcgggccggtctcggcatcctgtttggaacttttgattcgaacacgttctgcggtgctttgtccatctttccgatgttttggttccttcacaaatttgcaagtgcacggtctgtgattaattactgaccttaaaaatagaggctacgttacatgatctgacagaatctgctggcacttgctcttccagtcctacacaactacaagagaacaaaacatacatgcttgagagcctaagattatggttgacatttcataaagctatgttcggcatagagggttagcgactaacggccttatttttccagttatgtttataattatcagttaaaatttaaatttttaacattaaatttgaagttgattttgggggtcttttcactgtttatttattagcctatgcttttagatcattaataacacgtgcataaaaattttattcaaaaataatttttcgttagataagtattagctttaaaaaatttttgaaaaatagattaatatgattttttttaaaaacaacttttgcataaaattttttcgacaaaaacactcagttcgttaagcgtgtacaaaaaaaaaaaactataggtggaagttaggaaagtggagcgccgaacacactctaaatgatcaatagctcacggcgatcagagatgtacgaaaacataatcagcatagcccgtaccgataaaaaattgtatatgtacaataatatcagggaacaatatccctagtggtttggttgagtgctcgccttgatgaccagctatgtcagaggacgacctcctcgagcggaggaccgtgaggcccctcctttgttagttcggccgagggcagcgagtgaaaattgaggaactaggaggattgggagagatcgagggccgggagtcgggcccccgatgaagatgagacactagggagttatccaggttcgggccgctaaaaagcgtaataccctactcctgtgtatgatgatttttctgagtttacaaagtctctgaatttctggtgtacaagctagggctaagcgttccacctcttttttcttctatccccctcttcactggacatggacctccttttatactccaaggggttcccacatgcaccgggtgtgcttcccagtgaagagggaaaatattctctatattaaatgtttgtctcgtgccacaatctggaagtcatctgagcatcggctgctgtgcagggcccatcaaatcatgtcggctgacgtaggccgacacagggaggatccccgtcattcaccatttaatagatgtagacttccggcgcgcacgcactggaacacgatccccagtgtgtccaaagcggtcaagccaacttcggatggttgagaggcgttgtgcctcttatcatcgcgacgagacagggcatacctgccgcacgccgcctaacaccaggctaacgcgcacgtggcttcccgctgtcctgtctgtcattcgaccggccacgcaccggtcacaatttggtcaagcgcgcagcacgccgcattcaatgtggcgtggtgcgcttgctctgcccgcactaaaagcggttaggtgggcgtagaggggcgtccacctaacctcacttgcatgacggccacgtggtgaccgtcccgatgggtcggggcagcccagggtcgggctagggaggggtggctaccacctatccacgggcccgacccctcgggggaaaacgccacgtggacattgggggggggggggggtaatcttctaaagttggctcttctgctaactttttgattgggtccacatggcacccctccctttgacgaaaaaaaatcatgaattcatactagagaaaataatctgagaatcaccggtgagaaaaaaaataaattcatcaaatatactatgcctactccaaaactatcttccccttacaaatcacacaaacttccattcatttgccttcttcaaatatactatgcctactccatagtaggcctaaaaatcttgtggaacaaaaggaaataaaaagaggtcttgcagatgcaaagaggaaacttgattgtggattttatgttacagattgcgttgcaaaaaaaaagaactcttaatatactaaatgtttgctctttcaaatattcaaacctacaagtgtacatgttggaaccaattaatttaattgaatcttaaatttgacttgcatatattttctcaaaattgacgtttactataaacatggcattaaattctatccttttgcttaacattgcatacgagtttatatttatttatgataaaaatatttttatttctatgcataataaataaattatttatacatacatatttttttcaataccatatgtaccaatttgtcaaaaccaaaataacggttcacaatttcatttataaaatatttgatgaaaaatatcaaaattccaaaaaagaaactgaagtatatatatgtttcaaattagtaagcgcacccctagcgtgtttattttacaaaagataaaaaataaaattgtcgcccattttaatcatgtagtatctgttaggtgatagaatcatcttggatttttggttctaattatacttttacacccaaaaggcataccagcattctggttgctaagataaaaaaaagttcactataatattattacatgctacactaaaaattaaaatatcactaagaggccttattaaaaataaagtgtatatttttaa

SEQ ID NO: 23341 - DNA, 1030 bp, Oryza sativa
gagactcgccgagagggagggagagagagagagagtgagagaggtgaagaggagagagagatagcatattggcaggtgggccccaccatgtttttttaaaagaaaatattgactgggctgccatgtgtgcgtcacgtaggataaaaccgctttagattacgttgagggggggtaattcgtccgatattaaaagttcggggtgagtcatatctggttttcgggtttaggggggaattcggccgaccgcgatagttcggtgggggtaattcgtactttttccataactaaataaagcaacttttaacatgtatatgaagggaacatattctatgcaaacaagctttccgtgcacactaattagcaaatgtcacgaaaaattctataaaagattgtacacttacttcaaatagtattgcacctacatgtgaaattttatcttcaaattcattatattttagccataataaaaaagacaaaattctgacagatttttgcccttaaaattatcagatttttcactttttttattacggtaaaatatagtgaatttgaagtgagactttctagatatgtgtaatatgaataggagtaaatgatttttttagaatttttcgtgacatttgctagttggtgtacacagagtatgcacgagaagtttgtgtgcatagaatatgttcccgtacatggacaaatatatgtttagatgaaagttaaaagttgctacattcttaaacgaccgaatgcgggggggggggggggggggcgtatttgccaacaacatacctcgtggccgagcgtcgtggctaaatcgtcgtccttctaacagtacgcgttgaggaacccagtgaagaccaagatctcaccgctctccaaacaacccgtaaggctcttgtcgtcgttgatgacgtgcaccctccagttgatgccggggagaaagcggtgcccgatcctctccgacagcctccgttgcccgaacaccgcatcctccagcgtcgtcgaaacgatgttggcggccacccggcgcacccga

SEQ ID NO: 23342 - DNA, 1262 bp, Oryza sativa
aaatatgaaaacatagatcaatatgtgataaacatgcaaattttaaatttttaacattgaaataataaacatccatatgccatgagataaccattcatgatgtcggctatcgcattagtaatttctcgttaaagactctcttagaaaagaaaaagaaatatctttgaagggagcttaagccttaaaggctatgcatgcacatgtcgttgtacggcttcacggaacacctccaatgcctcccccatcactttctcctgcctaacttccgccgcgcgcctctgcaacggtggatgtgtagtaccctccccatttccaaacttcatgagtgcctcccagaagttcgggtttgcacgtgggtcatatcctgccgcagcctgcagcatgaggccgatgcggtctgcctctagttccgttctacgatgatcacaaggcaaaacacagtaggcgttaggcttattgagtaatctgtgttatacatatgtacatgcatatacgaggtgtcacctgtggaggaaattccgcataaaaagggacacccactcagcgtgcgggatcctatcgaccggaacatagaggagctcctcaacaaagttggcaaggacggagacccaaaatttgttccgcttcctctccacacggtgccttgcgatgacatgcccgacctgccaagaaagtttaatgtatgtaatcatctacccctgtgtttcatattataaatcttttaacttttttctagtcaaactttgttatgtttgatcaaatttatagaaaaatttagcaatatataaaatattaaattagtttaactaaatctaacattgaatatattttcataatatgtttgttttgtgttaaaaaatactgctatatttttctgtaaactaaagtttaacttagaaaaaagtcaaacaacttacaatatgaaacggaaggagtactggagattccttcgcccatataaaaaccatgtatacacactaatcttgtgtaatagtactacatctataactaaaggaaaaagtaccaattacccctcccccgaactatcgcggtcggccgaattaccccctgaaccataaaaccggacattcttgactccaaactatacaaaccggacaaattacccccgtcgactaatccgcggtggttttggtttacgtgacgtacgcgtggcagtccagttagcattctatttataaaaagatgtgggacccacctgcctactctttctctctcttctctctctcactctttctctctct

SEQ ID NO: 23343 - DNA, 752 bp, Oryza sativa
  unsure (1)..(752): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgggtctcgtcctctcctgcggttgcctctgccgcagccgtagccgtagccgtagcctgtcgccgccaccgccctcggataggctggatgttcatccatcgttctggaaatgggagaccgagccggagcgcggccgcgtcttccgctgcttcgacaccgacggcgacggacgacacctctcggccgcggagataagggaattctacgggtgcgggaaggccaaggagacggtcgccgcggcggataggcagaacggggacgggttcctcagcatcgaggagctccgcgcggtgatggaggacggggattcggaggcgctgcatgcggtgttcgacgagtacgacgaggacagcatcgaggagctccgcgcagtgatggaggacggggattcggaggcgctgcaggcggtgttcaactagtacgacgaggacggggacggtgtggtcacggcggaggagctgcggcgcgcgatgcataggctcggcggggtggatctgacggccgag

SEQ ID NO: 23344 - DNA, 9788 bp, Oryza sativa
tcctgcagccctaatagatcgctccgttttccgtgcggagtcactatgttcccatcatccacatgcgaacacagccttagtcgtcattctccttcgccagtttactgaagaagctcccgtcgtagacggctctgacggtgtccttgcgaaggatgtcgtccttgtccttggcggcctcgaatgtcgcccgccactctgttgcagcctggagcctgcattttctcgatcttaggccgagtttactttcaaaatttttctctaaactttaaaatttttcatcacatcaaaattatcctacacatacaaactttcaacttttccgtcacatcattctaattacaaccaaacttctaattttggcatgaactaaagacacccattactccaacaaccacaggtgaataaatatatatagttataccatttatgattcttgaagcactaagttttctatttgatagactaagttcctaattaaaatagttgtatatatccggttggatatagatgccgggtaaaaaaataccctatgattcttgaagcaacaagctagcaaaagattaccatcctgagctgtctttgtgctctgtatgatctgcgtatgcatgaagcatctcgtccagctcgtctgatgtcaggccgtcgggtacagtttttgcatgcctggtgaatatctcattgaatttttcactaacaaacctgcatagcagaggcctagtctagtttagttctcaactttttctttaaatttttaacttttctatcacatcaaaactttcctacacatataaactttcaacttttccgtcacatcgttctaatttcaatcaaattttcaattttagcttgaactaaacacacccaagttgagtatagccgtatttaggtatttttttgtggggcttcctcggaatacatgaattttgcatgattctcacatgaaaaagtttaaatccttaaaaattccaaaccagataagcctttactagtttaataatcacaaaatgcatgtggcatctagtactcgtttataatctagacacgttcccaaatggatgaggagagcacggtgtaccttccttcagaatcgaatgcacccgtatcacttccatggatccctttatgaatgttctgtacatagatagaaaaccatgacccatctgcgtcttcctgcatgcatttggaaaagttcaactcttgaggttgtcatcttaaatatgaggtgaattatgcgttgaatgagaacatatatataatataaattatacaaaggcgtcatgcgctgtgtatatagaaaaaaatatgtggtgcaaactttatgtatattgtgcaaagctgaaaactatcgtaggataggaaaatggacgtataagatttatctgtctccatgaataaactatttactctatgtatgtatgtatatatgtagaggttgcactacatattttttttatatacgttcacagggcataagagagatcatacaggtctagttttggggccgatgtcgccattgatgaaggtagcactcacggtggcgccgaaaatcccaaatccgagggtgcggagccctggcaccatataaagtccaaaatgcagcctaaatcacatccctttatcaattgaaaaagcatactaccctcatttcaaaatatatgataccattggcttttcgcatatcgtgtgataattcgttttattaaaagaactagtataaatatattaaaaaattagtataaatatgtaaaagtgtaagttaatattatagttctttgatgataaaacatatcacaatagaataaataaatttatataattttttaaataagataaatagttaaatattatataaaaattaacggtatcatatattttaaaatagaagagtaaggccaagtagaaattatcgaatactctagcagagaaaatcaaggcagggcgggcgtggccacctctgtacgtctcgccaaaggtgatgatgccgtcgtggtcgctgtcgaagaacgccacgtgcttctgtagctccgttgccggggcgtcgccgcccaccgccgccggctggctcccttcctcgatcgtaaacataattggaaacgaaacgcgcgtgccagaggatgactagtactcccttcatctctaaatatttaacgccattgatttaaacacatttgactatttatcttatttaaaaaatttaaataattattaatttttttctaccatttaattcatggttaaatatacttttatatatacatatatttttacatatttcacaaaattttttaaaataagacgaacagttaaacatgtttaaaaaaatcaacggcgtcaaaatttagcgaaagggggagtattaattacaggggccttacgtacagaagcatgcggcggacaggaggaggagaggcacggccgcgaccgccgccatatcgttgtcgccggccagggacgacagccgccgtcgtcgagcctccgctgccgtttccggctgttccgagccacctctgcttcttgatccctcgcttacccgctgaaggctgtatatgtgctcctctccctctggcgccacgtgcttcgcgtgtttctacgatcggctaaaattttccatgcaaacctatcgcttgcaggcgatactcacccaaatagtcaaatactcagcatctataataatggtgccacaaatctaagctccacacagtcggattttagttcgcatgattaaaataacattagtaagttacggttataatcaaaggcaacacaaatcattaatatgctaaggtgaactttaaaaataaaagcaatctggttaaaatacacaacataaattaacttttatctagaaaaactatcaacgaatatttacaataaaaatatataaaagttattgtgtaattataaactaattacacatgtaactatagtgtaatttgtagttacatatataattactgtataaataatgtagttacattcactgactagcacgtgtcatgtagagaaaaaggactcgccaccttgggaacaagttgttcgatcggcttgtctagatgcactttgaagcttgcacgaatagtgaagaagattagatggcagacaaagttactttatttagccgaaaaatatgtcgacccgaagttatatgtgaaatatattctgatttttaagatctattttatacaaaatgggaaagtatttctcatgtttttttcatgtcacctagatagtaaaaaaaatacaagatatattactatgagatatataacttcacaaatatgtaagttgaaattcaacttctacaaattttagtaaaaataaaaaatacagctgtgaatccttgtccatacgaaatagaatatatgcatgaaattagagaggttgtgagtttaatccctaggtcctggcgcacttgtaaatttttttcctcctccacttgtaaatttttttcctcctccaccagcacgaatcatgaggcgatctgacagctacaaattcgaaaattttatggtagaaaatctatcgcaagtttttttagcagttatgttactatttgcgtgtaggggtgaaaacgggtcgggttcggtcggatctcatcctttccgtatcctaacccacattttaaaatagggatcgggtcgggcacggatattatcggatacgaatacaagcacggataatgtcgggattaaatacggaacgaatacgtaccaagtcagatacgaacactatcggttacgaatccttattcggatatcaaatcaaagcaataaccatatataccacataggcaatagtcgttcaatcattccatatacgtataatatgaatatatattagagacttagggaatggtaatacctatcagcacaacagatccaaagtaggcgtacagactcaaatactcaatggtgtagaccatagttcacggttcagcattttgctttacgttgttgctcctccacacttgtaactttgtccttgacacagatactagtgtttgcattaccactagccattctatcctaatcctacagccaaacagtaaaagtaaaataaaacactgaacttcaagtcgtaaggtgatgttgataaagcaataaaacactgaacttttgctcacctggatgacctgctgagaggtgactaccggaagagatggtcggcgcctcggcggtggtaggcggggccttgcgacggtggtcggcggcggtcaacagcggccagcggccagcgggcgcgggcgcgcagcagcgtagccactagcagctagcacagcgcctagcggctagcatgcacgacgccggcggcggcgccggctgtgcgcctgtgcctcagtgccagtggttggttgctcgcgtgcggcatgcggcgccctcaggctgatgcctgctcgtctccctggtggttgtagcagttcgggtcatatacgggtagttaactgggtaatacccgcataatttaccggatacagatactgtcctcccgaacccgatctcgtatccgctagaaaaaattcgtatttgaatccgatatccgtgaaagtactcgggtacccgaatttttgacccgaatttatcccagattaatacgggcgggcggcggacgggaaatacccgccccgttttcacccctatttgcgtgtgagaaataagaaatatttcccactaaagcagtgctctccactgaccacgtagcagcaatcttaactactaattgattcattgatttatgagtcctactatcagtaaaaaaagatcattctattatcgatagttaattatatatggtagtgtatattatagttaaccattgattcatcgatttatgagccctacaatcagtaaaaaaaagtcattctattatcactatttaattaattaatatggtagtattacttatgtggtattcttttctcccgtagatgaagattaagtggtttacgcaaagtgaggtggtattaacgtatgattaattgagttttaattattacaaacttaaaaaatagatttatctgatattttagaacaactttcatatagaaagtttttgcacgaaacgcgatgtttagtggtttgaaaagcatgacacaagtatctaaattttcatccatttctcatcgtaaaaactactcataaggagcatcgtaaaaactacatctttccactatgcagaggggatgaaattttggatactcgtggcacgcttttcaaactgctaaatgatgtgtttcgtacgaaaactttctatatgaaagttgcactaaaatatcgtattaatctattttttaaatttgtaataattaaaactcaatcaatcatacgttaatgccatctcgttttacgtaaaaaacttaatcttcatcttcggctgtgtttagttcacaccaaaattgaaagtttggttgaaattgaaacgatgtgatggaaaagttaaaagtttgtgtgtgtcggaaagttttgatgtgatgaaaaagttgaaagtttgaaaaataactttggaactaaacacggcgttcttcttcatcttcagaaaaaaagaacaccaaacattaataggtggattgaatcgagaggccgtttgtggattgaaatcattatactagtgcttgatctcccagtcagggagaaacaacaaacggcttaatccaaagcccagactgttcgtgtgaggaagccagaaaaggccatcaccgttactgaaacgttgttcttatatgccactgcttttccgccatttggcgaacggtttcaacgtttctgcccttacgcaaatgcaagccactttggaacatttcctgggtaaatatatatggaccattcattttagggatgccttgacatgttctatcaatttagtacatttttccttccaaaatcccaatcatgcttggtttgcagagggacccttcttcttcgacgccactttactgaagaagctcccatcgtagacagttctgacagtgtccttgcgaaggaaaccatccttgtccttcccgagcttgaacgtcgtctcccactccgtcgatgctccgaccctgcattttctcgtggtacaaaagtagtgcaagcgaatacagtgagcagaccatttgaacagatatacatgcatatggtttctgaagctatcagctagcaagagattaccatcctttgtagtccttgggttctctgtttgcacgaagcatctcgtccagttcggctgctgtcaggccatcgggtacagtttttgcatgcttggtaaatatctcatcgaacttttcattgacaaacctgcagcagagttgaatatactactagcatatcaaaaagatgattgtgaattatatgtgtggaagaacgtaaaagaataatctatgttgcaaacagttcagacaatccaaggcaatttgctgaactcgcttgtatcattactgtttggagagtctacgaaatgactaccttccttctgaatcgaatgcgccagtatcacttccatggacccctttgtggatgttctctatatagatagaaaaccgtgatgctgttgcattttcctgcgtgcatttggaaatttggaaaaagcacaaactgtcagtttttttctttatatcacgcataaccaggggaattatgcgccaaacgaaacatatataaagatgtgacagatcatacaggtctggtcttggtaccgagggcgccattgattacggtcgcgctgaatctggaggtaacaactccaaatccgagcgcacggaaccctgcaggcaccattaaaaaaaatatcaaaatgcagtcttagatctcccttgaattgaaacaacatattaaaagaaattatgctgtaacaatttaagggagatataaggctgcgtttgacatttagcaagcagaaaacggaggataggacaggcatggccacccaccttcgtacgtctcggagaaggagatgatgccgtcgtggttgctgtcgaagaacgccacgtgcttctgcagttccgtcgcagcgccaaccgccgccgccgccgccgggctccctttcctcggatcgatcgcaaattcgtaatggaaaacgtagcgatcgagtaagcaaattaacgagacacgagaccaacaaatcagacgcgcacgcacgcgcgcgtgccacagaggatattgtgtgttacagggcgtttacaggaggacgacgaggcgaacaggacgagagccatggccgcagccgtcgccggagacgaccatcgtcgacgaacctccatttgttgttgggtcactcgcctctggtgctgcgtgcgcgcgcctcgtttgtactctccgacgatcggcaaaaatttcctatgcaaagctttggtcgattcgtttgcgggccaaataaactcgcccaaatacaacctataattagccaattccgtctccaacagcctatctatgagtctatctatctatacatctacttagctagtatatatctatctttaattttggcgtctagtatttacattgattgctttgtgtataatcgtgtatgaaatatatttctattttaaaatatgttttgtatttaaaagataaactatatgaaattagaaactaaaagatatatatcaaaactaatttatagaaaaatatgcattaaatctaattattccttatctcaattgggtatgaaactccacaaaattaggtgtaactagtaatatatgcccgtgtattgcaatggttctatatggttagagtaagtttcacaagtttatatatgagatgcgagcatgtggtgggaggagagaataaaagtaggacggctcttcttcttttataccgttgtaaaataaagataatccgctaacttgcttctttgtcatttctagtttagtgagcccaacctaatttactactagtagtattttgcaggaaaaaaaagtctattttgtctctcatttgtatgaggcagaaacttgtcccacgtatggttcaaaggccgagccccacccttgtaataatgtctcttgcctctgtttaaatcgcttcccttaacctaaaaaccaggcataacgtttctcccatctttaaaaccactgtaaatcgactcattcgtggtttcaaaagcggttttattgtggtgcttgtaggacccacatgtcaataaaaattaaaaaaataatcacacatgtcaatcatccttattgcctttttctttttcatctctactcccctatctctttccgttctctctctccagttggcggcagcgacatgccaagtccttggggcccacaccctatagccggccgacaagcttctcccctgcgcaccacccatcttgccaccgccttcaacggctcttggcgatgatgccatatagacaagcccagcagcagagagggacgtcacgacggcaaccgcgtcatctcgtccatcagtccctgccctgcacttcgtcacactcgcatggcttcgcgtccttctccctggaagccgtcggcatctttgcatcgcatcttcctcttccatctcctgactcctttttttccccgtgcatcgccaccacccccggtgatgctagcctttgctgccgcctggagagagagaacggcagagagaggggtgaggtgaggaaatagaaaaggagattaggataatatgtggggcagtaaatttttttttactgatatgtgggtatcacgagcgccacgtaagatagaactgatcctgaaaccataaggagtctatttacaccggttttcaagagatgtatggttgaggaagtcgattcaaccaggtctaagagttgagacggaaaatagaccaattcctttacgggctaaacttagcccaaacagagcaaattcctacccatgaagcccatctgtagaaacagaaggatccagtgcaggccaactccacagccgccagcccaacaagcgctaatggttcacggaccaactcgacgccaggtcggtctcggtccagccggcgtgcctccctcgtgctcgcgcctgctgcacacttgctcactgcaccaaccgcgccgccgtcgggctcgggccgccaacccgcccgtcgtacgctgcgactccgtgacttgatcgtgtcaagttgccacttggcccccccggtccggtcgagctgcccccgcttgaacgagcccgtccgttcgctcggccggaccggagacgattcttcgctgtttctgcccgtaattttgacaaattgaccctctgagaaaacttattttaaaaataaaccataccaaaaacttattgcaaaaataggccgtcgtctcagcgccaaacttattggcgctgaggtataatgccttagcgccatgtatattagcgctgacatttcatctgagatggtaaaaaaatttgccaagtcactggggttagtggcatagcttacggcgctgagctattgacgttgaaaatgatcttctggactttttggtttgcatgttctcgtgtagtgtggtggcaggagactttgcctctcatctcattaaccacggttcaatccctatgttttacatcctttggatgttttttttatttttatagcatattttttattagtcttataaattaggaacaactaaatttgagaacataaattttatagcattaatacttatattcataaaattttgaaagtacgcagcatttaacatttcatatgttttatgtttaaaacaagatcattacacataaatgtaagaaatgtaattttaaaataaaaaattaggaggtaagtgttaacataaattacatagtatttatttttatagttatgagtcaaaagaaccataatagggtg

SEQ ID NO: 23345 - DNA, 10111 bp, Oryza sativa
ataacgctgagccgccggcctatttttgcaataagtttttgacacggcttattcttgaaataagttttctaaaaaagtcaatttgtcaaaattagtgtgtttctgcggcgtgaactgcaactactatacggcgagcgtcgttccatgcaaacatggcacacgcagctcacgaacagttaagaaaccaggcggaagtgagagttaccagcattaacgcctccttcatcaaaaagagaaaagaaaaaaagaagcaccaaaaaataaaatctttgtctagtggttttgtcttcgttgacatgtcacagcgtcggtgacgcaagtttatcgtcgtctccctctcacatacttacgtctctacacggtaaaaagcggattccacttccaccgcgaggaaggaaataaagcacacaccgaatcaccggcaccaaaatttccaccgatggttacaagcccgaaacgacagattaattaacacgattagttaaactttcacgcccggtgtggaggggtccaaacaaaacagagggcgccaagttgtttttatcatctactagtcctacttggctcgcgtaagcgagagccgggacttgtcactagtttatctcgcagcacctaacgccttgacagcgaggtcgcgttgcatacgtggaccagagcaacacaaggtgcccagattgattaatcatctcgtctcatctctttctaagcactgtattatgattatgattatgattattattattattgccccgtcaccgtgccgaccagccccaataattttacggccccagacaaatcttattgccctccctaagtcaagtcagtctacgcattaatccgagccgatcggggtcgccgtcgggcatgtcgccgtcgatcggcagtgcggcgaggcagcaaggcaccggttggcttttcttcttgttttttttttttttactcattggagcagagaaaatacaggggtgcacatggccccatccgttcttatctgcaggccacgcttttgaaaaatcgggggagcctagtgacagcccatagggcgcggcccgtggggcccagatgcagtcgccgtcgagggaaatttcggttttttggcagggcccggttgttccagatgagatcctccccgtagtaattaattggttattactgctccagaaagggagaagtgtgcggtgtcatctctctttcccctctgaaaatgctgtttaatttgaaaacgatgcgtttaaagtttgtgtatcaagatgtgagattgagagtgagagttcggtccactacgtgtcgtgatcttgcacacttgtttcaatcgagcaatgtagtagagagggatacttcttctgcaaagcgaaggaatctcatttaatttccagccacgggtaagaaccaagataatcgcggtacacacgctgagataaggaagagcgtgtccacatgtagctgtcgatgagcttaccagcaggtttatgagctgtctggtgtcagtagggtgagtaattgcttgattttctttttgctgaacacttcaattaccatcaatcagctcattaattgtaccgacacgaaatggcactggtaattactgcggttcattttgacactttttgttgcttcaaaggaagaatctcgaattgctttcgcaatgtggtgttttaaattaattggcttgttccagcttcgatctttttttacaagatgccgaatcttcaaactttctaaaattctcgcgccgttatttcgccgcgacgtacgtatacacgacgacgacccctgcaaccccaaatgaagagtcgtcgtcgtcggcgtgctccgatctccgcgcggggcattcgtccgccgtcgtctcgctctccggtgagggcggccaaaatatatggtgctcgatcgagatgtgatcgagcccggccggcctgccgcttcaccgggagagcgaacacgacgccggcgacttcgcgccgccgcccgtgctgtgctcgtagcccgcccgtttcccttctcgcgcgactcagctcgctttgattttggttgggtttacagcgcagactgcagcttgttggtggcgtgccgggagacgagccgctcgagcgcctcacgcatccaaccgtgctggcatccatccatcgcctgctgcaccgtggcctgcacaaaatcgaatcggcatttagacgcccgtgttcgttctttggtcgatcgaattcgatcgttctcgccgtagaatggcgaatttccgtgtatcaaagtgcgatgggggggtcatgtactactactactcacccaggtgcgcttgcgggaggacatctcgggccactggaggagctcgtcggtgacgcggagagggaacatgaagccctcgtaggtggtgtcgtagcggcggctcttgtagtaccagcagccgagggacgtctcggtgtcgccgcggacgccggcctcctcgagcgcctcgcggcgggcggcctcgtccatggactcgtcgagctcccacccgcccttggggaacatcatgccgtgccccttctgcgacgtgatcaccagcacctccatctcgccgccgctgcgcacccggtacgggatgcaacccaccacgatgcggcccccggcgctcgtgtaccgctgcagctcccgcccctgcctcgccaccagcacggccatcgaatctttgattgttggagagagagagtagggttgtcgttagggttagaattggtgatgcgagaggatggtgctttgcggccatggaggtggagctcgcgggtattagtagcgggaagcgcgtcaggtcaatggaacgctgtcgctgtcgcggccgaatgagcgatggggtaacatggggtatggagcatggacgagcccaactggtgcaaggttggtggacgcagcgtactgatcttctgtggctcagcttaagttcgaggagccagattccgcttggcctcatcatggcctggtcctagagtacctgtttctctttttccttataaaaaaccgggataacatctactctaagaagaccctgtttagttcccacacataaactttttatcatatcacatcgaatgtttggatacatatatagagtattaaatatagacaaaaaaagttaattacacatattgcgtgtaaattgctagacgaatcttttaagcctcatttcttcatgatttgacaatgtgttgctacattaaacatttgataatgatggattaattaggcttaataaatttgtctcgcagtttatacgcggaatatgtaatttgttttattattagtctacgttttatacttcaaatgtgtgtccatatatccgatatgacacgctaaaacttttcacccctgcaactaaaaagagcctaacatagagataacctggtctttcttgtgcgtcttgtgcagataagtaaagaaggaagaatgtgtaaaattcttctgggactgattggtttcctactatttttcttgaccactttagtgtatgtctttattaaagctaaaaaaagatgatgatttctttgcaactctaggtatttgatgttataggtcttgtggttaaccatagatgtaatttattagcatgaatgcaaattaagtggtgtatttcaccttatgtccgttgtccaagagaatattcagaattaagtggtccttctcatgaaacatgtcatgaggagactccctatcctaaaacagatcaaatcctgcgtataaatttaggccgagtttagttctaaagattttttttttaaacttccaacttttctatcacatcaaaacttttctacacacacaaacttccaacttttccatcacatcattttaattaaccaaacttttaattttagcgtgaactaaatacaccctaatacatatggttcttcatattcgtagtcagaatttatttttttatggaaagtaggaagtacctacacgtacatttcagacatcattgctatgtacttctcctgtgcatatctagaatcgattatatttgtggatagatgtaatactatatacacgtgtgaatgggtttagtgataaagcgtgtagcctgatcagcgggtatgcatgtgtccaaataaaagaatattcagatttgttttcaagctaatatatctctaagacattggtcatttgtaatccctttcattttgggtacaccaaatgaaggagtactccttttctttcttttatttttttattatagcacatttaacttagctattgtaatcactaaatcaaatgtcatcaacttttgttagatgattgattaagaccctcctcttatccttttccttttaataaaagggagtaccgttcattagaaacttccacaagaaatttgcaccccggttgcatcagctgtactgaaaagagtatatgtacaaagagtaaagtactatcagtaacttgcaagtaatgaatttttaccatagttttcaactttggaggctaaagttttaaagtaagcactagatgaatccttgcttccacatgtactggaccacaatgtgaaggataagaccacccagagaacaataaataggttctttggattaaattcgtcagatttagctatcaagatagactgttccatggaaaacaatttcatatccagaagatatcaacgtggcaacaatgttctttattctacgtttctactccctacatcccataatataagagataatggatggatgtaacatattctagtacaataaatctagacagacggtttgttcagactcattgtactagaatgtgttacatacacccattatcccttgtataataggacggagggagtatgttattgagaatccgtttgttgatcgtgtatatgtctatgttatttcatattgtagaaaggaaaatatatttgaacttgaaacaatagaaatataacgttgaagtgacaacgaatttttttaggagaaatatttctttttgaaaaaaaaacagaagtatatttaactctgtatgttaaaaaagaataaattaaatgaccacttatgacaaaacaagatatatgcaacgaggtgtctattattctaacgctacgtttcacagtattttttactgcatgctcaacacatcagattagcagatccacccatagtaaatgtaaggatatgagactgcatatatacttagtcacatcaagaaaatcgtagtgctctctgttaagcatggtcgacaacaaataaacatactacaactatctctctcctcaatctctcatttttcatgtaagtgaaaattcaacttggataaaattttactacttacatacggctgatacaccaattgtacatacccttaattaatactctcccgttcctaaccgcttttataaaatggccagcaaacttacttcaaagaatagtcaataaccatacccggttgtgaattggctgctaataaagtaaccttttcttaaactaaagaaaccctactggaacatgcacccttcctactactacttcctactccttccattttatattccattttatattacaagtcatttgatttttttccttaactaaatttttttaaatttaatcaaattgatagaataatatgctagtattttcaatacaaaataaacatattatcaaaatatattaatgttaaatttagtgaaactaatttgatgttgtagatgttgctatttttttctataaacttgatcaaatagcacggtacaaacgtatatgtccacgtgtaccctcacctactgtgaacacatatgtacactatgtgtatatctgtatgataatttccaaaaggctaggccgaaataaaggaagtacttcctactcaagtagaaagtggagtgccctgtccatggactgcgtccacgcaagtaggccggggaaacggcgtccgtgttgccgatcgagagcccgagaggtggagatgaagcggacaaagcgcgtacctacgggctacggctgagtggccgcgcccgctcccgcgcttcgcagtcgcttctctcgttttcatctgaacccatggatggattggcctatctcctcctccctctccggccagtcacctgcgcgtccctagtgtacacatccatcgctataagttttagccgaaaatcccgtcgatggccaagtccatcttcttctccatcaatttaattcccgcgcttaattaattaccccagcttgctctagctagcaccttgttttatcgtatccgactatccgtcggtgtcgccactgacgtcgctacgttgtctccctcctcccgttgagttaaattaattgcttctttttgttttgtgcctcgatcgacgaagtaaaccaatctgagctattgtgatcgtagtacaagttgcgtgacagggctgttttgcggcgacgttcacacacgcacactgcgtcgtcgtgcccgtctctgcctctcctcctcgtccttttcttgttttttttttcccttttttgaatcagtggccatctttgatctcttccattatggaaggcgacgacgacgtggtttaaatacggttcgttctcttgttaacaatctggacaaacgtacatacatacgagtaaagtacgtagcaatggcgcaagaaatacatggcgaccgatcgtatcacgctaatttggccacatgagaaacgccgtacatatatactgtaaatcgccacgtttccaggagaatgtgaaaattacgtgcgtacccgtgtgttttcacacggatataccggtgcgacggtctaattctgctgctttggatattttgttattagtgattattacaccatcgtcatccacgatcccgtcggtcctgccattgtcgccgacgcgaaattaagaagcagcaacgacgacgacagaaggggccgggccggggttaagctttccggctatgttgcaaccaggttttgttaaaggcgaataaaaggtagtattatttctagctctggttggcggacagtgtgagtcgccaggactaccaaccaacctacggttagttgtagttggttcttccaaccgatatcgtcaccatcccgcggcgtggtgattcgcacggaagtttcacccaatcatgctgcccatactgcgcaagatggacgtacggatacttgtcccgccgaaaagtcgaaaaatgcaactatagtttgatgcatcgaatcaggaaaacaacttggtttctgtaccgatcaattcaggtttctttttacgaaatcggatctgactctatgtcagcacgtactactattcctacgtgcaatgaacccacttacttttcgtcgaacaggccagttttattttttttttcctgtagtgacaggtagcacgtttgctcgctgttcgggaccaatccggtcacaccgccacggccgtgtccagccgctgtaacccaacgccgcgaccgagcttgacgcccccgcggcccgcgcgcgcgctcaccaaccgatacaaatcgctcgccaccgcgccgccgaggggagcgtggtggtgaccaccgcgccgaaccgccgagctcgacaggccatggccccgcgcgccgtcccgccgcgcgcgcgcgtcagtccagcgatgcgtgcggtgcgcatctgccgtgccgcgcacttgcctcgtgcactgtctccaccaacatgggcacacgcattgatggctcgcgcgtggccgtgccgccttgcctgtttgcgcggtggctgccatatctccgttttgtttttttcttggccccgcgctcgctcgctgcgctgcgctgctccggcctgtttggtcgaataacgcctcgagaacgtcctcatcgtcgggcgatcgatcggtttgatgatcaggtttcgtcggtttgcgactcgcgagcggtcgatcgaccgaatgcgatttcgtgatggcgacagaggtgggtcgtcgtgtcgctactaatcgggtggttggggcgtcgatgccggccgtgtgtatgcagttgcggcgagcatgcctgcatgtgtgtacgtttatgtctatcttgctggggataatgttattatgggttcagatcgaccatactggttgttagctagtatgggtgcaagcttaatttgcagctgatgcaactgcattttgatatggcacaaactgtgttcatttcgtgggcagcgttcagacttcagacgtgcatggaggcatggagagccaatcgatcgatcaagtgcatgcatgcagcatgcctcaaagtcttccatggagcaattcatgtgcagccttaagcccttaagtcgttcactggtccatcacctgcatgctgacgtgaaacgcattgctccaaaataattttgttgccatgcgcatttttatcgccctcttttcgtttctctctgttttccggaagtttcatcgtcaagaacattctccggacggtttggtgaagtttggtctcagttccatgctgaatcttctttactgatcggtcctacttagtactgaaattgtactgctccatcagtgtagttggtcaggatgcttaaagtgctcaactttcctgcgtttgaatctatgttacgactacgaaatgactacatagcgaatcagaatttcgcaaatttgatgcgtgtttgtcagttaaaatcaatggcgtcttctacgtgaaactgaaagctttagtttcacgcgtctctgtccagttagaatctcagccaacccgtcgttcagttagatgccaccaaaaatgcctttctttcaaactagtttatgcagataatcgtccattatttgtacgaatttatgatcctcaataatgcatcaaccgtcagcccgtattagtgagattcggtcagaccatcgactaaagaaattttctaatcgatgatagatgccctcgaatatttctgctgcaatgcatgttccatgcatattatgaacaactaagtgcttaattaatctctacatcaaattccccctgtatgattaaattgaacagtgacaccatgcttactaatatcttaatcagcaggtcgatttaaagtgcacgtgagctacgaaattatcatgtaatttggcataaaaccacttgaactgcagcagagaagctctgtaagtctgcatatggtcaatagtttcttgcctgcttctgatcagaaacctgctacctctagctcgtgattttctaagaaactgcagcatatattagcctaacaaacactaattaatggagaatcaaggagtatagtgtacactaattaatcaaagtcgatggagttgtttggcgacgaaacagaatcaatagataaataatcgacgacaggacgtgatttactattcggtcgatcaaccgatggagcaatatatatttttgacaaatttggttgattgcatccgcggtcgacgtggacatgtgcaattaatattgtaagatccggggagtaacatgcactgccgatcgtcgactgaccgattggccggtttgtcaaatgatttgcttgggggtctcaagatagtcagacaccgatctgatatcttaactgagcatgtgtattacttggaaggtgaggcttgattattcttctctgacgacttcagagtccggtagaatgtgtatcatatagttaagaggagtaccctgcagaaaaaagtatagttaaggggagtaagtacgcaatgcatgtgatggatcatgcttgatgatatatatataaacactaatcaaatcatatatcgttttgactagcctcacctgacgtttagctcttcgaatatttcagcattgctgattatttcaacattgctaaatctaaaccactgattcgagttaaagtactatctcaatctcaaaatatattaatatattaacttgtactctattatatttaaaatataatcatttttagagttagacagatgtactacgaaaatagctataattaaatagaagattgttgtgaatgagaaaagagaatagacggaggattaaacatgggagatattgtgattagtttagataagaaggtatatggagaaataactatagttcaagacataattgggacactatcgataactatattttagaatgtagggagtagcattcgaaattatcctataatatagtactccacctactctatcatctcttttcttaagaccctactctattatctcaatca

SEQ ID NO: 23346 - DNA, 702 bp, Oryza sativa
tcctgcggccctgaccagcttgaccttgcttataggtcgttgctgagacaaaaatcgatcaaaatgctgcggcaacactgaactatggctgctaccctaatgattggtttcttctcattatggatttgtaataacatcatatttgtatgatcaattggaactgacctatgatggaactctcctaaatgctcctatcatggcagcaagagttacttaccctaactatccagctctagcctagtggcaacatgatattttgacacagataaatctgtatagagagggtgctattctaaaggttatgcacacattcttactgatcctatttattctttgcaatctattgctgaattcatatcttccactattcatgcagaagtctgaaccttcttggtttgttgtgggtatcactagtaattactttacaagtcagaatatgaggtccagatataatatatggtcgcttatagactactataagggttattattgcagatgatctagacgctgagagtggccatgacctcaagactttgatgtctcttaacgataaagctccattaagcccacctgtggaagcttcatcactacgaactgtccttgcactatacacctatgctctaaaacactttcacacgatgataatggaagacgaggccatactaaaatgagaaccccctcttactactgaactaaccttgc

SEQ ID NO: 23347 - DNA, 558 bp, Oryza sativa
  unsure (1)..(558): unsure at all n locations
nnnnnnnnnnnnnnnnnnnnnnnnnnnnnnnnnnnnnnnnnnnnnnnatccccatcaacccctcaccaccaccaactcatttctccatcaaactctccactcgatctcctctccgtctctaccgcttctcttttttctcctctgcaccattgtcatcttgtctcctggtgctcgacgaggcgtcgtctaatagctggaaaaacaaaaatgctttggttacttacccaacggtgtcctgtcgaggggtgatcgggatgacgccggcccggctggtgagacccaccgtcggcttaatcccgaccaccgaattccacgacgccgggcagattatcgacccatctgtctccgtccccagcgtcaccgccgccatgttcgccgccgcggccaccgccgaaccgctgctcgaccagcacggggtagccgtgaccacgtacgggttcttcctcatggacaattcgacaaacactttgtttacgcgatgaaatgctggggagatgacatgcacagaggtttggggttgccactaccaccacttaccagcgtctcgcccccgcgtgc

SEQ ID NO: 23348 - DNA, 2048 bp, Oryza sativa
ccagtagaaatgacgcatatgaagtccacatgctctggtagaaacagctatatgtgtccgaaaccgttaatcgtaaaaaaaccataaattatttgccatgaaggtaacctcctaaagtaaaattgtgtggttcaggatcacacaaacattttctcatgattaacatttttcttttgactttcatgatgggtttgtgagttttgttaatgttgcatacaaatacaatgtatagttgtgaaatattaaattcaaattgtacaacattcataatgtatatttgtgtgcgggtatgtacgaatatacatatgcaaagccctttaattagagcaactatatataaatatccaatttgtaaattgcaatacaaagcaaaagagacaattgaacatatcagtaggtcttatctagccatatggctcgaccaacaatgctctgatccaatgtgaccaagtcattagcatgagaaagactacatgaaaaaacccggcaattacattagtttaaataataaaagcattacattagggatatatcgtgatgctacttggtgcatcaggtggtagttgcggtagcatgttccatcttcgttgatggatggatcagatgaggtgttgcttgctcaagtgattggagcagcggctgctttaaatgtttcatccattaccctaagcttgtcagcgggcgcggctgcgtcaaccgcatcagcagcaatcatgtagacgatggaaaccgcggcaacttttttcttttctcctgtagccttggccatgttgagagtagaggcagcaaccgtagcctgcttggacgtggcctccaaagtttccgccttatttgctggtagtgcaacagcaacaacaccatcgagggcctttcggatgtaggagcatgtattacttatgcatgtgtcaacattggcggtgcaatcctccgttggcactcacatggccactttaaagatatcaatcattgtcgtaaagttgtaagcggatgccgaaatagggatgataccagcaatcttgttggcgcattccacgggtgaggctaacatggttgacattgtaataaccacaagcataagtgcaatgaccttggccatcatgaagtatatatcctaataatttgatgagggatgattcaatgcaacaagaactagctaccctagatcgatgagttgcttgctattatgaaagtgggacgtgatttctttaaatagtctgtaaggcgtagaagctttgtggtcataaattggttggttgaatgcatatgtgccatgtctatgggtcaccgcgcatttctcccaataacatgtcgttagcgagcagctaggtgtttggtggatggccatggtaacaggttatccccttttagataatggaaggttctattaaacttgttctattacatcaaagtcatacaactacgctaagaacactctcgacgtctctataacaaggatgcgcttagccaaaacacatgcgaaccaatttaaaagaagggaggtccaagaagcattaaggaccatcagtaccaagagtaaatcgccaccaatttacctaggtaagactctcattcgccatctcctgcaagtgtagacacgcaacagtaaccaactcccgtgagctcgactttttagtataaccttggtgcgtaaccaatgtatagttaaaaataggaccagcatgggagaagaaacaacttggctgcttcttctaaagcggattagagtgcgacgaccaaagctacggatcagcctctaccgctttccatgcgaagaaccctagcctggcctaaatggaccacaatttggaaggtgtgcctcctgtagattcctcggtcctgtggtgtggtggttgtgcccatttggtgttatttcactggatttataagcccatcaacctataagtctacctctcaatggagttcaattgattgttcggttgatttccatcgattctcctccaattacgtaattttctcttcaaacaaataaaatttcaagtactagtggagatagattattcttaaacaaaatatgcatgcaagcatag

SEQ ID NO: 23349 - DNA, 436 bp, Oryza sativa
ggtagtttaaacgtagtgtctaaattacggaatatcattttttggggttatatgctccggatgaaagttggtcccctgatggtgacagctcactccggtttttcctccgcgcgtgaagataatcctaagttaattccataggaagggtattcctctgtatttagccctggttgtatggtcatgacgggctgttataaggaactcgccagtcaggggtggcttctccaagtaccaggagggcatcggatatatggtattagctagtatatcagttaactagaatgtatgtatatatactatgtatattagaagtataggaatagattatctttctcttttctttctacttagcttagataatatattatgagaatgagtagctgatgcttgtgtgtcactctacccttggattatcttaacccctgcttagaatatg

SEQ ID NO: 23350 - DNA, 935 bp, Oryza sativa
ccaacatctagtcatcttacaacccaagctagcaaaggaacatgataacaaatagtatggctgagacaataggtgatcatcccatagtaacattataaaacgatgcaatatttaaaggaaaacattagagcatttgtaatatgggatcaatatgttcaaatgacaaacatgacttgccttgctctacggctggaggaacttcggcaactatctcgaagtacaccggactgtcgggagagctagaatctatgcgatatacaaggcaaacaatgcaaacaggctataagactactaaaacagagaacaaaaccatttttaatggattctttgcatttttcttgatttactgagacttgaatgggcttaaacggagcacagatgaattttctatgaattttagaagattcactgtgtttttactataaaaagaaaaaccttaattgatttattgcgcaataattaaccctggtgacatcagcacatggagggggcagcgccgacatgcgggccccatatgtcatcggctcggggacatcggtccatggtggaccgagtccatgggaccgggtgaggggagcgccatgtggcgcacacgtggcatcgacgtggtggccacgcgggcggcaacgaatgggcccgatctagccgagggtagatcggacggtggaggcggcacgcgggaagcttaagccggcccggcggccctaacgcgcggcggtgagacacgatgcggcgactcgagacagctagcggcggcgacacggcggtgactctgctaggcggcggcgcctaagggatgtagctcaaaggtctatgtaattcatagaatcatgtgatacgtattagtcagactcgtccgcacttactagaaagacgtttttccaggcggtcaaaacacgttttcacgggcagacaaacattaccgctgcatctaa

SEQ ID NO: 23351 - DNA, 1499 bp, Oryza sativa
  unsure (1)..(1499): unsure at all n locations
nnnnnnnnnnnnnnnnnnnnnnnnnnnnnnnnnnnnnnnnnnnnnnnnnnnnnnnnnnnnnnccggaataacacagcggtacaagtttagggaccggtgatgaactttactctataatataatataatggatgtttgtgatggcattgtcctattttgctgtccgtagactgtagttctttgattgacactagttgtcaaatttataaccatgacttaactttcataataacatacctttataatcaaggttttttctctttgttattatgttattactcttttttttcaaattgtttatggtctacatggctcgctaagtctccaactggttatgtagttcaggccctgtttagattccaacttttttcttcaaacttttaacttttccgtcacatcgaactttcctacacacacaaacttccaacttttccgtcacattgttgcaatttcttcaaacttctaattttgtcatggaactaaacacagcctcagtttgccaattgccaaataatatcatccattttaggaatggctagagacctttatttacaacctaacttgcatagttgatgctaaacttcatcacaacaatgtccttgtatgaagaatcatgatagtatggaagatgaggatgttttcaattcagaaaattcaaagatgcgggtctcatcttttcgcttatgcttataagctaaaaattgaatttcgaccttaaatttggagttgattttggggtttttcatcgaagtttatttttcagcttttgttcttagatcactaataacacgtatataaaagttttatttacaaaatatttttcgtttgcaaatataccgtttcgcttattcctccaataagcgaaaacgatgggtccggcaaacaaatttaattagaaaatatttttaatgtcattaaatatatagtccggggaatactgaatctactgttctaaaatatgtcaatcggacataacgaatggatgaaaatgatcatactgtaaagtgatgaaattccttggatgaatcccgtcaattcaaatgcaggccaatttgtcggacagtaacagatgccgtccacgtgctggatgcgattgttggctacgacagccgtgacgcaaaagccacacgggcagcatcaaagtacatcccaccgggtggatataggcagtttttgaagcctgatggattaaaaggcaagagaataggcatcccaaatggatttttcaacttcccaaatgggacagtgcaacagattgtttaccagcaacttctcgacacagtgaggtatgcaattacaggaattttcacaaaattatatacgttggcagaatagaagaaaaattgacatttcaaattgcattttacagaaataaaaatcacgcatttattattaattcccatcaaattatatatatgttgcaagtttatactatgaacatgcaatcattttacaaggtgcttccttttgtttcctgtaaatcaaaacgtatgcatgact

SEQ ID NO: 23352 - DNA, 3531 bp, Oryza sativa
ccgagtggtccaacttccgccctgtcaaatccggatggagcgcccgcgacggccagacggtggtaaccaccactgccaccacacatgctctgcttctcttctctgtttggtcgtgtatgctcacaaggtgtttgtgaaattgcccatggagaatccctacgtgctctcggctgacccgtgcgggtcgagcagcggtccggcggtggcggcggcggcgaacatggcggcggtgacgctgggaacggagaccgacgggtcgatactttgcccggcgtcgctgaattcggtggtcggaattaagccgacggttgggctcaccagccgggctggtgtcatccccatctcccccagacaagacactgttgggtaagtaacaattttatgatgagcatgtgatttccactgttttcgtaaaaaaatgttccatttcttttgattaattatctctgaatgtttatgatactgttttgaacatatttatttttgttaatttaaacaaaatgcaggccaatatgtcgtacggtgtcggacgctgcccatgtgttggatgtcattgttgggttcgatgagcttgatgctgaagcgactggagcagcatccaaatacatccctagtggtggatatggacgattcttaaggatggatggattgaaaggcaagaggattggcatccccaatggctttttcactgaaggagcctatgggaagacacaactgagggtgtaccaaaaacatctttccactatgaggtatttgaaattataaagccctcctgaaaaattatgcgtataaaaaagtatgaagataataatgattagaacaaaatttttttttgtaaatactgttatttttctgttgtgttcgaatgtataattggaatagtccatatatactgttttacatatagaatgaaaatagatcactgactactaggcatgagcacgttggcccatgcctcaaccaccttttggatgcacaaaggccagtttccttttctttttttttctcatttcctcagtaaaattcttaatttgtttcatatgaataaaatttatcttataagtagccagtccggtttattttatccatccatgattgaaaagaaactccttgtcttaagataatccattcatctccccatagaaattcagtggtgaacaaataattttagttacaaaaactgtagactgatttattgtgttcaaaatatttgtaaaagaaactaatcaagcattgaaccattaaaatgatagctaaaatctattcttttaagtatagatcagcaaaatatttcacgtatatgttgtggaataataatatattagaactcgcaatgaaagactccatctagtatatagtaaattatgtcatcatttaataactcctattctccaataaaggaaacacggagccctggtgatagagaatatcaacatcacaacaaatttgtctgccgcgcaggatgttctttattccaacgagaatatcgcattgcaagcagagttcaagttaagcctaaacgcttatttgtcagacttgctgtattccccagttcattccctcgccgatgtggtagcattcaataatgcacatcctgtggaggtaagtattaaagctagttgaattaattaatcattcatcacgagttctaatgccttcaaaattataaaactagctagttgcaaggaatgtcaaataatttatccttcaacgttcgaaagttatacaataatagtgtaggtttaggttattggcaaagaagagaataccaggttaccgattaacaagaatagcgaatttactttatgcacagtgcacggtcgagtgcaaaaattaaaccagcacttgtattttctaaaaagtattgaatacctttcatatgaaaaacaagaagccatgaaaaaataatctttgctgcaggagagacttcaagattttggccagcccgacctgattgcagctcaaaaaaccaatggcattggtccagtggaaaaagcggcaatccagcgtctcaacgagctgtcagctgatggattggagaatctgatgaggatgcaccagctagatgcgattgtcacccccaactctcatgcatctagcttttttgccatcggcggcatgcccgcgatcaccgtgccggctgggtacgatggtcatggagtaccatttggtatctgcttcggtgggttgaagggctatgaaccgaggctgattgaaatggcttatgcttttgagcaagctaccaaagttcgaaggatgcccagcttcaagccatagatggcctaataatttggcattgctgatgactgccattgtaccaaaataaattgtcagcaatgtagggtgagagagagagaagtggaagacattatatcagcaggacgcatacttaatcctttcttacggattgatacggttgaaggataaacttagtggtacattattggtacagacaaactgatatcaatttgttcaagaagagcaaactctacaacattcttatctactactatatgtctaaattcattagcatttatataaacgtgggcaatgctaaaagtcttacattgtgaaacagagggagtatatatcaatgcattggcagtgctagctcctccattttgaagagcgggcaagtactcaaaccttctatgaacagcagatccatgggtttcatttgatcctgaaaatcttcctaaaatgtatattactactgagagaacgagaatctcggccaggtataagatcgtcgcttgaatgagctcgaacaaccttggccaataattctctgacaaattaataatagaggcagaaggcatgtctgccagcactgttgtttgtgctgtgcttttcgggaatacgctagaagcgtatttttgcattaagaggagtaaaacagacatttacaaccaaaagcaaaagcagcaggggacaggggaaccggacaagagaaaacacaccccgccacgtgcctacacaccaccacaccgagaggaacacacggccacctccaaaacgatgccttcaagaaggtcacgacattaaaaacgccgccatcgcccatcccgaaaggatgaggttttcacctagaggatccttgaagagggggagggaggcacctcaacaacgccctcaagagggttgcaacgcccaaagacgtcgccgttgccgcccaagaattgggccggctttcgcctagcacctgccaatgcccctcttgccgctacctcaccgactcccaagcaatgtcagcacgtggcctctacaacaacgacgcccctccgtcggctggactccaagcgacctaacctgctaccagcgcgacccccacagctacacgttggaatgagcacgaccaaaccaccactgcacttcggcgaccagctagccttcctcccatgccgtcacctccaaagagagtgcccgccaccgcccatcactatcgataacaacctggggcaaccttgccgccgccttcaccgtctcgcaaaggagctccccacgaccaggcggtcaagaaggggaggagct

SEQ ID NO: 23353 - DNA, 3302 bp, Oryza sativa
  unsure (1)..(3302): unsure at all n locations
gggtttttgccccccgacttgcccgcgcgagagagacgcgggttcgtacccacacagcgacagtcttctaacttgcaagcttgaccctgaccaaaacaaaccgcgaacgcgtcacccctgccggccgagcgctcgcgcgcgaggcaaccgaggcccccaggccgcaacagaacccacggtgccgacggcgtcaaggaacacagcgatacgcccttgccgctcggtcggccctggccgtccggcggcgcggcgcgataccacgagtttgtgctgtgctcactcacgggtcacctgtttgagatcagaaatgcatatgaaacagaagttagcgaattactataaaactaatccatccgtcccataaaaaaccaatctagaattggagaatacatcatttggtacaataaatctggacaagcttctgtctagatttgttagactagattgtgtcccctctaataataggtttgatatttttttgggacaaaagaagtacggatctgcttcagtttgcaattttcatttacttcgttttttatttcctgatgtaatccagaattccagatgtatttttaatcaggaatttcttgttgatatcagtaagagtaagtatgaattgtaacatagtactggtccagcttgaaaaaaaatgttgatagataaaacagaatcagacatctatctatcttctatctatctatctatcttctattattatatactaaaagtccatgaaacttcctataaacgctctcaaaccgccacgtggcgctctaataaaatagagaaaatcctagaaattctaagaaaaaagcaaaacatctatcccttgattttcacttaaattggtgggtccaatattatacaccattagataaaattgatcttaaaactattatattatattatattatattatattatatactaaaagtccatgaaacttcctataaacgctctcaaaccgccacgtggcgctctaataaaatagagaaaatcctagaaattctaagaaaaaagcaaaacatctatcccttgattttcacttaaattggtgggtccaatattatacaccattagataaaattgatcttaaaacaaactaaataccatgggtcccacctatcctattcccgcacattagcagatgtagtatatacgtacgtacatacgtacgcctcccccctttttttcctttttttttctttttttcttctttttttccatttataatggatatatttttaaataattaatcataattttacaaacaaagaatctaccatcatataacttaaaccggtgtactttttactttatactattattttcaaataatgcactattttaaaataaattttacacaattatatcatgtacctatcaaataaacgatatctatattaactaatttatacgtgcactaaaactgatggcctcattatataaatcatcggatctactttttattacattggtctattattctcaagtaatgcactgttttaaagtaaggtctacaccattatgttgtgtacccattaaaataacaatttaaaatctatattaactaattacacttacactagaactggtggacatattattataatcatcggatctattgtttgctaataaataaagcgtccgaaattctctttgcccgctgcacaatacacgtatacaccttttgcctttcgcacgtgtaacaaagcgtagtgtctgagacatctaaggtgatcacaaccgatgtagcgctaccgttttgccacatatcaaattatatatggagatgattaattttgttaataacatgaaaagaaaattaaaggtgtgatgcagcgattaattattttcctgattccatattttggatttttgtttgcacgctttctaagtttctaaatggtgtcttatttaaataacattttaactttttagaagtcaattcatttgtttataccctcagttagctatcacataaattatataattcatcaatttcagctatcctaaaccttactacatattttttttcatgcaagtcatggtgattagtaaattggtgatcaatggatcatcgaagtcataagatgaatatgtaagagttactctgaacaattgtaaataggtgttaaaattaattgctattaattagacatctaatggcttgctagccacaaaattaatttctctctacatgtatataaacatggatgaagctggaacaaatattaccatatgtccaatacatatatattgcgcagttaatattctaattagtcatttaaaattccttaaaatgctctcaagctgccacgtaaatcggtaggtccaatattataaaccgttatattaaattgatcttagaacaaactaaatattacagggtcccacctcagcatagttgcgcacctacgtgcgcgggttcgtacgcctcccctcccttttttcatttttctctttcttctttttttcccatgcatatgcttccctccctttattattatatcatgcgccttcatgagatgatttaatcaaaagaattttaagtatcttgcactcgcatttttttatttgcagccatactacacggtatgtatatagatggactgtatgataattaactaccaatagtttcttatttactcgagaaaaaaaacatgattcaaaagttgtaagtactaaattcatctcctactcaaaagtttgtgaatggttttctaaaataccttaagaaaaatagaatccttaaattattataaaataacattattttgccctaaatctatgagacaaattttttgaacaaacaataatcttacctttcaataatataagtattgaaagtgcccgcgcgggccaccttcctagtttgataaaaagtccatgaaacctttaataatggtgagacatcatgcatgtgccgtagtacctctggtcctgcggttatttgcgcactgcgtagtgcatactcgtgatgtacggctgttttatatgcatgtgctgcacttattcacaaaagcatatgaaacacaattgagagctgaaacagcatgcagctgcattatggggatcataggtttttctttagccagcaggggatcataggttttgatatgtaggttccaacattcccaatgatgacaaccctcactgctagaaaaagcatttttctcaacgtgggggtctttttttcgcagacggacatgactcttagagcaaaatgaccgtctacaaaaannnnnnnnnnnnnnnnnnnnnnnnnnnnnnnnnnnnnnnnnnnnnnnnnnnnnnnnntt

SEQ ID NO: 23354 - DNA, 10586 bp, Oryza sativa
  unsure (1)..(10586): unsure at all n locations
tatgtaggttccaacattcccaatgatgacaaccctcactgctagaaaaagcatttttctcaacgtgggggtctttttttcgcagacggacatgactcttagagcaaaatgaccgtctacaaaaatataaatcggggtgaagttcgctctccgcctgttttcgcaggtggacaacttaagcggcgcctggaaaaatatgatttttgcaggcgaaccttttgtggtccgcctgcaaaagtccgcctgcaaaaatcgtacctacccagaaaaaaatatcttaactccttatcttctcctccacctcctccccaccactcatttccctctcaactctctctctccctcaacacttcttctcctccacccctacccaccgggctcgtcccccttccctcccctccctccctccctccctccctccccggcggatggggagcgacggtggcggcgtggacacggcggcagcggtggagtggacggcgatgtcggcgcggacaggccgacggcggcggcagctccccctctcttcctccccgctcctagatctggttggaggagggggagcaacggcggctcagatagggtgacgacggcggcggctccccctctctccatcccatctcttagatctgaccagaggaaggggaggggcgacggcagcggcgtggatgcggcttccctcccctccctctcctagatccggcccctacaaggagaggggagggcggtggcggcggcggacacctccctccctcccatatccggcccgggggggagggggtggcggcggccaccgcatgcaagttgagttcgccgacgacgactacggtttttttcttaagtttgattgatgttaacatcgcatgttgattgatgataacttgcaaattgatgctgtggatttgaatccattgctttatgttgatgtatggatgtttgtgattggactttgtttcttggatgagatttgtgagaatttgtgatttgtgatttgaaacctatggagggggtggggttggcgggaaagttttttttggcgccgtgagtatttttgcaggcggggctacccacggcgcctgagaagatcgaaactgctgcaggcggtgctttggtccaccggtaaaaatcgaggaattttaccgtcgtttagatgcaggcggaatgtttgtctgcccgtgaaaacgtgttttgaccgcctggaaaaacgtcttttctagtagtgcctacgagtcctactaatacgtattacatgattctatgaattacatagacctctgagctacatcccttaggcgccgccgcctagccgcgtcaccgccgcgtcgccgccgctcgccgtctcgcgtcgccgcctcgtgtctcaccgccgcgcgttagggccgccgggccggcttaagcttcccgcgtgccgcctccaccgtccgatctaccctcggctagatcgggcccattcgttgccgcccgcgtggccaccacgtcgatgccacgtgtgcgccacatggcgctcccctcacccggtcccatggactcggtccaccatggaccgatgtccccgagccgatgacatatggggcccgcatgtcggcgctgccccctccatgtgctgatgtcaccagggttaattattgcgcaataaatcaattaaggtttttctttttatagtaaaaacacagtgaatcttttaaaattcatagaaaattcatctgtgctccgtttaagcccattcaagtctcagtaaatcaagaaaaatgcaaagaatccattaaaaatggttttgttctctgttttagtagtcttatagcctgtttgcattgtttgccttgtatatcgcatagattctagctctcccgacagtccggtgtacttcgagatagttgccgaagttcctccagccgtagagcaaggcaagtcatgtttgtcatttgaacatattgatcccatattacaaatgctctaatgttttcctttaaatattgcatcgttttataatgttactatgggatgatcacctattgtctcagccatactatttgttatcatgttcctttgctagcttgggttgtaagatgactagatgttggattagggattgcttagccatgcttagttcaactagtacacaataggggaattacattaatgcatagacttcagattctagtattgatgttggattagtgcccaccgctatggtgttggttaattaaaatatattaaatggtaggttgtgggtgcatagttttgatggtcgcacccatggcaattaaggaccggttcgtgggatactctggaagaattcctcgtacttaccacaagccagcgtgggcaaaggctgggcttgtagtgtagctttcctctagctgacgcatccaggcaagggtgggcgtgatggagttcggatgggccctgcgacggcctatgcggctttcggattcacctaggcacgagaggggattgcccgctgccttgcgaggagtggggttgaaacctgaggtgtggtgtgcttggttagagggggttatgcgaagggtcctatcacggcctctttccggtatgtcgtggtggcatgcatgcgctcgggaacatgttgtggggctgtgtcttgtgggtacagttgtacatctctgatcaaagtaaaactattcgaatagccgtgcccgtggttatgggcggtcaaccagattcaccgtgattagtcccaccctagtttagcttaatggaactaattacttcaggtggtggttactacatctgcttttctgctttcaactactgtttataaatgctagctttatgcaaatgaaccccttttagcctcctttggttatatcttgcatcataccctccgttccggtatgacttgctgagtacagtgggtagtactcagtcttgctctacctcccaaccctcagagttcgagtatgcttccgatggtggtttctccgaggagtaggcttcgtccgagccgtcgaggatgcctatggagtggtgttcacgctgtaatccaagtcaaggcttagctccagttatcttttatttttccgctgcatctgtatgtcaattttgtcgtttgtgtaccctggccggtcctggacaggggatttattgcacattctgcttgaaattctattcgagaatttctaggcgtgacaagaaacaacttggctgcttcttctaaagcggattagagtgcgacggccaaagctacggagcagcctctatcgctttccctactgttctggttgaactagggctttggctgagcgacctccttcttccagtattcttagcttactgtctgcttcctgcctaagcggtgctgacttactgttattgcttgtcttgggcctgttctagttttggtgcagctaactaaggatcgattttcgtgatttgatgaagaggaagccgggtatctttggtcttgaaaccatatagttcctgcgtaagcaagccaacctacacgtgttagccaccccatatggttgcatatctttttaaatacctgacagccaactagtgtgaacacgtgtgaaacattatcaggtggagtaattctagatggcatataaatgatggaacaaactaattaggctgagcaacattaaaagaaaagttgtctaattgcctccttattgttagagaaataacagttttgatcgccttgccagttgcgttttgttccacctttaatatcacaaaattcaattttttgtgatgcaattcatgtactgtcttgcgtagaataaaaataccaccttggatgttgcatcctcgcatgacggcagtttgtgtagagctcatgaccagtcagagaattaactgtattagttgcaacctcggtgaaaatttcaagaccgacattcaatagaaatattggtatatatattggtgtattatgtatgcatcttgaactttcggaaggggcgttattaccgtaaaattgaggctggacagtgggaggacttccgcataaaattcgtttaatatattcatcaaatcctctttaatgatattccaaaagttttgatagaactacgctgaaaaccatccggtctaggggccttattatgttctatcccaaacacagctacccggacatcttcttctgaaaaagtgtcataaggaactcatttttcaacttcgtaacctaggataatcctctgttctttattcatccactgtaaaatgagagtcctcaggttgactaaaaagttgcttgcagaagctggtaatataagacttgggtgattgtacaagttcgcaatataagaattttttttcctatgtttactattggcaataggttgttataatccttgctcaacatagtacttaggtttgcaaataggaatgcagagtttcaggatcacaagtgtcccgtgacgcaagtaacatagaaatcgttattagaatgggctctaaatgtatatagatggttacatgtttgacttacagttttttatagtatagggtcgagttagtttgagattcttgcacacctaccttctgataattaattatgcaaggagtattcttattctctcatggatgcatgaccatccttacctagagtacgtcactattgctcttgctttcattcagcaacagcgtcaccgcaaacaacttgatttctgccacggcttaatcccaaaggaaacacttctagttatttactcgtgcaccactgttggtaattcttacggtcacagataaaatccgcaagcgcatggatatactgatgtagcacttcccctacggagtatttcaaagggtatcgaatcctgtcgggacccaaactaggatccctttgtatataatgtgctagtcctagatcaacgctagcacacacagtaacaaaagataaaatcacaactacatcatgattatattaataaataggaaacaaatataatttttacattggtcttatgaccagattttacaatttctttgccacgcagggccaaacagagataaacagcggaaaaagaagcgagaggcaccaacgacacaccacaggcagtcaactggggcacacaacctattcgacatcctcagcaacataacttctaaaacaactggccttctctgaaattttgtgagacaacaagggtgagtacataaagtactcgcaagtgtacgggaatatgcaatatatgatacaaggcttcaaaggaaagctagggttcatttacataaaggcatttgcgaatttaaatacagtaaatagatataaatttcatttaaacaacatttgcaatcacggtatttttaaccaaccaaccaacccaaaaaggatattgcgtccacacaggagcacacagctatattcattaatttatcctgcacatagctctttcccaaaagtaaaactttcacaaatctacccgtcaagtgaaatcaccgagcatgtccataaccgaggacgcggctattcgaatagattgacactctgcagaggttgtacaactttacccacaagatacagttcggtgccgctaaacaccaaagagtaacaaagcgtttcctctacctcgccctaacaccggcttcccccatgggcggtcctcccttcaccacacaggtgaaaggtcccatggtacaatccaaaaacctatcatctagccacctgggccgccagtgccagagctaagcaatgtactaagctaggtccttcccataaggacatgtggttgcacggtaaggctcagatcaatggcgcacgaagtgaagtccttaactgaccagggcgacttgcctaaactaaggacctcaagcacacagcaaaaagggagcacacagctcaatcgaccacacatatcaacggtaagcacacacacagatggcttacctcctaggttcacacagatccaccatcgcccaggtctaaaacattttccaccagttaattactacatggtgcaacacatgccaccaagaagatagcgcacaacgacacagtttatgtaaataaatgcaataagtagatcattagtcaatattatattttgcttgtaaaaatgtgagcatggctaagcaaatctactaccccgagccaataccccatgtttgattctcatacagtctagggtgacaaataatcaaggataatcaacaataattcaaggcatggaataattaacaagtaggtcataactatccacacgatagtttgtgaaacaaatcatgcatataatttaaaacaagataatttttcaagttaggatcaacatgttcaagggtacacttgcctttacccacgagatcgttagacggaaccttcacctgcaacaacaacctcctcagcaacagcgtctatacgatcgcagaaaggagcaaacaaataaacaaaaagaaaaggcagaaaaaaataacatcaaatgaaataaccaagtaaatcaggaagtagagctcaattttagaataatttaggaaaaagaacgggccgaatcggagtttggatgaaagagatgtgacctctggaagattgaattattggaaaaccatgaataaagaaagagaaatatttagaaaatattctctggaatttctgaaccaaaaggattattttttacgaactggcgggcgtggtccacctgtcggtaggatgacctacggttaattggttacaaggaggagagttgtggaccaattacgaggatggctgagatctatttgttgagatagataacttgattgattttgggttttaggaggctagcctgaccagaacgcatgtgacgtggtgccacacaaaatggatctcatcaacgtgacaacaatgaagcagcggattgaagtagggagaatcaaaagcacagcgggctagaagatgacgtcgggctcatgaaagatagcagcagcggtggtgaaggctgtggagttgaagcacaacggcaaggcaatggcatggtggagctcgaccttttggtggcagagagacatggagtagtaggggaaatacgagtagtggcagccacatggcatggactactccggtgtacaaaacagggatgtcggtgcagtgatttaggaatggaaccatcatgaccacagcagacaagtggtaggaacggtggatcgttaacggtgaggtggtttcaccggcggacaatagcaacttgacaagagacagtgccggaggcagggaagccaatggaagcggaggataagagcagtggtgctgctagggccttggagcttaccgaccgcagcgacattcataggaacgtaatggtgacaatgtggttcagctcgggttccattgtgacagcgaccatcgtggtgcgcaaacagatcggtgatgactgacggccacctttatgatcacaagagagagaggtggcagcaagaatggaagattgaattaatagaagatagaaaggaatattctctcgcgttttcaggttgattggaactattttgtgtaccaactggtgtggttcatatgtcatctaaagagagagattaacagtggtgcacgcacatgcacactgtgggcatggtggccgaggcaaagcagcagtacgacagcatttggacatgtgcgaatgaaaagaaaagaagataagggctctgttaaatacatataaaggaggaaggttgacagtgacaggggctgctttcgtgatggacgaaacaacaacatatagtgctaccaccgggtgataaaaatggaaggaaataatggaggatgaacatcaagagctcacttgtagatgtggtctcaacaagatgacgacatggtagcaacggcttgggttccaaggacagtgatgacttgtttgcttgcaagtggcgttaatggtgacagaagtttgtttggaaggagatgacgaaggagcagcgttggttcactgatgacagctgcgacgacgatgacgtggtgtcggaactcaacatcctggttgcacagatcggagcagcagggggacacgatgtcccaacctatgcgaacaccacatgatgaacggatgagcacagcagatgaaagacttttttatggtgtgcaactgcttaccaaccgtagcagagaagaggcagcacaactttccgatgtgagcagcaaagaggagacggtagtagcaggaagatgatggtgcaggattgatctgttgggatacgcgtagactacgatagcataaatcaattttttttgtcacgtaaaccaggaaccatgcaagtactagatcatagatcgttaccactcgacgcgctatgcagtggaagaaggcgctaagaagtcgaaggaattctcgggaagtagcgcgcgtcgatgtagaggaagtagtcggtcgcaccggctcgaccttctcctcctcgtgcgttctcctcgctgtattcccatgccaatcagcaccgcaaaccagcggcgcctctatcggtatccacacgtacaggaacggaatgccacgcgcagatgtgctagcacccgcgcacggctagggttttgctgggggaggggactgacaactagggtttctcacgtgatgcaatacctccgccggtcacacccctcacgaatatataggatccatcactcgggcctccaaggcccgtaggactcctcttcggatccctatccgaattaagctcatattggatctccatccaatccccttattccggcccattaagcgtgcgaccttataagttcatgtacactcggctgtaacccgaaaactccttttcggtccatgcgtcaacagcggcctctagcagaatgtattgacccaccgggcatacattaagatcatatctgctgaacttttagtgtatacttgtatgaacccctttgcctcacgatatcgattaagctcaaggctaaatatgtgccatcctctaatagctcaatcattcactcgaacctgttgattgattatataacttctgattgactcctcaatcaaatttggcatggccatgaacttccataatctacaacatcgaggggcccagatatatctctccataggaggggaaatcccatcttgattgttcatatcccactacatgtttcatagcatacccgaaaactacttttataattacccaattacggagtagcgtttagcagtccctaagtaagctactacacatgttgggaactataataatttcaggtctaaggattcaacaccaacactaaatgagataactgatgacacaacacatatggctcttgcagtgtctcatgttgggtctatccaacaacatgttcaccaacatgtgtccacattattaatttggtatctctataccatgatccatgagacatgaacatcaattaatacatgtgttgatcatctaaacatactaggggattccccgcgctttgctgcgtgaattactaagtaattttcaatattatttttttcttacaattcagctaggagtaaaaagaaaaaaaaatcaaatcttagggcttatcaatatttatcatgaaacaaatgaaattcgtactttaatgtagaacatgttgataagtatatattaaatattataaaaatgatagagagatttgtaaaactattgtggaaatgatgtgagaggtggtgattgaatatgcttgcatgataatttgtagaattaaatagactgtagatgctcttgcatgcttgcatgaggttgaatatgtaattattgttagtggcatgtgatgatgtggcatggttgcatgttaagctttagagttagtgggttataactttatagaaagtagtatagatttgttccacatataatatttgatcagtgatcctttagaaatagcaacacacaacataaagagtctcatgaaagaatcacatattcattaaccaataatgagttatctatttcaaggaacaaagtcggataaatatgtaaacatagtatgtgatacaatcatctctatgattgcctctagggcatatcactaacatgatcctcccatgcagctgctcgttctcgcgttgacggtttgatatatctccgtgccaacagcaagacatggccgtggctgagatttcgaaaaacagatcaagctcatcaatttgatttgatttttggtattgatgaatggaaacagatgaggggcagaagggacgagcagggaattgagggaagcatcatgaccttcatatatagcaaagcagaaacatcgtgcttgaagatgaagcagtagccaacgtggtgactttggctgcacatggcactacgtgcacacacacggtgtgtcacggttggcgtggaagtaaagcggggcggtggctgcgctggttaaacaaagaggaaaggaggaggggtgctgcagctatatatagggaagaataggagctaagcagccaggagatgaggagtcactggcttttacaaaaatggctcatgctcatgaaggtgatttaatttttggtgttaaataatgagattggtgagggagagggagagattaattagtgggaggaggaactcgaggagacagctcagtttcccggaagatcagtaatgtggctgagggaggacgaagatggagagttgagagaattgactgggaattggaaatannnnnnnnnnnnnnnnnnnnnnnnnnnnnnnnnnnnnnn

SEQ ID NO: 23355 - DNA, 2741 bp, Oryza sativa
  unsure (1)..(2741): unsure at all n locations
gcaattacattagtttaataataaaagcattacatgaggaatatatcgtgatgctacttggtgcatcaggtggtagttgcggtagcatgttccatcttcgttgatggatggatcagatgaggtgttgctcgctcaagtgattggagcagcggctgctttaaatgtttcatccattaccctaagcttgtcagcgggcgcggctgcgtcaaccgcatcagcagcaatcatgtagacgatggaaaccgcggcaacttttttcttttctcctgtagccttggccatgttgagagtagaggcagcaaccgtagcctgcttggacgtggcctccaaagtttccgccttatttgctggtagtgcaacagcaacaacaccatcgagggcctttcggatgtaggagcatgtattacttatgcacgtgtcaacattggcggtgcaatcctccgttggcactaacatggccactttaaagatatcaatcattgtcgtaaagttttaagcggatgctaaaatagggacggcaccagcaatcttgttggcgcattccacgggtgaggctaacaaggttgacactgtaataaccacaagcataagtgcgatgaccttggccatcatgaagtatatatcctaatgatttgatgagggatgattcaatgcaacaagaactagctaacctagatcaacgagttgcttgctattatgaaagtgtgacgtgattgctttaaatagtctgtatggcgcgggagctttgtggtcataaattggttggttgcatgcatatgtgccatgtctgtgggtcaccgtgcatttctcccaataacatgtcgttaccgagcagccaggtgtccagtggatggccatggtaataggctacttgttttagataatcgaagcttttattaaactcgttcaattacgtcaaagtgatacaactatgctaagaacactatcgacctctctataacaagtatgcgcctagctaaaacacacgcaaaccaatttaaaagaaaggaggtccaagaagcattaaggaccatcactaccaagagtaaattgccaccaatttacctaggtaagacactcattcgccatctcctgcaagtgtagactccctgcagtaaccaactcctgcgagctcgactttttagtataacctaggtgcgtaaccaatgtatagttaaaaatagctccatcaagggagaagaaacaacttggcagcttcttctaaatctgattagagtgcaacggccaaagctacggagcagcctctatcgctttccctactgttctggttgaactagggcttcggctgagcgacctccttcttcgagtattcttagcttactatctgcttcctgcctaagcggtgctgactgactgttcttgcttgtcttgggcctgctctagttttggtgcagctaactaagggttgattttcgtgatttgatgaagaggaagccgagtatctttggtcatgaaaccatatagttcctgcataagcaagccaacctacacgtgttagccaccccatatggttgcatatctttttaaatacctgacagccaactagtgtgaacacatgtgaaacattatcaggtggagtaattctagatggcatataaatgatggaacaaactaagtaggctgagcaacattaaaagaaaagatgtctaattgcctccttattggtagagaaataacagttttgatcgccttgccagttgcgttttgttccacctttaatatcacaaaattcaattttttgtgatgcaattcatgtactgtctcgcgtagattaacaataccaccttggatgttgcatcctcgcatgacggcagtttatgtggagctcacgacatgaccagtcagagaattaactgtattagttgcaaccttggtgaaaatttcaagaccgacattcaacaaaaatattggtctatatattggtgtattatgtatgcatcttgaactttcgaaaggggtgttattaccgtaaaattaaggctggacagtgggaggacttccgcataaaactcgtttaatatattcattaaaacctctttaatgatattccaaaagtttttatagaactacactgaaaaaccatccggtctaggggccttattatgttctatcccaaacacagctacccggacatatttttctgtaaaggtgtcataaggaactcatttttcaacttcgtaacctaggacaatcctctgttctttattcatccgctgtaaaatgagagtcctcaggttgactaaaaagttgcttgtagaagctggtaatataagacttgggtgattgtacaagttcgcaatataagaattttttttcctatgtttactattggtaacaggttgttataatccattctcaacatagtacttaggtttgcaaattggaatgcagagttttaggatcacaagtgtcccgtgacgcaagtaacatagaaatcattattagaatgggctctaaatgtatatagatggttacatgtttaacttacagttttttatagtataaggtcgagttagtgtgagactcttgcacacctaccttctaataattaattatgcaaggagtattcttattctctcatggatgaatgaccatcctcacctagagtacatcactattgctcttgctttcattcagcaacagcgtcaccacaaannnnnnnnnnnnnnnnnnnnnnnnnnnnnnnnnnnnnnnnnnnnnnnnnnnnnnnnnnnnnnnnn

SEQ ID NO: 23356 - DNA, 1337 bp, Oryza sativa
  unsure (1)..(1337): unsure at all n locations
nnnnnnnnnnnnnnnnnnnnnnnnnnnnnnnnnnnnnnnnnnnnnnnnnnnnnnnnnnnnnnncccatcaacctataagtctacctctcaatggagttcaattgattgttcggttgatttccatcgattctcctccaattacgtaattttctcttcaaacaaataaaatttcaagtactagtggagatagattattcttaaacaaaatatgcatgcaagcatagctagttcccctttattttggatatattgatggtcgaaatttgtctataacgaccgtcagcacatgttcttctttactttttgagtggataaggatgtcatcaagaaagacaatgacaaacttatcaagataatccaacagtgtgtgattcatcaatctcataaacacagctggagcattggtaactccaaatggcataactgtgaattggtacagtccataccttgttgtaaatgttgtctttcgcctatcttctttcttaatcatctattgataatatcctgatctcagctcaatcttagaaaatatcttggcacctctcaactgatccaatagatcatcaatatcttggcaactatcaaatcaatttgatgttgtgactgatcgtcgattctgttagaaattaatcttgtcgtttgttaatttcagcatgtttatctatatgcatgtgtgtgttgcatggcctggagagctagctatatgtacgtgggtgctgctgtgctgcatggctcagtgagtagtggttggcagtgagtagtgagccaataaattaagagccaggagatgagagcacatatatgtagcttagttagttagccatgcataattgtgggcaagtgattagccgagtcttgcatggattagttagttaggcctgcacgtggtggattagttctcctagatgcatgcagctagcatatcgccaggccttgaggagatgcggccaaggaagtggggcgtcgtgtgcgaagaaagtggatcaagtagctcatccagtgtatgtgtgcattagtagcttataaatagctgctcattgtaaccgtttagtgtgtggagtaaagaaaagaaagagaaaaggcacaagttgtgcgtggtgtcacaaatactctgtgtgttgtgttcttcttcttccttgtactcttcacgtgtaagtgtgatttgtgtccactgtgttcacatgagttgctttgattcccaacagattcatgccttctgcattatggttgtttgatctatatattgaagtgtatccatatattcatgcatgattccagtgagtagattagatacatcgtacctaaaataatacacatcacgagttgttgtctggtcg

SEQ ID NO: 23357 - DNA, 605 bp, Oryza sativa
  unsure (1)..(605): unsure at all n locations
nnnnnnnnnnnnnnnnnnnnnnnnnnnnnnnnnnnnnnnnnnnnnnnnnnnnnnnnnnnatttttagttgaattttcagagccttggaaataattttaaccaattaaaataagcaaagtgcaatattaaatccctgggaaaatcctttttcctttttatcttttcttttccctcctttttcctttttcttgggcccggcccatttcctcccgcgccggctcgctcctccctcctactcccgaagttcacccggcctccttctccctctcgggcgctgacaggtggggcccacctgtcagccctttccctaacctccggcagcccacgcctgcgccaaccgccgccgaaaccaccacccatcgccgcccgcctcccccgccttccgcgccccactccgcgccctgcgcccacgtcgccgcccaccatccccactcctcccactcgcgcgtgcaccccgcaacggagggattcaaattcgaatctctctctctctctctctctccattccccacgtcggcgagaaatccggccgcctcccggcctcgtccgtctctctcgagccccaataaagcttccccgcactcccctcaaccttttttctcttt

SEQ ID NO: 23358 - DNA, 7560 bp, Oryza sativa
  unsure (1)..(7560): unsure at all n locations
nnnnnnnnnnnnnnnnnnnnnnnnnnnnnnnnnnnnnnnnnnnnnnnnnnnnnnnnnnnnnnnnntatttctgtaaatattaaaaaaaaaaatctaaaaacaaaaaaaactcccggaggatgaaggagctcccgacaggtggggcccacctgtcggtctccacaggagagaagagcgggcggcgtcggctgggccgattgggccggctcggccgcgcgggagagagaggatgttgggccgaaatcggcccaacgacttagggaaggattttcaaaactttttcaattaaaataatcacttaaatgatctttcaattgttaaaaatacttccaatgctcaaataattccaagaaaaatcctgaaaatacttggacactaaaagtacttaacaaaattataattagaccatttaatgattaatttaatatttaaataattgctgaactgctctttgtatgattaaaattaagaattgagctccgaaaaatccaagaaaatttcagagagtataattaaccatggagaatttaataaaaattaaatccacccatgctttatatttaggaaattttatttcccacatttaacttcacttgtaaattaatgaacatttaatataaattctaataataatttattaaataatttataaatcctgaaacaaaaatcaggatgtgacaccgagcccagcccaaagtgtgtcctccctccctctcttttcctcccctctctctcccgggcctccacttcctcctctcctcctcccggcctgcctcggcccaagccaggccgagccgagtcagccgcgtgcgcacgagcgctaaccgcgcgaccgcgtggggcccaggcatcggtcgtctccttcctcccgccggctcctctctctcccccgtgcaaccctagctcctttcttccctcaaatccgcgcgaatcaattcccttctttccaaattgattggggggaattaataccctttccttcctcttcaattccccctaatttcccccttgcttcgtgctctcaaccgcccggaacagccgcgccattcccggccaccttccatggccgtcggccccaaatcccgccgccgttccccgcctctcccatggccggatcgctcccttccactataaaatggagcctcctccttccgttctctcgtttttgcctcttcccgagctcccccgtggccacaccacctctccccgccgcccttctttctctctcccgtgccgccggccgcctctagccgcctgtgccgcctcgcctgtgcaccggccgacgtcgccaccaccttcctcggctctgcgacgccaccccctctgccggcctcaccgtcccctcgccctaagctcgccggaacggtgtcctcgttgacgtccagtggcgttaccgccactgtgccgcctccagccgctctggttgccgcgccagagcgccggccgacgtcgttgtctcctcctccggcgtcgaagcgtcgacctccaccccggcctgccctcggtttcgtccggagaccaccgtgccgcgtcggcttctccatcctccatatcgacgtctgtcacgccctgaagttcccctcccttgctctaaattcataaaataaatcgtccgaagaaattgtttaatttaacctagagatgaatccctaattaataaatgcaaataataatcggaatcgacatgtggaatttttcttggattctacatgtcaaaatattctaacaggatttttagttgaattttcagagccttggaaataattttaaccaattaaaataagcaaagtgcaatattaaatccctgggaaaatcctttttcctttttatcttttctttccctcctttttcctttttcttgggcccggcccatttcctcccgcgccggctcgctcctccctcctactcccgaagttcacccggcctccttctccctctcgggcgctgacaggtggggcccacctgtcagccctttccctaacctccggcagcccacgcctgcgccaaccgccgccgaaaccaccacccatcgccgcccccctcccccgccttccgcgccccactccgcgccctgcgcccacgtcgccgcccaccatccccactcctcccactcgcgcgtgcaccccgcaacggagggattcaaattcgaatctctctctctctctctctctccattccccacgtcggcgagaaatccggccgcctcccggcctcgtccgtctctctcgagccccaataaagcttccccgcactcccctccacctttttcctctttccgccgctctctcccctgccctccatcactcccgcaccgctacacccgccgccgccgccttttccactcctccggtcgcagctcgccgccgctggagccaccgccgagccaatctgctgccgccattagcttcgccgccgccaaagctaccccggccgccgcatccccatccaatcccgccgtcggggcccgcttctccccgcgcgccggtgagtaccaccattgccgccgccttcggccatggtttccgcccgccgtagaccacccctctccctctaatccttcccattttgttccctaggaggtcccggagatcgttcgcccgtcgccgtcgtcctcccgtcgctcgtcgtcgtcgttcgccgtcgtctccactcgcgccggccaacctcggtgaaaaaactccccctcctccctctttccctctctcccgtgtgcgtcgccgtcctccgcgcgcgcaccgtcgtcttcggccgccgccgccacttttcgcgccgtctgccgttgccgtccgcgccgccggttgccgtcgccggcgaccgcgcgtgccgccgtcgctcgccatgcttggcctgccggctttgaagccgagccgagccaccagtcgcgcccctcccgccttgtgccactgccagtggggcccacgtgccggcgcccctccctctctctcttgagccgccgctcggtggggcccgcttgccagccgcccctctctctccttgagtcactgacccgcgggtcccgcgtgtcggcgccacccctccttatgctgacgtcagccctgggatgaattattgcgcaataaattgattaagggtttttcttttatagtaaaaacacagataatcttctaaaaatcataactaattcatccgagctccgattaagtccattcaagtctcagtaaattcataaaaatgtatagaatccattaaaaatggttttgtttcctgtttcagtagtcttatagcatgtcttgcttgtgtgctttgtttgtcgcgtagatttcgcccgtttcgtcgattcgtggtttctcgaagacgttgctgtggttccatcagtgcgagagcaaggcaagtcatacattgcaattgatcatattgtacgcaatttacaaatgtcccgcatttctattaaatattgcattgttttaaaatatcatgtgggatgggtcctattactcagctatatgttgtttcccttacgccattgataacttgggtattaaaatcactagacgttggtttaggagattgtcacatcctgatttttgttttagggtttataaattatttaataaattattaatagaatttatattaaatgatctttaatttacaagtgaagttaaatgtgggaaacaaaatttccttaatataaagcatggatggatttaatttttattaaattctccatgattaagtcaactctctgaaattttctcggatttttcagagctcaattcctaaatgatacaaagaacagttcagtaattatttgatcaataatgatctaattataattgttaagtgcttttcttgtttaaaatccttaaattataaattgttgtttaaaaggaattattagaaatgattttaaaagcttaaaagagaagatctaattttaatttgttaaatctcaatataaaattgggctagataaaattttgttaaatactttgcttaattctataattcctagatttttctgggatttatttgagctaagggagtatttttaataaatggaattgcatttcatgaataatttaaattgaaaaaggtttttaaaagtcttcttttggctttgggccgaaagtcggcccaaaacctctcttctctctctccctcggcccagttcggcccagtccgccgagccgccgctctctctctctctcccgctgacaggtgggtcccacctgtctggcctgtcttcctccttcggccgccgccgcccgaaaccctagccgttgcagccgccgtctccttccaaaattccgtcgctcctttccatctccggccgaattgatagaggggaaatgatcctcttgatctcctcttccttttctcctttggaaacatcggctaaatcggtttggaaaccgttggattcgagttggattcggattcgtttttcccgaagtttccttcgccgtcgccggccgccgtgggccttcgccgccgcctcttagcccctttaaaaggacccccgagctctcctctacccgccgcccccttcgccttcgcctctcgtcgtcggtttcgccctagcgccgtgtgccctagcgccgccgtcgccgccgtcgctccagccatgcgccgccgccgttccagacgtcgccgtcgctcgggaagaccgccgtcatggtcgccaagtcgtcgccgtcctcgtccgccccttcgccgtcgccgaagatcaccggagcaccgtcgccgccgtcaagccgaagaccgccgccgcttcaacctcgtcgccgttgtcgtccgttgttcttccgccgccgttttggtcaccggtgagttcgccgggtcgtcctctacgtgctggtgcccttcgtttgcgtcctcgcactgtcgttcgccggcgagcgtgcgccgtccgagccgccgagccgccgccgccggtggtgacgtcatcgctgacgtcatcgtccccgtccgtcgtgagccggtcgtggaccgatcgatctcggccgtacgttttggatcaagtcgatctcggccgtccgttcgcgtgaaccgccgccgtgcgcccggtccaccgaaaccctagcccgctgacgcaataatcctccttttccttttcaaaaataattcattattgcgtcataattcaattaaaatcaatttaagtgttttaatccgattaaatcttcaaaaattcataactaattcatcttagctccgatttagttggttcaagtctctaaatttttctaaaattgagatatacatgttaaaaatatccacatatactgttcatgcttgtttatgtgctgttttggtgtttttgcttctttttgcttagattccgtcgtttccggagagtccgttttcgccggagaagaatttgaagagttccaaggccagcaaggcaagtcacacagatcccaaacaaccctttgagcatgttgatcctatttaaagctactgtttttattcaactattgcatttattttcgaatgtcattgggtggaaataacctattgtttgttacaacccttttgttcttgattactttattccttgataccttgggttattataacttgactagttgagctttatatattggttcaactagatattagatataattgcttagccctgcttagaaacattagctcactattgggttaacttatgactcactgttatttaatgatggctgaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtgtagcatggttcattgcggggcaccagactgagaagtggcggagataagcccacgggggtcgctggggagtccataccttgtttataagggggtgattatgatccaggaaaggtgcgccgtagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgcttcaattggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttatcaaattctcaaatgtttgctaaatgctgcttttgcaaatgaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagccgtctgcgccgtttatcttattttccgctgcttagatctttattgattgagaggaactatctacctctgtaatgacattttatacgcttaatcattagagtaataattgtactctattatcaatttgttcttgtgtgcctcggctgattcctggacgagggttcacacacatgtaagcgtttggaattttggatagaaattccgggcgtgacagagatgcttagccatgcttagttcaactagtgcacaaaagggggtcacattaaagtataggctttgattattagcaatagctttggattagtgccactgcaatggtgttggttaattaaaatacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagctgacgtacccaggcgagggtgggcatgatggagttgggtcggccggggtgtccggttgatcggcttccggattcaccgtggcacgaaaggggggttgcccgttgcctgctggggacgggggcgaaccctaaggtgtggtgcgatcggttagagagggttatgcgaacggtcctgtcacggcctctttccggtatgtcgtggtggcatgtcggcgcacgggaacgtgtcgtggggctgtgtcttgtgggtacagttgtacacctctgataagagttaaactattcgaatagccgtgcccgcggttatgggcggtcgaccagattcaccgtgattagtctcacccctagtttagcttaatgaactggtgtagtccaggtggttggttgggcctgttgcaacgtggcgtagcgttggatagtgactggttaacattnnnnnnnnnnnnnnnnnnnnnnnnnnnnnnnnnnnnnnnnnnnnnnnnnnnnnnnnnnnnn

SEQ ID NO: 23359 - DNA, 859 bp, Oryza sativa
  unsure (1)..(859): unsure at all n locations
agttgggtcggccggggtgtccggttgatcggcttccggattcaccgtggcacgaaaggggggttgcccgttgcctgctggggacgggggcgaaccctaaggtgtggtgcgatcggttagagagggttatgcgaacggtcctgtcacggcctctttccggtatgtcgtggtggcatgtcggcgcacgggaacgtgtcgtggggctgtgtcttgtgggtacagttgtacacctctgataagagttaaactattcgaatagccgtgcccgcggttatgggcggtcgaccagattcaccgtgattagtctcacccctagtttagcttaatgaactggtgtagtccaggtggttggttgggcctgttgcaacgtggcgtagcgttggatagtgactggttaacattgcttaattactacaactgtttttactgttttcaactactggttttaaatgcctgctttatgcaaatgaaccccgtagcctcctttggttatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagccttcaggcttagctcgcttttatctttttccgctgcatttgtaatcttttgtatttttgtaagacgtggatctgtatgtcaacaattgtcgtttgtgtaccctggctggttctggacaggggtnnnnnnnnnnnnnnnnnnnnnnnnnnnnnnnnnnnnnnnnnnnnnnnnnnnnnnnnn

SEQ ID NO: 23360 - DNA, 2406 bp, Oryza sativa
  unsure (1)..(2406): unsure at all n locations
cccggaacttgtgtaccagtgtcggtagtcgttcgtgtgtgcgtgtggtgaccgtgttagtgtgcccgctcggtagccgcgtggtttccacgtgtgtagcccgcgtggtatctagtggagtccatttgtcggccactggcctcggttgacacacagggtccgcttccgtcaacccgtggaccgtctctgtgtacccggtccaccgtggtcccttaggttgacatgtggggtccgcatgtcaacagcgcagccttcttgtcttttccaggctagcgcttacacatgttttatagttgtaaagcttaattataataatccacaaatctccgtataacagcattaaacttcggatgaccacgtcctggtcatacgaactccgaatcgacctgttcaagtctcttaatgtttattataacctaaagaaccatgtgcctttctttttatgtattgttattgcttctttgtaggcttgtagcttagcttgtgtgtttcgcgtagcttccgttgttccagaggttcccgaagtgtggttcgtggttgtcgccgaaggttcgaaaggccgttctctctaagcaaggcaagtcgcataatccttgagcatattgaatcccagtttataaaattattttgatttaaattattgcattaacgctttatttaagtttttgcgttattattgttttatttagcactccctattaatccttgttatagccttatcattgctattgtttattatcaccttgttcaccctaggaaaataaaaccccaactagtgggtaatctatgcatggttcctctagtatgaacttaggtagatgcttcgctgattaattaggcaacattaggtggttttataactttagactttgggagttctcatatcatttggacacacacctccccctctattcaaaacccccaaaatggttttaggttgggctcgaggtgcatggttttgatagtagcacctcggccatcataaggaccggtcttcgggcctctattgcaaagcactaccgtactaaccacttgtctaatgagtaagcttaactcggtgtttagtctagtcctgaccaaaccgacacggatagagatggatgaagtcgttatgatgaatatctctgaggcaaatgtaggctacaccggctgcggttcggcagtcgagatatgtaggcaaatgaaggctacaagggccggtgtcccgtaagccgagatgccatggcactggactagcacgcgggtggtctcacctctatgtgtgtggtgcacccggtctaggtcctattgctaggggctcaatcctggcttgcctgtcccgggataccggtcgtaggcagggttgggtcggtgcttttgttcacggctaggatgggtgaagggttatgtcacgttttttatgatgggttccacttgcaagggaatgcagagtaaaggcgtgtcttgttgttaacagtgaaatttggtaagcccggagtagtcatcggcttagagttagcatcggcttggaagtcctgagattagccgatgagagttgtcaagtcgtcagttgtcggattcttgctatattcggttaagaaaattgatctactaaaggaagcttatccagaagagaccgagttcaaagagaatgcggcatggcaagttatctattaattaggaatagtttgttagtttccttttatctctaggaaagtgtgtttagtgtcctataaggactttattttttttcttttatctttaggaaagtttctttcttgtccgacaaggacttgtatcaacccatgggtataaatatctacacccgaggtctatgtgatctatctctacgatcaatacaattcagcgcatcgccaccctttttacttctacttttgttttttacgttccggcggaacttggcacccgacgcggggctgcatcgtcttcgatcttcggcgaagggataagtccaatgttccgtaggcctaggcaattctatcgtttacgtcggcgtcgttcaaggctgcatcagtacattcgacctcttggattgctctggtttggatgatatttttgtctacctatttatcatatgtctatgttaatctagtcttagcaaatcaatttatctctatcggctgcttctcgttttagggtttctgccggtataggctaaatcgtgttgttagattagattagcttagacatctaccaccctaaaaatcagtcaacgacttgattgtctagatattatgtttcttttcatacttagtgctgcatcagttaagtttgatctactaagccgtgcttaaaaccataatctctagcatgcttcttgattgccaataagggtttcannnnnnnnnnnnnnnnnnnnnnnnnnnnnnnnnnnnnnnnnnnnnnnnnnnnnnnnnnnnnnnnnnn

SEQ ID NO: 23361 - DNA, 1486 bp, Oryza sativa
tccaggattgcatcccaataacggttggagggcacttcggacaattccccttctacaaccgtcataactacctctatataaggagctcactctcttcacttcacacacatctcaagcaatagctctctcatttctctcaagtttaatttagtagtatctagctggtggaatagaaatagaataggaatcaggagtccggaagccttcggaagagttcaggtatggctctagtagctttcctttcctcttttctaagctttgtacttttattagaatatttttctatatacatttatggtattgaaaggctttccaagtatatgagtacctactttataatatgttcatgttatgctgaatatacggctagcttatctgggagatggtttggtgcgggtataatgtttgcatatgcaattgctctataccatgacgatgatattatagtagtatctggtaatttaggtgtggtgtctagattacgagatatcattatttggggttatatattgcggatgagaggtgggccgctgatggtgacaactcaatacgggtattccttcgcgcctatatataatcctaagttaattccctggggagggtattcctccgtatttagccccgattgtatggtcatgacgggctgtcgtaaggaactcggcaatcaggggtggcttctcaaaataccaggagggcatcatatagagggtattagctagtatatcagttaactataatgtatgtatactatgtatattataagtatatgaatagattctctttctcttttctttcctcctagcttagattatttattatgagaatgaattgttaatgcttgtgtgtcactttacccttgaattatcttaactcttgcttagaatatgattatcacaagtaatatataaactattagtcaatctctctctacatgatctttccacgggataaaataaatacgatacccttggaatactctcgggtgaaatgctacaatggtatatccgtgcgcttgcggataaactctgcaaccataatataccagaagtatttctgcgccattgctggaaattatatttctagtaatatcgttaagaaataccaacaaagtcctaggtagagtcctgtcttataccccagttgagcgccagtgaagatggagccgtaggcccgctagtccgctactgtttatttgtgtttgtcaggccttaagtgcctttgtaataatgtaaatattatcgatataataaagatgtgtcttttgtatcatgtttgtgtggtgtaccttggcttttcaaggatggggataaatacactaccgttcaggaaaatgtatttttccaggcgcgacaacatgccctttgtctccactcttgatgaaccctgagttcctctcgacactcaatgctggtggtggcccgatctttcggtgagttgtgataactacgatttggcagaaacgttgacgatccgattacaaccgtac

SEQ ID NO: 23362 - DNA, 3844 bp, Oryza sativa
gtgttgcgccttagcgatcgatacactctctccgtgggttgttgatcttgccggtgcagatcaacccctattcctgcaagcaaatcgaagaaacaagcaagaacaagataaaaagcaatctgatattgcaaataggaatttaatacaaatgataagttggggttccgaagaacaagcagacggacggtctagccgacacgcgcgctgcaaacaagtagcaatggctaaactttaatctaacaaaaccccccagaaaccctgaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcatcttgtttcttcagttgctgccgactgagatggaatttggcaatgaggcttgatgcattggaaagaggactccgagagctttccatcaagtactcacgggccgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcacatcatgctccccttcttcacagaaaaccgtcctcggtttttccatatggtgttcttcatatagtccattcaaaataacctgtttcatccaatcaaaactggagaaactcgaagtagtgtgattagcaataacatgtttctctaaatccgaacaaatgaaaactatatgcaccaaatatattcctctatcattatatttgccaaagatatgaaaaatagcattagttggacatagcaaatcagacttagcaaataatttctccttcaaattatcgagctcacaaaaatcatcaaactgaatatagcccaaagtatttaaagaagatagcaatttacgttcctcaacttcattagcaatgtgaacagcatgcttaaaatcagcacacaaagaaacactaggaatagcatgttcattcactagttgtggcatggatataagtgaagcattatcacacaactcttctttatcacaaggaacagcgagtaaatcaacttgtgacaaatgaattccagaatttggttccactaacggttgctctacttttgcatgaaaagtggacaaatttacttcgttaacaatgcactcaccttgattagtttcagtaccatttactttaccttggatgtcctctttagatgatggaggtgtctcgaacttgagtgtgaacaatggaattggtggctctttcatgtctctctcctccttttcgtgattacgcacttccagcaaatagttagtaattggaggcaaagacatagcgtgtttctttttcatatcctcctctattttactttcagcattgcaagcaagttgtaacaaatgagaaagagatctatacttttcacaagcaagcgtgtcctgaatttctttgttaagtccacgtaaaaacctcaattctgtagcttcttcacattcatctaagccacaacgtaataaacaagcatgcatatcataatagtatgaagtaacacttttggtatcttgttttaaacattgcagtttgttgagcagaatatcagcataatacatgggaacataaacatctctaaaatatcgtttcaggtctttccaagattgtggtattttgttatgcctacaaagatgtttccaatcattagaagcatgtttaactaaaacactagaggcacacataaccttttgtttctcagacaagacatgcctttgaaattcactatcaaccgctagctcccaattaatgtaagcataaggatcatagtttccctcgaaataaggcagtgcagatttgatcttacctagaacatcgtcacttacctcataaaggtcatgttgatcactcctcatgtctcgacgaagatgtcgatggtgagcatagctatccccaattatcgtgcgtatccctgccattgttagtagaaaacaagaaacatatacaaaaatatgcgcgttcctattaactactaggtagtggcagctcaaaaatcacacacactcaagcttttaaccaagctcttacaagatcttaccaatgcaagcggaatggtgacatacaccgactcaaccaagcaccccaatggaggttggatgtatcgatgccttggctaacacttgttgtacggctgcaatcaaatctgtggagctctgggtaggcttaaatatgtagcaaaggaatagcaaatgctcaaatcagagaatgcaaagttgaataattgttcaaagtcaagcaccgtgctggtcctaggctagaacgtactagagacgcgagcctagacacaaacgataccacaagatagcactaggaacaactcatgcacaactctgatatatgagttcagctcaaacataacaatattttctcttttctttctttcttctttcttttttttcctttccttttcttttcttttttttttgggtgcggcttttcttttcttctttttttatgcaccattctgccttttttttctttcttttttttttgattttattttacaaaaacagattaaaggacctcaatgtaagattacagggactcaaacgtaaatacaaaatttacagggactcaaatgtaaaagttaaaacccaaaattagaactatacaaaaatggaatcctctcgtcctgtaggttccgtttttgcaaacggattttcaatccgatactcgaaaaattttcaccaagcagtatgcaagatcacggtatagattgaaaccgtgaccgagaggagacactcggactcggcctggtcgcggacccggggcggtggtgggtgaggaaaggaaggatgcggcactacctaggagtccggttatggtgagagaaaaagggaaactgatttcaatcaatctgatctactatttctttccagattaaactctcgcacttccaaaaacagatttggaaattcttcttcctcctctctacaccggcaacaagcacaggccgatctattcacgggcaaaccagaaactcaagcaaatcctaaatgcaactccaaaactgaccgataaaaaattctgaaaactacaaaaacagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaagtaatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggataaacgttgacgatccgattacaaccgtacgagacgttgtgttgcgccttagcgatcgatacacctctccgtgggttgttgatcttgccggtgcagatcaaccctattcctgcaagcaaatcgaagaaacaagcaagaacaagataaaaagcaatctgatattgcaaataggaatttaatacaaatgataagttggggttccgaagaacaagcagacggacggtctagccgacacgcgcgctgcaaacaagtagcaatggctaaactttaatctaacaaaaccc

SEQ ID NO: 23363 - DNA, 11877 bp, Oryza sativa
cgaaacctttccatcaagtactcacggccgaaaacgaaggtcgtatgaagcttcgccgcccgtttgaagtcaccagtgtagcaggtggccgaattggttttgggcacttggaggactcgaacttgatatcttgttgttcatccatgatgtgagcaacggatgtatccgtagtagccatggtgacatcaactcttcaccaccaccaactcatttctccatcaaactctccactcgatctcctctccgtctctaccgcttctcttttttctcctctgcaccattgtcatcttgtctcctggtgctcgacgaggcgtcgtctaatagctggaaaaacaaaaatgctttggttacttacccaacggtgtcctgtcgaggggtgatcgggatgacgccggcccggctggtgagacccaccgtcggcttaatcccgaccaccgaattccacgacgccgggcagattatcgacccatctgtctccgtccccagcgtcaccgccgccatgttcgccgccgcggccaccgccgaaccgctgctcgaccagcacggggtagccgtgaccacgtacgggttcttcctcatggacaattcgacaaacactttgtttacgcgatgaaatgctggggagatgacatgcacagagttttggggttgccactaccaccacttaccagcgtctcgccgccgcgtgcgctccagccgttcgtcaagggacggaagctggaccactcggcggggttggacttgccgaggatgacggcgccggcggcgcggaggcgggccgccacgccggcgtcgcagcggacgacggagccgagcagcgccagcgacccggccgtcgtgttgagccggtcgcgcgtcgcgatgttgtccttgaggaggacggggacgccgtgcagcggcccgaagccacggcggccggaggctcgctcggcgtcggcgcgcgccgcctgggcgagcgcgtcggggttgacctcgatgacggcgtgcagcagcgggttgaggcgggcgacgcggtcgaggtagaagcggacgagcgctgtggaggtgaggctgccgttgctgaagccgagctggatggcgtcgaaggtggcttcctcgatctggaacgctcggcaggcggtggcggcggcggcgagcgccatgatagcggcggcgagttgcagcggcaggtgagacataatgcacgtgcttttagtgtcagtatgtttttatttgcgtttgttaatcgagacacgaacggcatgagtaagagtaagcaccgaacagggaatttataggtatagcagtggaggagtatatgatacgacacatatgccatgacgccactattactaattttcgcacaaatgtgctctttagttaaccaaatcccacgaatgttcgtaggcaaaatttgctacggaacgctaaaaaatacaattaactaagagataccgtaaagacataaattaactatggaacactgtaaaatagtggtaattagctaatagacaccgaacacactattttattatttttataaaaacagagagagaaagagctgcgttttgcttttgctgaagtcgcaccgatgccgctgggatctgccccatggcagtgagctgccacgccatgaccggactaaacaaatgggtgagagaaagagataagaaagagaagaagaagaaaagagaaaaaaaatagaaaccatgaaaaaggaggaagaaatggaaaaaaatgaaaaaggcgatgatggagtgatggatgtcgcgcacgccgccaccgcatggtcaaacggcgtcgtcgcccggccccaacagccacacatgggcaaagccatcgccctgtcgcgcctgcgcgaacccatcgcatccacccgcgccacagttctcggctgcacctgcgcccgccgcgttgccatgcctggcgccccggccgcgctcaccctccagccgcttgcagcgttggccattcgcgacgtcggccgcccaccatggccatctacccgctccaccactcgcagcgtgggcatccatagcgcccactgtgccgcctcacccctggtgccggctggaccatgcctaagtattaattacttctctaatacttgcgcatgaacttccttctctatctggagttctaatactatagcacttagtacgagtactaaacaatgaacctgtaaagatgtaaatctatctttcttagatgaaataattaaataatattagaaaggatcccgaatacttacttaatagaagacctggactcttacagaattactcctaggaaactacactcgtcgaggtagaaatcggaaagagcaccaaacttccgagcacttctccagagctttccctgactctctacctatctctaatatacaaaagatacaatagatcctcttgtaattcagcttaaagttgtgtgttctaaaaatgagatgagctactccttttatttgctccatatgatggttataggtatgcgaaatttccaaaatgccgtccaaccatctttgtaaagttatcagtagcatacacgtggaagaccaggatcaaaggcgccagtggtggttcggccgaaccctgggccccacctcctagcctctcctttagctaggagattgagtggtgggtcctgatggcagttacgacagttatgacccattccatgatggtttcacttgacttgtgggtccttcaatccgtgtacttgtgtctaattggccggatgtatgttttcttatatgactggtgtgttttctccttaaaatacctgcatactcatatttcaccaacactagtggaaataattagtaataatccctactactaagttggatatcatattttatattattatatgtagacattgacggtcagatattatgatttaaggatcgttaacagtaccttttttaattaaccggtacctataatatattgtaggtgttattttttaaaaaaagttaccaataatatcagtgatgatttttctttataatcgacacctataattgctcaaaagtgccatttgtatattttttaacctgcataggtggaaaaaggtttatgagtgtcgattttatcatttcctgcatctatggtaccatcctttttgtgtgtttatatggtagtgccttaggcccattggatagaggtccaatacaagcggtagaggagaccttgccttcatctctcccgtctatcttggctgtcgcgcagattaaacgcgtcgtcgtccatgccgggttggtagcacagcggaaggataagttgtacttaagaaatagttcgagcaagtaaaatatatcttttttttctttctagctactttggaatggtcaaaacatccttttctggcaggacaattggcttaatggagccaatccgagtctccgagagttaagagtaggagaacggtaacagtttaatttagacgaggtgttttataatgatctcttgcagtgataaaatctatccaaactgtttatatttggcaaaatttactggaaggcattgtgattttgtgattttagctgctgaacatgataaaagttaatctatctatttttagtagaataggagaaagaagttgtgcgaaatatcaaaactgcccttagccccttcctccatgtttccattctctgatcggccccgaggcgagctgtcggtggctggaatttttacaatttggtctttttaaaaaacttatttcacaaatagatcccaaaagaacttacctaaaaatgatcctttttgggtgccagagtcgctggcgccgttgtcgtcctccagccaccgtagctggtcggtgccgaggtggcagggggagcgcactaatgtggctggcgccgcccatccccccagcccgcccaccatttttcctctcctctcctctctagtgtagatgtgcaacattttttattttgtattattttttttggtattttcttcacaagaaccaaccatgtgacttgtagatttcgaacattcttgggcctttttttacatcttttatatcctataaacacaaaaagttggggtttgtattttttttgttacatttgggtgccatttcttaaaacaggcgtaactttctcatacggactcggaatcaggcaaataatatatccacggtcatttacaaattagaacctccaaatttcgcttgcaagattgtgttttcgaggctagaagcttttcggtagagctttagaaaattctataagtcacatattttgtccatttgagtttatttttttatggttggttcttgtgctcttaagtgtgaaaaaatataaaaaaactaaaataaaagtaaaaaagttgcatctatgtagagagaacaagattgtagaattagagggggggggggggcgccagcatgcaaaacccttgggagacaaggttgctgtaaggtgacaaggatttgatgtatcaatgttccacttttatcatggtaatttagtaacgttgactagttaatttattgactgctggaaaatattgttcaagtaaattatggctatcatttcatgtagttatattttgaattagattaaatatttagtaacgttgactagttaatctattgagcgcattatgttaatctaatgtgttcacataaaaattctattggccacatattttattcgttcgagtttaaaataaaaaaaaaggtcgcaactccacggagagaaacaggattggaggggggcgctagccatgctggctccctcctcctaccacgtcggttcacgtgtgccacagtggcgggggactgtaccaatcatcctggcgctgtcccgttcgaccacggcgacagccactctggcgccatcaaaagaaccattttttagataaatttttttaagggtctatttgtgaaataagttttttagtaggatcagattgtaaaaaattcagctgtccgaagcgcaccaattcaagctctccaacctgcacttcgtcaacgagcacgtggcacgaaagggaaaagggagtcctgttgttagtgtgcggcagtgtggcctccatcctcgggatgtcagatgagggcttgcgtgtggcatggcgccacctgacgtacgcgctcgattttctttagaagtaatactccctccatctacttttgatatagttatatttcatcttggcacacagaataatgataagtaattctacttatcatccatttaaatatgatactagtcatttctcgtaaacaagcgatttattaatatttataattcttaagatccatatagccaatcaggtgtgtaagaatggagagtcattaattaaatccgagaaagtcattaagatgataggttgttgaaagtagatggagggagtatgatttaatgaaaaatcataaaattatatgtcggtcaagtgaaatcgtaagtttagcaccctatcgaacaaccatggttcatcgacagggacctctcgaacaacggctgtttggtaggggctttgtattaagacctatcgaacatgggatgttcgacatgccccttgcatgcatgcactttttattactccctctgtctatttttgatagtcatatttcatattgacacacagatcaaggataagtaattctacttattatccatttaaacatgctactagtcatttcttgtaaagaagtgattcattaatatttacatttctcaatgcccatgtagccaatcatgtgtggaagaatggagagtcacacattaaattcgagaaaatcattaagatgataggttgttggattgaaatatacctatcaaaaataaaactttcagatttaaaaatataactatcaaaagtagacggagggagtattattttcctgagcccatgatcctgtcgaacaacggtggatcgacaggtcctattgaaccaccattatttgacaagcgttaaacttacgatttcatctgaacgacctatatttttgtgattttcattcaaatcgtattatttctaagaaaagttcctctctgcaccgtccacctctcaacagactagcaagatcgatgaacagcttgtcgaactcctcacctccacagcgccggcagcgcccacaccggcatcctgcaaactcttcttatgaataatgggttaatatatttttttttctaaaaaatattatttaacaatttaaaaagtgtacgagcggaaagccagggagatgaacacaaccctcacataaatcgcctgttcgggcacaagcacaatgtccacatccacctcgcctacatgcctccactgaccactgaccactgcttccttcaacctcaacggccagcagtgagattgtctctccggtgaccactcaacatccatcaaagtccaagaggactccgcgaagacaccgatctgccacaacaattactgacattgaccaaggttgagaggatgattttgctgtgcgtgaagctggcgggtgatggtgcatgatctgaagacaaggaaatgtagagatttggggaatcagggaggaaagaaaaggaaggatctgaccagtgggactagctagctaggggcgttcttggccttttatattttctctctctcatattcaaacaaaaataatattttaatgggtgcggtgtttagtaacaaataaccatattttgatccaaagattgacttttgtcatgtgcaagaactaaaaccacgaagttacgatgattacggaaaattttgcctttatattttctactccttccgtttcacaatgtaaatcattctagcgttttccacattcatattaatattaatgaatctagacatatatatatatatatatatatatatctagattcattaacattaatataaatgtgagaaaatgctaaaataacttacattgtgaaacggaggaagtactcaatatttcgcttacgcatgtgcttgtaagacaaattttaaattttaaactttaatttgtaagacaaattttggtgttgatgttgtagtttttcaccattaatgttggtgttgatgctatttaaggacatatttaaggacatcaaacttcgaattactaaggacatatatataaaagttttacttataaattattttttacttgctacttcctccgtttcacaatgtaagtcattctagcactttccacattctagaatgacttatattatgagacggaggtagtaataatcagttgggatatgcatatgcataagtgaacagaagtgaccggtagtacttaaatcataccaatttatactaccaattcaacttgtttggtttgaatatttcttctagttagttgcagtcttgcagatcttatagatcaatgactgggccgactggcggccctttaatgttgttgttggacttctgatcagctacgacagtgcaatctgttaactccggtccaatgtgccttttggcgaccaaaacttggaaacaatcgcctccctgccgctttcattagcgggaaaaatggaggatcttggacaccctgatagctttggataatacggaaaggaaagaacaatcgggttttcaaccgggagcttccaacttggcctgaagttgtatctcaaagctacggaaaaagccaagctatagtgaccaggtaaactataagtcgcttttctggtcgtctcgtaggttgtacttgtttgagtcctctattttgataacgtgagatgtaagattgttgttttattatttgttgtccgctctatgtaactgacagggtgtcactttgtctgtttacttccacaattctctatatgtctaaattcattagtatctaaatgaatgtgggcaatgctaaaaagtcttacattgtgaaacggagaaagtataatatagacaaaggatacaatgggttgagaacaatggaaggaccaaataagtatcatgtataggttatttgcacttataacatgcctcaatgccccctcacatgtgcacacgacattctaattagcttataacagagtatgattagttataatgtgttattttggccttgattcacatgcaccggacaaatttgtgcactgaatcaagcgttttataagttcgtgtactaaattgtatcaacctattccctgcaaaaaaaaaaatcaaagtatcaagttcgtgtatcaccaatacaatttactcatataaaaatgttattgggatgtctgaaaaaatggttttaaatactacctcagttttcatttacttgtcactttgaccacgttttaggtttgcaaatacttgacacaacaagcttaccaaggtagtgattcctattttgtccttgctgagcctaagataatactcccacttaactaggggcattttggtcattttaaacttgattgcattagtatgtggcgtggccaaaagtgattcataaataaaagtggaggaagtagtgtataacatctaagttaagaggctgtgtgcatgctgtaggtgagatccacccatacacttcgccctttttcctcatgataagaggcactagggctgccggtagcacaggtgaatggtgaaacgaaagttttatagtggatatgtagatggggacatagatatgtagatggatgccggtctttgtttgtgggttagatcacttatatgcaccacactagtatgctacagaaagcagcgtcccaaccaaaccttgacgctatcagcgttagcgtccatcctttttcaaaataggatatcctatttaccagatatttaatttttgaattataaattattataatacattgaacatataatactctggactaccaaatttttggcatccctgaattggacaacaaaactagatggctatttagttccatcaatttatttgggcaaggatcaaaaagctccgtgaattatataacacaaattttatatacactacatcttgaagccaggcatcattcgaactttggtagcttgctcataagcataggccatttcaatcagccttggctcatagcccttcaatccaccgaagcaagtaccaaatggcactccttgactgtcgtacccagccggcacggtgatcgctggcatgccactgacggcgaagaagactctcccgttgtcattgggcgtgacaatcgcatccaactggtgcatcctcatcaacttctccagcccatcagcagacagcttattgagatgttggattgaagctttctccaccggtccaatgccgttggtcttttcggcttcaataaaatagggttgtccaaaatctttaagcctctcctgtaacaaagcgtcatacaacactaagttcttgcgtaccttttttttttggcaattaaatcgtaattaaacaagagtgtgctcaaatttaattttctgcattgggttgcaaaatttgcactttcaagaacaaattcatatctaatcttataatttttcaagccaagagaatttgtgatgcaagattaattaattaattcaagtagctcccatacatacctccaccggatgtgccttgttgaatgctatgacatctgcaagggaacgaactggggaatacaacaagtcggacaaataagcattcaagcttaacttgaactctgctatcattgcgatatgctcgttggaaaaaagaacattctgtacttcagtcagattttttgcgatgtcgatgttctcaatcaccatggctccatgtttcctttcattaagaagaaatgacgttttttagaacattaagaagatatgacttaataaacgatgaatgctagtataattcattttgagctattttagccaacattttaatggttctgcgctacacaatatggcacactttttattattgtataccactcaatttgcaagactatatccagataaataaacaaaataatttgttctatgttttccacatgcatattttcctactatatccagataaataaacaaaagaatttgttgtatatgcgatagtttttatcatattattgaatcgatcatttgctgattacagtgcttaatatgattgactgagtcttactttcttttctcatttttatgccagattgccagaaacaaacaatattgactataacattttattatactttcaaacatcatagaaagaatattattttactgcaacaatttctttcttcataaatgatgcttctaatacgaatatcaccaaaatcttttatagactgaatgcacatatgctagcatatgtattatcttttagaagtgctttgtgtttgtgtacctcattaattgaatatgtttttggtatgccctcagctgtttcttctcaaatatttcttgagtgaagaagccgttgggaataccaatcctcttgcctttgaatccatccatccttaagaattgtccatatccaccattaggaatgtacttggatgctgctccagtggcttcagcgtcaagtgcatcatacccaacaatggcatccaacacatggacagcatccgacactgtccgacatattggcctatattttgtcagattaaaaatgttaatagtatataattactgcaaaatgtccactcattcatacatagtcttccatatataacacctatagtatgtcacagtcctagttgtttttctgtgtagttaccatgaagtaaattttaatgcagtaacttttgttaccaaataataaaaagttaccaatagttaaaactaaattagcccgaaaatgtttaagtatctctattttaaatatatctggacaaatactgatatacagatgccgtaacgactcaatgcacacgtttttttccttgcttagaatgtcatatccattgaacgtgcgtgcgtatataaaatcagtaaaaaatgatgacaaatctagaattaaaatgtaatggactagatacacaaccgtatcactaagctacatagtttatggaaaacaaacatgtgttagttatttctcttttgaactgaaatagaacccccacttttcatgagctctacgagatttgtaaccagcaaaacatcatagttagtgaggttatgaggctaggtgacgagattttaacctttagtcgatcatttggtactccagaagctaaggtcctgggaacatttgaaaactgtgattgaatctgtttggtttagtaagagtgaagtcaaaattgagtttgttgatgcttttgggcacttgaatctgtgttaatgcttaaattgtactccctccgttttcttaatatgtgatgccattaatttttagcataacatttgatcattcgtcttattaaaaaaatacataaatatttttaatacatgacaccgttaattttttacataatgtttgatcattcattttattaaaaaaattatatcaatgttatttattttgttttgcatgttttaacattaaaaacattaactatgacctatactttagcatatttatattaattttttgaataaaacgacaatatatactttgtgctgttagtggagtagagttgtttggaaaatatctttagctaaaccgggagattgtttcatacaaaagcaacgcctttggcacttggcatcgaaagaataaaaagctaacaaataaccttgtgttagcacttttttaaccagaaaaattgtgttcatttttaaactgaaaatgaaacttgtgattacccaacactgtcctgtcgaggggagatggggacgacgccggcgcggctggtgagcccaaccgtcggcttaatcccgaccaccgaattcagcgacgctgggcacagtatagacccgtcggtctccgtccccagcgtcaccgccgccatgttcgccgccgccgccaccgccgaaccgctgctcgatccgcacggggtgaacgagcgcacgtacggattcttcatggacaatttcacaaacaccttgtgagcttatacgatcaaat

SEQ ID NO: 23364 - DNA, 2332 bp, Oryza sativa
  unsure (1)..(2332): unsure at all n locations
acccggccgtcgtgttgagccggtcgcgtgtcgcgatgttgtccttgagcaggacggggacgccgtggagcggcccgcagcggcgaccggtggcgcgctcgtcgtcggcgcgcgccgcctgggcgagcgcgtcggggttgacctcgatgacggcgtggaggagcgggttgaggcgggtgatctggtcgaggtagaagcggacgagcgccgtggaggtgaggctgccgttgctgaagccgagctggatggcgtcgacggtggcctcgtggaactcgaagccggtggcggcggcgacggcggcgagagccatgatggcgagtagcagccgccgctgagccatgagtaaagtaagcagtgagcagtgtctcagcagactcgtgtttattttgcgttggttaattcagacacgaacgccatgagcccatgagtaagcacactaagtagtggaaaacagtgggtttcttatagcagcggagcagtgggacgcctgacgagtgacgacgcccccatttctccattattaattgtcgcataaatgttctcttctctttgctcgaagaaaaccaagtagcttttcgatattcggtattttttatagatgaaaaattttaaaatgcaagtgcagtataatcactactacagaaatggtcaaaaacatattttcgcaaatggccagtggcttgcctccccaagatgtttttaaaaagccaatactttttcaagcgggcagcgcaatcacgcgtgtagaggccgccgcagtcgtatgtgccgtgcgcaagcggttaagttgtgccacccgcctacaataaaaaaaatcatcaaaaagagaaaaaaaaaatccaaaaattgaaaccctacctccggtttacttccactgagggccattgtcgtcgctgctctcatgctcgaccgccatcgtcacctctgccaagctcagcgactacggttccgttgctacagaagccgatagcggcagatccacgctcccaggatgttgaggtcgttgtcgccgctcccattcctggcggtggtggatccatgctcctgaggccgcggctgttgccgtcgtcgctccttcccgagcgatgagggattcacgctccagaggtcaccgtggtcgtctgtactgctcccgtgcccaacagcggcgggtccgcgctctagtggccaccaccggatgatctacgcactaggaatgggaagtgattgttgacggtcattatcgaccagtttcgaccgtcaatattaccaaaatagaggagaactagtgatgtttgcaatgcatatatatgttagaataataatattccactagtattaggttcactaaccttttgcagagaataaccataaagtggaggagaatcgacatcaactcaaacgataaatcaatcggacgatgtcgagaaccagacttatgtataaatgggccaagaactcagaattgacatgacaaactgggctaaaaatcacaagtctgcggagaagaacaacagaggagtccgccagccaaaccatgggctggttgggccggccccaggttcagccgaacctccctcgtcgccgttggatgcagggcttcttctggatggtgtggattagctcccaatgacggttggagggtatttccgaccattccaaccgtcataaccgtcattgggaggctatataaacccctcaccttctcacttcactcacacaccttaagcaaagctctctcatattctctcaagtttagtttagttctctcatattctctctcataggaatagagtataaatcaggagtccggaagtcttcggaagagttcgggtatggctctagtagctttcctttcctcttttgtaagctttgtacttttattagaatactcttctttatacatttatgatattgaaatactttccgagtatataaatgcctactttatattatgttcatattatactgactatactgctagcttatctgggagatgctttggtgcgggtataatgtttgcatatgcaattactctatgtcatgacgatgatattagagtagtatctggtagtttagacgtagtgtctagattacgggatatcattatttggggttatatgctgcggatgagaggtgggccgctgatggtgacagctcactacgggtattcctccgcgcgtatatataatcctaagttaattccatagggagggtattcctctgtatttagccccggttgtatggtcatgacgggctgttataaggaactcggcagtcaggggtggcttctcgaagtaccaggagggcatcgnnnnnnnnnnnnnnnnnnnnnnnnnnnnnnnnnnnnnnn

SEQ ID NO: 23365 - DNA, 689 bp, Oryza sativa
ttagttccatgacaaaattagaagtttgaagaaattgcaacaatgtgacggaaaagttggaagtttgtgtgtgtaggaaagttcgatgtgacggaaaagttaaaagtttgaagaaaaaagttggaatctaaacagggcctgaactacataaccagttggagacttagcgagccatgtagaccataaacaatttgaaaaaaaagagtaataacataataacaaagagaaaaaaccttgattataaaggtatgttattatgaaagttaagtcatggttataaatttgacaactagtgtcaatcaaagaactacagtctacggacagcaaaataggacaatgccatcacaaacatccattatattatattatagagtaaagttcatcaccggtccctaaacttgtaccgctgtgttattccggtccctaaactcgcaaatcgaccgttcagatcctcaaacttattcgactgtgtcatcccgatccctaaacttgcagatcacttgtttaggtcctccaacttgttcagttgtgtcaccctggccctaaacaggacggtctaaaaactttatatcaaaaaataattcatgactttttcatgtgaactctaatgaagacaaactttatatcaaaattgtagccctcgatgcgacctacaactttgtaattgaaaagtttttgaattaaaactg

SEQ ID NO: 23366 - DNA, 660 bp, Oryza sativa
ttggccctccgggcctgtgctcgcacgtggtcctgggagtacgtgaagcgatccggtgggacagcacgggtagcgcgagggtctgggagtggggtggagggcgactgctcctgcgtgtgcaccggcggtgcgcctcaagctgtgagggaccgataatgtccgggaagtcgaagtcactaatgtcgaagtgcgtggcggaagcccacccgtgctcggacgaagtcccggtaggaccctgccaagacgtgccgggcggctgtgacgaagtcccggcgtcctgccagaactacgcagacagcgaggccgacacacctgcctgtgacgatgaccccgcagcctgccaggagtgggcgcccggcgtcgtcccaggctgagcgaagcctacacatcgacgacgcgacacttgtaagcttacacataaattgagtatcaattgattgatgatgtacaaatagaccttgaatatacgtacctccgaagggagggggtgtcggcgtaggaacgtgcgcagctggacgaggagcagtcggtcggggacgcacctgtggtgctgcgtctgcctgagcaacgtcggcagcacgacaggtcagcgcacggagaaccgagcgcatcgagtcccgtatccgcgtgtacgtcgacaggtgctcgtctgcccccacc

SEQ ID NO: 23367 - DNA, 3223 bp, Oryza sativa
tagtcatccagtacgcttggtccctcgtgcagagtgtggacaggcctagcggcgcccgactgtgggtaagcaaggcactgtagggctcccacactacgtccgtcggcagaaggcggtcgaactccatcacaaactccgcgtacgaccgcctaacctgcacgtgagcccatcggcgctgcaatacaataaggtcagtgtgacgtaggatgaagttaacaatagtaggacaacattaccaaatactagcgacgtacctgacgccggcaccacagagtacccatcgttgggtagtcgaccgccggtctgttctcgtacagcgacgcgtcgtaagggtggtgctccacaagggggcggccgatcgcaatcctctcagccgcccaaagagaaatgaagagagggcacccaccgaagatcgcgccagggtccgtcctggtacaagcctcgcagaggccacggtactgagccgccagcaacgcggagccccaactccactgaggcacctcaccgaccgcggcgtcggcgatgctcctggcgtagtgcacgagaccccggtcgaccgagtgtccgtgactaccacagaacatcacccacccaaaaagccacaacaagtacgcctccaaacaacggctgaaggagtactcgtcggcctcctccggtagctggtcaacctgcaagcgttggatgaaatgttaggcactttacaagttacgtacataatacacgtcagtttaggtagaaagaacttacagtgaactgaagcagccacctcttcgtaggcccggtgttgcggtgctgctgcaacggctcgagcggtagacctggtaggcgctgcacgggtgcgaaacgtgccgtcagctcgtccttccagtcgacacccatgtcaactggcccgacagcgtctcccgcgagcggtagccccaacaagtaagagacatcctgcagggtaggggctacctcaccgcacggcaggtgaaaagtgtgcgtctccggcctccaccggtcgaccaacgctgctaggagggacctgtccgggtcccaacgtctcgtcacgtcatcgtcgccggtcgcggcctcaactagccgagccaacggtaagagaccggcctcacgcaacctgcgaaagcgaaataataccagacgttaaaatgaacacattgctaagccccctccaccgtagtaaggtaagcccggtgtcgtgaacacagtaaaaccatacctctcgacgaaggagtcgtgaaccaaaagtcgctcacgtgacgaccgtggacggaacgtcccaagctgagccccctccaccgcagtaaggtacgaccggtggcgctgatctatcgccggatccaacaactcaggatgtgccatctctgcaagtaacgtgttacatgttagggtaaataagaaggtaataatataattgtaaaaacaagttatctgaaacggaagaatacttatagagacatgcaagagtgcagattattgagaacataactttcgttacacaaaggcacgtaacgagaatgaaataacataaaacaaaattacaagccgtaaaacataaagacattacatgcggaagtctaacaagtggttcgcaacacaacacaatgcgaacatatcgataagttcgaacgaaattacaagcaaagccttttgccaacatacaacacacgaactacaccacgtaaccggtcgttccacgagaacgtctaggacggggtcgccttgaagtagtgccttcacccgtagggcgagctccatctgctgctgatcctgatagacctgcctccgccgcacttggtttttccttgtctttaggacaatacttgtaggtgtggccacgttcatcgcatttgctgcaccgcttcaccctgcctgcctccgactcatccatatcgttgcggatgcgccgagtcttcctccgtcccgccttgtctcggagtttcgttgggtcaggaatatagattatcagatcgttaatatttgtgaactccccagctacaccgaagccaaaaatctcgccactccatgtgtgatatattgcttgcttggagaagtattgtgacacatatactgcatcttggatgccacactcagatgccgcggaaatgacatgggtgcatggcctgtggagcagcgtcggctttctacaggagcagtgacatgtgccgtcgtctttgagaacgcactcctgctttactctcttgcggtagatacccctgcctgccttgtcttggcagagtacctcaaacctgtgttgttgggtaccttgcactagagctcgatgtttcatggcctttgcacgccactccgctagttttttctccatgaaagttccaaataaaatgttgttgttcggcatagagggaaaaactgcttggaaccgctccctgaaatacttgcatgtcccatgtaaaatgaactccactataccaactagtgggagtccacggacaccgcgcatcacccagttgtaaacttccgccaaatttgttgtcattataccatatctagcaccacctgtgtcataagtcttagcccatttctcttttggctcattctcaatccactgagaaaattttcgaatttgctccccagttcttctaaccaatgttacactgtctgttgggagagctccgagtgcttgaggagggtcaggtacagcggccgctggtcttgttgcacgctggtcactacatttgcctgtcaactcatctaatctcttccaaagctcattgaattttttctcctggttctgattgcatagcctcttgaacatgttcatcaactccttgttcttaaattgcttgaagaaattagctcccatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactcacaccattgcgg

SEQ ID NO: 23368 - DNA, 973 bp, Oryza sativa
  unsure (1)..(973): unsure at all n locations
ctcatgaaggtgatttaattttgggtgttaaataatgagattggtgagggagagggagagattaattagtgggaggaggaactcgaggagacagctcagtttcccggaagatcagtaatgtggctgagggaggacgaagatggagagttgagagaattgactgggaattggaaatacaggtttgtctcggtcatggtgattcaattggagataatgtagtgtaatatgatttggtgcttggtctgctttagtttcttggttgatgatcaacagatgattaaattcatggtggatggaaagtgcaatcaactagaaattaaatggctaacgtttgcatttgacgcggctgttcatcgtctctgcgagatgcgcgtgtggaggaggaggtgagtggttgggagatcagaagtcatcaggaattgcaaaaacggattcagatcgacaagttggttcaatttttagtgttagtggagaaaattgatgaaggagaggaagagatccgtgaggaattgaaagaggcgctgctgttttgatggagaggtagaaatgcccatggatgaagacgaagcagaaacacgtgcggggcagaacacatgtgagcggcgcttgggctggctcctcctggtcgggccctggtgcagacagagaaagagagatcgcgggagagattagattgaacgagagattagaacacacaagggatgtatcaaccaggacttaaggaggaaatggaaaaagaaaggaataggcgaaaaaaagaaaaatagaaagcaaggaaaatgataacgattgggatgcttttatggaaaagtatgaacttggaaggatttggaattttgacattttctggatttgggacttattttttttaaggatttgacagaattcatgagaacgagctccactnnnnnnnnnnnnnnnnnnnnnnnnnnnnnnnnnnnnnnnnnnnnnnnnnnnnnnnnnnnnnnnnnnn

SEQ ID NO: 23369 - DNA, 576 bp, Oryza sativa
actatagggcgaattcgagctcggtaccctcttactttcacgtttaaaatatctttaataataaaatatgtcacaacaaaataaaggcataaatatttatgactataattgaacgagcatactgatggagagatcaagaatccaggtagaagagcatcatgtgcgctttcttttcataaaaagacattgtgcgacaattaataatggcatcactcatctgtcgtcactcgtcacgcatgtgctcaatccgaattaacaaagacataaaacaaagttattaggtgaaaccacctgcgctgcgctatggctcagctccggctgccactggccgcggccaccatggctctcgccgccgccgccgccgccgccttctgctgctgctgctccgccgccactggcttcgagttcaacgaggccaccgtcgacgccatgcagctcggcttcagcaacggaagcctcaccttcacgacgctcgtccgcttgtacctcgaccggcatcgcccggctaaacccgttgttgcacgccgtaatcgaggtcaaccccgacgcgcttggccaggcggggcgcgccgacgc

SEQ ID NO: 23370 - DNA, 432 bp, Oryza sativa
  unsure (1)..(432): unsure at all n locations
taatgatgggaaacatctttgtaggcataacaaaataccacaatcttggaaagacctgaaacgatattttagagatgtttatgttcccatgtattatgctgatattctgctcaacaacctgcaatgtttaaaacaagataccaaaagtgttacttcatactattatgatatgcatgcttgtttattacgttgtggcttagatgaatgtgaagaagctacagaattgaggtttttacgtggacttaacaaagaaattcaggacacgcttgcttgtgaaaagtatagatctctttctcatttgttacaacttgcttgcaatgctgaaagtaaaatagaggaggatatgaaaaagaaacacgctatgtctttgnnnnnnnnnnnnnnnnnnnnnnnnnnnnnnnnnnnnnnnnnnnnnnnnnnnnnnnnnnnnnn

SEQ ID NO: 23371 - DNA, 735 bp, Oryza sativa
ggcccggcggtggtgcgcggctgggggcggcaacggtggcccggcggcgtgatgcggctgggggcggcggcggcggcccgatggctgggagcggcacctggcaaggcggcggcggctccggcggcgccccgcccggatccggcgtccccgaggtcggatccgactcccggatggctagggtcgttatggccggcgtcaccgacgatgggaagacggcgcgtgcggaaggacggcgcatgcgcgacgggaggatgccggcgtcgaggtcgatgcgtgcggcgccgtgcagcgggccgacgcggcagtggctggcgccagcgatgcttgccgccggacctcgtggatgaccaccggtgggggctgctgccagatggatggctgcgttgtgggggacccgactgggacgccggcttgcatggcggcggcggggtcgttgcgcgtcgctcgtgtggcggcgctgcaggtgttggccggtggagatgccgccggtctggggtcgagctcggattcagccgcacagcactgccatcacgaccggcgatgacgaggggacgccatgtgggtgccttctcatctccttggagctcctccccttcttgaccgcctggtcgtggggagctcctttgcgagacggtgaaggcggcggcaaggttgccccaggttgttatcgatagtgatgggcggtggcgggcactctctttggaggtgacggcatgggaggaaggctagctggtc

SEQ ID NO: 23372 - DNA, 349 bp, Oryza sativa
agaaagataaaactgagaaaaagaaaagctagtctaaatcaaaatagatacagcgggatgaacttggcagctatatatccatctatcttggctatctatactcataagttgtgcttcttaaggtgaggcgttggtccccggcgttcaaccactactatcttcgcaaactgatgaacatccgggctccctccatggacagagtttgatccaacttgcacggcttcaaccttcttggtcttctcctcatcgagcttcttctttgaatcttctaatcctctttctgttgatgaaccacggctcgacatggacgtgttcttcactgcaaaaaagatagtaatactggttaaaa

SEQ ID NO: 23373 - DNA, 599 bp, Oryza sativa
  unsure (1)..(599): unsure at all n locations
nnnnnnnnnnnnnnnnnnnnnnnnnnnnnnnnnnnnnnnnnnnnnnnnnnnnnnnnnnnnnnnnnnntcatctctacagagactgcccagctttacctgcatgatgtcaatagttcgcaagtctgaggacaacatagctattcgagagtcccacttactactagttactgcccagcgggatattgatctgtcctagtagtcgggcacttgctgggcctaagcaatgctagatgatcattgctttcacgggttcgtactgttatggattatgtcaacctggcggaagccccttccacaagtccaccccaaacctgctcatagagtaaccctgcagtctttcatacagtgggacaatgtactagtctaagtctgattacttagtcctgtggatgggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23374 - DNA, 590 bp, Oryza sativa
gtagggattattactaattatttccactagtgttggtgaaatatgagtatgcaggtattttaaggagaaaacacaccagtcatataagaaaacatacatccggccaattagacacaagtacacggattgaaggacccacaagtcaagtgaaaccatcatggaatgggtcataactgtcgtaactgccatcaggacccaccactcaatctcctagctaaaggagaggctaggaggtggggcccagggttcggccgaaccaccactggcgcctttgatcctggtcttccacgtgtatgctactgataactttacaaagatggttggacggcattttggaaatttcgcatacctataaccatcatatggagcaaataaaaggagtagctcatctcatttttagaacacacaactttaagctgaattacaagaggatctattgtatcttttgtatattagagataggtagagagtcagggaaagctctggagaagtgctcggaagtttggtgctctttccgatttctacctcgacgagtgtagtttcctaggagtaattctgtaagagtccaggtcttctattaagtaagtatt

SEQ ID NO: 23375 - DNA, 979 bp, Oryza sativa
  unsure (1)..(979): unsure at all n locations
nnnnnnnnnnnnnnnnnnnnnnnnnnnnnnnnnnnnnnnnnnnnnnnnnnnnnnnnnttgatgtttatgtgtgtgttcatgttgtatcttgatgttcttgtctatgaattaaatgtggtatataatatggtcaagccgatgcaatgagtaactccccatcaccccaagccgatattgttgttgttcttcagtctccccccccccccccggcgcgagctggcgtctttgaacaattaattcatcaactgttccattgatcaaatttcacaatgtatccaccaaaactccagattcatcaagcaaagcacgacgaactgcttcatcaactatatcttgaagtgtttcaatcatcggattgggaagacaatgcttttgaaaatcagccactgaatcagcccttgttgcgttatgacgaaacatcgaagacaatgcttttgaaaatcaggcactgattgatccatctattacctttgttccaccatcaaattctccattgcgaccaggatattggcgttgacttattcagacatgtaggtgtaaaactcgtgtcccaccaggcatgccaaaagagtgttgacaagaaatccgtgctcggccgatagtgccaggtctatgttgatacaaactaagtcgacaaacacaacggcatgggagatctgcttagctctagtgcatgtccaaaggccgatgagatgcaagcgtgctagtcagtttgatcgtgcaactgacaagatatgtaaacagttgatcaaatagccgatcggctgaccagctgatggagcaattccatccgatgccgatactagccgatagcgatagggttttgagctatcggctatatgtttgatgtagattccgacactttatgcaaataaagacaatcggctgatgatgacaaataccaataatatannnnnnnnnnnnnnnnnnnnnnnnnnnnnnnnnnnnnnnnnnnnnnnnnnnnnnnnnnnnnnnnnnn

SEQ ID NO: 23376 - DNA, 1328 bp, Oryza sativa
gattatctattaattaggaagaatatgttagtttccttttatctttaggatagtgtgtttgctgtccaataaggattttatgttttccttatatctttaggtaagtttctttcttgtccaataaggactagtttctacccatgggtataaatatgtacaccaggggtcattgtaactatctctcgatcaataaaatttcggcacatggccaccttttacctttctactttttcggcgagttcttgcttcgagttagggcatcagcttcgatcttatgataagaggtatgacttgtctcagctgtttgcgttggcatattagggcgtcgctttagatattctaatctatcttttacagcagttggtatatatcttagttaatctagcttagcattttaatttgatcatatcggctgagattcgttttagggtttatgctggtatcgactaaattatcttgctagattagattaagtaaggtatccaccaacctgaaaatcagtcaaaggcttgattgtctacatattatgtttcttttcatactttgcgttgcatcaaccccagtcgtgtttagaaccataatctttagcctgctttttgaatgccaataagggtttcatcggggttttagccggtgagttatctggatgttgcatcggcttacgaggattacatacaagttcaatttagttgatcgcggcgaaggttttattgtttatctaatcgtttggatttattaacatcggaccttcagccgatgtatgctttaaccatcggatcacttattctatcataattattattagctgtttgatttctactggattgtattattatttattcaagtatcagaatatacattggatatatagccaattgttcaaaaccctatcggcatcggctgcaattactctatcgggttgtcagccgatcggctatttgatatttattttatatatcttgtcagttgtaggatcaaactgactggcacgctcgtatctcatcaatttttagacctgcactgtagttaagcagatctcccagaccattgctcttgtcgatttagttcacgctaacacagatctggctctgtcggctgagcgcggatttttcgtcaacaatattccttttgttccctctgagtttccaccttccacataatttcttttagcttcctctccaagccaaatccaagatatcacagagaaaaattcctaaaaccatcagagagctcgtgtttgttttaagttatctcggagtcaccgtgcaaatattctaaaatccccaatctcatcgtttcctgttaaaaatatcctgccaaaattctat

SEQ ID NO: 23377 - DNA, 2337 bp, Oryza sativa
  unsure (1)..(2337): unsure at all n locations
aaaaaaaagaaatattaaaagacgagtctagagtccatataggtatatatataatttcaggatagttaagatttgatattaaaaataattaataactgacacatatataaaatataatatgaaattttagaaataaaaataaataatattagaagaagagcatagagtctatatagaaatacaatttacagaaaattcggaattaaaaaaagaaatattaaaagatgagtctatagtccagatacgaatatatataatttacaaataactaaaacttgatattaaaaataattaataattaacacgtatataaaatataataggaatattacacattagtagttttgtaaagttattgcaaaaattaaaattatgttgtcattttaatatatttcaataatataataagaaaacatatatgctattatatgagaaaagtataatgatgctagctgcgcaatctgcgcgggccaccatgctagtttttattataggattatttggtcgtttattcgtatgtgtatgttggatcgtgtcggagatcccaccggacctgcaggaactgaagtggacctagaaggctacgttgaagcttcagaaggccacgttccacaaggcaagacacagttccaatctttgatcatattgaaacctagtagagaaccacttaattattttttgcattgagtatttataaaattattttgcgtatgatttatttttgaataaatttgttagtatagttattacccattattacgttgttattattggccaaacccacgaattgctatatcgtgtcctttgataacctaggtgtaggtttatatacttcacaataacattgtagtggataagaccaccaaatatctataatcatatacttattttacccgtcgtcacatggtggcgtgtcgagtgacataaaattggttatttgatataagtcactcccctggagtgatatggaagattaataccgtgtgaagatggatgttgtggtttgtgaggccgtgcatattattataattattttgtggaatgtgtatatttacacttggagtatgcatgggcgtgtgttagctctggtggctttccccggatataaggactaccctcttatgccatggaaaatgttgtaattttgcgcccatccacaggactaagtaatcagacttagactagtacattgtcccactgtatgaaagactgcagggttactctatgagcaggtttggggtggacttgtggaaggggcttccgccaggttgacataatccataacagtacgaacccgtgaaagcaatgatcatctagcattgcttaggcccagcaagtgcccgactactaggacagatcaatatcccgctgggcagtaactagtagtaagtgggactctcgaatagctatgttgtcctcagacttgcgaactattgacatcatgcaggtaaagctgggcagtctctgtagagatgagtcttgaatcattcgtatgtgccgtgcttccggttaagaagctgtgtcattgggtgattcctatttatcatggtatgagtagcttttaaattaaaacatatgaaatatgtagaagatgaggatgaatggtgattaatattgctaccattttaaaatgacgttttacaactatttgcaaatgaaatgttttataaagtagggaaatactatttatgataggcttgttatgaaacctccttgataaactatattccttgtaagcccagtgtgtgtctgtgtgtggcgctacgtgaagcgacacaaacggtgtgtgccacgttgctttggtggagcgactcgcaagagcgccccgtctgtgttttccctttttttcatacggtcccatcgcctaacctcctgattttccgtttttcccatgatcgctccccctgacccggtttcctgattccaagcgtatatcccctttgggactacctgtatatttattgacaaattttctcctaaaaatttgatagatgtaattatagtacaatcgtagtgtaattacactgtaacttatatgtaattacactgtaacttgcatgtaactacagtgtaacttatatgtaagtttcacataattttgaatcgttagatctattacaagatttgtttcggtgaggaagaaaacaaatcatagcacacacatatgtgaaagaatttgttcccacgacatccattttaccgaaataacatgttatggacagatttttgaaagttacatacaagttacactatagctataatgtaattacatnnnnnnnnnnnnnnnnnnnnnnnnnnnnnnnnnnnnnnnnnnnnnnnnnnnnnnnnnnnnnnnnn

SEQ ID NO: 23378 - DNA, 1022 bp, Oryza sativa
tacgtcggcgtcgttcaaggctgcatcagtacattcgacctcttggattgctctggtttggatgatatttttgtctacctatttatcatatgtctatgttaatctagtcttagcaaatcaatttatctctatcggctgcttctcgttttagggtttctgccggtataggctaaatcgtgttgttagattagattagcttagacatctaccaccctaaaaatcagtcaacgacttgattgtctagatattatgtttcttttcatacttagtgctgcatcagttaagtttgatctactaagccgtgcttaaaaccataatctctagcatgcttcttgattgccaataagggtttcatcggggtttcagccggtgaattatctggacgttgcatcggctcataaggattgcacatacatataagttggatttcgccgatgacaacaaaggtttcactgtttaatctaatcttgtggatttcttgacatcggacctccagccgatgtgtgctttaaccttcggatcgatgcttatttatcatatcattgctagccgattggtttatactggattatattgcaatattatattatcatcagccgattgcctttatatcatcatctacattggacatatagccgatttatcgaaatcctatcgctattggctggtattggcatcggctattatcgatatcggctgagattgctccatcggcttatcagccgatcgactactttgatctactatctgcatatcttgtaagttgcaggatcaaactgacttgcacgcccacatctcatcaacctttggacctgcacaggagctaagcagatctcccaggccagtgtgttcgatttttttgtcaacacttgtgggtaaagatgtacacctctgatcagagtataatctattcgaatagccgctccctcggttatgggcaagcctagcaatgtacccaagttagtggtttacttcttaaaacttgcttaacaactaaaacgtggaatggttggcctgggttg

SEQ ID NO: 23379 - DNA, 648 bp, Oryza sativa
  unsure (1)..(648): unsure at all n locations
cgaattcgagctcggtaccctataccaactgctgtaaaagatagattagaatatctaaagcgacgccctaatatgccaacgcaaacagctgagacaagtcatacctcttatcataagatcgaagctgatgccctaactcgaagcaagaactcgccgaaaaagtagaaaggtaaaaggtggccatgtgccgaaattttattgatcgagagatagtttacaatgacccctggtgtacatatttatacccatgggtagatactagtccttattggacaagaaagaaacttacctaaagatataaggaaaacataaaatccttattggacagcaaacacactatcctaaagataaaaggaaactaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23380 - DNA, 716 bp, Oryza sativa
  unsure (1)..(716): unsure at all n locations
gaattcgagctcggtacccccactattactaattttcgcacaaatgtgctctttattaaccaaatcccacgaatgttcgtaggcaaaatttgctacggaacgctaaaaaatacaattaactaagagataccgtaaagacataaattaactatggaacactgtaaaatagtggtaattagctaatagacaccgaacacactattttattatttttataaaaacagagagagaaagagctgcgttttgcttttgctgaagtcgcaccgatgccgctgggatctgccccatggcagtgagctgccacgccatgaccggactaaacaaatgggtgagagaaagagataagaaagagaagaagaagaaaagagaaaaaaaatagaaaccatgaaaaaggaggaagaaatggaaaaaaatgaaaaaggcgatgatggagtgatggatgtcgcgcacgccgccaccgcatggtcaaacggcgtcgtcgcccggccccaacagccacacatgggcaaagccatcgccctgtcgcgcctgcgcgaacccatcgcatccacccgcgccacagttctcggctgcacctgcgcccgccgcgttgccatgcctggcgccccggccgcgctcaccctccagccgcttgcagcgttggccattcgcgacgtcggnnnnnnnnnnnnnnnnnnnnnnnnnnnnnnnnnnnnnnnnnnnnnnnnnnnnnnnnn

SEQ ID NO: 23381 - DNA, 743 bp, Oryza sativa
  unsure (1)..(743): unsure at all n locations
nnnnnnnnnnnnnnnnnnnnnnnnnnnnnnnnnnnnnnnnnnnnnnnnnnnnnnnnnnnnnccgtctgttaatgttataaataagtcatacccaataatcttgggttagtctctgcgggacccaccatatacccagttctatacggaatcatacattatatacggaagatattttggataaggaaggggaagtaaagttctactcgggcactataaggactactcggatcatattcatactttgtctctctagttctatttggacaagggggcacctgagggtataaatacatgaccccctagaaggagatgagagatggcaagccagaagatagatctagaacaaatctacacaagccaatacagatttagagaatccaagacaagccaacatatatacaccagaacaagcctagacaaatccaatctgaagctacaaaggcaaacatgagggatctagagctacctccaatctcaccgagttcacattcgaagaaaaagactacactagctgttggctgcatgtaagggtgcaatgccgctatgctaacaaggattggattaagtcatccaattattgtactaatgagatattgatatataaaggtaactctggatttggctaatatgagtagggctattacttgtcagttaagggggccgaaactatatataaattcttgcctattgtctcttttaccctaatatcgcgtacaccctgataccgacgaacaccataccct

SEQ ID NO: 23382 - DNA, 334 bp, Oryza sativa
gatattcgatctcgttacccctcgacatctccggatgatgacggctggtgcggaagatgaccatccatcgagagagcggagaggattatggaacgggagagaagggcggcggcgatcggcggtggatggccggatgcggccgccgccggcgactctcggtggcgtttgggtgttgaatgggtttattacgggcaaagccatcgtggcaggttattctgttctactatagatggccatctgggccgcccggcacggcacggcccatgcccggccgtgcctgggccgaagcttgtcgggccggcacggtccgaccgatgctccgggccgtgccgtg

SEQ ID NO: 23383 - DNA, 1272 bp, Oryza sativa
caccggcgatgtgggggaatcggggtccggcggcggcggacggaaaacgagcggcggccgaggtgcgggcgggctcggtgagcgcgacggcggcgatggtgcggcgcggcggcggctctagcggcggcggctcgcggccgaaggcggcggcaagcggcggagctcgggtgtgacggcgcgggcgcggtagggggcacgggaggagacggcaagtgggggaaacgagagagggagctcgggagagcgatgtataggtgcgggagggggcggacgtggccggggaggtggccgatttggccggcgacgtggggaggagagagagaaagtgggggattcaaatcccccaccacttggggcgcgcgcgcgcgggagatgtggagggagagggcggcgacgtgggcgcgaggtgcgggcgcggagtggaggcgcgacgtggagcggaaaaggcggcggcgattgccggcggaggcgggcggctggaggaaggggacggcctgacaggtgggccccacctgtcagcgtcccggagagaggggaaggggaacgggccggcccaaacgaaagaggccgaacgcgggagggagtgggccgacggcccaacaaagaaaaaaggagggaaaagaaaagaaaaagagaaaaaagatttttccagggattaaaattgcactttggtgatttttaattggtaaaaattatttccaaggctctgaaaattccactaaaaatcctgttaatatattgtgacatgtggaacccaagaaaaatcccacaatgccaattccaattattatttgcatttattaattagggaattagctctaggttaattaagataatttcttcggacgatttatttagccaaatttttttttaaagcaagcaaaaggggaaacttccgggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtccttctctcgctggtttcgaggatacgagtcggcttctccacatatgtcagatcttcctgaatttcgatgtgatccggacttgcctgttcctcaggaactctcaaacatttcttcaactgagagacgtggaacacattatggatgccaagcatgttggaggaaagctcaagctggtaagcaacttcacctctacgttccaaga

SEQ ID NO: 23384 - DNA, 4729 bp, Oryza sativa
  unsure (1)..(4729): unsure at all n locations
nnnnnnnnnnnnnnnnnnnnnnnnnnnnnnnnnnnnnnnnnnnnnnnnnnnnnnnnncctcaagaactctcaaacatttcttcaactgagagacgtggaacacattatggatgccaagcatgttggagggaagctcaagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcgtcggttgtctgcatagcttttctgccgagattgcacgattctcaatctttccctgacagctctgactttctcttctgcctcatttaaaacttctgtaccaaacaactggcgttcccctgtctgatcccagaagagcggggtacgacacctccgtccatacagtgcttcaaacggtgccatctgcagactagcttggtagctgttgttgtacgagaactcagcatacggcaagcttttgtcccatgccccaccaaagtcaagcgcacaggctctcaacatatcctctagtatttgattgactcgctcggtctggccatctgtttgtggatggtaagcggtgctgaaattcaaccgggttcccaattcttcttgtaatttctgccagaactttgaagtaaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgatgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgatccaccaaaacttctctttgaggtcttggtacatcttagtactaccgggatgaatggaatactgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggatcacttgcttgagctatgcgaacctgctccaccagtgtgggctgtgcctctagggcagccacgaatccgtgctcaactataccaaggttcagatgttccaaatcgcgttgaacctcacaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcaggttgagtaaagatgtactttagacttttgtgatctgtatatacctcacaacggttaccgatgagatagtgccgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctgaaaatctttcgtctgatcaggcaggattaagactggtgcagacaccaaccgtcgtttgagttcttcaaaactccgattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccacttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcattagtaagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacaggtcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcaacttgcttcttgacttccatcaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactgatccctggcttccgcggcactggagactggaaggttaccacctctccttttgcattggtcaacttgatggtgcggctggcgcaatcaatcactcctctgtgccttgtcaaccaatccattccaagtatgacatctaggtccttggattccagaagaatgaggttggctggaaaaatcaacccttggatttcaactgtcacagatgggcagtagtgagttgtggtcatgccacctccaggagtatgaactcgcattggtatcttaagcttcactaaaaataacccatgtgcaccagcaaaacgcttggaaatgaaggaatgggttgcaccagaatcaaacaatattactgccggtgtcgagttgacgggaaatgtgcccaatataacctctggtgctgaccgcgcctcctctgcagatgcatgattaacacgggcctgaacgaacttgggtccagtacgtcttggcttcgggcactttccaaccgtgtgtccgggtttgttacaattgaagcagagttcgggtttttctcccaacctcttgggctgttctggcagagctggccgaactgattgagctggaatctttagtgaactcggagtagggttgagactgtgctgctcactgttgttgtgactgccactatggtggttcttgttgaagctacccgggtggtagggacggtgcggtcggataaccatggtggaaggtccaccgtgatgtcccattgtgaaacgaggcttctgactcttcccctagggagtcctgaactgagctgccttcctcttacggtttattttgttacagtgctcctcctgacggatagccttatccaccagcttctcaaagtcctcataatctctagagatcaactggttagtcaattcatcatcaagaccagacagaaacttctcctgcttctcggcatcggtacgcacgtcctcaggggcgtagcgcgcgaggcggttgaactcatgcaaatactctataactgttctggttccttgttgcagagaacggaactctctcttcttttgtgccacaattccctcgggaacctgtgctttattgaaactatgacgaaactctgtccaagtaacctctgccccagttggacgggtcaccatgtagttgtcccaccaaacagaagcggggccttgcagctggtgtgtagcaaaagcaaccttctcctgctcgttgcattgcaaaagattcagcttcttctcaatggcatgaagccagtcgtgggcttcgattgggttggtggtgcttgagaaggtgggcggcttgacacgaagaaattctaacagtttggactgaggaggtggaggaccaaactgcaggttctgctgttgctgctgtgcttgctgctgcacctactgcatcacctgatggtactgttgctgcatctgttgcatcatcattgtcatcatctgagtctgattgtccaacacctgagcaattgttgggttctcgggcggtggggacggactgttgtcagatgcaccgttggcacgtgctccattgatcggctcttcgctgccactagcgttgttcgagtcgcgtgaaccattccttgtctccatctgaaggggataggtagaaatatgagaaaagaaagaaaaacagggggctcagaaactaatcttgcttatgaatttaagtgcaattatcttaatctgggattaaaacagtgaaaaagcaggcacgcaagctcctaattgaggcagtcataccactgacacatgatatcgaccgacgactaacccacaagcaacaaacctaaacacgaaaactagcaagcaaacagactaagaaggcgataaagctaagggcggcgactctgnnnnnnnnnnnnnnnnnnnnnnnnnnnnnnnnnnnnnnnnnnnnnnnnnnnnnnnnnnnnnnnnnnnnnnnnnnnn

SEQ ID NO: 23385 - DNA, 508 bp, Oryza sativa
acattttgcagtaattatatactattaacatttttaatctgacaaaatataggccaatatgtcggacagtgtcggatgctgtccatgtgttggatgccattgttgggtatgatgcacttgacgctgaagccactggagcagcatccaagtacattcctaatggtggatatggacaattcttaaggatggatggattcaaaggcaagaggattggtattcccaacggcttcttcactcaagaaatatttgagaagaaacagctgagggcataccaaaaacatattcaattaatgaggtacacaaacacaaagcacttctaaaagataatacatatgctagcatatgtgcattcagtctataaaagattttggtgatattcgtattagaagcatcatttatgaagaaagaaattgttgcagtaaaataatattctttctatgatgtttgaaagtataataaaatgttatagtcaatattgtttgtttctggcaatctggcataaaaatga

SEQ ID NO: 23386 - DNA, 391 bp, Oryza sativa
  unsure (1)..(391): unsure at all n locations
ggcgaattcgagctcggtaccccagagtacccatcgttgggtagtcgaccgccggtctgttctcgtacagcgacgcgtcgtaagggtggtgctccacaagggggcggccgatcgcaatcctctcagccgcccaaagagaaatgaagagagggcacccaccgaagatcgcgccagggtccgtcctggtacaagcctcgcagaggccacggtactgagccgccagcaacgcggagccccaactccactgaggcacctcaccgaccgcggcgtcggcgatgctcctggcgtagtgcacgagaccccggtccaccgagtgtccgtgactaccacagaacatcannnnnnnnnnnnnnnnnnnnnnnnnnnnnnnnnnnnnnnnnnnnnnnnnnnn

SEQ ID NO: 23387 - DNA, 393 bp, Oryza sativa
ctgatgggctggagaagttgatgaggatgcaccagttggatgcgattgtcacgcccaatgacaacgggagagtcttcttcgccgtcagtggcatgccagcgatcaccgtgccggctgggtacgacagtcaaggagtgccatttggtacttgcttcggtggattgaagggctatgagccaaggctgattgaaatggcctatgcttatgagcaagctaccaaagttcgaatgatgcctggcttcaagatgtagtgtatataaaatttgtgttatataattcacggagctttttgatccttgcccaaataaattgatggaactaaatagccatctagttttgttgtccaattcagggatgccaaaaatttggtagtccagagtattatatgttcaa

SEQ ID NO: 23388 - DNA, 283 bp, Oryza sativa
taatttattgcgcaataagtcccagggctgacgtcagcggaaagggggcggcgccgacatgcgggcccctctggtcagcggctccaaagggagggaggtggcgactggcacgtgggccccaccaggcggtggctcaagggggaagccaagggaggcgccggcatgtgggccccacgggcagcggctcaagggggagggagtgggcggcggcatgctcggcacggctcaagccggccggccatggcgaggcgaccacggcgcacgaccgccggcggtgcgggga

SEQ ID NO: 23389 - DNA, 1234 bp, Oryza sativa
  unsure (1)..(1234): unsure at all n locations
gaattcgagctcgttaccccaaattgaactgcagagatcaaatactgaactggagcaagcaaggagcactttggctgaggaaagaagaaataaccttcgctcctgcaataagatcaattctaataaaaatagcagctcttcttctagaaagcatctacaaggcagagtatcctcaaagagtaaaaatacggcaaaggaaagtggagctgttgaaaacttggagacactgtaccgttgtgattctgatctgggttcattcatggctagaactaagaatcctgagctgtatcgcaatgggtgtacacaacgtatccgtgcaatcaagcagcgaagtccaaattcggatacatccctggtagaaaacagcaagcaaactagtgcactgaatagccgttctaagactggaaaaactgataccaacagaaacccacagagcacaaggtccatcatggaacagatacttcaaacaaaatttctggccaactgcaagagaaagagaggtaggcgaagcaggccaagttacatgcatgataattctggtgagcatgggcaaacagagtacaagtcgtctgatacatctgatggaaatgggtgtttgctgctacttcaggctcttgaacaagatctttcacctctaaaggcgtcttctggaagtgttggtgagggattagctgaccagaaggatgaattgctcaaggatgaaaaggatgctgacttgaatcttcaccctgcttcccctggaccaaatgatggaccttcagttaaccacatgccgatgtaaaggagggaaaggttttaggctattagagtccttggatttgattttgaggccaaaactgcccctgtatttgggaaccccctgccaaaatccagttattattatagcatggttaatagtggacagaggtttgattcacctgctggaaaccatggtcctggtttgccatggactggtgaaaaccttaaggaagtgactgaagctgccaaaggtggtccaataaagttttaagaccggttcccggagtgtcctccggtcacaaaaagtaaatgnaatgaaggacccatttagaaccttggtttttttaatttacaacataggcctcggtaataactttcggaatatgtattgagccctgagcatggttaatatgatgcaggtannnnnnnnnnnnnnnnnnnnnnnnnnnnnnnnnnnnnnnnnnnnnnnnnnnnnnnnnnnnnnnnnnnnnnnnnn

SEQ ID NO: 23390 - DNA, 832 bp, Oryza sativa
gcagacttctgaattttggcccaattcatcgtgtcagttctgagttcttggcccatctattcatatgtctggttcccgacatcgtccgattgatttatcgtctgagttaatgtcgattctcctccactttatgatcattctctgtaaaaaagttagtaaacctaatactagtggaatattattgttctaacagatttatgccattgcaagcatcactagttctcctttattttggtagtatgaacggtcgaaactgatcgataacgaccgtcaacagacttcttctccaaagcttctcctactgaaagagagagagatagagcaagaatgagtacaaccacagtattcagcaagtcacacagggagatgcatgattaatgcaagggggtacaaggggtaataatatagggttaggttttgcagtaaatagcatttaaaagtcacttagttgcccaaagttattttgtaaatataatcctagagctacacaatattattactcaaggccgtgaacccatacgaacctgccataacccaaggcctatgatgattccgaccgaactggcaaccctacctgggtcccagttcgtcccaagccaacccaggccaaccattccacgttttagttgttaagcaagttttaagaagtaaaccactaacttgggtacattgctaggcttgcccataaccgagggagcggctattcgaatagattatactctgatcagaggtgtacatctttacccacaagtgttgacaaaaaaatcgaacacactggcctgggagatctgcttagctcctgtgcaggtccaaaggttgatgagatgtgggc

SEQ ID NO: 23391 - DNA, 768 bp, Oryza sativa
  unsure (1)..(768): unsure at all n locations
nnnnnnnnnnnnnnnnnnnnnnnnnnnnnnnnnnnnnnnnnnnnnnnnnnnnnnnnnnnnnnacataagggttataggcctcccaactgcatttgcatgaatctggaataaaacaaatagtggcaatccattttcagttaaatggaacacacggagttgagaaatcaatataaaatcaaatgcagatgttataagtcataaccaattgattttttttaattgtaaaagcaatcaaacaagaaatagagggcaaagttcatcgatcatcaactaataataccttaagtagtcctgcattcttgaagcagtcaaaaattttggttaacaatgaacatgttatctgatcatttcagatgagcgggatgcctaacctgaaatctgccttggtttgtccctacggcaagatgagtgccacgctgcgcccaaccgatagaaattaacattatagagacctgtcaaccacagcgtctcatccaaccataaccaagtccaatatagttaaagcaattggtttcttaggactgaaaactttatcgaatttcagtctctcaggaatttttcagacaaaaattttgagaaaattctttcaggttataaatcctgaacttctatgctgcatgttggactgacgtacattactttttttcttcttgatctaaaagtgaacttaagcaattctaatcccagagatggccctaattaaaatctgcctgtccaacggtgcctgtttttatacatacatgcatgcaacaaaaaaaaattaaaacc

SEQ ID NO: 23392 - DNA, 4509 bp, Oryza sativa
  unsure (1)..(4509): unsure at all n locations
gttttttcttctcaagtaaattgcattgtctctaccttgactttacttgcactggtggagaaaccatcttctgtcggttggtaaagatggtcggccaaaatacacaatagtcccggttgcaataaagatatctttaatcccagttcaaaaggttagagtagtttttttatctttagtcccggttagtattaccaaccggaacaaaatatctatttctagtcccggttggtaacaccaaccggaacaaaagatctctattatctttagtcccggttggtgttaccaatcgggactaaagattataggcccgattggtaacaccaaccggaataaaagatcagcatgcgcaacatgggcggcggagagtacgaggccaaatcgaggaggaggaggagcagttaatatattctatctcctccctggccttatctcttcctcctccatatctcttctttttagaatttgtgtgtgtatttgatttgtgtgtgatgtgaatgtgatgtatctgtgatgaattttgtaaaatttatgatgtatctgtgatgtatcgatttggggagttgaggatttgaggatttggggataatttatttgggattttgggatggggatggggtgaaatcaatatattaaaaacaatgaagaaaagaaaataataatggagcaaccggatctagctagcctagctctatctttatatttagtcctggttggtattaccaaccgggactaaaaagactctatctcaccaaccatgactaaaaatggatttttactcccggttttttcacccgggactaaagatagtgatctttagacccgaattggtagtccggtttgaaaaccgggactacagtgaggttacgaaccaactcaccgggagtaaaacccctttctccaccagtgttgacatataatgctatttaacggaacatattgcatttcttttgtatttctctttttcttttcagtgtatgacaattttgtggagaagccgataaagggtcttgagtgtgacaaaaaactccagtgccatagctattttcatcttctttggatttcatgttgttgcaatgctgctgggggtatgacgagcgatgagattcaaactcacccccagttgtttagaaccatacatactacatacatactagtaatttgtccatgctaacgctacggtgtaataatattttgattaataaattatattattaaatttcatgttagtcaaattacatttctagaatcagtctcaaatgttaatttaagacaaagggcaaaaatatcatattgtctgaaaaaaataatttaagaccatcaactatatctaggctaaattctttcccatgagtcgctttttaaactgctaaatggtatgcgttatgcgaaaagtttatataggaaagttgttttcaaaaatcatattaatatattttttaagtttttttataactaatacttaattaatcatgtgttaatctatcgctccgttttccgtgcggaggggaggggttcccaacctctccaaaagaaaacagccctaatcacctcgacacaagtctagggacaatatatgtccatgtgtggcggggtaaaaataaattgaagacacattgcacgattagatccagacattcatttcaaaagcattataagaccaagtgcatagacattgaaatgccaaaaattgacctggcatggccaaactcaaaatgaaagctaaaccctgtaaacattcaaattctgtttctcacacaacatcccacattccacttgctttgattggagtgaatatggttaagaatatgttcatctcggatccaaaatataccttgcttaagaaataagttgacatgcattgcaattttaaacaaatattaaatttgttagcttgacctttagaattataataaatcagtacctattcaggatattctactgattgtagtgaggtacacaaaagaatgccaaattactgcaaataaaaggagcatccacattggtctcgacaattctaagtcattgcttacatggtcatgaaagggcagtcacattctaattctgaaacaagaaagcaatacctacataagggtgttacaggccacataagggttataggcctcccaactgcatttgcatgaatctggaataaaacaaatagtggcaatccattttcagttaaatggaacacacggagttgagaaatcaatataaaatcaaatgcagatgttataagtcataaccaattgattttttttaattgtaaaagcaatcaaacaagaaatagagggcaaagttcatcgatcatcaactaataataccttaagtagtcctgcattcttgaagcagtcaaaaattttggttaacaatgaacatgttatctgatcatttcagatgagcgggatgcctaacctgaaatctgccttggtttgtccctacggcaagatgagtgccacgctgcgcccaaccgatagaaattaacattatagagacctgtcaaccacagcgtctcatccaaccataaccaagtccaatatagttaaagcaattggtttcttaggactgaaaactttatcgaatttcagtctctcaggaatttttcagacaaaaattttgagaaaattctttcaggttataaatcctgaacttctatgctgcatgttggactgacgtacattactttttttcttcttgatctaaaagtgaacttaagcaattctaatcccagagatggccctaattaaaatctgcctgtccaacggtgcctgtttttatacatacatgcatgcaacaaaaaaaaattaaaaccgtttattaatctattatcattgatgaataattataattagagcatttgccttattacaagattagaggagcataataggtaaatgtagatcaaccaactccctttttcatggctaacatttgatagaaaatcctccataaaaatccatcaaatgtaatatttataatgcaattacaatgtaagtataattagggttaaataagtcacattaaactacacaaaacaattgctaggtaccaaacaatctgtcaaactcatgatctctgtcatgcaacagaccaatggagctataaaaagattgaaagaactggataataatttggaaagcctgaaaacaggaactacgtgcaatttgggccagcagttcacaaagcaaatgtacaacaatgcttgtttgttcaatcgaaattaaagaagtgaacttctacagtgtatgtatgtatgatgagaaaaatgtggacgactgcgtagcatttcaatctcatacctgctgtgtgggttcctgctgctatggaggctcctgctgatgttgctcgtaattgccataaccatgtatccattgatgtcccgtactcctgtcggggttaacctgtggacaagcaagatgcagctagcatcaacagacaagaattcaactctgtacacagaaaaacccccctacaaatcccaatatgctatcacggcagaaaatccacaagatggcgacctggaggaaggccgcccggtgccctagttctgtggccgcccgtcgagcttgtccgtggccctgactgaggcgaggaaggcgtcacggtgagggatactggtcggcaggggattccggtggtggcgcgacggatagcagacgatggaggctcatcggagaccaaacgacggcggcgcgacggagactggcaacggcgtgacgaaggccagcggtggcggatcgacggcctacggggcggcggcaattagggttggtggcagtgcgctcctgaggggggcacaatacgtcgattgcgcgtgcagggcaaggagatgcgcccgcgcggggtaggcgaggtgagtcgatcaggatcgttcgatcgggataaatgaatacagagcgtaggatttgatgaatgaaatatgaaggatgtaagacccagttgttgaattatagggtagatgcagagatttatgctttgatgcaaattgtagcacgcaccatcttccagcatcacattatctagctctttttaatgatgtaaatcattattgcaagattgccattagaagattacaaaaattccactataattatcatccgagtggcatacatgcaaaattaaaaaaccagtggcatgcatgcaggtaattactatgtatacatagatttgtaaaaatattgtggaaatgatgtgaggggtaatgattggatatgtttacatgttgatttgtttaattaaatagattgtagatgatgttacatacttgcatgaggttgaatatgtaattattgctagtgggtaatgatgtggcatagttgcatgttaagatttagagttagtgggttgtaactttatagaaagtaagtatagattagctaccagtacaagatgtaatatcctcgtgataaaaaagttaaaatatgctttctttgcacgtctcttnnnnnnnnnnnnnnnnnnnnnnnnnnnnnnnnnnnnnnnnnnnnnnnnnnnnnnnnnnnnnnnnnnnnn

SEQ ID NO: 23393 - DNA, 6254 bp, Oryza sativa
  unsure (1)..(6254): unsure at all n locations
nnnnnnnnnnnnnnnnnnnnnnnnnnnnnnnnnnnnnnnnnnnnnnnnnnnnnnnnnnnnnaatgatgtaaatcattattgcaagattgccattagaagattacaaaaattccactataattatcatccgagtggcatacatgcaaaattaaaaaaccagtggcatgcatgcaggtaattactatgtatacatagatttgtaaaaatattgtggaaatgatgtgaggggtaatgattggatatgtttacatgttgatttgtttaattaaatagattgtagatgatgttacatacttgcatgaggttgaatatgtaattattgctagtgggtaatgatgtggcatagttgcatgttaagatttagagttagtgggttgtaactttatagaaagtaagtatagattagctaccagtacaagatgtaatatcctcgtgataaaaaagttaaaatatgctttctttgcacgtcttctttcaacattgtacaacggcgcataaaaactatacaaagtctatttaaagtacacatgtacatcacatatcttacacaatatcgagcacacaagacttgctaaccacaaacttttccaaaatcatgtacgtaagatcattccttgtgttgcataactggaatcgcagtctcaacattcataacacaagcaatcctcttcctttcaactcgccccaatggctagcccagtaaggatcctgaaacaaattctcattgttgaccatgagatgtcccagtagatgagtaccacttctcaaccatgctgttcttcccaaaattcgtattggtttgaaactgttgcggatcataggtccaacggaggtgtttcctgttacatggcatggcctgtcaacctcaactttttcatatcataagttacatatcaccactagagaacagatctctttcgtggtaaaaaaacacaaatttctcggatctataatctttagtgattttagttatatcactactaaagatgttttttaataccggttggtaacaccaacggtactatacaatctttagtaccggttggtaataaaagatagtttttaagtcccggttcaacattgtcaaaccgtgtcaagccgcccctcaggatctttagtatcgattggtgtgactaatacttgttccagttgatgttaccaactgctactaaagattatgttgatctgtagtaccgattggtgttaccaaccagtaccaaagctcatttcccttttatatgccttcttcctcctctagctcgaaccattgttgccaagaggaggaagagaagtgctgccaaatttttttggaaagtatttggtgatattacacgaatcgaaaggatctaaaaggttagcaatttcatcctctattgatgtatggttaacatattacatttctagctatgtttctacacatttctctcacaaaaagttgtggaaaaagaggagagaataaacttttagagaaaataagagtactttagaattttagagacattggatgaaaatgttaaaaaaaaagacaacaaaggaaaattatagaaaatgaaggaataagaacagaaaactaagtccatttttttttaaaaaatagttagaaataagaatatattgaaaatatgctcagaattttaaaaaacttctaaaaatagttaaaataagtataatacatgaaaaaaaatacttacaattttataaaacttctagaatttatatataattaaccatagctctgattaagtccatttaaaactcattaaaatcactagaaataagaagaattcattgaaaatgtttttagaattttaaaaaagataatacatgaaaatgtatatttacaattatgatgttttaaattattaaatgcttatttaaccattttcaccttcgtcgacttcgtttacatggccgatgcatctacatgaaataaataaatgtaaaggaagtcgaggaaggtgaaaataatctttagtatcggttggtgacatcaatcagtactaaagtgttgatccttagtaccggttgatctttaatccctaaggatctgactcggtctgacaatgttgaaccgggactaaaaacaatgtttagtgattgtacagtactagtggtgttaccaaccggtactaaataacatatttagtatggttggtaatagatctgagaaatttgtgttttttggtaccacgacaaaagattagttctccagtagtgatagccaatacttgataattgtgacaaaaaaaagcaagaaagcaaaaatagttatcaacaatctcacacagaataaagatattgtttgacaacagcgaatagttgataattgtgaaaacaaaagcaggaaaagaaaactagttattaacaattttagtcatcaaaataattattattcacaagtagtgacggattttaccttgtgcagcaggtcatgtgcaatgtagtcccaaggaagagatactgacatcaagcaacattttagaggcagaagctcatcatcaaagcgtttgttggtagatgcagcctcgtaggcatgctttgctagttttgatgcagtagatgctgcactatggacaagggcccgaaagctatttcctggatctttctttgatctctcatggctctgatctggtagaagacaatcattcccgtgtgagagtttgatggatcaacaacttgcactagagctacagtaacccaaaaagtgaatgtgcatgtctggggtggggcagtaaggatatttggaagtagttctaatgttgtacatttgttatagaatgcaaaatgcaaactataacctagcattgcaccaaaaagtgataacttgtagagaaacaaacatttcaacaacagtataaagatacgacagtagtttaccaattaccatagcaatatatgtgtgtcattattttaactgagtcccaaatccattctattagaactactcattacagataatgcatgattgcatgtcacagcatgataattatggcactgatgatttgggactctcagactaaccataactgacctgctattccagaaacagctacttcaacttctccacgtccttcagggcccctcatataaagtttatcaagtttagtgcggtcatgcccgagtgagaataagctctcaaattttgatctgccagctataacaggatatcagaaaatgtgaaacctacaaggaatgaaatgttaggtacctacaatttttttaaacaggaaatccactagttgagcaaagggttgatgcagttaaaaccagtactatcaaacatatgattctattagatttagctatggaggaagaaatatgttgacaggaatattaatcatgtgacaatagtttctgtgcagataaagttgaaaggaagcaaatacttcagaagaccaactgaacaatagtttccttggaaatacttagatggacgaaagactaaccatcataagcttctcgaacgttttggtagctgacgtagcctgaaaagagagttctctgcaataataatcacagaagccctatgtaggtgagaaactcattaatattgtatgacattatacatcataaagttgtgttgcagaagcagatatcttctaaagcgtaactatgctttgaacaagagtgatgccagtaggcagagagaacctgtcaatagttctaaatttatattaaaataattaggagcatagtgaaagatgtgcacaactgagaaggcacgactgagcaagccctccaaagcatataaaatattattatatctataaaactagaaaaggttgaggtgccaagaaaatactactttactatggcactgataatatggggcctgaaactgttgtccttgtgaccacaataaattaccagttgccaacaaccgaagtttaacaagactcttatgggtttgaacaaatgctcacagttttaaagtagatcggttttaaatgaatgatcacagtcttaaagatatgatggatttggcactcaattactaccggaaacaagaaagtactgcagatcggtaatgtttaacaatgcataactcttttaaaaactgattaaaacttctgatcttatgtgacattatctaaaaaaatgcaagatgtgataacatatatttctaactgcagaactactcacaacaaaaaaagtgatttgaagttctttccatctgaaaatggtactacaaagaaacctgcatcgtatgtgtgtgtgtgtgtgtgtgtgtgagagagagagagagagagagagagagagagagagagaacctttggtggtttttcttgtttgctcccagtgtttaccccagatagcacatttgagctaggatttttcgattcagtgttttcaggaaatgctgccccatcatgtgcattgagaataacacagtagcaatgttcagggtctgataaaacctgctaaaatttgaatgaccacgttaatcattagggttttcctatagagtatatatatgaaaacaatgaaaacaatgcaatattaaagatacatccatatgacaacacttgttagaacgctgaacactatctcttctactagggggaattaaatgggaacttacaactgcatcaaaggtatcatcgaagtcatcaattgagaaacaaatattggggtatgcaggtaccgtttctactgcctgttcaaagaaacaagaatgtatatagaaaaaccatctcttttaacagaaaaggccagaaaaaaaatcaccttccttcgatcaagatgaaaatttacgcggctcggggatgcatacacagtttttgtgacctgttttgataagacaatgagtttgagatggaattacttaacactgagaacatgttaaactttagctagggtagatagcattgcaacaatgaaatacagaagttaagagttaaataaaatggaacaactctttcagagtcaggttcatttcaacccaaggcttggaagaataaagaaaacccagccaaatgatcacacacgaggctttctgcagtccttgagggcaggaggtaccataatcctagcagtcaaatacacaccatctaatggctggaaaggttttgtaccgcccgccacgacggcctattgagagcaggtaccaatctatttctaatggtgggagggtaacatggtaatttcgcatcaactatttcttcccatccaacgacattacctccttggctctgcagctcatgcgctgtcttcccgtcttccctctcctgccgaccatcgcccacctttgggacagacatggccgacgccgatgtcaggggtgccagatatggccgagggcggcggtagctgggaggcttcctcgatttcatgggcggcctaacaacgagaacgatgagcagacagtgacagcgatgacctttgcgtggcagatgtggcagtggaccggctcgacgaccttctgatgcgctaggaggagagagcagggaacgtgggggcaggtgacggcagggacctccctccaccctggtccactcccatcgccgctggttcagtactgagctgagaccccactgacctctcttcctctttattttttgtttgttgctatgaattttgttgttgggtttgctgaaccaaacgtaaatagctatatgctggaataccagattacagtggaattggcagttttatattgatgaactataaaaacaagatccagagcttggatctgctgtaaataataggatatcgattcatgagaaagtcttgttctttgagttacgcattatttttcctcatccagattcctccctctgttcagatcaaagcagcagactcaaattgggtgccatcatgtgcattccccttgcaaggcatcctccctgatcctctgatcccattcccatgtctgtcgtgagaaacggatatagatacctagcattgctatttttaacttttggccatcatcctcccagcaaatcaatggttagatttgaatggtacccgtcattaccttgtacctggtggcacctcttaaggatggtaaaatcctctaaacacacagaagcctgatccagtattgtctgtgttctggactgtttagctccaaaacaggtgaaacaaaatttaaaggagttgcaatatgcagatttgaaccagcatctttgtctttcaatgtaggaaggaatcaagtggataggaccattgttcgtaagaaacaatactaggtattagttggcaaacaactcgaatagctgttaatcttttaaaggattttctcaagacaattt

SEQ ID NO: 23394 - DNA, 2558 bp, Oryza sativa
  unsure (1)..(2558): unsure at all n locations
ccccccccccccccgccccaaacacccacacacacaatgatgccagtataaattaataacgaaagatatctgactagttctgtaagttagaaggtaacctagatccagttcacaactgctagagcggggaagaaacagaaaatagaagcataaaactagtacagacaacatgtggcaacagtgtcacatttgagcaaaggaaggataagaatttaagagaatatacaggcaacttttttactgacagattagaagtttagaaccattaagttgcacattagaaaggatgtgcatcactagatcaccaaataaacttttccttgttaacataaataactgaatgccaatcattcaagataaatactaggtaaattttgctacaagacatcgtgacttcacgattttagctctaggacaccgcacggaatgacttttggggtaatacactctataaatgtggtaatttgccaagggacactgcacccattaaaataataactttcgctggaaggagagagaaaaatagcgcgaaatgtcaagaatacccttggacccacatgtcagctctcccatctctcttctctctatcccccccttccttcccacgcttccctgcgccagtccgccaccactcatcgattcctcgcgctctagcccgccgccaccacctcccgccaaagctgcttgccgcctcctcacgtgcgcccgccggacatccgagcgccgcaggtggctccggatgcgcgccctaccccgccgcctccgaccgccggacagctagcgccgccactggttcagggcgcgcgcgactgccggacatccgagcaccgccgcctcctcgatgctggcaaattaatcgagattcgctatagatgtttttctctcgtggcaagaagatggataatcaaacagacctccaaaattaacagctcataggcggaccatggacacctggaccatgacgagctcccacgtgagctcgaacaccttggcggagatggcgagcgcgcccttctgcccgttctgcgtcgcctcgatgctcacctggcagtccttggtccgcgccatgaagctcaccatgccggcgatctcctctagcttggcgatgatgtcggccaccgacgcgccggacacgaagcgcatcctctcgccgcgctcctggaacagcccggacaggtcgaagctcggcgacgatgcaatgatgtcgaacgcgtttaggatcttgggccgcggcatgcgcggacactggacacagtcgtggcagtacgcctccccgacgtggcgtcccctgccggcgggcgtggtgccgaggtaggcgcacggaacacgttgttggtcaggtcggcgaagcgcgtcgccagctaccaccggtgagccgtcccgtggcgccaccttgtccgcatcgccggcaaacccatctgtggcatcgatggaggagacatcgatggaggagacagagagacaagagagatgggagagctgacatgtgggtccaggggtatttctgacatctcatgcggtttttctctccttcaaacgaaaactattattttaatgggtacggtgtctgctggcaaattaccacgtttatagagtgtattcccccaaaagccatttcgtgcagtgtcctatggctaaaaccgcgaagtcacgatgtcctgtagcaaaatttgcctaaatactaaatacaaaacatgcaggatatcttgagagatttgttgcagaaacattacctgcatattgcaactgtaacagagtatgacgtgtgagcaattaaattcaaatagaatgaacgttcccaattgacatcagctaaatttatattggtgatcttttcaagctgctccacataaaacaaaagaggccaaatagaaaatcaagacagtatgtataaatgtagtataagaaattgttgagctcatgctctagaaagtatgttatgaaccaaacactagcttatgaaagtaaatttaccaaatttaagtctgtcaaattgtggcagacaatcaagtacatgctaaagaaatgcagtataagacttgctggtgcaagtgtaaatgtgcaatgaatgataaatattattggaaagaaacatgaatgaaaaaatatgttatggttgacaatacatgatgatgtagttcatcttgatacagtttcaaacagaataactcaacagtaaattacagagaaattccaaaatagaaagaagtcttgaaattttccttctaccaaaagggacacatgcatttattgatcaagttaaacaaatagtctagcttaatttaccttaggagcccatcttcgcacaaaaaagggaggtggattttccatgttatcactggacctgtacccgttcaatttctgcaccaacatagaatattgagcttcagttagcatacaagaccacaccgtcaagctaaataaggggaatcaatagattgaaatgtaccatattattaacaaagaagacaaggtcatcctcttaacctcccctttgaaaccctaccatgcannnnnnnnnnnnnnnnnnnnnnnnnnnnnnnnnnnnnnnnnnnnnn

SEQ ID NO: 23395 - DNA, 1360 bp, Oryza sativa
gaaattttccttctaccaaaagggacacatgcatttattgatcaagttaaacaaatagtctagcttaatttaccttaggagcccatcttcgcacaaaaaagggaggtggattttccatgttatcactggacctgtacccgttcaatttctgcaccaacatagaatattgagcttcagttagcatacaagaccacaccgtcaagctaaataaggggaatcaatagattgaaatgtaccatattattaacaaagaagacaaggtcatcctcttccctcccctttgaaaccctaccatgcacgaagaaaagatcaagtatttcatgccagaatttatcatccatttccacgtctgatgcatcagcttcagcatcaataactgtccagccgatcaaatctgaatgttttttcaccatactcagcagtttgttcctaaaaaaaagtacaggacagaaagttgagcactggttaaaggatataagttttcgcagaagatgaagatatgcttaaatagaacaaaatcaaatctcttcctatttccaatgcattaccactagggagataacttagctctgaccagcatcattgggtggtatgtgttacagtggggtatgatgttgtcctttttttttcagcggaagtcacaagaatgatcattttggtcatgttttccttagcaatgggatcaagagcgctcttcaagcatagaggacatcagcaagggttaaggttaagcatgcagacggagctgcaaatcaaaggagggtgctttgcttgttgagatagctttagttctagtgaaaatgacaactgaagtgagatgaatgatcgatagtcagcagagacaagacttccgaagctgaaactattgtttattttgtcctgggtcccccatgatctaatcacatcactgctaaacctagaaaataaggagaggctgaaaagaagccattcaacaaagaaattcaatctttacatgagatcatcttaaaatagcaacaagaggaccactgctcaaagaaaagaaaaactcccaatatgaacacaggttaacaaggttgaatggcaatcttggttccatcgtaaagactaaagagcggtgttacgatataaaatggtatcatagatagctctaaggtctcagtaaatgtaatttcactcgaatgcattgagcatcaatgagcaataacttgtgctagatttcaaaacattactttaggtaattgaaatcggaatcgctaaccatcgtttgacagatttatgagccttcaatcattcggttttttagccgtaggatggtttgtgagatccgtgcttgcatctagctgctaattaactaggtccacgttactgttccctggtg

SEQ ID NO: 23396 - DNA, 2665 bp, Oryza sativa
  unsure (1)..(2665): unsure at all n locations
nnnnnnnnnnnnnnnnnnnnnnnnnnnnnnnnnnnnnnnnnnnnnnnnnnnnnnnnnnnnnnnnnnnaaacttttaagtccctatcacatcggatgtttgggtactaattataaatattaaatatagactattaataaaacccatccataatcttagactaattcgtgagacaaatctattgagcctaattaatctataattaacttatgtaatgctacagtaaacattctctaattatggattaattaggcttaaaaaatttgtctcgcgaattagctttcatttatttaattagttttataagtagtctatatttaatactttaaattagtgtctaaagaaagagactaaagttaagtcactgatctaaacaccacctaaattgcctctctactcatcttcttccttcttccggcactctgtcaacttctcgtcatgctactcactgacgtcatcatcgtctgggctgccatgtcattcaactccctctatactggctacgtcctcctcgtctagacctgtctggacctatcactgttgttcggccatcgctaaagacaaggacaacaagcagcgacacctcgcctcatacactcctcatctccaatcacaccacactggtaagaatcaaacgagtgaagggacaatttcgtcccagtagtcttaaattaagagtcaaaccgataataaccaaacgagtgaagggacaatttcttcctagtagtcttaaattgagagtggtaatttatcaaatctctttttaggattggtatttgaggaatctcttggttgaattggaatggaaaaaaggttttattagcttgtttgaattatttttattttaaatctcgcttaaataaattggtaaactggaatttttgcaatgcctaaattttggtggatggttttggtttggatccaagattttaccaattatattcacggtctattgtttgtcctagctaaaatattaagttattaacagcaccgaaatttttggtaactaaccccaaatgcatgtatcatactactccctccttaccaaattgatcatcacgtaatagaatctaaaattttccaaattaatcatcatataactgtatggacacggatttcactggaatacaattaatgcagcatgggagaatatgcgcatgctaaggtgtaattggcatggagttttattgttttaatttgatgtaaattatctatgattttagtgcataaacttaaatgatgatcaatttaataggagtaaatattatccattctgttgtctcgccatttatcgttggttgccccccaaaagttgaggatcaccgatcctactgtgctgtgcataactagcgagcggacgctccaacaacacccacgttaacactcaccacaggatgtctcgccgccgtctgcagctgctgcttctcgccgccgtcgtgctcgtccacgccgccgccgacggttgccgagtgttccagatcgaggaggccaccgtcgacgacatccagctcggcttcaacaacggcagcctcacctccaggcagctcgtgttcttctacctcgaccgcatcgcccgcctcaacccgctcctccacgccgtcatcgaggtcaaccccgacgcgctcgcgcaggcggcgcgcggcgtcgccgtcgtcgtcgtcgtcgggcagctgctgcggcgggctccacggcgtccccgtgctcctcaaggacagcatcgcgacgcgcgaccggctcaacacgacggccgggtcgctggcgctgctgggctccgtcgtcaggcggaacgccggcgtggtgcggcggctccggcgagccggcgcggtggtgctcggcaaggccaacctcgacgagtgggccaacttccgcaccatccaaggcaccggtggctggagcgctcgcggtggccaaagccgggtaaggctaagctacctcctctcactcgctaacttcgccattggtttctccatcacaaaagtcaatgctgaatatcgatctctttagttcaaaaaattagcttgtatattccatgccaagttcttggagaattcttttaggaaaataaccatcaatgcaattctgcaaattcttttgtagcttgtcgaaacataatccacactaaaatttagtgtgaattctgtaaggtcgtcactgggtttatcacttatcacctttgtatttttcagacaggaaagcatatttttgtgttgcaaaattattcaaaactcaagcaattatatatggcatatactgtacattagtaaatatttggcatgtatatgtagaatccatatgttctatcagctgctccatgcggttcaagcacaggatcagccattgcagctgcagcgaacatggcggccgtgacactagggaccgaaaccgatggatccatactctgcccatcgtcgttgaattcagtggttgggatcaaaccaacggttggattgacaagcagggctggtgttgttcctatctcccctaggcaggacactatcgggtaagctaaggcctcgattgtttcctcgttcggcagttacaaatttcttatttctgtatacccatttaccaaacagttaaatagtgtatttttnnnnnnnnnnnnnnnnnnnnnnnnnnnnnnnnnnnnnnnnnnnnnnnnnnnnnnnnnnnnnnnnnnnnnnnnnn

SEQ ID NO: 23397 - DNA, 1471 bp, Oryza sativa
cttatttctgtatacccatttaccaaacagttaaatagtgtatttttttaggaaaaaaacattttatttagtaatgtttccaaagaaatcgaataaatttaatttttaagttcataattattgataatcaattaatcgtgtgcctgtcttagctcgttttacgtgtaaataaaaaataacagctacttattagaaccgagactaatacatgcattacttatttagcccgtaccgatggttgatgtttttttactgtcactatccagttgttttcttgtgattgcacgagatccaaagtacactttattttattttcttaatgtgccaattggacaattggcttagtaaactcgatactgacaagtcaatgaaggatgtttatacataacagatacttcgagtaaattacttaacaaatgccatcagaaaatatcatgtacagcaaaatgttattcgaaatgttgaaaaatacggaaaatacaactagctatgtcaatatgtttcccatcctgaggtccacatcaatctagtgagaaaatatagaaaatgacggtttacccgttatttcttccccaacatgggcatggactaaatggcacacgacataaatcaaatgaagtccaaacatttcataaaaattcagagatggacttcaaatatttacttcgaaacaattttatatgtattatattgaattagtttctatggtcatttttattaatttgcttgatattgtgatttttcctacttgttttatttttcaaaatacaaaaaaaaatctgggaagctgatctaaataagtcgtcagatttttggatgctatacttatactgtaaaggcctgctaaggttaaaaaaattaagaaaagaaaaaaaaagaagggcatgattaatatgaaacttttataatcttccgatggaaaatgtgatggcaatagaaattggatgattcgttgttaacacaaaaattttttcgcatgaatccttatttcccctagttatgtaggcagtgtcattttttctataatataatatagagtaaagtccatcaccggtccctaaacttaccgctgtgtcatcccggtccctaaactcgcaaatcgaccgttcaggtcctcaaacttgtttgactgtgtcatttcggtccctaaacttgcagatcactcgtttaggtcctccaacttgttcagttgtgtcaccctggtccctgaacttgtatttgaatatcatctgggtcaaataggacggtctaaagactttatatttaaaaataattcataactttttcctgtgaactctaataaagacaaactttatatcaaacatgtagccctcgacgcgatctacaactttgtagttgaatttttttattttaagtcattttttgtcccaaaatgtaattttaaaattaaaatttcaaaatctataaacatgcaacaatattttgggaccctaaacagttttaattcaaa

SEQ ID NO: 23398 - DNA, 2238 bp, Oryza sativa
  unsure (1)..(2238): unsure at all n locations
taannnnnnnnnnnnnnnnnnnnnnnnnnnnnnnnnnnnnnnnnnnnnnnnnnnnnnnnntggctagagacctttatttacaacctaacttgcatagttgatgctaaacttcatcacaacaatgtccttgtatgaagaatcatgatagtatggaagatgaggatgttttcaattcaaaaattcaaagatgcgggtctcatcttttcgcttatgcttataagctaaaaattgaatttcgaccttaaatttggagttgattttggggtttttcatcgaagtttatttttcagcttttgttcttagatcactaataacacgtatataaaagttttatttacaaaatatttttcgtttgcaaatataccgtttcgcttattcctccaataagcgaaaacgatgggtccggcaaacaaatttaattagaaaatatttttaatgtcattaaatatatagtccggggaatactgaatctactgttctaaaatatgtcaatcggacataacgaatggatgaaaatgatcatactgtaaagtgatgaaattccttggatgaatcccgtcaattcaaatgcaggccaatttgtcggacagtaacagatgccgtccacgtgctggatgcgattgttggctacgacagccgtgacgcaaaagccacacgggcagcatcaaagtacatcccaccgggtggatataggcagtttttgaagcctgatggattaaaaggcaagagaataggcatcccaaatggatttttcaacttcccaaatgggacagtgcaacagattgtttaccagcaacttctcgacacagtgaggtatgcaattacaggaattttcacaaaattatatacgttggcagaatagaagaaaaattgacatttcaaattgcattttacagaaataaaaatcacgcatttattattaattcccatcaaattatatatatgttgcaagtttatactatgaacatgcaatcattttacaaggtgcttccttttgtttcctgtaaatcaaaacgtatgcatgacttgccctcatcaatatgaaatatgatttaaaatgccaaaatttaggcatgatttacctgcatgcaaaacatagtacatagctaagtttttattttctgtttccgcttacattacatacttggcacgaatttatttaccatagtttataaagttcctttagagaaatcactgaaaaaaagttggtacataagctaaattattgactacgttcccaattactcttccatattccaagttattctcatgtaaacatataaacaattataacttgcacaataattcggatatgtgcctccctgatttcaatatgaggaaattttggcatatatttagttacagttggaatgtcccctttcagctgtttttatattaattaaatttacgaagttgtgattaaagcatctggaaaccacaattttccactagccggttgctgtgtattccatcaaacttatatatctgcaatcaaataatatttagttactgcaaatgtcagaaacaaatgtgtgctttatttggaagtaaattgaaatgtgtattttttttattgcatgcaaagaaggtgtaatttttgtgaaatttactgtaatgaatatatattggactttatggaacatccgtattctatattatcgcacgtataggccaacagatatggtgtggcatgatgtgcattatcaaccagtttaggtcatatgccttccaatttataaatatatatatggcgatagagaaaagtcagtttcctagatatttgacttttacatcattctttgaaggaaacaaggagcggttgtgattgagaacctagacatagcaaacttggctgttatacaagatgtccttaacaatggggaacagattgtgttagcagcagagttcaagtcaagccttaacacttatctgtcagacttatcctactccccagttcgttcacttgcagatataattgctttcaacaacgcacatccgattgaggtcagctgtgtagctcctaattaaccttctggtgttgattctctcacagttccacattgcacatatcttgctagaatttttttttgttttctgcaaatctgaagaaaatgtacatatttactttactaccttatatattatataacgagacttcggaaaaaaaatgatatctcaggatannnnnnnnnnnnnnnnnnnnnnnnnnnnnnnnnnnnnnnnnnnnnnnnnnnnnnn

SEQ ID NO: 23399 - DNA, 3171 bp, Oryza sativa
ttagcagcagagttcaagtcaagccttaacacttatctgtcagacttatcctactccccagttcgttcacttgcagatataattgctttcaacaacgcacatccgattgaggtcagctgtgtagctcctaattaaccttctggtgttgattctctcacagttccacattgcacatatcttgctagaatttttttttgttttctgcaaatctgaagaaaatgtacatatttactttactaccttatatattatataacgagacttcggaaaaaaaatgatatctcaggatacacttaatcaacttgttcaacctttagtaacgtatataaaatcatgtatacatttttctagaggcattttctaggggcatacctaaaccatgcatagaattttcaacagaattatcacatccaatttcatagtattttcagatgacacatgattagaaaattctcttttggattgacactatcaattatcaatgaggtctaagatgaaaaatacaaaaataaaaaatcaaatatcccgaatacataaaactgataattagcaccactactcttgtataccaaactctttgtgcatcaaggtatattcatgttgttgcagattatgaagttaatatcaccatagtatattgcacatcttattttgttgaagattatgaatctttgtatgtaatgtaatcagcttaaaattaaaaaaacagtcagaacagctagctaaatgatattgccaaaaatgtgtataacaggagaggctaaagaattttgggcagctcatcttcctggtagctgagaatactactggcatcggtgcactcgagggagctgtgatccgtcaactaaacgagctttcagctgacggactggagaagctgatgcaggatgagcagcttgatgcaattatcactcccaatgacctagtttccactgttctcgccattggcggcatgccggcaatcaccgtaccagctggatacggtaagatgggagtccccttcggaatttgctttggtggattgaagggctatgagccgaggctaattgagatggcttatgcatttgagcaagctaccaaggtcagaaaggcccctaagttcttgcacggaacattttagcaacatggcagacatgtttttaactagtaaaaagtaattcattgggctgatcgtttatcgcaactactattgttgagcttgggaatgcaatttaaaacactgttgcagtgaaaacttagtggattgtgaaaaaaatattggagggagaggtatccctccaaacattgtctccggactcaggttgaaaccacacacccattgccactgtactatcaagtgattatgatctttatatggaaagccaaatctttatatgcataaaccttgattttcatgacaccttttgttttccatagccacatatatggcctgggagaggtgattcctagaataaaatgatcttgtaaattttctatgaaggataactcgcagagttccacatgtaactccatttgtccccttttgaatccagaagctgacaaaaattaattttgacttgaagagtttggaactgagcatatgcttgctcacagagaggaaacctgaagcagacttctagaggtttagagcatatcctatgtacaaatttgtttctgtaggaccaaaaagcaagaaccaagccaaccagaggagattgaatggttgtagtacccaaaaaccaaaacttttagtggaattgaaaattacgaattcgatgatgactggagtaaatgcgccggtctgaccacacaatgatctctagtctgactgacgtagtagctctggtctgatcgcttaatacgccgttgtcgcctgtcgccgccgtaggtctgactgcgatattcccgccggtttgaccgccggtgtctagtcggttagaccgccgaacctgagcaaacacaaatcgaagatctatcgatgtagattcaaaccctaacttttctataaacttggctctctcaaaatcaatatcgggagaccacgacctccctctctatatatacctatatatacttgaggtaggcagcctaaagccacgaaccaaactagtaaaaaagtcccactgctggggaatccgtttttagttatggttcgcaaccctatttgatcccgggtatgcaaccgggatgcccaatccgggatcccggttatttcaatatttagtcccagtgatgtaaccaatagggacaaaagtttttttttcttttttttcattgttttttgctgtttgcatattgattttgagccaaactcactaacatcacaaattaataaatcgaatgaacatcacaaatcaaattgacatcacaaatttacagatcgaatgtacatcacaaattgacacaaaaaaaaatcaaaggctcacggctaaggaacaagtttatgcttagtatgaactgtagctaaacaaatgcgcaaatacaaactttggtaccattatggtttgagtaagcagcaagctctaaatccgagacctctcaattcaccatctcacgcaaatccagcgtaattcaccacaagtgattcagcccctgctcaaaacttggcggcgattcgggaccaagcccgctgccgcccgcccaccgccacctaccgcctcctatctcctcccctcccgccagatccagcggaggagagggcgccgctgcctgctgaatcccgtcccgccgtctcctcgtgcgctgccgtcacccaccacctcctcgtgcgccgctcgccggcttccttgctcactccgcctgctcgccagcttcctcgctctgctgcccgctcgcgcggtgagatagatggatggatgtggccgaggggaaatgctttcagatggatggatggatggatggatacagcaagagggaagagaaagagagagagaggagagagagaaatgctttcagatggatggatggatggatggatggatacagcaagagggaagagaaagagagagaggagagaggaggaaagggaggaggaaaagatgaggacagggtttacgaggaggaggagaggataagtgcgagggattatatacgacgcgtcgatctttagttccggttgctaacagacaggggcctgacactttttgaattgggactaaaattgatctttgctcctggttggtgttaccaacc

SEQ ID NO: 23400 - DNA, 2623 bp, Oryza sativa
  unsure (1)..(2623): unsure at all n locations
tcatatgaaatcttcaccaaccacatgcaatccgtgcacctcaccctttacgtcattccttcaatgcaattgtccatcctctccaatagtagcacaagttctacagtagtctcctatcaaggattgaaatttcggtccccctctccacagcaatcaactatctcagccaaaatttttggaattttccaaaattttgtgaatttggccaaaatatattcaaatttagtcaaaatttattaaaattttaaatagtttcgtgcaaaaaagtaccaaaaatcccaaaattcacaaaaagttacgtggttttcaatagtgtgaaacctgcttctaccttgtcgaaacagtattggccctactcaagtcctctgctgctctggcaaacctagtagttctgggtgtgtttagttcacgctaaaattagaagtttggttgaaattgaaacaatgtgatggaaaagatggaagtttgtgtgtgtaggaaagttttgatgtgatggaaaagttgaaagtttgaagaaaaagtttggaattaaactcggccagagtacagtggaggaaatttgaaaactagacatcgcaaagtgtgccgtgctccctgccagacatcctccctccttccccgcacctcctcaacagctatcgcactgccaccaggtggaggaccgttcatcagagatgcaatcgatgatggtgagtggaagaagatgaaggaatagaagatttcgaatccagtcgcaatcgttcgcttcgctcccgttacaaccgagggggaatgttagaagtatagatatgtcggttagagataagagtcagatacaaattatagagataagatataatcctagagataagatagagtcctagagatagaatcctagagataaatatactcttagttgtattgtactccaagtctctatcccctatgtactccgacatataccccatgagaggatcgatgtaatacaacataatataacaatcagatgtttccacagctctggtgtgtgctacatctatgacggtgtaactcagttgacacttggctagggtgaagtgctagattttgtcttggtctattattgtctattgggcctggttgctttggatgttttgttgatcatgtcactatcttcatcgatggcatgtctttatccactgcagtttcacgacgccattgcgtattttggtgacaactccatggtgccttacatctgcccacgacattatttgcctttctttcatcatcatatcttcatcatcaacaccctattcagtccgctagatcaactattattaccttatgcatggttgcactaaccatgactactttatgacattggcttcatgtatcttgactaggacatctaggacataatggactatcattattgagcatgcacgatgtgccaaaaataaaatcatggttggcattaactaaaattaaaattgctgtccacttcttcacccacgtgagtggtgtgtggaagtatcaattcaatactaatctcttgaaaatttatttgctcattatttctcctcaccattagcatcctgctaaagcaagctgacatcatcttccgatgctgcagtgggtccctaccttcatggtgtgcccaaaagcacaaaagaagcatatacacgaaccacaataagaagaggaacaacaacaataagaagaagcaccagcacaagaagggtgaaggtcgatgaagtcatgggcaaggtcaacaattcacaaaggcatgccccagcaatgagtccagcgtcaatacatcgtggccaacaatatatagttttttatatttgagtaaagtacaccgtcggtacttaaacttgaggcgtggtgtcacttaggtccacgatcttgtaaatccaatatttgggtccgtaaatgcaccattcaggtcgaaaagctcgcctgactaggtttgagtgcaaatatggcagtacagcgtggccgtatttttgcatttacccccttcgtgagcccgtctcccccggtcaccgctggtggcggcatcggcaagggtaagacataggcattgtgcaaggccattgggagagacacatgtgccaaggcagaggtggctgttgaagtgtagcatcttgcacacgatgagcagcgggaagaggacgtcgtgctgggtagccgaagatgcggtgtaggtcagcgctggtggtggggcgtcactgacaagctggtcgggaggcaataagggatggaggcgggtagtgaggatctcgagtagggtggacttgctggctttgccggggcccatgatgagcaacacactgctctagacattaaacggatgaaagagattgcgccgaagaggttccggttggacttctcggtgagccgagagcaaacgtacattgctggggagaagatgtatgaatagacgcgaattgcttggctccattcttgtagagtctggttgtcgttcttgtcggctcaaagacagggggtcgatggggtcatgaagggggtaaacgcacagatgcaaccacgccggactgccacgtcggtggtcaaacctagtcaaacaagatttnnnnnnnnnnnnnnnnnnnnnnnnnnnnnnnnnnnnnnnnnnnnnnnnnnnnnnnnnnnnnnnnnn

SEQ ID NO: 23401 - DNA, 4892 bp, Oryza sativa
attttatatcaaaataaatattatttctatagaatataatatatatagtttgtaaattaacttgttaatgttttttaaagtgaatagagttctatttttatgagtatgactataaatctaggaccagagattctatataaaatctgtttgcaagtattacgtcatgaaatgccaaaacaactggaaggactataatgtggtgctcctagtttccactgtgctgtatcttttcaaagattgttttatttggagtacttaagaaaatttgtttcattatgtgtgaggtaaacaggcttgatactatcaaagcttagatgaagacatactatgataaatatgaaaaaaaacttgttaacacaaatgacacagaaccttatagtgctacttaagcatctcataaaagggttcaccagttagtagaaaaaagaaacttaaagatgaattttaacaatagagttcaacaataataaatggttattaaagttaaggttcaaagttggtgcatcgatgatactattattatctaaataattaaattgatgatgttttactgtgatggaagcacaatgtagaaaataccctatattgtcactcatagccagggattttcttgtagtaccacttagtatagtgccatctaaatttgcattttagctctgctcgtaaaattcttgtgcatactcggagctcatttacacatgtattgttagagagtttggtttacgcaaaagattatttgtgtaaaccttgaaaatgtataataatgtctccttttgaattattgcaacctttggtgaataactttgggtaggtgatgaaatacaatcgtttggttaaattagacatgttaatatcatgtattctactctttactagtactgcaataaggttgtgtagccttctgaataaactttccaaagagccaaaatttatcgaaaatgaactccggagcaacaagttatgaccttttttttttttggtgctatcaaggaaagtcagaatttttgggcccttagcccagaagtttctaacagaactatctgttcagcctatgaaactgctaggaagtcctgagcctcaggccagaaagttccgggctgctgtttcttgagtaacggcttgtttttgggcccgagtttttaaacccctccattctctcctatgtttgctgctaggtttgggcaacaatatacttattcaaagccaaataacacctatgtgacatcttggactaactaggataaggcctgtgtggcccatgagagctatgtgcgcatgtttagtaccaccgtgctaatttagcgaggaatggaacccaacttataaggcatcttccctccaaccatatcactctatggatagcatcgggggtttgtttcatgatccgttttatgtatatttgccacttatataggtagatcacgatatataaatacatcaagttagatcgatctcgattaaatttcatatttggtgatcggttgttattttatatattaagttagatcgatctcgattaaatttcctttttggtgatcggttgttattttatatatttaaattgatttgttaatataatttgtattggagtactagccaatatgttatctatgtttgctctaaacaatgatctatcagctatttccataatactgtcttaaagtgattgatataaacaaaagggatgatattacaactgataggacatattaagggttttgttttacttgtccatcagaaaaccgcagccgatttggtctaactgtatcggttgggtcctgacgatacgtcattggctctatcggccgataaactacctttcatctaattacggtttatgtttttcgttgctggttgcaggatcaaaccagctagcacgctcttgacactcgaggcacgccttggacctgcattggagtgaagcaaatctcccaggtcgccgtgttttctgtcaacaatggcggcttgacttgtcaggccgaggtaatagccgaccgaatttgttgatggcgtcaacaggaccatctggctgtacatgacatatccaagatctacgggttagtttgatgggatatatggaaatttgtcaggattgtgatatccggatacattgtaacatactggatcaaggaggagcacatgtaatttgtggcttgggaatgtagcatgtaggctatggctgaacctttttaacaaatatcgtacctcggtgtcatgtttggtattctatgaatatcgtatgtttatgttcattttaacaaatatcgtatatatgttcattttatgcatttggttcccgatgtatatataggagccgattttacaacttattgtcaacaatcctattcctcgtctaacaataaggcaccgatgtatgtagatcataattaagataaggcaactagcaacagatcatgaactgtaaaatacaaactaatcaaccatgatagcttctgaatcaggatacatcctcaccaattcctcacggatgtcagctggacaagtggtggcgatgtcaagatggagagcagtaccgctcagttgatctatggcagcgtggatcactggcgattgcatgatggaggagtggctgtggtggagcggtggacgagcaacatcaaggtggaggagcagcgggatatgcccctgggatctatggcgatagcgtggtggatgatagatggcagttgcctggacaagcagtgtcggggcgagtggtgcctcctagtctatctgtatgtggcttgcctgatcccttctccccacactaaaatttcttcatgcacaaaattttgattgtacacatttgaaccgaactatgtctcattcttgaagatggtccttatgacgcccatttttcctcactttccttgttattttggcgttatgagccaactctgcgttgttcttatgcgtagagacaatgtttatgtgaactcctctctctttcctccatgtcatcaaatcagtttacgtggcaaccgagagggcttgctaaaaagaccattgtacatgaccttataagttagagaacttgatatgaagaagtgacagttggatgcaacaatgtcacacacaactccgtggcctctagcgttttcatcatcaatagcataccatggatcaccataccggcttggtatgatggtcaaagtctcaaagagtgccatttggcatgtgctgcggtgaaataccctatgcttttgagcaagctagaaaagttcaaaggatgagtcacttgaagccctactatattgccaatttgccattgcatatacatgagttcaagcaataacttgacaacattagttagctaggaaagtttcatgctgatcaaatttcctatttcactgaacgtggaacttgaattgtatgccatcaaattcaaaatttgtaatccagatcatcaagtcgtacaatggcatacgccacatgggagctcatcgaacaaacttcagttccaaaggagttatcatgatttgcctagtggtacggggagctgaaggaagttgggtgaaggctttagaaggcgctctgcatccagtctggtcggaaggtggcctccccttcctctccttcctagcaccacctgcaaactttgtgggcaaaggaagcctttgctacaacgtcagcgagagataaaggtcggcggatcacgcgcgcaaaggagcaaggcaaccccgcgtctacgtaagatggggactgatgtgccccagcacccatcacatgaacactcaagacaatcatttgacttagccgctgataagagccaatccattacaccatttcaaggaccgattacacgtagacgtgcaaagaaactacaacaagagataaactcgctactagctgaaacatatttcaatattgacgagaattatatactacctaaatcaagtactttgctattgcttaggtttacacatgcacaacacatgatgggcatcgacaacgagctagaagatcaaagtgacgatgggttacgtgaagacgacgactgtttatgtcatgctgattttggagtgcactgtctccaaacatttgctccaacttccaaggaatgtgcgacccaaccagtcaactttctccatgcttaatatatatggttggaaagataatcaagtttagtttcacctccaacaaacggctcatcatttcgacttcccaataaggagtaatagacaaatcattgatgactgctaggaagccaaacagacgcgcgagtcttctcgggaattcactttttgtgacctttgagctagcctatgtccagtaaactcccaagacctttcattcctatataggagggttgttcctggtataaatattccctatgttttatcatttggaggacttttgacaatgaaaatatgaaccccttttgttcagctgtgtgctaacaaattcagggagaaatctctacccctctgcttttgtgattttcttgtgagagtacagaagcggcgttcgacgccccccaattggtgctcctggtcccttcgaggtttttccttgattgattccaggttgtgttggttggtaaacttagagtgtggttaggcgaaccctcgattcaggttaccgtaatagagacggtggttggcttcgagtacgatcgtcaggttgcactgttatcttggctgcttgcagctagttatcttggtctcttttaggctagttatctattcgtgatcctacgccgtgaagatcgggacgtcacccctaccggggtcgcatcagggacgaccgtattggggattgggacggatgggtgtgggatacatgacgccggtgggtttgtgtgttagtgtgacatatgtgtgagtctcacttagcagcgcaaggtaacagggaggtgtacatgtatctctgaaagacatgccacactatta

SEQ ID NO: 23402 - DNA, 437 bp, Oryza sativa
actatgattagcaccgtctatttatatgtgtttctatccggcagtaaccatccaaccccttatccccgaaatttttggatcatccactcagccggcgaacgcctcaccctgccgtcaagatggccagaccagctgggatgcggtgaagaaggagcggctagtgcagtcagcacagctaggggtcgccaaactccacatcggagtggcgttagaggacctgccgttgagggggagccgccgtcatccgatcagatctggagccaccgtcgccatggctctccaccgcggaggcctaggcagccaaggacacgaggtgactgccaagctcctccaacgcctgccgcagcgccgtccacccctcccgccatcggcgatgttcatgaaggaaacgggatgtaacccgatccgctgggaccagcgccggtggcaccaggaga

SEQ ID NO: 23403 - DNA, 676 bp, Oryza sativa
gtattcacactccactatgattgatggaactgatggtttgggtgttgctgatttggaagttggtgacattgaaacaaccactgattgcacaaacacatcaaatatatgtataagttttatgagtctattagtatatgttctttaggttatttttttttgtactagtcttgtatctgacattctgaattgctgacaaatacatgtatgaaattttaggttttttgctgtgccaaaggaataagatgaagtttctgaaatttgatatccactgacaccctgctgaaatcaaacatggcactattattatagcagcaaccgctgactgctcactcaaacacatcaaatcctcaaacctcagctgcgatgctagctcatgtagcttgagaccgtgtgttctgcatgcagagtactcgagcatattgtaattttggtgcagtactacagtggcatggaaacaatgtgccggcgtcccttagtcatggctctgcccagccaacccgacgaagtggtcatatgcttagtgtgtaaaaattttattgttcgcagtgtttgtgtagtttagcttgtaattcaatgtgataatcgtcagtaaaaactttatctatcgatgtattattgcggtgaaagtttgacctcaatcttttcaccccaataaaatagagtaaataaattactc

SEQ ID NO: 23404 - DNA, 767 bp, Oryza sativa
aggcataccccctaccttttaatattcgatacgtatcgacatgcaatacccacgcgcacgcggatatttcctttatgatctaagaaaacctttccgaaaatcaatagacgggaaaaagtccttctcggacaagaactgggttacctacgtatcgtgctaggtctggtatcttcgagtcctactcggagagtaccagacctgtcatataaaagggaccccccgagaagggcatagatcatcgaatctcagaatccacacagtctaagaagccggagcctgcgaggagccaagtcgccgagagctagtcgaatcaactcgactacaatctcgccggatctgacaagtttcatcttttcctttgtaacctgtgttttccaccatataatcccacatcaactggattagggctattacctgtcaaggggcctaaaccagtataattcttgtcttttgattgctcgatgtcgtactacgtagatctttgtaccagcgtaccccaataccctctatatccggtctacgggtatcacccgtcgacagtgctacacttttgaaatcggtagccaatagtctcttattccactataggtggcgtagttccattagaattgctagctaaagaacattatgtggtttaacgctagtccataataaagagaagttggagatttgtctcatcgccttatttctcattttaattttaattttatctttacccttttttattattaaacttatgactgtgtgtcttatgatagaagctggag

SEQ ID NO: 23405 - DNA, 708 bp, Oryza sativa
  unsure (1)..(708): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacggtgtcttgcaaaccaggactgggttaggactgattccctcaaaacagttgaaaacacggcggtaagttccttcatttgctagctcaccagctattttttattttcctcatacgtatgtcattaaatttgcagatacctgtgatcatgcttgtagctcaagtgccctgtgacacaaatttgtccagtgaatattcttctgttctggatagctcacacgaacaattatccatcaatgtgcttggagatcaagggagcccttctcgttctgacaactctagttcagaaggtagcagcatgccaatgtgttcaagaataaacaaggatgatggcaatgttgtgcagtcaattcgtcttgatataagtttcaaattaccattccacacaggactacagacaactgagttggtaagttaaaaaagattactatctacccttatattttgaagaaaataag

SEQ ID NO: 23406 - DNA, 16997 bp, Oryza sativa
gacactatagaatactcaagcttgcatgcatctcatctctctatgtctatgctgtgttttccgaccgttgtcaccgttgtgggccacaatgctcactctttgtgggggcagaatcgatcgataaaaagctataaacactatcggatgttcagcacacgtatcaacggatactatccgtcgcatcactgttgacaagtcacaacaacaaatgctgagttgttgcgatggcgatcgatctggcgagttgagtctcgcgtcgatcgatcggccgcaccgttgtgcttttgtccctgatatacgagtctggtaggcttcggatccacatatcagtgacaaatgagcgttgcaatcgactgcagtggatttgatctcctttaattttcggacgcaacgggcggcgcgcgcgacattggcacggcagccgcgcgtggctccgacgctcgcatgcaccgacccaccgccaaatgttgtactacagtagactactccacctcggtacgaccaaaaaaacgttggccgatgtctctgccaatctgccatgcgtcaaggtgcacggttgtcattgtcaacaagtagtgtcgtagtggtacataccgatgcaggttcatgcatgcgtgatttcttggttttgtttctccggtaccactacactcgactccagctgccggcctaagctttttttgttggagaagctagcatagcccacaggttcccttgattcctggagctggctcatccagagccagctgctccctaatcatcatcacttacattattctctttaacaaaaaacaaaaacaaacaaatgatactccatatatactactagtactagtagccatagtactgttgtagtagctacaaagagaggctcatgggttatccttgtgtttgaagccaaagaaagaaacttaatcagagacgaacaagccacaccaactttacactggtccccaagcccacatgggccaacgggaaaccacttcccactctcccactcccactccactgccccactcacctctactcctataaaatctcaccgtccacatgtacccgagacctcgaaccatccatccatctatccacccaaccactctctcgctcgctagctcatcgctcaccggccggttgagatggcggcggagggcaatgcgtcgtcgtcgtcgacggcgacgggaagggggtgcgggctggcgctggggaggttggtgaggaagctgaggaggcagagcaggatgatgctgtccacggcgacgtcgtcgcggccgccggcggcggcgaggtgccagtacgacccgctcagctacgcgcgcaacttcgaccggagtggcctcggcgacgacggcggcgacgtctccgcgcagctctaccaccgctacaccttcgcctcccgcttcgttctctcctcttcgtccacggccgctcgccggcagccgcaataggggccgagaccgatgctagctgaggcacgcatggccggtctgcgcgtgccagtgctgcgcgtagctaagctagctagcttagctctagccattagaggtagatgcactcttgttcttcatcctgcagtgttgttaattaattagtgtgttcatatgaggagggagtggtggttgtaagggatttcttccatggctctctccattggccgagatgatggtttcgatctctcgtgctgatttcttggaaatccatgcacattattcctgatataaatcgtcccattaattcctttttttcatgaaattctgaaattggctgattaaatcgccgagatcaagaaaaattggatgctcgccaactttgtagtagatgttgtgttgattgcatcattcaggctacaatagttgttacggcgtcgttgcgttgtcgctgcattctacagtagtcggtcactactactactcactagtgtcaccgctgcgccacagcgattattcgcacgggacccctgtgcccacgggtgacggtgccgaccaccggcgaggacgcgagatcgatcggtgctactagtaaataaaatttcacattttcactgctcctgcattgattcgaggagcggaagggctcgaagaaaaaagagaggaaaaatagagaagaacggttgctctgtgcagcaaatttccaacgacggaaagcaaagaacttttttttagaatcacagtataaacgtgtgcacacttaaccgtatgaatgtattaacatatatacactaattgacattatactcctactactagatttttcacgtacctgatcttgaggcccaatcgtttgccaaattgaaaacccaagtccaattataggccaggccctcttgaaggtgcagacttcagaggagactgcctgtttggggttaggctctactaatggcccattgtacttatcggcctatagcttttggcccagttctccatcgcataggctgaatatttctgcccaaagtatcacggtgatccaacaatgtaaaaaatcaagaaacaccacgagcgtaagtctcttcgctcgagaatttcgttacagccttacatacaggtagaccttcttcgacagtcaccaacatgaacacagacatgggttttttttcattgctccttccatgattactcgcttaattagtacgtcaacagaaataattttttttagacaagtacagcaataatattttgttcctagcagttctgaacatgctatgctattgggatatcaccacttcagcaggttggagccaaaaaatctggatgatgcctcaaaattctccagcaaggtcggagccaaaacatcttgatgatgcttccaattcttcaccaaggttggggccaaaacatattcatgatgacaggattgtctcaatatctctgtcactttctcatcaccttcatgatcaaacagatataggaagtctgactccggcactttcttctctttgaaaccaagatggagcgaagtagaggaatacaaattattatagtcatatatgttggccagattcaaagaattttcggacatgcaaaggcttgagacaaggggatccaatgtccccaattctttttaacatagcggctgatatgttagccattcttattgaaagagccaaagccgatggccaaattagtggggtaattcctcacttagtggatgatggtttgtccattctccaatatgccgatgatacaataatatttcttgaacatgattttgaacaagcaaaaaacatgaaggccattctttgtgtgtttgaacatctctcggggctgaaaataaactttcataaaagtgaaattttctgctttgggggagctaaggaaatggaggaccaatatagacaactgtttggttgtaattctggatcctttccattcagatacctaggaatccccatacactatcgaaaacctcagaaattctgattggaaatgtgtggaggataggtttcaaagaaaacttagcacatggaagggaaaaaataactcctatggtgggagattggttcttcttaactcggttctttcgagccttcccatgttcatgttatccttttttgaaatacctctagctgtacttcaaatactggattactaccgatcgagctttttctggagcagtgatagccagaaaaagaaatataggttagcaaaatgggattatatatgccggccaaaagatcaaggtggactgggtgtcctaaatcttgatatcatgaatagatgtttgttgagcaaatagctattcaagcttcttaatggtgatggcctatggcaaaaccttttgcgcaacaagtacttaaaaggtaaacccctctctcacatgtcacacaaaccaggaacatcccaattttggactggcctaatgaaagtaaaagatcaattttttcagtatggatcttttaaacctggtaatgggatagaaataagattttgggaagacacatggttaggcttgcaaccactcaaatatcaatatccttctctgtacaatgtggttcgaaagagacattctactttggcagaggttatgagcacaacaccgttgaatgttttattccgacgatcaattgtaggaccaaagttagttgagtggaatgatttgatttctcgactagctaacataaccctgtcaaatgaaaatgattgctttatttggtcgctacataaaaatggccatttttcggtcaaatccatgtataatgcgatcatcaattccaatgtaagaatccacaagaggatcttatgggaggtaaaggtactactaaaaatcaaagtatttatgtggttgcttcacaaaaaaagtaatcttaacaaaagataacctcataaagagaaaatggaggggaaacaagcaatgttgtttttgtaatacacaagagaccatccaacatcttttctttgactgtcatgttgcacgttttgcttggcgatgtgtcttctttgccttcaatattccccctccccacaatgcaaaagatatttttggtaactggctaaggggagtgcctagacacacaaaaaaatgattttatttggagctagtgctctatgttggtcaatttggcgttgccgtaatgatatggtttttaaccataaaaaaatgcctaacatcatgcaggttatattcatgtgttccaattagctccactcttggtgtatgatgctttcacaggaacaacaggatactatgcgtaatggtgctacacgcttgaaattggtagccaaggaacttttactccggtttggatggcgtagtacctacagaatttcgtgatagaatctacgtgatttaaaaaaaatatgattttagtatatcatattatcggcagaagttggggtttgtcctatctcgtttttttaagctcttttctattcacttctggactttttggctgtatgcctgcccggagatgtaacccatttccattatcttaaaaaaaatgttggccggattatgatttccgcagggtgtatgaacaattttgcttggattgtactcgcaataggtgcatcgacctgattacagagccaaaataaaatgggaggtgaggatatacaatggagatagatcggtgtaaaaagtctgataagagaaaagtatagatgccatccaaaattagatgtatatgattgctacattatcattgtattcattttaaggcaaaaacagaaagtggatgttactgattttaagagccatagcacacgattggtccactaccatagtctgttaaaattaattgcattttgggccacatatttctaccaaaaattcactttgaaccactcttgaagtgcttttttaactttagattaggtatttttatcaaatgttattactttgaattgggtggcccacatgtcaataagactaaccacctctattgtctatgtgtctcttacatgcgggccacctggtcgaaacatttgacaacaatatttagttcaaagtgaaaaaaaacattataaaggtggtctaaagtaaaactttagtaagaatatgtagcccaaagtacaatttacttctaatttaatttatgttgacaaaattacatatatttaccaactaccatagctgcacttcttcaacatagtacacaatacattaagataatatcgtaaagggctcagtgactcaccgaaacatgtatagtaatcttttgagtttttttactagtgaagcccggtaccaaatgtggaccgctggataggtatgatcggatggctgacatcaattggtaccttcaggtaccatttactccctacgtggtacctgccaaaggggaatgaggtggaggggtaaaattgtatttgcacattggaaaggaatttcgtcgatttgattcgtgttttggataaggctttgcagaggaaaatctacggcagtggcggcgagccggcgacgcttcaggaattacggtgcgctccaccagtcttctgaggccacaacggtgctccaggagttgttgtcagcggcgacaacggcagcattccaggagttatcggcagtgacggcggtgctccagggatcatctgcaactgcggtggcagcgctccgataattgtcttcggcgacgacggcatcactccacgggtcattgctagcgacgacgatggttgatttggttgaacagtttttgagcaagaaagatacatacaggaataaattgagaagcaggaagttccccgcaaaaaaaaagagaagcatgaagttgatttgcctaaatggcttcaggttgatttgtcagacaaacacaaaatcaatactcatgcgaaaagctccaacacaacctccattccggaacaattatagggtgcagactacagcggcggtggcgacaaagtccggcgcgtcaggatacatgttgcggcagcgtcggccatcggccccactgtcgttgccgcagagcaaggacacgctggggctggggggaggacaggcagcagcgacggcggtgacagagacgtgcgcgacggagcgagctgaggaacgatgtcatgcgtcaaggagagcagaatgcgacggcagcggcgactcggatatgcctgtgaagatgaggagatttcgtcgtcgcacgctagctggctgctttacttcatttccaatcgtaccccagtttattgaacggccggatttcgtttggtacctgtggtaccagtacctggaggtaccaacttctggaccagaacaaagctcgttcctgcagcagcaatcacaagttcacaatccagtggatgaaaaagaaaagttagtcaaataagcaatcgaaaatttgagcaggagttcaaatttgttcccaatttgattacccaaggatgttgtctgcaataggtgcctagcaattcttcaaacttggcaagaagaaacttctctcgcttcacaaaggctgatctcaccgttgatatttctgacagggcttgtgtattcagtgggttttcagatgatgatctctttcttttcagtcctcggattggctgatgtccgtggatcatcgtgttcagcttctcccaatcaacgtcagagatcacgcagccggaggaaccgaaatctcgcgcgggtttcagccattggcgcaggcagtcgaggttctcgccggagagggagacgaggaatgacccgatcatggcgctctgggggtgatcggaagcctcgccggcggcggcgtaggggtttctcttcttctctctgctgctgttctgaagaatttcggtgaggtcgcattgcctggaccagaggtgttcgatcgcctcatgctccgagatcggcttgccggcggcggcggcggcggcgcggacggcggcgacaaggccgtccagtgaacggcattccacacggagcatggcgtcggtgtcaaagatgtctcccggtaggtcagcctcgtcgtcgggcggaggaggagcggcggcgtcgtaccagacggtgttgaggatgatgttggaggcggggtcgagagggccgtagcagtgcccggcggcgaggagggagcggatgaagcggccgcgccgccgcgtcgtcgtccaaccgtcgccggcggggagcacggcgagcgcccggatgtagaagccatggatggcgtcgaggaggcacatcttcagcgacagaatgtgctcgcatggggagaggtcgtagttcagcgctgcgccggcagcctcgtcgccgtcgtccgccgcgcgcgtcacacccgccaagcgtctggacagcttcgcctccatggtttcgcaatcgaacgtcaggtcggagatgtacccgagttgaggagagtcgatgcggcttgcgtctgcagcgatcgtgattagggcaacacggccatcttccccgatggtggttcgaagcgtcaccgtgccatcttggccgccgccgaggccgtacggacggcgcaagaagtctatgttgacctgcggccattgatgacctagcaagttcttgatgtccatgacgtcgccggcggtgagcagctcgctcccttgcagttaggccatgataggggagagctgaccggcggggaactgcgccgtcatgaggcgcgccagctcgtcgagcgcggggtgcgccgccttcagcgccgcgaccctgagcgcggccttgatcttgccgccgtcggggagcaagcgtgggcgctggcaccgacgacggcggtcgtggaggacgagcctgacggcgagggggaggtcgatcgtgggcggcgaggtggaggtagcgcctagcctgttcgtcggagatgtaccggaagtaggacgacatgaaggcgacgaggccggcgtaggagcgggcggcgaggataccccacagcgacttgccttcctcgcgagggagggcgaggtgcggcgccgcggccgccctgccggaggcgtggtgggcgatggcgttgaggatgatgttgccgacggggtcggcgaggccgaggcagtggccgccctcgaagatgcagccgacgagctccgtgatctcgtcgatcggcagccgccgcgccgcctcgtcgtacaacctcttgatcgacgtgatgatctttgcgctctcgtcggggtgaggccgcttcccctcctcgccatggtagcaggcgaagctgcccgtgcccgaccatggcggcgccaccaggtgatgatgggacgaggaggaagacgacgacatggagcccccacgagttggggattttctttcctccaagatttgctggtccaattagtttttttattattatttttgccctcgatccgacggttgctataaatcggtttaatgtggagaaaaaaaaagaccacttccttatatacttatctgtaccataatatcggatattatgaaccctcgactattaaaactagtcaacactgtcgtgtaaacgtcacgtaagcgaaaccgtcctccaaaaccaccgagaaagtcaaattacactcattttgatagttgagaggtcaatatatctggtcggtttaagaatacgaatcagattcgatgagtagttaagggagttaaagtgaacttattaaaaaaaaatctcggatgtttggttcaggggagggctgcctcctgcctgcattgggtttggctctaactagtgggccgttttagttatatagggctacaacttttggcccacttgtccaaccaagcccactaaaaattctgagttggcctactatgggctacgaccaggtcaagcaccctgtcactcacacaaaaagtcaattgtcaccagatgattgatgaaaaagtagagtaacgacatcctgtcgaccaggttgatacaagtgttccattgaaaagtcaacccgtcgatccagttgtcctgggacgaattgatggaatttaggccgccagcaagcaaagaccgagctgagcagctccagccgggtgttatcagggtcaaaacaatccaaatattttcaaaaatttcagttcgtttgacttggtttctggccgcgacgtctgctttctctcgcgtagcaagtggtcaacagaacagtaggttcctcgtttgactatcctatgtaatccaatattccctccaatgcattgctacactcattcggtcattcactatactttgtgtacggatttttatgtgaccagttgttccatcacggcaagggtacatgccagccgaacaccttagctaagtttggaatatcgtggcacactcccgcccatgcaaacctagtacaaataaagccccaacttcacacaacaaatttgcatactgaagaagataaaaaaaaaagttcgatagattcatcgctcatactagcaagcatggcaatgccagttggagttgcaccggtgttgttactgttgcttttgccattggcggcggcgacggcggcggcggagagtgacgacagggacgcgctgatggcgttcaaggccggcgtgacgtcggacccgaccggcgtgctccggtcgtggaacgagacggtgcacttctgccggtggccgggggtgaactgcacggcggggcgcgtcacgtcgctggacgtgtccatgggccgcctcgccggcgagctctcgccggccgtcgccaacctcacgcggctcgtggtgctcaacctcacctccaacgccttctccgggagcatccccggcggcctcggccggctccggcggatgcggtacctcagcctctgcgacaacgcgttcgccggcgagatacccgacgcgctccgcaactgcaccgccctcgccgtcgcgtacctcaacaacaacaacctcgtcggcggcgtcccacggtggctcggcgcgctgcccaacctcgccgtgctccggctcagccacaactcgctctccggccgcatcccgccgtcgctggcgaacctgacgaagatctttcggctcgagctcgaccagaaccttctggaaggttccatccccgacggcttgtcgcgcctcccggcgctcggcatgttagccttgtcgcagaacagcctcgccggagagatcccggtggggttcttcaacatgacgtcgctgcgtggcctcgcgctcgccgacaacgcgttccgcggcgagctcccgggcgacgcgggcgcgcgcacgccgaacctccagtacctcttcctcggcggcaacctcctcgccggcccgatctcggcgtcgctgtcgaacgccacggcgctggtggctctcagcctcgcgaacaacagcttcgccgggcaggtgcccggcgagatcggcacgctctgcccgctgtcgctggagctgtcgaacaaccagctcacggcgaccgacgacgccggcggcggctgggagttcatggacaacctgaccaactgcagcgccttggccgagatactcctcgacggcaacaagttcgccggcgtgatgccgccctccgtcgtccgcctctcgccgcagctcgaggcgctgaaccttgccggcaaccgcatatccggcgtaataccgccggagatcgagagcctcgtcgggctgcaaacgttgtgcctccagtccaatctcttctccggcgagatcccggaagcgatcggcaagctcaagaaccttcgagagctgctgctagagcagaacgaactggccgggccggtgccatccgccattggcgacctcacgcagctgctcaagctcgacctgagcggcaactcgctgaacggatcgattcctcccagccttggcaatctgcatcagctgacactgcttaacctctccggcaacgagctcaccggccatgtcccgagtgagctgttcaccctctcgtcgctgtcgctgctgatggacttgtcggacaaccagctggacggcccgatccctcccgacgtcggccagctcacgaagctcgcgttcatggcgttgtcggggaaccgcttctccggcgaggtgccgaccgagctggagagctgccagagcttggagttccttgatttggcccgcaacgtgttcgtcggaagcatcccgccatctctgagtgggctgaaagggctcaggaggctgaacctgacgggcaacaggttgtccgggagcattccgccggagctcggcgggatgccgggactgcaagagctgtacctctcgcggaacgacctgtccggcggcataccggcgagcctcgagaccatgagctcgctgatggagctcgacgtgtcctacaaccgtctcgccggccaggttccagtccacggcgtgttcgcgaacacgaccgggctgaggattgccgggaacaccgcgctctgcggcggcgcggcgcggctacggttgccgccatgtccggcgccgggcaactccacacgacgagctcatctcttcctcaagatcgctctgcctgtcgtcgcggcggccctttgcttcgccgtgatgttcgccttgctccggtggcgccgcaagatcaggagttcgagaaccggaaacgccgccgctcgcagcgtgctcaacggcaactactacccgagggtcacgtacgccgagctcgcgaaagccaccgacgacttcgccgacgccaacctcgtcggcgccgggaagtacgggtcggtgtacagggggaccctgtcactgaagacgaagggggagttcgcgcgcgaggacgccgtggtggccgtgaaggtgctcgacctccggcaagtcggagcttccaagacgttcatggcggaatgcgaggcgctgcgcagcgtcaagcaccggaacctgatcaacatcgtcacctgctgctccagcatcgacatggagggcaacgagttcagagctctggtgttcgacttcatgcccaactacagcctcgataggtggctgcatcgtgcgaagcatacggagaccgggaaatggtgcggcggtgccggcggcctgggcgtgatccagaggctcgacgtcgccgtcgacatcgccgacgcgctcaactacctccacaacagctgcaaccctccgatcatccactgcgatctcaagccgagcaacgttctcctcggcgaggacatgacggcctgcatcggcgacttcggcctcgccaagctccttcttgatccggccagccatggcgccgcggcggcgaacaccgagagcaccatcggcatacgcggcacgattgggtacgtcgcgccggagtacggcacgacggggatggtcacggcctccggcgacgtgtacagcttcgggataaccctcctcgagatcttctccgggaaggcgccgacggacggcgagctccgcgacggcctgacgctgccggagttcgtcgccggcgcgttcccggacaacatcgaggagatcctcgacgtggccctgctgctgcaggccgaggagctcgacggagcagcgtcgtcgacgacgtcggaggaggagagcgaggcgcgcgtcacggtgcgcgattgcttggcatccgccattagggtcgggctcagctgctcccggcgagctccctacgagaggatggccatgagcgtcgccgccgacgagatgcgcctcatcagagacgcttgccttcgtgcttgtggtaaataagtaggacagtatactgattatttgtagaactttgacagccgaattagtcgatggataattattactacgtcatcggcatcgaattctatcactattcgaggcttcgagcaagctgttgtggagtaaaaaaaatgaaaatgtaaaatccatggaattcaggagctctgatctcttgatttatctagtgtactgtactgacagaaaatggatgtactctgcatattcagatttcagaatagattgttctgtttatgtccagattccagaatataatgggcctgggaaattgatcagtaactgggcctaaataggcctttagactgaactagtcctgcctcttgtttatttggagtagtctttgtttcgcagtagttttttcttttcttttacctcttgtttttttttctttcttcccctccggcataggcctggccgattgtattgtataactaaaactctttttcttctaatatattgacgtgtaattctttcgcgcgtttgagaaaagaactagtggctattgctgattcatcctcttgctatcgccgttgctgaacaaagtgtgagagcataagaggaaaaaggagacgttgcgttgtcacttgccattgccagcgtgaaaccgttgaagatgcctcataaatgcgacggattaacagtttattagcacagcactggataaattggatatacgtgcatacgatggcgtccatggtttgcttgcttttgctgtggataagttggtcactactccactcactagctgcaaaaaagcaagggaaaaaaaaaaggtaattgcaatgtgctgcgtacgtgcgcaccctggatggtgatgtgcttgtttaccgtaggaggagcatttgcgaattcgttcttatcctagagaaattaatcgagccatttcacgctgtcaaggtatatatgatcgggtttcagagtttcagtgtgatttgccatttgccaacaaagcaacacctcaatgtaaatagcagtagcataaaaaaatggttcttttggattgtaaaaattttgcagattttaagtagctttataaaattgtataaaaaatatttatttttaaagaggtcggaaatgtcaaacactgagagagatcggtagcgcttgctgctgccgccgctgcggctgcgagagctaaaaatcagctacagcagcagctgaaaacggccacagtcgtgacggctgcagcagccagcagttccgatcaggcccaccgttttttgtcaagtgctgtaacagtgtactttgtgctgtaacagaaaattggctggttgtcaggtgctggttaaaaaggccaattttctgtcaagttctggtttgtgatttgtgatgctttggctattagttaccctacacaagtactccctacgcaacaaagaatggttaaggcatgagcccctactgtttgtgtaccaagtgacaataattggagctttcgatacaaacaatacttaaccaactaccttgtacggttcccatctgccgccattttccaactaactcgagctactacaactaataatcatcagtaacacgagctaattaaaagcatcttccagcacggcaggaggagcacacatccctcatcctctgacaccgacatgtggccccacaccacaggcacttgacctgtgtcggatccggacccgccaacccgccaggtgttccctccaatgggaggcgagctctccctcccaagagaatttaagaacagagagaggaagtggagagactacttcccccacctccgcctctctctcgatccatctcccccctctctcctctcctctctctctccgttcccaatctgcggaggcggaggcggagctagggcgcggcgtcgccggcgaggagttccgcaggcgcggtgtggacggggctcctctgcttccgcacacggcgggcggcgacggcgagcagggttggaggggcggcgcggcgacctcctcgttcctgccttgcctgcctccatctgggtatgaatcggacatcagtttttgtgtttccgaaatttcaaaaaatatatgcatgtcgggttggggggttcagctcgccacgttgggcaaagccgtccgtggtggtgtataagttattgctttccacatttgttaggaaaaaagtatgcgtgatttaatccgatggtagtttgactactaaaaatagtggtcgtctgatagctgtgtctccttggtcaaattgggggtcaaattgttgggatcattgtcgttaataagtgattgatcggtccaacagttaatccgtttgtgcttttgtttgcttgtacggaatctgaatcatgcattcacaagtttttgttatggaaaacagtagggggaaaaatcctatatgaagtatctgtttgttgaacagtaggaaatacgaccgtataattgtattgaagatcttgtgattttgaactgcccaagtatgccaacagtagagttggtagttttgcatatacaccgagtactaattttgcaaggctagtgttttctcccctgttctgagattatatccatgatcccatggcttatcttcatccattctgtgaagagcaattgcttcttgtctagaaacctttctacatttgctatcttggtatggacaaacttttgttgtaggaaccttaggttatgtctttactcggtaattgaaagttcacacaataatccagcattttgatcaaattaattagatcgttccaacatacttgaatttagtggccaaacataattgtttatatcggttatctcatggccacgttgttaaaaaccataacaatctccatgtacctctttttccatcaaagttcgttgagagtttatacataaatcagaaaatagtaaatatgagattgtaatgggaaggaattgtagctagcgatacacatttatccctataggtgatttctgccctagtgtattttgtaggttaagagagtcgatggattgtctacactagatttgtacaaagttttcttcagctgtaattcaattcaagtctataagaacagaacatgaattaaattttattgagaataatgccaaaattggcattgttagcaaaatcctctaactggaagtaatcaaataaaagtttctaatctcaagccctactaccccctaactcagtagggacccaacccaacattgcaacctccagctggactaattttccttgaagacaggctgataacttaagctaggctgaagagtacaagggccttgacacattcactagcccagtttaatgatattttttgggccttgacatattcactagcccagtttaatgatattttttgggccttgactgacataattttgagcatacctagcaggccaaatccttgtggggcttggtcaggttgggccacttgtgttatatctggtccatcgctacattcgtaacctagcataatttattagttagtttcagttgtcgcttgtcagaaaaaattgctcaggtcacaagtcccctgtgaaccaaaatgtttgagtcacgaaattgtcgatggcaaatttttatcctctgaaaaggtctagaaagtaacaaaaaaaggaagtggacccatatctttaattactgccatatcaataccaaatcatgcttatccgataactgcgactttcccatcatcgagttatatatatacccttttgttgattgagacttgtataaattgaaaaggagaaattcaggtgcataaggaatctacgttgcatgcataagacggtaagtactagcttgtttgccaactttctacttaaatccagttgtgcattagcatggctttagataagtttaatgatttggtctagcgaaacttgtttcagatgatcagatatatttcttgtagtgtttatatctgtgcgtgtgcgaaataaatgcatagatcgaggggggtgagcagttcaatgtacaatcaggaacatccttcagatatgaatttggcctgtttgattaaaattttctgtttcctacatacatttgactttgattgcctatctaacaaatatcacaaataccaaggtttttaaaattgttagcta

SEQ ID NO: 23407 - DNA, 11337 bp, Oryza sativa
ctattagatgtgttaacactttggaatccttagtcttgacagccttgtgctacaagtattgtgcctgaaggagatacgggtatgtatgtggattgtgattagtcctattgaatctatgcatagaagagagaccatcaatactatttaaaaagaggaattggttctggttctatgcatgatcagatttttcattaatgggtttagaatagaccatctacacatgtgctgtttataggattttttttgtgtaaaatattgcattctttcactgttgcatatgcatatattagttatcggttgatcttgcattattatatgtatacaattatttagattagataatgattacttgtttaaactcaaaatttgtgtatatttatttcgatccatcacaactcatgggatgtgatgctagtttatcataatttaaaatgtgcatgattatccttgattcagatatctatatccattgccatcaacttcttatttgttttgatgcgtgctcatattgatcatgcttttagatagcaatatcatacaagtatggtactgccattattcaaatgtttttgagcctcagcctttcccaccccttgtcactgtcttggggcaatatttaactattgaagaattaactatgctttgcagggcacctgtggggcctgtttgcaataagaaaccccgtggctactaatgactactaatacaactcacagtcttaatcgtgtgtgttatcatacagggaggctttcagacaaacattgaaaattcttgctgaccatattattttctttttcataaataaacactatcaagggtcaccttttgtgggcttgcttatttgcactgaagatgaatttggaaaggtactaaagtactagtggcttagaatttggctatgcaaggttagcaggagaaccggtattgctaatttgtgctaaggatgaaattggtaggtgctgaagtactaaatgatgggagtttggctaggtaaagcttgaaagagaaagtcttcctaggatatgatagataaatcaaggaatttgttgctcactgtgcccaaaatcttaatacaatgatacacaaagcttatgtgtattcgcgaaaaatgtgcccaaaatctaaccaaccaactgctaaccttgctaggcaaggtaggctaaggaaccaaacatggttgctaattgctattgctttctgatcaaacattctgttcgatgattttctcctgtagactttattacaagatccttttagttacacttttgtgatgcatcatgcatgcttacagttacttatatctgcaattttttagtatgtctactaatggctgatttcttcaattatgaattccctgctctgctgctggtacataaaactgatgctagcatcttatgtcggatgactatttttcagaacaagtttagacattgaacttaaaagtaaaactatagcagatcgattcatctgcacaatttattagtttgtaacatgggaggctaggactattacctaatcgagaatgcaactgacaatgtttgttattcttattttgcagtgttggaaatatcataagttttgggacaagcaagagaggacatggagctatcatcacaacctcagccggcaattggtgttgttgctggtggatcacaagtgtaccctgcataccggcctgcatcaacaatgcctacaggttctgctgtcattcctgccggttcacagccaacaccgtcgttccctgccaaccctgatcaactgagtgctcagcaccagctcgtctatcagcaagcccagcaatttcaccagcagcttcagcagcagcatcagcgtcaactccagcagttttgggctgaacgtctggtcgatattgaacaaactactgacttcaagaaccacagcttgccacttgctaggataaagaagatcatgaaggcagatgaggacgttcgcatgatctccgcagaggctcctgtgatctttgcgaaagcatgtgagatattcatactggagctgaccctgagatcatggatgcacacggaggagaacaagcgccgtaccttgcagaagaatgacatagcagctgccatcaccaggacggatatgtacgatttcttggtagatatagttcccagggatgacttgaaggaggagggagttgggctccctagggctggattgccgcccttgggtgtccctgctgactcatatccgtatggctactatgtgccacagcagcaggtcccaggtgcaggaatagcgtatggtggtcagcaaggtcatccggggtatctgtggcaggatcctcaggaacagcaggaagagcctcctgcagagcagcaaagtgattaagaagagtaaatgatccctgtgaattgtcaagaagcttaccacctgattcagaattttacttttagccaggttgtcgtctattctgaatttatgaataggattaggattctctcatggtagttgcatttctgctgtagtggaaaaggatttatgacatgagagtatgagactaatgggtttcagttactataccgtttcctgtcaatccaaaagttggcctttgcgaggccattgatattgaacctaatgtggttgaactgcccatgccaacgtttgtaagctctgatgtgggtcattctgtatttcatgtttgcatggtttcatggaatcttctttgtttagacaatgaaaatgttttacattcgtggcatctgccataacacatacccgatgagtttttaatgaaataaaaagacgggtgggggatacatccccagcgtactcttgatttgctagtaaacagacaactcatagccaaggtaatgtagaaaactacagtttataaagcctacaatggtttggtaaaactggtcttgtggcattcacatgcagccctatattaatctaaccattttgtttgattttttccaccatttgaatgatttatcgttagtgcgctgtgatatttgcaattttgcattgtgttttagtagcttatagctccgtgcttgtttgttaatctaatgcaatcgggtcaaagaaaaaaaaatgaaacggtactgtccatggtgagggctgattagtatggtcttggagtgtagtcaagccgttttatacagctgtggtctcttcgtaaataacagaaagtagtgtacaagtaaaatagaaaaaaaattcggaataaacattacaaataacagaaagtagtgtacaaatgcatgatgccatgatgtctcctaacccattacgctggcttattagggcgtgtacaagggtatctttctctgtcagggaaaaaaaaaactagcgcgaaatgtgttgatactatgaatttaaacataacatctcgtattggattttttcttttaacggaggcagtataggtgcattgggcgtggggagcgtactcagttactcttaccgttggcacgatgcaaccaagccaagtaactacctctgaaaaaaaaaaagaaaaacaagttaatagattgagtatcttttgcgaggaatgtatgtataagcagttagttaattagcacaagtaaactgaaagaaattcagaaataaacccacctgtaatttgtagtcgttaacctaaacttttaggtacatcaatatattaccagcttatgttgagagaatattttctccaattatccatcacatctactccctctgtttcaaaaaaaactcaacctagtattagatagaacgttttctactgtccagatttgttgtactagaagacatcaaatccaatactacattgagtttatggccctatttagttcacaccaaacttcccccaactcctaactttccatcacatcacatcacatcacatctaaaactttcctacacatataaacttctaatttttttttccaaactaccaattttctccaaacttctccctaatttcagaaactaaacacagcctatgtgagacagaaggagtacatagcaaaatcttcatagcattaatgatgtcaaaagctccacggtgaccagagctcgtcaagaaacatgacgccagtcactactcgccagccattaatctcagttcgctttcgccggctggccgcaaacggcaaatattcctcgtccaagccggaggccccgagaagaagaccttgccgagataggcaagcccggaagccacgtcgagcctgcagctttgctcgcatgctgatctcccagcttggtcttggccgtttcctgtcgatccagcagtcaaggatatgcagtaataccgagtccaaaaacaatccttgtccgtttgtttattttccttcttattttcatcggatcaagaactgtagttcgttacctacgctatgatgcccatgcatgtgcatgtttcttattgctatcttatgtttgcaaaaacaattattgtccgtctttcttttttcttattttcattcgattaacgtatccttgtccgtttgtcttttttttttccgataaacgtatcatttttctttattcttttattattttctgataacagtcccaaaaacatttgcacgaaaaacgaaagatttttctcgcctagtacacggactaacaaatctaacatcacaaaaactttaccaagttttgacaataccaaaattctagcaagatgacaatattgttaaaattttagtatgatttcttaaccaaatttagtaacaaactaaacgtagacatttttttttgacaattttaaagaaaatggtatggttaaaaataatgtcaaagtgaatacacccattataacgttgaaaagaagaccagacgacccacacgtcattcttttactcgcttttgcgttttgccacaaacggcatgctttagctaggacctcagccaggtgagaagaccttgccgagagataaggaaggccggaagcctcatcgaacctgcctgcctttgcatggcccgctagaccgcacttccaattaattgtttttacaattaggtagtttacgctttgaccactcgaaggcatttttattaaaaacaataagtatctcaaaagtaacctacgatgcatattgtcttgtaaatacgcgggcttcattcctaactaagaaaaatggtaaacggtgtattttacaactgaaaaatttacaaacttaaaattcacaagtataattcgtcacgcactgcatgcaaatatgcagtgatgcacacacagctaacggtcccgggttctcccaccgcccatcgcctagagacaagttcaagcgcagtaccgcctacactcccatgtgctagctgcttccatgcttgcctactctctgtttacgagtagtgagaagcagagagtgagagagacgaacttgatggtgatgcaccctaacgctgcgctcccagtcaaagtcaaacgcagtagcacctagtacgctcctactccctccggaggtatcattttaattaatattttagacaatgacacggtctacaaaatatatctttaaccttatttttctattataatataaataataaataaatacatgtttacttttattatagtgctttgaaagacaaatctatacatgttgttctagttcctttaaactaaatatttttaaagttatcgatgatcaaagttataaaagtttgacctcaaccgtgtctaaaacgtcaattaatatagaatcggagggagtatactcgtagtcgtatttgatcatccataaacgcgtccaatatctttgggtaatggattttgcgacataacaaaaagtttagaccagtttttttactagagacgataacaacgtgccgagcaattttggctctcaaataatgatgttgttttttatgggaaaacggtttattttcctttgcaggttgttttcttgattatttctccagaagctcggtttatatggtattatcacttcagcttatttatatttggagcaagtggttaaggagttttatacctggcatttgggtgatgacctagttttcgagttgtaagaccttgatctcgagagtttttatgattttctctcttcttttaaggcctcgtttgatctatccttttggagataaatttttagtgcacgtaaaacgagaaacctcattaccatatgattaattaaatattaataattataaacttaaaaatagattttatctgaattttttaaacaacttctatatagaaaattttgcaaaaaaaaacacatcattgactgtttgaaaaacatgctaacggaaaaaagttgaagtttggagttgaggcaaagaacttagcctaagtgtgcagtgtcttgttcacttggttgtgtgcactatcatgatacagagggcctgtttagatcccctggtaaaattttataccatgtcacatcgaatgtttggacacatgaagtattaaatataaacgaaaaaataactaattacacaaattgcgtgaaaattgcgagacgaatcttttaagcctaattgcgccatgatttgacaatgtggtgctgcagtaaacatttgctaatgacggattaattaggcttaataaattcgtctcgcggtttacaggcggattctgtaatttgttttgttattagactacgtttaatacttcaaatgtgtgtacgtatattcgatgtgatacgcaaaactttacacccctgaatctaagggtgtgtttacaagcgaaattagtaatttgttttgttattaatctatgtttaaatgtgtgtccgtatactttaaaatttttttggccaaataactaaacacgaccatagtcccatatgctgcttttgggttagagaccagcccgatggtgacaaactgatccaactccaaccaacgtttgcgttgaggtgctctctctgaatttttcttgtgccccatgacgttgctagctgcttttgccgattagcctcgtttcgttgcttttgctctcctgctgcaatgctgcctgcggctgccacgaacttctatccgcggagagcgacgttcgttcccgatcgaacctgaaacttcctggcattttcacgcgcgcgaacgaacgaacgaacggacgaactgtactgtaaatactcaggcgcccgaacgaaagttaacgaacgaacgaaagctgaagtgctgaacgaacggtagactgtaaaactcaggcgctccgaacgagaagttcagtgaacgaaagttacagccatcggtgaattcacagtgctagtgccgtggagatcgcggcctataaatacgcttcgttgctttgctcctctccttcagctcgaaggaagccgttccagtgtctcacaagccaaggtaaagaaaaaaaagagagagaaaaaaacagagaaggaaatcaagagaagaacaccatttgattctcctctctgctcactccttctccttcttctgtttgtccgtcttggattggagctagcacttctttgactgcccttgttcatcgaggcaagtgcagaaatcttttcagtgtggctggatcccgtttaattcaagcgatttgattggggttttttggttttttcgatggacaggcggcgaggcgaggtcgcgatggggcaagggaagatcgagatgaagaggatcgaggacgcgacgaggcggcaggtgacgttcagcaagcgcagggctgggtttctcaagaaggcgaacgagctcgccgtgctgtgcgatgcgcaggtcggcgtcgtcgtcttctccgacaagggcaagctcttcgacttctgcagcccgccggtcatgtgcgccgccgccgcccggccctagcttctatctctgtttcttgttaatttgtttatgacgaaatgccaatgaaaaatctgctttaaaagaaacaagaaagagagagagagtgtgtgtgtgtgtgctgatctctaatcttgatttctatatatctgcatgccttagctgagttttcagttctttgtggtgattggtggtgtgtgcgatgattcagaaatttagcattgcatttatttgttgcagttgatatttcactcagcattccagataaatgtttgggggtactgttcgattaacatcccgatcaaatgggtagtgttcttcatgattggtagtggatttgggaaattgggatcgctttccttgcattcaacattatcactagaaatctttcgatggttcatgttctagagcttgcttttctttctgatttaatcttttctggcatcctgaaattttgatttcaggatctattcctataggacttgtgcttgctgcatagtgcattcttcaattaagcagtgcccatgaccacatcgattagtactactagaagctaatactccttttacatgtataagttcacttcattggtccaatgtactagtaataccatattgtttctggatgtaacatatttgattatgctttgttaagcttgatggagctgtttcaccgttatgagatcaccaccagaaacactcggcttcaggagacaaaccgtgatgatgaggtaagcgaactgaatctaacacatgttatttttttcttttttacatttgaaaggcaattgcatgtcccacaccaaattcctaatcactcaaagcttcatttctacaactaatctacatgtgtgatgctgccttgcagcaaatggtcatggagatcacaaggctaaggaatgagatcgaccagctcgaagccagtttaaggaggcaaactggagaagacctgtcatctgtgtccacagtggatgagctcagccagctgcagctgcagcttgaatcatctctcagcaaagttcatgcgaggaaggtactagcacttgcttaaatatggcagaagattagtgcagatcagcatcaaatccttatggaatatacaagtcctccacgatttttttttctttgctcacaaattcacaattagagtttatatgacagaatgtgttaactgcatgaggtgcttgtgtgcaggatgagctcatgagccagcagctggaggatatgcgtcgcatggtacactactcccttattgtagtcgcagttgtggtttttgctgatgagtggtgagctgaattaatatatggattttctgtatgaaatgcagcatcagaccgtgcatgagcagaacaatttcttgtgccgcatggtaactaaaatactcctactagtatgccactgcattggctttaatttctttttgagttcttcctaaaatgttttcatgattcgagtgaatatcctcttgtttcttacgtgtcatctatcctataattcaccaactcgttttactcatcttttactcttacactcttacattcatcattcaacggttcagatcatccgcgtaaaatccgaacggttcagatcgatcccacctccacctccctcaatcagcggacgacccgcaccgcccccccccccttcctatcgctctcccaccacacctgcacctccgccctccgccggaattccgctcctgcacctccgccatcagtgctccgctccgtatcagccgccgcgccgtcctctgcatcgcatgtctgccaccgatccccgccgccggctcgccctccacgatcctccgcctccccgctgcacgaggtcctcccgtcgccaggtcgtcgccgccgttctgctccaccgatccccgccgcacgaggtgctcccgtcgctaggtagccaccgcgccgtcctctgcatcgcctgtctccaccaatcccctctgcatcgcaggggtgagctgcagctatggagttccttgccggtgggggagcagcaggtgaatcccgtgagaggtgagtagttgaacaaaactcatcatgcagttcatcagcaggtgaccagtccggaacttggcatcgtggaggttcatccggattcatcatgcattctgaaacaaaacccatcatccagcgcttgccgcttttcctcagagtacaatgaacgcggggtgctcggcgaaatgtcccgtccggctcctcacctgcaatgcatgtgttctggagagtgtttatggattctggatcttagaccccctcaacgacttggatcgtcagtaaagcttcatcttgaaggtgcacatctgccgttgtttcgtcaaaatactatgcatgatctttaggtgataaaatattgattgaattgtctactgctatcgctcagaatccatactccatcaatcttacatatacacatatttgttgcgtcaaacacaagcttgctttccatacatccctgaacaattcagcctcacaactgctcttgacatatctcattcagaattttttttctcaaattagttggactgatagaaaaatattgcttttcaagattgtaaaataaccaactgactgggaagttgatgtcatatgttggaagcaatctgctaaaatgttaaagaagtgcatctaacttttgtacccagtgaattgcaaatctctatctcgtttttttatttacagtttcttttgttttaaagtaaaataggttgacatgggaactttactagcagaggaatgggcttatattcttggaaaaaatacatttctccatgcagaatgtgatcacaataatgatacttgctgccatgatttctatcactcatgcacgcattgccattgatgattgtatgcagttgggatatattggttagttcaccctctatctctctctcaaaccattatttatcttcattcactattcacttacaatttccctcgtattagtgatatgcattagtgagtttatgaaaaaaagatcaaatatttaaaaacagagttagctcctttggaacgaagacaaaatgctactttgataacttgacttctcaacaccactcttatctgcacacaatttttttaatgaccagtttgaactttcatctctttacagtcatcaagcaagaaaattcttggcgattctggtttatatgacttcctggaagcagtaggaacaacaagagttactgaaccagaaattgaacttgccttcttcatgcatcagatgaaccataaagggaacaacactactaccctctccaaaattgagctgctcaggacttcgtagaaatttacagcttcaggacatgtgatttatccattctcttttactgtttattctaaaatgcaaaaaaaaaagaaattttgttgtagcttagattaaggcagcctcagctttgtggtttgccaagccatgtactgatatatgaatgtgatactttaattaatgttgaaacgcatgattatgtatttgaactgaattgactgaatgtgtcctggaatcggtttagaacttaatatatcaatcagacttttgttctttgcttactggtttttctgtgacatggagaaaagacgttgaagacataatacatcgtcga

SEQ ID NO: 23408 - DNA, 4092 bp, Oryza sativa
ggtgatttaaggagtaagtagcacatttgcacctatccttgtacctgaatacattggttgcaaacttcgcagtggtaactcaatatagaagttagtttacctttgcatgttatagttttttgtgtctggatctcagttgacctctggttttctagtggagtttaggctactgcatcagtatcacttatttaactggtagtataattcaaccttttagttttatgtttgtacattctaggaatagtatgccttagtttttatgtttatacattctaggaatagtacgcacatagcgtaatttccacagtaccataagagaatcgtcgagaacgaaatcctcaacctagcatgtcataagtcattctctttcatgcacctgtaaatccttgtatgtatcgtgtggcaattatctgttgtcatatttttgacgtaatgccttactttgcttctcttgtaactgaattgtttgttataatgtactccctctgtcccaaaaaaacaaatctagtataagatgtgacgtcagttcaaattagtattactaggatgcgtcacatcctgtgtttgtttattttgggagttgttcatgtttttgttttgactcttgaacatacttgtttctggtcatttattgcactggatttgtcaagttaactagtgacgctgacatcaataatttttttgaagttttgatgaatttgttcattccctatccaacataatagatatttgtgagacccaacatatgtgaaaacgttactgttgtactgcaatttttttggatctacagcatatattcatccatttacttggtgatgtctggaatactgttctcaaacagaattatagatgctttcatcaaatttgctgtaccgaggtaattagtgtagtcgttatttttaagggttatatttttaatgggcgtgggacttccagattatgcttccacttggtataaccgatggcataaatcaatatatatgttctgccgtattttgccaacttcatatcgcccggatatatatgttctgcagtattttaccaatttcatatctcccgaacacttctgctgtgtgctataacggcgtgtatattcgaacttaacgtctcccattgttttgttatatgggtgaatggtagcaaagttcgcactgtcatgttgttgagcttgtgatttgtggagagctgctggtaaggagccatgttgcattgcgtacgtgggatgggttggtgtagctcctttccagcagtagtgaacaaacgaatcgccaatcgtgattgaggcgcagccgcatagcatattgcttgaaaactacgaaatggtataaacaggcgagctatcaaggattcaagttacaaaatgattaagcgaacagtacgtcaatcttagattgtacggcctaactcgcccgtaaaatcccagattctgggctcagatgcttgctaaaatgcaaaacggcgcgttaaacagaaacttctcttgtagaagttcgcaaatttctttaggagaaaaatccaaattccctcataagtcactttgtgttgtcatcctcacctctacaactcaattaggtaaaaagacatcccacaacacaatctctcttctaacatcctcagtatagatttcattgatttctcttgctcaatttcttgtgattttcttttcgtttgcccaatttcttgtgacccacatcagaactacggcgactttctgctcctgaaacacgttacagccacgttgttttactgttcgaaatttgaatcacatatgatagagcgagctttgtggtgaaaacggatcggataatatactgttcgaaatttgaatcacatatgatagatagagctttgtgctgcatctaggggtgaaaacggatcggataatatccgatccgctccaaatccgtctgaaatgaggatatagaatgtgcttttagaattctggtggatacgaatgtggatgcggatagtatgaggcggatgcggattatgcgacatttttgtcggattatccgataagccgtttgccggataatccgaaattatcaacatatatacccactatatctattgcatataatataagtcggtacatccaatgcccaaattcatcaattaacatagattttttagtctaacgcttttatcgttgcatgtcacattcatgtagctatattttttatattatgaacatcatgtatttatgttgtttagcaattaatcgtataattattacgatgggttatttattgactatattgtattattattccttggatttatcgatgttgcattcattgctatacacgtaacatccgataaatttaatctgtttccgaaccaattccgcattgactccacaccattttcgacgcccgaaacaatccgctccgcatccgctcggaatctgcttaaaaatatggtttaagatatggtatgagcactatccgtccaaatccactccgttttcacccctaactgcatccttccgctatggtatcataccaacatgttgatgaacgattggagaaattagtggaaattagacagaagggggaagttagaatagaatttgagttgtggccgattttttttttacctaatcgagttgtagagggaagagtgaaaataaaagatttgtagggggtatttggattttccccaaaataaaacgataggcccatcaaaccctaaaaaggttaagcacggatggtctatcaaagcaaaaaacaaagcagtccagtcaaggctgaaattgttaaaagggttcattaagacccaaaagattgaaagggcctactgaggcccaaaatgttaaaagtgcgtggagctaaatttcatgaaattttgtcatgattttgatatccacaaattccacactccacggtcttggagctaagctagcaaaattttggatcaaagaaaatattttatacttttttttaaaggttaatacttataggttttactagaaggctaactctcaaatttatagcatgtaggctaaatttcatgaattttttgtcctaatgttaataatcacaaatttcaacgcaacattcttgatgctaataatagcaaaattttgggccggaggaaaaaaattgtgcatttttcctaaggttaatactcgagaagcctacaactcacgaatttatagtgcgaggggctaaatttcatcaaaattgtcatccatatgttccttgtgctagtactagtgaaattttggaccgaggaaaaaaaattcatgtgtttattccaaaaggttaatactcacaaattttgccacaaggctataactcatgaatttatagtgtgaaagctaaattacatcattttttctcctaatgttaataatcacaaatttcacacacgactatacatatgataatactagcgaaattttgggtcagcgaaaaaaatcatgtattttttttctaaagactaacactcacggagtcatgggtttgggctaaaggctataactcacgaatttataaccttagggcaaaaattaatgaaattttctgtcataattttaatatgcataaattttacatagaacgatcctggtgctaatattagcaaaattttgggcaagagggaaaaaaacttgttttttttcaaaggttaatactcgcgggttttgcgagaagcctataactcatgaatttatagcatggatgctaaatttcatgaaatttttcttcttgatgttaataataaaaaaattcatgcgtaacgttgatgctattactagtgaaattttggactggaaaaatttcatgctttttatccaaagtttaatacccatgggttttatgtgaaagctatataactcattaatttatagcctcgagacaaagttttattaattttttttgtcccaatgttaatattcgaaaaattcacaagcgtattttttggcctatgaaaaaaatcatatttttttccaaaggttaatactcacgggttaatactcacaaatttatagcatggtggctaaatccccccccccttttttgctatttttaatgtttttcatgaattatacacacggttatcctgatactagcactagcgaaattttgg

SEQ ID NO: 23409 - DNA, 61272 bp, Oryza sativa
tgctagtactaacaacagtttggacaaaagaaaaaagttcatgcgttttttcaaaggttaatactcatggtttttgtcaaaaggctaactcaggaatttatagcgtgcaaactaaatttcacattttttgtcctaatgtaaattatcaaaaatttcaacgcaacattctcgatgctactactaaccaaattttgggccgaagaaaaaaaaatcttgcatttttctgaaagttaatactcgtgggttttgcgttttttttccaaaggttaatacacacgagttttgcgagaaggctataactcacgaatttatagcgtggagtctaaaatttcatgaaatgttttctcctgatgttacgatatggtccatatgctaatactagcaaatttttgggccgaagaagaattcttgcattttttttacaaaggtttaatgcaaaatttaatgaaaattttaacctgattttaatattcacaaatttcacaaacaatggtcccgatgctaatactagcaaaatttttaactatttgttttccagaggttaatattcatgggttctactcgaatgctataactcatgaatttatcctgatgttattattcaaaaattttacgcgcaatgacctcgatgctagtactagcgtacttttggggcagtgaaaaaattcatccattttttttcaaaggtaacactcatggtttttcctgaagaatataactaattaatagcgtggaggctaaattgaatgaaatttttttgtcctgaaattaatctttacaaatttcacacgccattgtctcgatgttaatactagcaaaagtttgtaccaaagaaagaaattcatatgttttttccaaaggttaatacttatgggtattttaagaaggctaactcacaaatttacagtgtcgaggctaaatttcatgaaatattttgccctaatgtaaataatcaacacattttaacgcggcattcctaatgctaatacaatgtaattttgggccgcaagaaaaattaatacattttttgaaaggttaatactcacaaattttgtgataagcatatatactcacaaatttacagcgtggttgctaaattttatgaaatttttcattatgatgtgttaataatcataaatttcacacccagtgaccctgatgcagcgtggttgctaaattttatgaaatttttcattatgatgtgttaataatcacaaatttcacatccagtgaccctgatgctagtactagtgaaaattattgaaaaagaatttatatgttttttttccaaaagttaatacgggttttgctggaagtctctaactcacgaacttgtagtgtggaggcccaatttcatgaaaattttctcccaaggttatggtacggtataggtgctactattaacaaaaatttgggttgaaggaaaaaatagtgcattttttcaaaggttaatactcatgggttttgacccaagtctacatctcataaatttatagcctcaaggcaaagtttaatgaaaattttatcctaattatagtattaaaaaatttcacacacaacggtcccaatgctaatactagcaaaaatttgagccgatgaaaaatttcttgcattttttttgcaaagattaatactcacacgttttgcccaagggctaatttgtgcttatttgaacgtttgttccaaatttcacacaattatcttaatgccaatactagtgaaatttcgagccggcaaaaaagttcaacagtttgttttccaaaggtacacaaataactcgctgccactaataatttgctaatgtcacccatgttaagattttaaatcccaatgaagagcggcgtatcaacagtaaagctgaacaacaaatagcccaataagacgtactaggctgtaaaaaaaaaaagacaaacccagacacacatatacaagttcgtagctaagattggttttttttttttgtaacggaggggtagtattgtaaaagactaggtccatctaatcctaacggcataactagcgcactcgagccccatactcccatggtctcgccataaggccagcaacaaaatacagccagtttattcttagtcgtcattgcatgaacaatccctcatgtttagtaaggtacaaacgggtaccatcgacgaagcacctgcaagcatatccggtaaagaaaacgggatatcatgagaatgagcagactccagacataattagcttatcgatcgcagattcaggcaacactaattcagagtgagcctcaaagtccaaaaagagaacgatgtttcatgcaagtcacgacggcaatatattgaatgaataggagggtctcaggcactctactgcacatgtacgataaagacaagctccatttatggacgatatattcaaacataaagatacatcaagagaaaagtggtcaaaatgacacattcactaatcaaatcatataaatacacactgagcttaaaaggaacaacatataaatacaaactgagcttaaaaggaacagcaagttctgaacgctcaatactaagaatacacagcatacacttgtatagatggaatcatataagagctagcataactgcaaattccgttctgatgaaggtgaatgatacctaggatcatccatgaaagcaataaaatgacatttaaacaagaaggcacggttcaaatccctactacaaacacacagagcaacttctggtcatataccagacatcacacctgcacaactaacgtaaccagtcgtaagtgcgaaagaacaaagcagatttgttgtgggttgggctaagtgatggtcagtggttcaggagagaagatcatcgctcgagaatcagggggcgagctctacataaagataaataatacagttggaggagtggaaatttatcttgcttgcaataaataatacagttggaagagtggaaatttatcttgcttgctgaaacaagacaatcaattccactacatgcgactaaaaactaacttaatccccaaaagctacagcagaataagactctggattaagctagccaataaatagcaaaagaaaagatggggaaggcatcatcagtcataaagaaagcacctgaatactcaccaagacatgcaaattggcaaattagtaaaataaatacaacaccatgcagcttttgaaggctcctaacagcaatcaacacagtcccaaaacatgaaagcatgagggcacatgactacaaattggtaaccagaccgataaaaagtactatcacacgagctatatttgctttttaaaacaaaaaaaatgttcttccagctaatgacgaaggatatagttgccattaatattattgtcacactcacatactaatacaaacagacaggtgattcagtattgctctcataatcatccttttcagtcattgcctcacaatcaacatacattgcagcattgctttaatcaaatagaacttctgtcttgcaaaggagacaatgagacacaaggatctaaactaaaccagttaggtgtcattgacataacttgcatgtatgaataacataaactccacctgtccaccaaacatgtgaaaagagcgttattctaatacaccaaataggaacaagataactcagcttcatagaactaaaaacaaaaagtcagcaccacgggaaaacaaacaaaaaagacgtctggatgtaaagggttacattggttcacaacaaccaattttcatatgaagggaggcaaacaaaaccaactacaagagcaaacaacgtagggcattccctggagataattctatgataagggcactgagaagttaattatggaggataacaaatatcaacagaaaaatcttctttttcggggcagactatatgcagtacagataagcaagatagaacatccaagaaactcttacaaacatacgaggcaaagtaggtatgcaagtagactgacccacctaccgcactttctgcacatggacctataaccagtgacaaggttccacccagcatactagggcaatggtaggcgctaggcggcatcctcccgcctgctgcacaagtattaacaggtaacctagctcctaggcagaaacccagctcacacagcgcctttctgaacaatactcaatattagtggtaaagcaagcaaaggattggtatctgggttggtagaccaagcccggttgcatcccaacaaaaatcccaccaattaacaaaattccaaacaaactgtaaaatcttaacaaaacagtgagtaaaacatcagccatgtaccaacaaatttatgcaaggcaacagggtgcaaaagaaaaggtcagtgcaagtacaacccaatttacatatatgaaaccagtgttgttaaggcagtttaacgcgacccaccactgccttagcgccatagcgctgaggcataaggcgttgctttgccatatgagatggttgaggcgtgattagtggagaacatggtagagaaattaggaagaagaaagggggtatttggtaaaaggcccactaagccaggcagccagcccaccaaagcccaacataggtcttcatacccacgtgttctatacttctgtgccctaagaggcatcgtactccaccaggcaccagcctccatgacgagcagataaggcaccagccattgcggtgaggaagaaggtgactgcaagccaactagggttctaggatgagcttacccctatcttcttttcctttttctactgtttttttctctaaggccttcttctttcccttacatatatgaaaagtcaaataaaaagacaagacaactgggagaaaacaatactgtgtaaagggacgctacattgattcacaagaaccaatttcatttggaaggaaggaaaacagaaccaacttaaagaaacatagcaagataggacattcccttttctttctctctctctcttttttttttttggggggggggggcagaaagaagtagagaaaggattacagcacttgttcagctgctaaaacacaacctagaggtaaaagaagatagctatgctccgattgcacaaaactttgaagggaccaccaccacagacaatacagctctagagataggccagagatatttctggtaaggacactgaaaaattaaatatggacaaaaaaaagtacattttcagagccatctattagtaacatcatacaagaaactcttacacatattagtagtacgtatgcaagtgggatggatgacccacctactcaatctctgcacatggcctatagctatcgtacggcatctttatgaacaaagccagatattagggtaaagcaactgaatgatcagtgtgtgggttggctgaccaagcccagttacatacttgcatcctaacagaaaccccattaatcttatccaataaattccaaacaaaccggatgatgccgacaatactgagtagcaaataaaaggccaaagggcagatgctaccaattgtacaaatacagcccaatttacttatctaaagtatgtttaatcccacaaggaacaaaacaatgaaacccatatccctcacaaacaacacagtcaacagacaacattgttgataagaaacccaacgaatctaagagaatacaaggaaacccaacctaaaccaaatagaaaacaatccatctctaaaacatccagattggaaaaaagaaaaaaaaagaaatacatcactactgctttactttaagcattttctaatttttatcacctaacctaaacaagcaagccctacaatcaacggcatgaatgggaaacaacaggtccggttagatttcatgggaacatacatttataaggcctttactttaccctaatccctaaaatcagtgcaaggcaacgatatctgatgtaaattaggttccgagatcaacttggtctgggcgtttgtgcaaggggaccatgcaactgacgggagatatcgccgtcatcgccatggatgcgggagccagtggtcgggtcgtgccgtgcaacggacgccccccgttcaccgaacaaacgctaaccctaggtaccccaaccccgtggattacctgctcgaggcgtcgccgcggagggggagacgaacgaaccgcacgacatgacggtaatcgcaggttgtaatcgtcgatgccgccatcggcggcgggtggtgggaagggggacggtcatggcggctcgtggtcgtctagggttttcgatggcgaggcggatctagaagggagggggcgatgccgtctgtgcgagaggaggccggaggggaggaggaagaccaaaccctaggaaggaaatcgccgccgaatccgcctcgccgcgccgcgccggccgccggcgagaaggggggagagagagagaggcggatcgatttggggattttttccgagagggatgattcgggaaaggattaatgggcttcgttgtgggtgggttagccttgtagcctcggcctgttgggcctcgaaatgctaggttaccccatctgggccgtcgatgttagatcggacggtcgtcgagtcggatacccaccactatcccagcacgcggcctgggagccgcacggccgcaacccaccaccactcccgaagcttctctcatggcggccatggccgcggcggcgaagctcacggcggccgcctcctctctcctcctccggtgagctctcactctctctcttccttcgagtccggtctactgcagcagtgttagtcaagcagatattacttctaaatatctaatccaatctttttcttacatgtctcttgtgcacaggcgctcacccttgctgcggcctcacggtctccgactctcccgccgcttcgctccccaaaggtgtggccgctttcatcagagatctgacttatgcccatgtttcttttgcgaatcatttttggaaatttggaccaaggttgggtgttactactggcattcaacttttgggcaactttggagcagttttctcttgtacttatggatgcttaggagacttcattctatctttagagcaatcaattaccagatgattattaacagaatcaatagactctctacatgcccattggcctgttatatgtgcatgattctagatttagttagccatgaagggtcaatcaacggagtgtagtgtgctctattgtttccaacggttggtactaaaaaaagtataagcaatgaacaaagggttgatcaccaaatagcaattaccgaatcccaattagttatattgctatttgatataaactcaagtctgtaaaacaattaaatccaaaattaaacaagtgcctaaacaatatggtggcatttagatgtgtggtgggtttacggtaatgctatgaaatcatagttctctcccatcgtctacaattgatggttcttgtctaatattgagtccgggtgcttttcccttttcctccagatttgtgcgccacattgcttcatcgacaaatgaagaagctgctgctaaagcagcagcagcaacagctgatactggaggaccgaccatgtaagctttctcattttactatttcataatcccttctgtggcagtggcactgagtattcctctttgtttattttatggaagttttgacaagatcattgcaaaggaaattccttctaatgttgtctatgaggatgagaaagtgctggcatttagagatattaatccacaagcccctgtgcatgttctagtcatcccaaagataagagatgggttgactggactagacaaggtatggaatgttgttcactagtgtttgcgagaggaattctcaatctctaaaactgtgtagcatggcagtatccatgtacttcgttatgtgcttatcttagtacaagccgatgccctttttaactgcctatggaagcaaaattgttggtcatgtactcatgtcttctttgagcaagccttccatcagacattatcacctcatgttggaagaacatatttttaggctgaaccaaggcatgtcgaaattctgggctatcttctatacgccgcgaaaatagtggctgagaaggaaggtatagctgaagggtaccgtgtcgtcataaacaatggacctaaaggatgtaagcactcccatgccacatctcttttctacttactggggtttgcacatgttttcacttttcagtatacatgctacacatcatccttcaacgtattttcggtgttgatacccatgctcatgcatgagctcttttccaccgccatatttttcagtatttatgctaatactgtatcatcgctctgtccacaggtcaatcagtctatcacctgcacttgcatgtactaggtggaaggcagatgaaatggcctgctggctaattaaccaagtgggatgctttctgtactattgcctaagttctcttgtagtaagacaatatgatcggttgaagtaatacccgcattggtgaatggtgttttctatccatctgtaacgtctttgttgtcaatgataccttcacaacagagcccgtgagaatgctcaaagaatctgttagtgagattgtctggtcgttctgtaattacttgattcgagcctctaaagtttacataatcgttcggccacaatatttatttgcaatacggatcgagggtaataagctagattcttcgtgctgtaatgtagttttgactttctcaaggcaaaacgatcgattgaattgaaagaacagagttatcgacttgtctaatgatgcttgttttaatgttttataaatctgattttgttattcaaactggaataatatagctggaaaacgggtggatcacgtttcatgcagctatctccagaattgaattcagaagataaacaaacccacaatccctgagctgcaatctcaatacaatcaagtcactgtcacttaatcaaagtttaaacaaacccaatcctccacctgtattcagatgataagcaaatcaagagctgaatttcaaatggagcacaaacggaatgatcaggacactacaaaattttcatgtctgatttgcaagaaaaatgtttcagcttattacattccttgggactcctctatccagaataatataatgtggtaggagaggcgagatggctcattgtcatgatggtgagttgctgcatagtttcttgaaatccagcagttaggggattgatcagtgtttgccatcttcttcctcacaaaacttcttgtacttctcatcatccatcagcgagtttaactcacttggatcacttatcttaaccttgatgatccatcccttctcatatggacttccatttatctgtgtaaaattgcagaagcaaattgtcaactgaacatagcagtgattactcaaaaattagtctagcaagggtagcaattgcgactcacaaatcctggtttttcacttagttcatcatttacttgaataatctctccagatactggtgcattgatatcactggttgctttcacactttcaaccgcaccaaagttcgttccttgtgatactgtggaaccaacttctggaagctcaacatacacaacatcacccaaatggtcctggaattgaaacaggacatattaagccatcacactatcacagaaaattctattttgaggaaaaatgctgtaatgcatgtcaataacacgttgaagttatcaactcagcaagagacccagtaatatagcatattgaaggctgataaaatgctggtgcagcttgcaaatgtatcaaactgattacctgagcatggtctgtgacccctatggttgctgaatcaccctcaaccttcacccactcatgagtatcagcatattttagatctttaaggactgccaagcaggaaaacaaatatgcattacttattagagtgataggctgacagcgaagcaatggatattgtattcatttgaaaagtttcagtaaatgctccaatcagttagatacgctagagggatgcagtagcagtacactggaaaaatctaaaaagatgttttgaagaaacataaaaccaagttgagaaaacaaatatggcacaaggtgcatgaccaccttctcttgggatcacctatttttatttctgaaatagaaacaactataaccactacatatggaatagaaatgtaatccgcatatatgttgtgttgcctgtgtaatctagcaagatgtaatttgcagtctagtaccaatttttggaagccctacactgtaattccataaatcatctgcacatttcatcatctcaaattctcaataaccaaaagggtaattcacatttcagtcatccaatcggtgcagagtcttgcctatgaactaatgaacaccccaagaaggaactagcaactagaaagtctagaatggtgcatcaagccatcaaaaacaaataaccctaacattagacctaatcctcctccctgatataaacgatcgacatgcctcacaatgaactatcgggtcaccgctatactttacatacgaaagtctcctgcaaacgaactgcgcaaatctgtgacgcgcgcacacaagcagtgaagcaaaaacatcacaaaatttcagatttaacagcatacttcctcccgaaacccgataattagggtagaaacagccgagtcaccccgtcccaacgcgcagagcctttgatccccaattccccataccacaaacagtacacaactacacatataatacaggcaaaatactaagcaggagggaggacaaaatggcaaagcaggagagggggcagatgccataccggtggagaaagccctggggaaggaggagatccgaaggtaggaggcggtgcggcaagcccagagcgcccttgaggcggcggcggcggcggccatgatcgagcgagctgttccaccgccgagctcttcgagtggaccaaccccgccgccaccttggagagagaaagagaaaataatgggctttctcttaatgggcttttgttagtgggctgtagtttaggcccatgttgaattgggctaaactgggttggttaccagtttgcctctgacagcttgaagagatattggaaaaagtacaccgaaggtccctcaacttgtcatcgagatacaaaatcgtcccccaaccacaaaaccaaatatgtgacatccctcaacttacaaaaccgtgggactacctatacatttgttgacaagtttttctccaaaaatttgacagatgtaattatagtacaatcgtagtgtaattacactgtaacttatatgtaattacactgtaacttacatgtaattacagtgtaacttatatgtaagtttcacataattttgaatcgttagatctattacaagatttgttttggtgaggaagaaaacaaatcatagcacacatatgtgaaaaaaaattgttcccacgacctccattttaccgaaataacatgttacagacagatttttgaaagttagatataagttacaccatagttacagtgtaattacatgcaagttacagtataattacactacgattgtactgtaattacatctgtcaaatttttggggaaaaatttatcgacaaatatatagcaaaatcagaaaccgtttactctaggtccttcggtggttttgaccctggttttatccgacatggcggctgagtcagcgtgggacccgtgtgagcccccacatgtcatactgtccacgtcagctttctctttccctcttctctcccttcctcctcctcctcctcctctctctctcttctctcttggcatggcgtgcatcgggtggggaggagaccgcgccgctcgcccacgccgcccgcgccgctcgcactcgccggccgagtcccggccgtgccgctcgccctcgccagcgccatgtcaactttcagctgtcggcgagtctgccgagatgagcggcggctggccctctgcagcacggggccatctctctaccgccggatgcactcaaggacaacgcccccgctgcccctaccgtcgacaagctcggccgcgcgcccgtcggcggccggcgcggttgggctccatgccacgggaagctcgaccaccaccatggccccggcacatcgccacacggcttgctgcgctctgcggtcgacaccggccgccatgttatggggcatctcgtacgtcttggtgaagcagttgcccggcggtgaggacaagtctccatctagcaccacggtgattccattaatgctcattcgcacacgttgcatccccagctccatcccctgcagtctctgcatggcctatgacaaggcagcaaggctgttgccgacaagctcctttgccgctgaagaaacccaccacaaccgtgatgccgctcccgcagctcgacggccacgacctcgcgccgacgtcgtggtcggaggtcagcaaggccctggaggtcatcaagcctacgctcaactccaacacgacggagaacgccaagagcccgcatggcaggcggtggagacgtggcgccgaggtcgtgtcggcggcaggaggatcccccgtcgtcgtggacggcggagaggaggccgacgcgatggcggtgggagcacgcggataggaggccggcgcaacgggcagcctttggcggccggctgctggtaggggggagcacagtggagaggaggccggtgcgacgggcggcgggcggtggccggcgagggaggagcgcggctgagaggagggctggcgcaacgggcggcagtcggcgacacggagcacgacgacgactcggggtccctcccgtcgtccctatcccagccgccgcttgccctgctgccgctcggactgcccccgtacttagccgctcgccctgccgccggagttgggctgagacggggcgccagcagcagtcgtcaccgcactcgcctgcagccaccgcgctcgcctgccaccgccactgccaccatgaattggctcaagctcggttgaccgccggccgcccgtcggggcgcagtcctcctcctatcccggttggcctcgttgacgccggcgccttccggccacccgggaggcccgcgcctcccagtggacgcccgcgcacggccgcggcacgcccacgccgtggagctgcgctgggctgcagttgtccccaccgcggacatcagtcggggcgcggtcctcctctcccgcctcgccccgcccagcggccgccctgcatagagagagagagagagagaggaggaaccgaggaagaccgaccggcctgcacagaagagaagagagggagagatatgccctcatcgtttggcttttcttttaataagccaaaacggcttattagagaataaaaataaatttgtaggtaaaacttttatatatgtgttctcggtgacttaaaagccaatgctgaaaaagaaactacgttgaaaatatctcaaaatcaatgtcaaaattaagtttgaaaattcaaaatttggctttttctttggctgaataggccatccgatgggagccatagatgactcagcctaacatgtagggtccacatgggtccatgctgactcagccgccacgtaggataaaaccggggtcaaaaccaccgaagaatctactgtgaccagttttaattagttgagggatgttcggtatctagttttaccggtatctggttttgcggttgagggacgattttgtaactcgatgacaagttgagggaccttcggtgtactttttccaagagatattctccaatagaatattcttctcctctgatcccacgaggaacgttctctagattgcttaaaaaccatccaaactgttatgaaaaattctaaagaaatttgaaaacgcttatacaatatatttatacaactccacaaaatcctaggtctaaactcaactcgcacgtcaagataaaaaaaagataaaaaagacaaatttaacgtatgaatagcaatgtactattcacatctaaatttatctttttttctcaacgtgtaggttgaatttggacatgatttttggtaaagcgatagatattattataccctatattgctaaaaaaatcataattgtttactactatttgtataaaatttaaaagaaaaggtacacgagaggatataatcccgaaggattagaatccactcccctctcattttcgctttttttttagaattggtccagaaattaagggtcatttctgtacgaaaacgtaaaaataacttaaagttacattaagtggttaggtcgtcattatcgtcctaatgaaattattgcgtactccctccgtcaaaaaaaaaacaaactctggtttccgtgtccaacgtttgaccgttcgtcttatttgaaaaaaatataaaaaaaattaagaagataagtcacgcataaaatattaatcatgttttatcatctaacaaatatgaaaatactaattataaaaaaaattcatataagacgaatagtcaaacgtcagtacggaaactcagggtttgcctttttttaggacggagggagtactggttaggtcatcataacagctcattcccactatatatatgtagtacatttttcgatctattccgggtacacgatcaacagttcgcaccttgattgacgctaattttagcccaaaatactcccaacaagaaaacaaaaagaaaaaatgaaattactacagcaatcagcctcgggaagcagcaaatttctcataggaatttcactgtaaacaacacgttgaaaccaacggcgccgaatgtgcaaaattatcagcagctggagatcgatcgatcgaactcatcgaagacgctgtgcaagcaaggacagtccacagagccggatacgagtgcgtacatcacactgcagctaagctgagtagggcatcgagcacgcgctgaacggcagcatcacgaggggcgggtgggcgcgagcgcgagagaccatacctagctgcaagccttgacgagtagtatcggagttggggacgacgaaccataacagtagggatgaagagggtcccagacgaaagcctagcccagtgttcactagaccagcaatgggcacggtcatactttcgagcgtggtaacctttctggcgacgctgtcgaggtgcccctttgcccttaggcaaggatctctataggaaaactttgtccagttttttagacaggcagcaatgttatgctatcacgtcgcaccttaatgaagacgttgtttttagagtttccgtcctatggtgttgttgtaagtctagcagtgtccggtctcaaatagcattagtcgtttcgatgcttgggtccctttttttgtagcttgtgttcgtgtggttgagatgtagtgtggtttcagggcgtgcgtttttagtgcacgtcctttctcgacaaccagctgtcaattcaaactcttttgatcatccctaccaaaataagattcttcgtccgcttttggccattggcatcaggtgccgcgtcctttatgcaccggaagatagcttaatcattctttaggccccttcaaagaaaatttataggaattttagaggatttcatttctatagaaatgtttcctacaaagtcctttgaatcaaaggaatgaaccctatggaatcctatgaaattcctatggaatgcctcttcccgtacaagttttggaggaattttaataagatgtagaacctcatagaagaaatcctttgagtttttatctctccttaaattcctgtgtttttcctgtggtccaatcaaatggtcattcctatatttttcctgtgttttgcaatcctctgtttcacacttacattcctgtcagaatcctatgtttttcctattcctccgttttcttcattcctgtgattcaaaggggcccttaagcaccaataatactacttcagaataacaatcagtagtgtactggtgtgtttgttttgttgctccctttcttcaaagattacgacagattaccagtattatattgcgaagaaagaggaaatgccttcatttagtggaatcaagatcaaaccggacccaattaattaattaattactccctccattacagaatataaaaattttaaagttggacacagttattaagaaaatagttagaagtgaatgatgtagggttgtgatcggataagtagtggagataggtgagaaaaatgaatgacggagggttgtaattagttagaagaaaatattggtagagaagttatattttagaataaattctaagagataaaatttgttatattttggaacggagggagtaaatcggactaataaaactacaaaatgtaacaaacacactacctcacctaaagctaaccaccgcaaactgaactagcaagctggaagaactctgcaaaatttgctacctatcgacctcgtcacctccgctgtttgtttgcagtcattcgcagcggcagcgatggatgttgcggccgccgcgggcgtcgttggtgggttcttgcaggtcgtcttcgacaagtactacggctccaagctcgagcagtgggctgctcgctcgggcctgcacggcgacttcctcagcctcaagaaccagctccacatggtccgtgccatgctcgaggcaggcggcggcggcaacgccccccacaacgactccctgcgcagcctcatcgtggagctcaaatccgctgcctacgccgccgacaacgtgctcgacgagatggagtactaccgcctcaaggagctcgtcgaggacaccagtggccgcgacggcggcgcaccgtcgtcgtcggctcgccaggtggtcggccgcatactggtgcctgcgcctctcctgtccaatccattcaagcgagccaggacgggcgccgacgaagccttgcaagggcagggcgctgacacggacacccccaacttcgatcaggatgcaatgtcctccaagatcaaatcgatatcctgctgcctcgagcagattgctggcatggtgcggaggatcatcgagctcgacaagttggtgtcgatggcgagcttagggcatgtacaaccagaggtggtggtaagtctgcggcagacaagctcctttcccactgaaactaagttgtttgggagagatgagtctaccaacaacatcataaaccttatgcttagaacagatatggagtctaggtacaataacttcaatgttcttcccattgttggcattggtggagttggtaagactgctcttgcccagtctgtctacaatcatcaaagagtagttgattcatttcaagtgagagcctgggcatgcgtttctgatactcttgatgtgcgcagagttatagcagatttgatagattcgatcgatggtggccaagaaactcccaagtttcatagagtgcctagtcttgatgcaactcagagaactctactgaggaaaattgaagggaagaggttcttgattgtccttgatgatgtgtgggtcagcagccactgggagaagctttgtggtcccttctccgcggggatgtctggaagcatggttttagttacaacgcgacagagaaaaatcgccaaggccatgggcacatttgacagtttgacactgcacggtttacatgataatgaattttgggctttcttcctacagtgcacaaacatcacagaggaccacagcttggctcgaataggcaggaaaatagctctcaagttgtatggcaaccccttggctgccaagaccatggggagattcctttcggaaaaccacgaggaggagcattggtgcaagtttctgaatagaaacatatgggaactaaaacaagagcctgacgacgttatgccggttttgttgttgagttatcagcatctccctctaagcttgcagcgatgtttcacctattgtgccatatttccaagaggctataagttcactgagcaagagcttatatttgcttggatggcacaaggccttgttccaacacctggagaggatcagacattggaagatgtaggaaaggagtaccttaacgagttactcagttgctcattcttccatataatcgagagtggccactacatgatacctgggttgttacatgatcttgctcaacttgttgcagaaggggaattccaggcaactaatggtaaattccctatctcagttgaggcttgtcacttgtatatctctcattctgatcatgctcgtgatatgggcttatgtcatccactcgattgttctggtattcagatgaaacgccgcatccaaaagaactcatgggctggcttgctgcatctaaaaaatttgcggactataatgttctctgcctcttcatcaatttggtctccaggttctgaggtagtctttgtccagagcaattggcctagtactatcagactgttgtctctgccctgcactttccgaaaagagcaacttgcagcagttagtaacttcatacatttgcgttacctagacctcagatggtcacgccttgaagaattacctgaagccgtatgcaagctttacctactacaagttttgaacataaagcactgtccgtgccttcttcatttacctccaaggatagccaacttattaaactttgagcatctgattgctgatgaaggaaaacatttactcacaggagttccatgtgttggcaatatgacttccttgcttctgttggataagttctgtgttaggaaaaccaggggctttgacattggacaactgaaaaggttgaggaacctaagaggtttgttgaaagttcagaatctcgagaatgttgatggcaatgaagaagcagcaaaggctagattgagtgacaaaaggcacctaactgagctgtggctgtcatggagtgccggttcttgtgtacaagagccttcagaacaataccacgtcctggaaggtcttgcaccacattcaaatgtaagttgtctccatattacaggctataggggcagtactaccccatcatggcttgctagtaatctcagccttagctcactagaatatctttatctagattattgttctgaattggaaattcttcctccactgggactcctccctcaccttaggaagctgcatatagtcaatatgcacgcgctaagaagaattggctctgagttctatagcagtggtcaggtggtggggtttccatgtttggaagggctatttatcaaaacaatgccagaattggaagactggaatgtagatgactccaatgttttccctagcctgaccagtttgactgtagaagattgtcccaagctgagtagaattcctagttttctatggagtagagaaaacaagtgttggttcccaaagcttggtaaaatcaacatcaaatactgtcctgaattggtgctgtcagaagccctccttattccacgcttgccttggctccttgatatagacattcaaatttggggacaaacagtgataaatttgcgtggtggctgtcttgaggtttctgaaatcaatgctaatactagctcaggcccaataaatgctgttctacaattgcattggctaaaacatgtgtctagttttcatatttgggcacaggacagtctttctgtacacccctgcaagcaaaagacagaaccatcagcatgtaattctgaacacatggtaaattctctacaaacatcagcagagaaagttgaagtcacagggtatggtattactgatgaattattgtcagcaattttggagaatgaaatctgtccttcaagtttatctatatcagattgtccacaaataacatctcttgatcttagtcccctaagatcattaaaatctctggtaatacacaattgtgtatcactaagaaaactctttgaccgacaatatttcactgctcttagggatttggaagtgaccaatgcatcaagttttgctgaagcatggagtgaactgttaggatccagatatgcagagtggggtcaagttactacctcactggaatctcttacagttgacagcaccttattcctcaactcccctttgtgtgcagtgctcacttctctgaagaagctaacaattcattcggatttcagggtcacttccctctcaagacaacaggtgcaggcacttctactcttaacctctctgcaagatcttgggtttatacaatgctgcaatctacattctcttcccagtgaactgcacaaaatatacactctcaagcagctcgagattgattcatgcccatgtgttgagtcattgccaaataatgggctgccggaaaagcttgaaaaattgatcatcagaggctgcaacagaagattgtatacaggtgcatcaatgatgggttcaactagcaccaaagtgcacctagtagatagatgatataatagatttaggttcatattagtcggcgaccacgaatataaatagctcgtgcaagtgcacagtaatcaagtagtctacgtagtcgcttttggatgtcaggctatgcaacggtattaatcaaaagatttattcacctatttttatttctgaaaactgttatagatacaaccgtttcgtatggaacaaaaaggcaacccacacagatgttttcatctgacttgataattcctcttaacaatctaattaccatgacatgcatcctccatacattcttagatctcgataccagaatcctccaaataatagctttactttttgttctgatttgcacacaaaagtctcctccaaacgaactgcacaaatcttgacgcgcacacaagcaatgcagcaaactcatcacagaaattcagatttgacagcatgcttccttccgaaacccgatacttagagcagaaacagccgagtcaccccgttccaacgcgcagaacctttgatccccaattccccataggccataccacaactacccaactcggcaactacacgagatacaggaagggataaaatggcgagacgggagagggggcggatgccataccggtggagaaagccctggggaaggaggaaatccgggaggtaggaggcggcgcggcaagcccggcggcggcggccatgatcgagcttcgagctaattccaccgctgagctctgcgaatggaccaaccccgcggctccgagtccttgaagagcgagaaggaataagttcacttgaggtccctttaacttgtcaacgaatccaattttcatccttcaaccagaaaatcaaatacaacgggtccctcaactatcaaaatcagtgcaaagcaaatccctcaacggttttgatggtggttttggctgatgtggcgcctacgcggccggtttgacttagtacttgtcataagtggcggtaatgtggcacgggaagcaaaatataaaaataaaaaataaaaacaaaaatgtggggcccacatatcaatcagataaaaggaaaaaaacagtgggacccaccatcctctctgtacacggacgacgggagaggagcagccgacgcgtccttctctctccctcccggccatccttcctcaccggcgagcgcgcacggagagggaaaaaggcggcggatccgttggtagctgcccgccgttggtgttcggtttggatccatcaataaccagcccgattcctcgcacccacgcaagatccaaaacggaaacttagacggcacgcggatccaaaccgaataccaacggcggaggaagaggcgcgcagtgaaagagagagaccagcggatctaccacgctcgccatgcgagaaaaagacggcgcgcaacggcgaactctgatcaaatcccaatcaatagccggcccgattccttgcacccacgcaagatccaaaatgaaaactcagacggcgcgcggatccaaaccgaacactgttagatttaattgggtaattgatccatttaaatcaaataaattccaaggctcattatgctaggaattatgctaggaattcatgtgtattcattttcttatgggatatcaatgggatgaagagtttatgagaattaatccatttgactagggaattggtaacttatatcaattactcctaattgatggatggttgatggttgtgtagtggaggatggttcatggctagttgatgacaattagttgctctattcctcttcctattccattggtaacctacatcaattactcctcattaatggttggttgatggttgtgtagtggaggatggttgatggctaattgatgagaattaattattccatgactcttacccttcatcttccattccttctataaaatgagaatggatttgatctccctaagaagaagtgagacacactttcatccatttccaaggctgttgctgctacaataatcccatcccgacgagtgtgtgcacacgcgttgggagagtaggcctccgaaaccatgcaaaccatgcactgctacgacgtttgcacggacgggcgggtgatcaggtttttggggagcgcaaggcgcgactactcattgttcgtcaatgtctacttcatcttcaccaacatgtcgaacactggagacaacggcaacactggagacaaggagaaggaggctcccgacaacaccaacggaggcaacactgcctcaaactctagcggaggaccattcttgggtataaccttcttacattatttcaattagaagttttactgttaatgttcatcgcaatgtcaacattgcgttattatgtgattgttgatgcttattctacgttaagcatgctcatgttgattacattcacctctatcactggatcaaatcccattgtaaatatcatgtttaacaccaacggcgggaaacgaccagtggatccgctgccttttcccctctccgtgcgcgcttgccgacgaggaaggatggccgggagggagagagaaggacgcgccggtcgctcctctcccgtcgccgtggatagagaggatggtgggtcccactgttttttccttttgtctgactgacatgtgagccccacattgttgtttttattttttatttttatattttgcttctagtgctacatcaccgtcacgtaggacgaggaccaagtcaaccggccacgtaggcgccacatcagccaaaaccaccatcaaaaccgctgagggacctgctttgcaccggttttgatagttgagggacccgttgtatctggtcttccggttgaaggacgaaaatcggattcgttgacaagttaagggacctcaggtaaacttattccgagagagaaagagggagaataatgggctttctattaatggggttttgttaatgggcagtatttcaggtccatgttgaattgggcttaactgtgtaggttaccagtttgccactgacagcttgaagagatattctcccccccccctctctctctcttttcgaaaatgctaatggcgatcgattgcccctagcgatcaccctcctcctccatgtggttttcttttttggcactgtattacttttctattttagtaaatttatacacctaaactttgtacacctcaagtttacatatctaaagtttatacacctaaagtttagagacccaaagtttataagtcaaaagtttatatatccgactcaaatttgaatttaaattcaaatattttttatatatagtatttctatacatctaaagtttatacatataaagtttatagacccaaagtatataagtcaaaagtttatatacccgattcaaatttaaatttaaattcaaatattttttatatatatagtatttctatacataaatttttctaacttttttttattttttttaaaaaaattatggtgtagtaggaagagaaaaaggggaggagaaaggggggagaggagcgtatagggggatgggggtgatcgccggccattagcaacgcccctctcttttcccttttttttagaattggtcgagaaattaaaggtcatttcggttagaaaacgtaaaatatgttaaagtttcattaagtggttaggtcgtcattatcgtcctaatgaaattattgcgtactggaacccaatgtgattagtcaataacagctcattcccactatctatatatgtagtacatttttcgatctattccaggtacaagatcaacagttcgcaccttgattgacgctaattttagcccaaaatactcccaccaacaaaacaaaaaaaaagaagaagaagaaattactacagcaatcagcctcgagaagcagcaaatttcccataggaatttcactgtaaacatcacgttgaaaccaacggcgccgaatgcgcaaaattatcagcagctggagatcgatcgatcgaactcatctaaggcgctgtgcaagcaaggacagtccacagagacggatacgagagcgtacatcacagtacagctaagctgaatgcatcgagcacgcgctgaacggcagcatcacgaggggtgggtgggcgagaacgcgagggaccatacctagctgcaagtcttgatgagtcgacctccatccatgcatggcgctcgcaagattttgtctcactgccctaccgaaattgccactgatgatatacatatagatggatggattgacacaatgccagaagtatcgtttgagcacgcatttttctttggtcagaagatattagttcttgctggtgtgagaggctgaagctgccagcatgatctggtccatgagttgcactgctgaatatattgaattcagccaggagctgctactgcagttctgatctcgatctgcattcgttgttctgagctatgtatggatttgatcggtttgaaggcatccatgtctttaatttcatcgatcagatcatgttgcagcttcactctctcactaccagcaaaaccatctcatcggggctccagtcttcgatcacaggttcgtaattgtcttaaggtaggttgctgatcgatgttatcttgttttgtcatgcaatttgtttctgatccatcgagctgttgatctgtagttcttttttgactgtgatttctcagcaggtcatcactataagctgacaagctatatgatgcaaccttttcccgaacttctatggactatgaagaaaggaggtcagtgttctttgttcctgtaacgattaaactattagccatatacttctcattttctcttgaacatggttttcttctttgtgtgcacttgatgatttgatacagtacgatatattgctatctaatctcacaactgttgatacattctcagttggaactctgagcaattttgtcccccatttcctcctcggacacatttactacactgctatatatacattttcacaaaaaaacaatgctccagggacattgttagttcatctgaacttgcttctgcagttctacatctgtactgttaagtgtttcaggcaacatcacgacaggagccataaatcctttcagctacatctagggagcgcaactgctgtcctcgacactgtgacaatattctacagagaatgtgattttcagaaaagaaaaaaaaatgcaaagcattggccattggccgcttgaaatggtttttgttttttagagaaagcattggccatatgcatgtgctcctacacgattttagcgactccataatcacaatgtgtgcttctcatgttcatcttccggaaagcatcctctttccccaaaataatagctaataataaaatgactcatatcacattggattaagcattgctatagttcctgtgaattttaattattgagaggacatatcaaatactgtatgacatatgtaagaggtgtcatatctgaagccctgaaacatgtggtgtgagcagctttgaagtgcaatagtacgtaggagtaccacaatttttgttcctttttatcaaccaaaacttaatagcagtagtacagtctaagcatgaagagatgtcggtgaacacatgggcatgtagcctgggggacacgaccataatatcgtcacaggttagcgtaacacatctacatgtgcaaatgtgatccttgcctccgaaaggccatgcagcgtccatgctgcattaactctgacaacatatgataagattcttctatttgtgattaacagcgacacagatcgtgccaggtttcggtccagtatcttgcacattggaaaagcctactgcagaaaactaatggcagaaaaggtcttgagaaacagctagccatcctcacgttccatgacatctaattgcaacgaattcatcatcaagttctattcacaaagttagctttggatgatacatagaatctgaaagcaacataccaacgcccaaaaccaaactggcagcccagaagcttcacctgagaaggcttaaaacagtatgcacagtggcatttgtctccatacacaacatgtacaggtctcattcataacagcaagagcgatattatagcttagtgtaaactgctgcaactagaatatggcaaaatatagtacaccattatagtttgtttgtgccgggcatttctctcatgccgaggacgccaaaagcttattattattcactgtcatctagcaatacctgaagcgaagcctatttcaagttcaaaggtagcagacgactgactttgcattcttacaaacttacaccaaggtccgaacaagaccaccgcaaaaggctagggaaattgcgtcatatgcttgccaccagtcttatgcgtcattaagagcaaggactcctgggagggtcttgccttccaacagttccaagctcgcgccacctcccgttgaaatgtggctcatcttgtccgccaacccggccttctcgacagcagcaacagaatcgccacctccaatgatcgttgtaacacctttggcggtgatatcagccaatttcttggcaattgcctgaattgattaagaacacatttagcttcaaacacaaaaacctgtgctgataaatctgttcaaaaacagtactcacatcagtgccagcagcgaatttctcaaactcgaacactcccataggcccattccagatgacagtcttggtagtatccaaagtttcactgaaagtcttgatggagtctgggccaatatcaaggcccatccaaccatcagggatagcagatgctggaacagtctgcatatggtttcatattgtcagttctacaggataactgcagaattgtagtcgcaagtactctctgatattgtttgtttgctgaatccatttaccaggcaactggccatacagaaggcgaatgctgaatgcagatatttggcatatgacgcagtgaatttaagccatgatttatgaatgactacttcaaaagaacattgccatggcagcaagttcacatttacaatgttgtgctactgaaaaaccattttcatatattcaactatgattgtatgatgcagtgaaatgaaattcttatgcagtgccattcacgaggtaatgaacaaaccttgctctctgcatccgcagcaaacttatcagctactacaatatcagttggaagcaatagggagactccctttgacttggctttttcaataagcgaggtagccaattcgagcttgtcttcctccacaagagattttccaacagcgtatccctgagccttgtaaaatgtatagatcataccaccacccagtatgaggatgtcaacctttgccaaaagactctcaatcaccccaatctttgttgacaccttggatccaccaacaatggcagcaaatggttttttggggttggcaacagctccaacaagatagtcaagttcctagattggtgaggacagttactacaaaattttaaaaggattacatatttcaaaaaatctcaaggaaaaacagcttgaattcattgcggatacaatttaaaagacaatatgcaatttggcaaaaagaatgtagttgatttcaacatgtcttgcaacttgtcactcaagtactgctgcaagccatctgctgcttgcaacttgaaggagtttcattgttctaaatggagtatatcagtaagtaaacaccaaacgaaattatgttcaccaaacagttatgtcaaaacagttcagatggtgaaaatcttgagcaatgcacaaagtaaggaaacttgtgcaataccttctgcatgaggaaaccagcaacagaaggtctcaaatacttcgtaactccctctgttgaagcatgagctctgtgtgctgtgccaaaggcatcatttacataaaggtcagcaacagatgccagcttattggcgaattcagggtcatttttctcttcctccttgtagaaccgaacattttctagaagcagaacaccaccatctggtaaagtggcagccaatttctggacttcctcaccgatgcagtcattggccatcacaacctacgacaaggacatcatcaaaacatggaaatataagatggtctaccagtttgtagtaagcagaattgcagaataataaatatgatttatccttttatagcatacatcaacaccaagaagctcagacaagcgcggaacaagaggcttcaagctgtacttcggggttacaccttttgggcgaccctgaaaagacaaaattgattgcattacaacagaggacaagagaaaacaaaaaggggggcgaaagaacattatcccaagcatagaaacacggttagctgctgcccttttttgaacatacaatttcagtttcatttgccattttaacataacccaattatatggcatggggatttttgaggactactgcactttaaacatgtggctctttctataaccaaaatgttacagaggtggattttgcatttgacttacacaacataggagaaccaaagtttaaagaaaccgtggtgcattacagtgattttgtaaaagggaattgtgcctcttgcaagcaagtgttgggcattgatggaaaccattaataggtatttgtatcaaaattagatatacataataacaacacaattaagtaacaaatgccacattctggtagtaaaatcgcaagataaataaaagatcactcaaaacattactctgtgaaatcatcgctcactgtaatcagtctaaaaatacagtattaaatttatattgacaccttaacctcctatcgtaaccatgaatctgcacatagttaccacttaaaattcactgtgaacctatcaccctttgatgaatcataaaatcgatactgtttatatagcatgtcacatcatccaaaacggaccaccaatctcacatatcacacaacctcatgctcaaacacattatagcaacgtagtaatcctcaccagatggctggccaggatgaccttggcgcccttccccatcaagaacttgatggtgggaaccgacgcgcggatgcgggtgtcgtcggtgatcttctggctgtcatccagcggcacgttcagatcggcgcggaggaacaccttcttccccttcagatccgactccgtcagggtgcccacgctcctcttgctcgccatttctctctcgcgtcactacacgctgcaccaaatccgaccccgaaaatctcaaaaattcgcacgacggccttgcaatccataaatcggagcgatcaggggagatgaggtaagatttacctgccaaaaaaaaggatcgaaatcggtggcaaagttcgtcgccgctcacgagattggggtaaaggagagtttggatacgaggaaggcacgggaaggtgctgggcttttctttatatcgtcgttgcctgcagttgtgccacctgtcaggctccttgatacgtgtgccagtggcatgtggagccagacgaaatgtgggtcccactgcacgtcaaaggttttggacctttcggggtttacgctttcggcgccgtgggttttggatgaaaggatttgttctggtatggacgagtggacgactcagattgtactggagttttgaacaatttttttcattaacaactaatatgagacggtgccatgatttatttacgggatagatctcaatagaaaactgttgaataatggcagcaagtgattgagttaaaaaaaattactagactaacatcatataaaatattaatcagaaaagaaaagaaaaataaccacccgagcagcgtctatacaaaacctagaagaaaactaacacaaaactcatcactagactaacaaagaagctacctataacatactctttttataacaaattatactccttttataacagattgatggctttgggcatgcctttctagtaaccattaaaataaattatccactagagtaagatatagacgtgtttaattcgtagtagcacttcagttaagtaagtttgactaacatatactccattactttaatatttgacttgccaacttaaagtactttgagtaagccacttagccacaatatttagctagaagtctctacttcacttttctgtcaaaaattgctggcatatggttgatttcttaggttcaaaaattgcaaggctagcaccctgtaaaacattaaccaggaaagaaaaaaaccaccaccaccacaccaagcccgatagtgcctatataaaacctaagagaaacctaacaccagaccagttaccgctaaaccaacaaagaagctatcttatatgttgtgaactatatgatcaatggtggattttatacgttgatggacttttcatctatagttgctatgacacaagtggatcccacctttacactcttgagaaattatacattagacatgctctcactacatcaagcatcctagtgattttcatatcctgagaaattatcctacaattgtttgctttgtctgatctattccctatctccctcctttttatatcgtgttttttctaaaagtcaacttcttttagtttgactaaatttatagaaaaaactaatgagacataaatagcagtatgacttaaaaaaagtcaaaatgttttttcaatatgaaacggagtatgcattgcgagtctgcgaccctaataaacaatatgaaagggagtacgcattacgagtctgcgaccctaatcaataacatgaggaaaggtcacatatatagaaatttttcgcataaaatacaccgtttaacggtttgaaaagcgtgccaacggaaaacgagaaaaaaatatgtatctttataaagttagaacgggccaaagtaaaaatgatttgaaatgcgagaaagataaatattttttttaaaaaaagttaaatgctagaacaataaataaattaaaactgatggagtattgtaattgggaaaattcactattttcttcttcaaatctcgagctcgcaatactcaactctatctaggaacgttgttctatcccgtacatgttccggttacagaacagttaatttgtacctcagaaaaacagccactagaaggtcattcagagcagaggggcagctatccatgagaagcttgtaaccctccgttgcagcgactgcgtggaaattctcctgagaagccaagatgaactcgatgcacctagccttgagcttggtacatccatggcgctccgccagagccaacgccatcgcggcggtgtccacgctaatgccagcgtgcaccttctccgcgcagatcagcatcagcctctccacgccgtaccgatccgcggcttcgagaagaccatacgccattgtttcagcctcgacgtcgtcgtcatcttgctccggcaaagtgtcggtgtagatgaagtggagcagggtcctgaagacctctgcctccatgtccttgatctcgatgctctgcgagtctttctccttcatgtcgccgaacagctcggccatgaacaccggcgacctcgcggcgagcacgcacctgtgcgccgcgacaggctcgccggagacgaggaacgtgatgtcggcgccattcttgctcgtcagcatctcgccgaggtgcttctgcaggtcggagagaggcgccggaacgcttgccgccgcgttcactggtgcttcgagcagaacggtgatcgcgcactcgatcagcaaggagtcgtctggttggacgtatctgtattcagacgcatagctcctcgacaccaagaacatgtcctttggttggccattggagaagatggatgtcactatcacctccttgaaagagctggatgcggacgcggcggtttgattgatctgatgatcatcgacaaggcggcatctgaacgtcgccgacacggtgcgctcgccgtcgctcgacaaggtgaagcgcagctttatgtaggggccggagttgcgggagctggtgccgtggtagtaagcggccgggaagacctcgatcagccagtcgtatccgcccacggcgatcgtacacgacgtgaccaaattttgcctgttcgcggtcgccgagtacccgttgatcctgagcagctacacgcgccgcgccgcctgcgtgaggttgatggcggcgttctccatgtctctgggctcaggcgtcgatcgagcgttaactaccggctatatatatatcccttcgtggatttcaaatcgaaacgttttatcactagatttacaaagagacataacttgttacaggagtctgttttagtacccaccatctacaattaataacaggtatagttcgcaaaagcaaaccagaaatatacaaatgtttcggaaacaaggtaaacaacaagggctaaaccatcaatccctaaaaatttcaatgaacatccaactaatttttcgttttttctccttttaatttgtccccttgatgaactgaacttttagacgagccggagatttgcaatgatattgcaccgccgcagtgtcgacgaattcttatgggattctacaaacggacaggtatctgtggaggttctgagcccaaaaaaggagagggctgctacgggatcccgttgcaacaggatagacatattaattattctcttgcacgagtatcataggtatcagatcctaggtattacaggtgttgggtaacaggtatcacagttatcgggtactatgtagctggtaccacaacaggtatgtcttatagaagagtatcccgttccaacaggataccgttgtctaggttttctgaaaaaagaaaaaaaaacctccattgaacattgaaaaataaaatttgagcttgtccaatccatactgtcgtggcagccagcgatgacgtggacatcgcgtcggccgaatccttgatgtgggccgcgtgatcctcggttgggccggggatgtttcgttcatcaagagttcaagacctgctgtgtccaatctgctgtcattaacacgtaccggtatattattatgcaggttcaaaggaaaataaactccatcgtacattgaagagcaaatttctttatgagaaatgagaaatggaataaatttgatcctgagtcagcagttcaactgtgcaaaatcaggttttgcaacaaaacaagttttagcacaaaattttcagaaccaaggtttatcattgtttcagatctccctgccaaaactgaccggcaatgagcctgaaaactgatcactgcattgtgcctctccattcctaaatgtcaatctattttccccagagggatttgattctttgaaggcgagaactactccaatatgtttttctgaaccgggatatacccgtttcaattacagattaaactgaaatgaaaggccctacacagacagagtagcagagggattagacagggttgcgtctaattactacgaattgcccactgcagaagagaaccgtatgatcatgggcatcacacaacagatccaatggcaaaatcacaaaagaaaaggatagagcaaacatataagcaaattgaagatttgtttgctctcagcaagtccgcagcagctcatcgccagcatccaggagcaacttgaaatcttctctgcttattacctgcacaataggaaaatttttgctcagatgccaaatggcccataaataaatattaagaacagagcgaagctagtgatgattctgaaaaaaaaaaaacaggttctcctgcttaaagaaatgtttctgaaaaataaacgtactgattactagtggcaacaggcatgttctcatagcctgaaaggcttgaaacgcagaagcatatttctgcagtgcagtagtagtattgtactaacacgtgagaaaaatacaagaatgaccaaggtaatactagctagtactagtgagtagtgacaaataatgggcttgtacaaagtatgcactactccatgactgggaagaatcaatcaaaacttctagcacaaacagagatgatgcattgccaaatcctagagaaaatttcacaatagaacagttcagctatgacatctctgatacgcacgtacctgcattttaattctttcttccacgggcaaccttgacaaggtcagtcaacaccgagggacagctcgcctccagatgtttgaacccatcagtggccaacacagcatcaaggttttcagccgtgccggcagcaatgaactcgacgcacttggccttcagatgcgagcagtcgtgctgctccgccaacgccaacgtggtcgacaccgtgtcgacgtcgatgcgctcggcgagcttgctctcgcagatgagcttgagcctctccagcccgtacctgtcggcgccggcgagcagatgctgcgccatcgccgtcgccgtcgacgctgcctccgtctcctcgccatcacggtggtcgagctctggaacggtgtcagtgtagacgaagtgaagaatggctttgaagaccggcgcctccatgtccttgacctcgacgcgctccgaggccttcaccttcatcgccccgaacagctcggccatgaaaaccggcgacctcgaggccagtatagccttgtgcgcggcgaacgactcgccggacacgacgaacgtgacgtcggcgccggtcttgctctccaggagggcgccaaggtacgcgtgcaactcggacgacggcgccacggctgcattcgcgctgtcgcccgccgctgccgccgccgcggctatctccggctgttctcggagcacggtgatggcgcactgaacgacgtaggaatcgtctgtgagatagcccgacgcctccagctcgtcccttgccatgaacacggcacggggcgagtagtcaccgggcttgtggaacttatgcgacacggtcttcatctccgacggcctcagcttctgcgtcggatctaccaagcagcagcttagctgggccttcacactgccgctgcctgtgcggggcgcgccgcgcaggacgagcttgagcgtgagcggccggtcgcgcctgccaacccagggatccttcggccgcaggcggatctcccagtcgtgtccgccgacgcaataccgcctggaactgaagaactcgccgtcgtccatggccattgtcaaggagtggcccacgatcttgagctggatgtcgttggagcgtgtcacgtcggtgagctttcccatggcgatcgatcgaatcgtatggctggactggacgtatcgtggagagagggctaggtgaggaagcgagtggaattgtttttcttcagtagctgagtgcttttgtattagagcaagtttaatagcatagtcctccaattcatctatagccaatttaagagcttattcatacaatatttacatactacactattaatatctagtcctacctgtcatacacacactgcatcttggagtccgtgctatagctggctataaatttatagctcactgcttttctttctatttatttatctctttaaaatatatttgcagctgacttatagtctgctattgtatctactcttatactatatcggtgtcgttcattaaagtgagctagtcgatcgttcgatggctcctcgggtagcgcttccggaaatgaacaggcgaattcatcagaccgagttccctctttaattaatttggataatttgaccgatggcttcagtgcaggatagaaattgattccccacttgtggcatgatcgaccaatgcagcgtttacactctaaacccctcccctcgtttttcacgtgtatgtttttcaaactgctaagcagtgcttttttttaaaaaaagtttttatataaaagttgcttaaaaaatcaaattaatacttaattaatcacgtgtgcggtccattttccatgtacactgtttgggtcgggaaaaagagtgtcgaacacagctatgtatgtatggattgagatgtacaacagcactggcaagaagtcaagaacaacccacgacttttcgaacacacgagcgaattattcgccgttgctctagtaatctaatactccatattaatatccctccacaccgtaacgacaaaaatatttttgtaattagcttagaggggtttctaggtccatcaaaaagatgattataattagagctagtgttgtatgttggtcaatttaacattgttgtaatgataaagttttaatggtaaataactatctaaccctatacagcttatcttcatgtcttcctactggctccacttttgatttacgatgttaccacagaaagagcatgatactatgcacaatggtgcttgtcagggttacgggtcaggcatatcccctacccttcgatatacgatacgtatcgacatggcatacccacgcgcatgcggatatttcctttatgatctaaggaaacctttcacgaaatcaatatacgggaaaaagtccttttcggacaagaactgggttacctacgtatcgtgctaggtctgatatgttcgagtcctactcggagagtaccagacttgcgatataaaagggaccccccggggagggcatagatcatcgaatctcagaatccacacagcctacgaagccggagcctatgaggagccaagtcgtcgagagctagtcgaatcgactcgactacaatctcgccggatctgacaagttccatcttttcctttgtaacctgtgttttccaccatataatcccacatcaactggattagggctattacctgtcaaggggcctgaaccagtataattcttgtcttttgattgctcgatgtcgtactacgtagatccttgtaccagcgtaccccaataccctctatatctggtctacgggtatcacccgtcgacagtggcgcgccaggtagggggacttggtactcaaggttctactactatgccatcaagcttcgtcgataacaatgtcaacaccagctccagccaagcattctcaacttcaacaatgttggtatggactcaagtcggtgaaatcgtcttcccggtttacaccacgatgccaatctcaaccggtcctccaatgactgaaaacgagaacgcagtggccacaaaccaagacggctccatgtcgaaaaatccacccgttgaaacggagaacggattaccgactacatccaaactcgggaaggattctgatgcggccaagtcttgtcccaccgacataaatcacgggccgacaaagatgacttccgaagctatcaggtcttggtgtcctatccacaaaaccaagaaacatacccttcaagattgctgggtattcatcaacgtccgtgctgaaattcgcgcctgcaaagaacgtggaattcaatgtatttctccgactcgggatgtctattgtcctatccacaagacaaagaatcacgatctctcgagctgcaaagttctcctcggcgccatgaaaaccccgtctcctaagtcatacgtccccgctagggataacggcaaggaacagggagcgactccagcctcagatcgattcgttggggtaatcgatctcgatcctcacgaaccatcggtcttacatcccctcgaagactacgggtcatcgacaacaagtgcgccgcgggaggtattagttatcgatgacgttggcacgtcagcgcaagccaacgcagaagcggcgaatcaatcgactactctagtccagcacatcagggctattcaagctatactgagggaaactccttacgatcccgttctgaacgacgacctcgagcgttggacagaatgattacgggagtcggtgactaacctcagcaatgcgttcaaagaggctgctaccgcagcacaccaagatcagccaccaatcggcgacgccaatggtgaagatccggagcggagggaattgcctcgacaggctacccctccacctcgtggcactggcgatcttcgagatcaaattaacaatcgccgagaagcacggcgcacacgggacgacgcaaatcgctctcggcgtcatgtttcttcatggcgccatgatcgaggaaaccgcccaaacgaggaccgagaatgcaacgatcgcgaacggcgggggccagacaatactagtcatggccgtcgccgcaacgacgacgacgaaggagatcggcgccgagataacaacgagagacaacaacaagattctcgggatccaggtcatcatcctcgtaatcgtacgccggagccaagcgacccatcgtcatcgtcatcatccgcgtcctcttcatcgtcagacagacatccacgaaggtcacgcgaccgccgacaacccaccgccccagcgctgggtgtagggctttcggtcgttccctacgtgatgtccgatggcctgagagattccgacccggggccattgaaaagtatgatgggagcaccgaccccgaagaattccttcaagtctactcgatagtgctttatgctgccggagcagatgacaacgcattggcgaactatttaccaactgcgttgaagggttctgcacgttcatggctgatgcatcttcctccctactcaatctcttcgtgggcagacctgtggcaacagttcatcgccaatttccaaggaacatacaagcgccacgcgatcaacgacgacttacacacgctaacacagaactcgggggaatcattgagggaatacgtttggcgctttaacgagtgcagaaacacaattcccgaaattatcgacgcttctgtaattcgcgccttcaagtccggtggtagagatcgctacactacccaggagttggcgacaagacgcatcacaactactcgaagattattcgagattgttgagcggtgcgcccatgtggatgacgcgctaagacgcaagaacgacaagccgaagactgggggagagaagaaaccagccgcagacgcctctgagtcaaataagaagaaaaatcgcaaaaacgggaaaaggaaagctcaagcggaagtcctcgcagcagaatacgtgaaccctcccaagcgcccagacccacaaggcagcgatacaaagaaatcatgatgccccatacacaaaacggacagacattctctggaggattgccttgttttcaaaaagtcgctcgagaagcacatggcgttcaaaaaaggcaagcgagtacgtgttatcgagaagaacgaggagacatcttctcacgaatcggattctgcgtacccagactccgacctccacgtctcacacatcttcggcggctccacaacgtactcctccaagcgggaatacaagaaagcggaacgtgaagtctgttcgacatggcagggggctgcacccaagatgaagtggtctgagcagaggatagagttctcggatgaagaccaccccaagacctctgttatcccaggacgatatccgattgtggtcgaacccactattcggaacgtcacggtagcgcgagttctcatcgacggtggcagctcgatcaatctcctcttcgccagcactctagatgcaatggcaattccgcaaagtgcgttgacaccaaccgatcaacccttccatggaattactccccaatcatcgtccagacctctgggcaagattacgttgcccatgaccttcggccaagccaacaacttccgaacagagcagatcaccttcgatgtcgctgaattcgatacagcttacaacgccatcatcggaagaactgcacttgcgaagttcatggccgcatcccactacgcatatcaagtgctcaagatgccgggaccgaagggaacaatcactatttaggggaacgcaaagctggcggtgcagtgcgacaggcggagcctcgacatggtcgaacaaacgcccaccccacccgccacgtctgagccaccggagaaagtgagcaagccaaacaaggcgccgaagccggacggcaccatcaagatcgttccgctctccagtgctaaccccgacaagactgtcaaaatcggggctacactagatgagaaataggaactcgcgctcatcaccttcatccgcgataatgccgacgtgtttgcttggcagccgtccgacatgccgggggtccccagggaggtgattgagcacaaacttatggtgtgacccgatgccaagctagtaaagcaaagactgcggagatttgcaccagaccgaaaacaagccatacgagaagagctcgacaaacttctcaaagctggcttcatcaaagaagtacttcatccagcgtggctagccaacccagtcatggtgaggaaggccaacggaaaatggagaatgtgtgtcgatttcacagacctcaacaaggcgtgccccaaggatcactttcctctccctcgaattgatcagttggtggattcaacagccggctgcgagctattaagcttccttgacgcttactctggctaccaccaaatcagcatggcaaaagaggacgaggagaagacagcgttcatcacgccgttcggggtattttgctacgttaagatgcctttcggactaataaccgccgggaacactttccagcgcacggtccagggcgcacttagcaaccagcttggcaacaatgtcgaggcttacgttgacgacatcgttgtcaagaccaagacaagtgactcattgattgacgacctgcgggaaacgttcgacaacctccgacgatatcgcctcatgctcaattcagagaagtgcacattcggagtaccgtcgggcaagctactcggattccttgtttctggtagaggaatagaggcaaatcccgagaagatcaaagcaatcgagaacatgaagtcgcccacaagactcaaggaggtacaaaagctaaccggatacatggcagcattaagcagattcgtcactaggatgggagaacgaggacagcctttcttcgctttgttgaagaaacaagacaaatttgtatggacacgggaagccgaagaggcatttattgcactcaagcgctacctatcaaacccacctgtactcgttgctccccaacctaatgaagaattattcctttatattgccgctacgccatattccgttagcactgtcattgtagtcgagagagagaaagtacatcgaccagtttattacgtcagcgaagctctccatgatgcaaagacaagatacccacagattcaaaaactgctctacgcagtcatcatgacatcaaggaagctacgccactactttcaagcccacagagtcacagttgtctcctccttcccctcagcgaagttgtgagaaacaaagacgttgtcggccgcatcgcgaaatgggtagtcgagctaagccaatttgatatccactttgtgtcgcgaacagccatcaaatctcaggtactcgccgacttcgtggccgattggaccatgccagataacaagtcagacaaccaaggcgacaatgagacatggacaatagcgtttgatggcgcactcaacagccaaggagcaggggcaggatttatcttgacatctccctccggagatcaattcaagcacgcaatccacctcaacttcagggcaaccaataatactgcagaatacgaaggactactcgccgggatacgagctgcagccgcacttggggccaagcgactaatcgtcaaaggagactctgagctagtcgcaaaccaggtgcacaaagactacaaatgctccaaccccgagttatccaagtatcttgcagaggtcaggaagctagagaagaggttcgacgggatcgaggtccgacacgtctatcgcaaggacaacgtcgagccagacgacctagcacgacgcgcatccagacgagaaccgctcgaccccggcacctttctcaacgtcctgacgaagccatcggtgaaagaagttaacggtgagtctggcccgagcacccccaacattagctcggaggtcaccgaggcagaacgtgacgttgctgacatcgaaaccacagacgactggcgtaccccattaatcaaattcatcagcagcgaggaattgcccgaggacgacacagaggccgagaaaataacccgtaaagcaaagatctactgtatggtcggtaacgatttatacaaaaaagcgccaaacgggatacttctcaaatgcgtctctaccgacgacagcagacaactcctcttcgacatacatgaaggcatatgcgggtcacacgccgccggtcggacattagtcggcaaggcctttcgacaagggtttttctggccaaccgcccttaaagatgcatgcgacatggtccagcgatgtgaagcctgtcaattccacagcaagcacacaaagctacctgcacaagcgctccagacaatccctctgacttggccgttctcgtgctgggggctagatatacttgggccattcccacgaggacagggcggctatagattcctatttgtggcgatcgacaaattcaccaaatggatcgaagcactacccactggggaaatcaaggccgacaacgccattaagttcatcagagggatatactgcagatacggactaccgcaccacatcataaccgacaacggctctcaattcatcagcgccgacttccaggattactgcatcggtttgggagtcaaaatatgttttgcctcggtctctcaccctcaaagcaatggacaagtcgaaagggtaaacggcatagtactacaagggataaaaacccgcgtctacgacagactcatgtcacatgacaaaaaatgggttgaagaactcccatcagtactattggccgtacgcaccacaccgacaacatccaacaaggaaacacccttcttcctcgtgtacgggtctgaagccatgctctctggcgagttacgacatcaaagtacacgagtacagaagcattccgacgaggaacagcgagacattgatgtaaaccttctcgaggagcatcgtgagcgagttgctgttcgagcagctagctatcaacaagccctccgctgttatcacgagaagcgtatccgagcacgcatactttcgatcggcgactatgtcctctgacgagttcaaacccaagcagggcaaaacaaactctcaccaaaatgggaaggaccctacacgatcacacaagtcttgcggccaggcgcattcaaaatcgcagacggcgacggtcgcgaattagcaaattcgtggaacattgaccaactacgtaaattctatgtatgagtcaataacaccgtacctgtaagcacccttacagtatcaataaagcctatttctaggtttcataccacgaccaaagtgttttcactcgacgatcccttactctgataacacctaacgttgaaacatatccttatgaccctttacgccgtctcgacaaggcctccgaggaacctaagggatcttcggctggggatgcccagaaccgataaggccttgtcagatccttcagagacgaaagaccatgtaagatctggtcgtgtaagagttctcgccgtgcgtattaaccaagccgtgtaatcggaaaccgagctttccaacttcacggctgggggctaggatcagagcttattcaacctaggcagatcaagtgtccaagagccttatcatccaagaaaatttctccgacgacaaggctgggggctagggagagtgtacgactcaaacagccgaggtcgttaactaagaacacactctaacacataacatccagagtaagatgcatttgtttaaggaatatttctttattcacataataattcttacttgttttttacatagatctcccactacattacactttttcctaagacatctatagcaggccacgagtattaccaagagggccaatgccagtccatagactggaataccttctcggctaacggcgtcatcgacctcgcaaggtggtctatctccgccggagtcctccgagaacgagcaaacccttcatggaggaattcgagatccaggcgcgggcggtgatctcgcaggcaagctagcacatgtcctccggcatatcgactcgctcgacgacactcttgtttcaaggcctcatcgatacgcctgccgatgccatcgagttgggcacaggccccgttgagccacgagatgtacccggtcgccgattcctcaggagtgttgcggactactcgaagctccccgcatacccgggccattgaggtacagcaactctttaaatatgacgcaaaccacacctcgcgtcctcggagcgtttccatggcttgctctttcttcacggctagcatggttctcgagagttccgccacttcaaattttgtcttctaatattggatacgacgatcttgggttgcaagggcatcctcgagatctgctaaacataacgaccactaagacaacctggaaaccactaacccaacacgggttaaaaaggctactcacttgaggtggttgtccccatctcgacctccacatcaagagtttggtcctcgacgtcatgtgagacgcgtggttcaaactcaagtaccggaattatcgctagtgactcgggctacccgcgctgctgaacatcctcgtcaccagcatctctacaatcgacaagaaaaacttccgaaatcaacactgaacaaggatggtaatcatacgcccgaaagcaaccagagttcaagatttgcaaattataaaaaatacaagaagtcctactcttcaaaaagggggaggacagactcccccaggtcactgacttcttccatcacctccttacgcgtgtcgcttgccgccccctgatccaagatatcacgcagatcgagttcagggcgcgacaaccttacacacgcgaggatgtgacacgccccggtgtagataccgttggacgtctcctccgcgatcctggccgaatgcttggaggggatttcccctatcaccgtcgccagctccgcaagagaagaagtcaacaagaactcgtcggggttcaccgggatcgtggacttgacgccgcactcctcggcgagctggtgaaggccggtgtaggtgacccgcagcgaaccacggatctcagagagattgtctccaagttccgacatgcggtcctcgagccctttgcgttggcgctcgttcccggccaccagctccctcatcttcgtgaggtcctcacaggcctcagccagttcccgcaccaaccgctcggcacgcgcgtttgccaccgccgtctccaccctcgcctctgagatctcgcggccggtgccgcgagcaccagcttcgagaaggcgccccatttcgacttggagctcttcctaggtgaggacggcctctgccagactacgaccctcagcgggatcgctaacagggccgcttggcgtcgcctcccgactcccgaccacgggcacgacatctgtcgacaccgtggcaggggatgcgctggacgttcctctggatttggcccgcgcagccttcgcccgcgcctccctacaaataaccacgaatcaaaactccatttgaatagaagacacgagaatccaaaagtctgtttactaacttctcgccgatcgtcacaatgcgctaacgtcgcggaggtggaggagacgcgtcggaagcctgcaagacaaccaatgtggagtgagaataaaccttccttgctacacaacatagcgacgaggtgaaattaccgagggagtcgctgccttgcggcgatgtccgagcacatacgagaatttcctcgccttggtcggagctttgccatcactggtggtagcagcgtcagacgcctccttgacgaccttctccttcagagatgccgccacctgatgatccgcgagcggtccgacgacatcagtcaaaggaagggcctacgctaaatcatatcataagctgatttcgagcagagaaggcgggacgctatcgaatgaactcacattgattgcttcgtcgcgctccgtcgcacccttttcacaaaggggtgcggggatgtcgctcgccgtggtcgggccgctgatcatcacctgaccaacacactgctccacggcttcgctgctcagacctgtcaaaaaggaatcaatttttgataagttgaagagtaacgcgagtacaagcatgtctaaatgaatgcgagaaagataccccgaggagaaacccaggtcgcgtcgtctggcccggaatagtcataagccggatgggcccgagcctggagcggctggattcgcctaccgatgaagtctgcaacgacttcatatcccaataagccctgttctcggagatcatcgatgatgtcgataaacggttggagagagggggtcaaggagggtttggcggtccagaccggaatcttgtccggttgttcctcgggaacaacgaggaccggatttgaatccttgatttcaaggtaaaaccacctgttccgccatttgttgcgagaagagggacattggaaggggacataatgcgacttcatgccatcacgaagtcggaacccgacgcaaccggataccctattggattccatccagcgcaactcgtagtaaaagcggaacagatcaagaaagggctctaccccaatgtaggcctcgcaaagatgcacaaagacgctaaggaaagcaatggaattggggttcaaatgcagaagagaaagcccatagaaattcaaaaccagcagaaggaattcggagggtggagggagaaacctgcagacaactgttgatataaaacacgaggcctgggagatctgcttaactccagtgcaggtccaaagctcgccttcggatgtatgagtgtgccagttgatttgatcctgcaatcaacaagagatagaacaaagaaaccgcaattaatcctataaatgatagccgatcggctaggtgctgatgacatatcatttatttcaagccgatgtcatgcgtacatcgatcggcaaatatcaataagcaattcagaactaaatctactcgatcaactgtagacattaatgatatataatccttatatcagtatatacttaaatcaagtgattgggatagatcggtcgccttgccgagacagtataaatcacttagattgaaatatatattaatagtaggattatatacattcataacatagctgatcaggtaaatctagcatgtatcggctaatactccgataccactctatactaagatattaaagcaagtagaatataccaaacataagcttaatatacttagatgcaataaaatcttaacataaagggcagatttaacgtatcaatcaagcatataaaataaaattagttaaatcagataagatcggctgaaactccgatattaccctaattggcaaccagaaagcaggctagagattgcaattctaagcacgacttaatagatcaaactcaactgatgcagcattaagtatgaaaagaagaacaatatctagataatcaagccgctggaagttttatagagtggtagatatatcacataatctaagttaacgtcattgtataacctaatcggctgccttccattagcagatgttagccgattataggttagataaagatattatcgaagactatatgagatatatgataactcgacgaattatatagacaagattagagtgtcataaagatggaagcactaatcctgagaacataagtcgtcatgacaagttttacctctttgttgaagatcgaaaccgatgtagctcaacccgagagcacgaactcgtcgaaataaaagtaaagcaaaaaagggtggcgatgcgccgagattgtattggatgtgttatctcttttttatatagggctcgggtctatttatacacgagaattacaagatacgtccataacggacacgactattatctctagcaaactctaagataccataagtctttacggcagactttttgcccaaacatatctctaaggaaattacatagaatatcctaattaatagatacaattgccttcccaggactctatccatgcatggcaatcaccttgaagcacatcaacttaaacccgatgacgttcaccgggtcatattatcggaatcagctgtatcggctagccccgtccaactcgaactctgccgatcctgaccttagctgatttagactgcagccaatttttactctgtctccgcaacgatcttcatcttggattccacttcgatctgatcttcatctccgatgccaatagtgatagaatttaccaaatttggtcgttaacaacaacataatcttcgatcgcaaccatgcgacctaagatgggctgaggattagtacctcctgctttcctctccgccttttcacggccaggaagggcgccgtcctcctggagcttctttagggtcgcgctggtggaagccgacttgccgagattcatcgctgctgaaagatcgccggagatggacctagagctggcgaagctagggttctttacggcagcggagaaggtgaggagtgctaacaggtggtgtgtttgacggagttggcggacttcaaaacgtgcacccaaaatccctttaaataagcgcacccccaacggtgcgaattccaaggaactgagagaaatccccgctggaaatttctaagtctattacgcgcggcagtttttggacttcagttcaaaattcactcgtgactgttgggcttcaaacgggatgctcgactacacatcaactccgcgattctcgcacccggaatgataacgttctagacgcccgaagtcgcgaatggtcgcatgagttcgtttttgagcaaaagtcggaggctactgtcagggttacgggtcaggcataccccctacccttcgatatacgatacgtatcgacatggcatacccacgcgcacgcggatatttcctttatgatctaaggaaacctttcacgaaatcaatagacgggaaaaagtccttctcggacaagaactgggttacctacgtatcgtgctaggtctggtatcttcgagtcctactcggagagtaccagacctgtcatataaaagggaccccccgagaagggcatagatcatcgaatctcagaatccacacagtctaagaagccggagcctgcgaggagccaagtcgccgagagctagtcgaatcaactcgactacaatctcgccggatctgacaagtttcatcttttcctttgtaacctgtgttttccaccatataatcccacatcaactggattagggctattacctgtcaaggggcctaaaccagtataattcttgtcttttgattgctcgatgtcgtactacgtagatctttgtaccagcgtaccccaataccctctatatccggtctacgggtatcacccgtcgacagtgctacacttttgaaatcggtagccaatagtctcttattccactataggtggcgtagttccattagaattgctagctaaagaacattatgtggtttaacgctagtccataataaagagaagttggagatttgtctcatcgccttatttctcattttaattttaattttatctttacccttttttattattaaacttatgactgtgtgtcttatgatagaagctggagatgtaatccattttcattatctcaaatccagtactccatacacgagtacatgtcggatgtaaataaaagcacagattgtgcactgcattagcacacccatcacaagttcacaactcgcgagtcacagatctaaggttcgttgctcgtcgtgactcgtgacgaagtagcaaacaacgataagaaaagagttctcaacggttggcagcatgcagagcatgcgttacatgacagcacaatctgcactacaagcatcgtcaaatccaagcatattctcgcaaatctgcttgagcctctccagcccataccgacccgcggcttcattcaagctcatcaccatcgtcctcggcagcaggggatcagaaccatcctctctccagtcgagctccatcaacgtgtcggtgtagatgaaatggagcagcgccctgaagacgccggctctcatgtcgtccttgacctcaacgcgcaccgacccatccttcttcctcgtgccacctttcaggacggcggcggcgagggacggcgacctcgcggcgagcacgcacctgtgcgccgcgatggacacgccggaaacgatgaactcgacgtcggcgaatctcccgctccgcagcagctcaccgagctgcaggtgaaggtcgggggacggctcggccgagttgatggtgttcttgctgagcaccgtgatggtgcagcgcacggcgaaggagtcgccggtgatgaaacccgacgcctccagctccctccgcttcacgagcagaacccacggcgagctctcgttcgcggacccgaacgcgtgcgactgtcgctcttctcctcggaagcatgggagcgcgtggtcgacgggtgcaccaggcagcagctgagctacgccttgatggcgccagcgtcgttgtcgtcgtcgtcgccgccggcgcgctgcgcctgctcgccgatgccgaggaagacgagcttgaaggcgacccagtagtgccagtgcgcatcgtggcctggggtgtagtggatctcccacgcatacccggccacggtgagacgcttggaagagacatgctcgtgtttggccatggctttcgtggccgagtagccattgacgttgaacttgtggacggcgcgcgcggcctgggtgaggtttgaggagggcgccattgatgcggatcccaggcaagctagcggaggcgaacgagcctgagcaaagggagcgttatatacagatgtctgcacggcttgggtgaacgcgaaccgttgtaccgctctcgagagtgtttcgcgaatcgtgcttgcgttttcccaggcagcgctctgttaaatccagagattttgagagatctttccgtttcaacgcgcccttctaccaacgcagacttgagactgactgtggaaggtacttgaaataagttcacttaaggtcccttaacttgtgaatgtatttgatgttcgtccttcaaccgaaaaaccagatacaacgggtcctttagcggttttgatgatggttttggctgatgtaacacatacatggctagtttaactctgccttcgtccttggtgtagatgatgtggcaacggaagcaaaatatataaaaaaataaaaacaaaaactgcgaggcccacatgtcagtaagacaaaaggaaaaatagtacgatctacatgttagtgggtcccaccctcctctatccatgccatggacgacgggagacgatggaccgccggaccgcgtctccttctctctctctccctcccggccatccttcctcggcggccggcaagcgcgcacggagagggaaaaagccgacagccgacgaggggggcggagacggtcgacggccgccgctcgctgtgaggggaatgccgacaagggcagagaggccggggggctgccgctcctcttctgcccactcgccggctgccgaccccctcgcaccgttgctcctgtccctccctctcgtcggccggcgcgcattgcctcctccctcgcagcgctcccgtcggacgccctctccggcagcgctgcgcgcgcagccgctaatctccctcccacccgtcggccggtgtgcgccgccgatgctctcccgccggcagctgcgtgcagctcccccctgccgctcctctccctccctcccgccggccggcatgcgtcaccgctcctctcgcgtcggaggtacgcgtggcgtccttggcgaggtcgtcgccgctccgcttgtgcctctgctctgcccgctgccgccgttgctccgctgcgaggacgagggagagcagagaggaagaagagggagagccgagagggcagggaatgacttgtagggcccacgtgggccccaccagtatttttttgtgtagctgacatgtgggcccacgtgggccctgctatttttaaatgatattttgtgtagctgacaagtgggcccacggttttattattttccaagatataattgccatgtcaatgccacgtgggacggagagctagtcaaacctgctacgtagacgccacataaaccaaaaccactgagggacccgctttggttttgatagttgagggacccgttgtatctagttttctggttgaaggatggaaatcagattcgttgacaagttaagggaccttaagtgaacttattccaaggtactttgacgcgagacgaagctgtggcccaatttgaagccggcgtgaggcccatgaaccaaccacagtttggccccattttgatggttaaaaaaggaataagttcatctaaggtcccttaacttgtcaacgaatccgatttttctctctcaaccgaaaaaccagacacaacgagtccctcaagtatcaaaaccggtgcagatgaggtccctcggcggttttgaggccagttttggatgacgtggtgcctatgtggctaatttgactcggtcttcatctgacgtggcgcttacgtagcaattcgacccgaaaaaataataaaacccgtgggacccacatgtcagtttcacacataaattaataaaaaatggtggggcccatgtgcgccccacatgtcattctcacccctcttcttcttcctcctctccctccatctccctctcttcgtctctctcccctatcctctctccaggtgcgacggagaggcagcggcgcacggcggccggcgggagagaagggagcggcgcggcggtggaggcacggctccggcagctgtgggcggaagaggaaggggcggtgggagttggccctggctgcggcagacggtaggacatgagctgcacaaccgaggccccgccggcgccgactccttattgatgtcaccggcgccgccaaggctgacgaggtggacgcggtggtggtggaggaggaggaggacggcggcgcggcgcggttccatgagcggaggctggtggtggtgtttgtgctgccgtcccagccgatgtgcgccacgtgctggcggtggtggtccgccgcgccgccaccctcgccgccgccgcctagacacgtacacaacatcactaataccaaactcctaaatcaccccgcaaaaaacaatcgacaagatagagcagaagtgaagaataagcatccaagactccaaacaacgaaccttggggcttcttgccgctcttgccgccgccatcgacgacgtccacgctggatccattgcggcaggtggagaaggggatcacgatgaaccggtccatccgccgctgctccttgccactattactcatggctagctagccactgctagctaagctgatactatcttggaatcaaattgcttgccgctttggctgaacctgtactggtacgatcatttttagtaaaagaaagggttaattaagaaatggggttcttgacccttgctaaaaaaaaataatcttggaatcaaatcaatgtctgctcctcgctggcgtgcgctgcgacagcggccagatgctgagcgacgggagcagcacctccgcggccttggcgactggtgccgcgggagcggcgggccgacggcggagcctccctccgcggccgacgcatgctggcttccctcggcggcggcggcggctctgggggcgtcctccgccatggctgcgggtaagtgggagagggagagatctatggcgtggagaggggagagaccgagagggagaaaagaagctccgccgccccttcctcttccgcccacagccgccgggccgtgcctccgctgtcgcgccgctccctcctctcccgccggccgccatgcgccactgcctctccgttgcgcctggagagaggatcccaatccgagagagagattaaggcaccgttcgttccagggtgtttggggagattgagtctcgttttccgcgcgcacgcttttcaaactactaaacggtgcgttttttgcaaaaaatttctataggaaagttgctttaaaaaaccatattaatccatttttgaaatttaaaatagttaatacttaattaatcatgagctaatggctcacctcgttttgcgtatcttctcaatctcctcaatccccttcccctcaaacacaccctaagggagatggggagagagaggaggaagaagagggatgagaatgacaggtgggcccacttttttattattttgtgtgtggaactgacacgtgggtctcatgggttttattattttttctggattaaattgccacgtaagcgccacatcagtgcctatatcagataaagaccgagtcaaattagccacgtaggcgccacgtccgccaaaaccaccctcaataccgccaagggaccttatctgtacctgttttgatagttgagggacccgttatgtctggtttttcggttgagggacgaaaatcagattcgttgacaagttaaggaacctcagatgaacttattccgttaaaaaatcacgcatgttttaagaggggaaaagtacaccgaaggtccctcaacttgtcatcgagttacaaaatcatcctccaaccgcaaaaccagatttcggtcgtcccttaattaatcaaaaccggtcacaatagatccttcggtggttttaaccctggttttgtcttacgtggcggctgagtcagtgtggaccgacgtggcacccacgagtcaggatgccacatcatctatctcattcctcctctctctctctctctctcactctcctcttctctgggcaagccggccggcggctggaaaggaggtcaccgggtgaggcgggagaggaggagagcggcgccgcgacggcggctggctgcggctgttccatggaggccacatctcgcgtcagcaacaccaacaaccacccggcggcgacggcgaaccttctcgttggcggcgacgacgcggccgtccacggggagacagccattgctcgcccctgctgccgccagcttctcctccgcctcccgcgcccggaacggcgacagccgcagcgcacgcatcaggcggtcgcagcgtttccatctcactgtttcagttccagacaaacgttgcaatggcgagcacaacggcagcaacaacaagtgagcagttcccaccggcggccatggggcccgtcaccgctgcgccgttgctggaagaaccgtcgtactaggcagtgacaacctcgaaacagctgacgatgcatacgacgagcagcacgagcgcaatgaccggcttggaagaagagcgctccatcttgttctgctttcgattgcatgttcaaagttcagaactcagagcagagacgatacacttgagcattttgctcaaaatggcaggatttatatagaattgcttcatggaattatctgtgaatgttgacatggtaaacatagtacatatgcacacaagtttgtccttttctctcgatcgtgttctgctcgccaggttgagttggggttgatctggacggctggtttgttgctgcatactcgtctgaaaagttcaacaagaagatgaggtgctggctttgattttattgctggtgttccttcctttctgcctgtaccccaaccaccccgctctcctcgaggcgcagcagccattcgcctaaaaggaaaccagtactaacctcgggatggtgatggccgcgaccgcctgatgcgtgcgctgcggctgtcgccgtctcggcgcgggaggcggaggagaagctggcggcggccgggggcgagcaacggctgtctccccgtggacagccgcgtcgtcgacgccgatgaggaggagagcatcccctcattcgccgtcgctgccgggtggttgttggtgttgctggcgcgggatgtggcctccatggaacggccgcctccccactgcggccgccgccggcagccgtcgcagcgccgctctcctcctttgccgcgtcgccccggcggcctcctccccagccgccgaacagtttgcccagagaagaggagaaagaagaagagaagagagagagtttgaggaggaagggaaagagatggcgtggcatcctgacatgtggggtccacatgggtcctacgttgactcagccgctacgtaggataaaaccggggtcaacactatcgaaggagctattatgaccagttttgattagttaagggacggtcgatatctgattttgcggttgatggatgattttgtaacttgacgacaagtttagggaccttcgctgtactttttccttttaagagatgtttctttttcgaagcattagcgggcacaaggacctgtgcagtcgtgctgaccttgggtgaagcatttgacagaagaattgggaattgatcctatcatcaacgttttcagaggaaacgagtagccgagtactccctccatctcatagtaggtgacgttttcgattttttatttataacgtttgacaattcgttttatttaaaaaattagtgcaaatataaaaaaagataagtcatatgtaaagtacttttgataataaagcaaatgataaacaaaataaataataattccaaaattttttgaataagacgaatgatcaaacattgacaaacaaaaacttaaaaagacaagtaatatggaacggaggcagtaggtattaggtaaacaccgtttggtggaccgaatatacaggtagcagagccgagggttgaagagagcctaaaaacttgctctgggtgaacaatgggccaaccccttctgcttctttgatccgatgctacattccgacgtttccaaaaaaaaaaaaaatcatgacaacgttgcaaacgccatgagaaaagagaacatactaatagcatcaggcatcaattaaatataatcttataatcatacgaccatttcggggctaattaaccacaacataattaagtagatatcgaaatgcatgtataagttaaagtaaagcttctcttggcaaaccagaaacccaccagctgctaggatggaggtgacggcactctggatccaatccatacggacaaacggcatcaaaccatgggtatgctgcctagtgcctacgtactactgaggatctttgagcaccgtgatgacgcacctcattcagaatcacaagctaaaatagccgggctcctctccagatcgtcctgtttaatgagcttaacccagtcagagctctccctggcgaggtgaaatttgcgtgacacagtttcagccctgcagtcgtgctggttcccgcttgcatcacgccaacgtgcctccgtccaagtggagcggtgatccatcaggcggcagctgaacgacgcattcacgcctctcgcccctgcaggtccaaggaagacgagcctgaacgcaatacggtaatcgccatgtgtgatgaacacctttgggtagtagcggatctcccactcgtaaccacccacggtgagtcgcctggacgggaagtcgttttcaccgccggacttggtggcagagtagccgttcaccgtgatgtcgtgaatagccgatgtggcctcggtgaggttccacgatgaaaatgacattgctgccgatcgattgccttgtttgtggtgggttcgcactacggctactgcgagcgtgagatggcaaggctcaagcaactccttctacgagtaccctatatgtagatttgtagaggcaagtggagactggattaatatcggaacgagaggagcgcatgcgacgcccgggttgaatgtagaacgcgaatcgtttggtcactctcgagctaggcgtttcgttattctcaccgacgggttctttccaagggattaacacacgcctaagagcaggtacaatagcagactattagccagctataaacatattttaatgagataaaagatgagagagaagagcagtgggctacagatctgtagccagctgcaacacgaactccaagacgcagtgtgtgtatgacagtgagaccatatactaatagtataataaacaactattgtataaattagctattaaattggctatagataaattagagccagtagttggctataccattaaccttgctctaagagcacccgcaatagtaaagtaaggtgctatctataaaacatgtacatctcagcaatagactagattaatagtaaaccatctcaatagtatgtctacatgggtatctatagctctctaatacattgcctcgtttttctctatagactatctccaggttagtagatagctttgctctctctcttcatttaatctcttccaagtaggaaaatatgctgacatggatctcttatagagagcctatagataaccattgtgggtgccctaatactacatgcataatactacatgcagtcatgatgacctgtgaggctgtgactgttgggaggagaatgaaaattgatgtcaccggcaatccggcagtcctgcagacgggcagaaaaaatgtgtctgcaatgtgcagactctacttggtgcatactgtatgcagtacgtaaatttcatccaaatgccaaatctgccaccaaacgccttggcctcatatgccattcaacatttcatccagatgtactatacactacggtgccgttcttacaagtttgtataacttgaattccatagttcagactgcaacaatccgaaatccatgaaaagtataataacttaagggtgaattaacttaaattctaaattagtactacagttcatggaacagatacttcctataacttgggaagttctctgccgaaaatcagttgttctgctcagggtacccttttgactgctccagggaatcagttgtgttccatgtctcttagttgacgtaattttgtacaattgcttccgcacaccagtcgtgcactcgtgcttccaatgttatgcctggcgacaaactgccagtgacacttccacagttcaactgatgctacacgttggagcagatttcttcgtaggtattacctccttcctgaaaatataagggatttttgcattgccgaaatcccttatattttgagatgaaggtagtaacatgcttttcgtcttccacgagtttatatagcctaactgccagagtgtctcacgatataaacgtccttccatttgttgttattggtatttcatgacggtcatcgtccaaccacttcaacctgttgctgcggttgagcagcctatcccaccatgctgctcaggatttgtagcttcgaacagatatactgatctctgctctttccataaccttacaggtgaacagcaggaatgagttcatttctgcatccggaagttggaaactgtaatgttgggggaaaggttaaggatccgttaatcatgatatcaatatggatttgatagtttaatatacgtaccacgtggtgaaacccactgtcacatggggagcaggaacaactatccctgaatatatgtgcattctgcgtgcagcaccttcttgttcctgaattagccatttcaaggctcccccagctgccaagttagagcaggatagaagttacaatactttggaacacaacttcaccaaataacgcacttgaatatgggcagtttgcaactttgtatatctatcttacattacttatgttgcaactcataggactaatattagggtgtaacctagcaaatgtagagtgaaacccagattgacatgtggtgttaatagttaccttttttaataattgacataaccattctgagtgtccaggacgcagtacaggacattccagcccaacatcgcttgtactgtgtggaatccctaggctcttctcatctctatagctcatcgaaatcaatacttggcattattttcttcagtaggttgaatgatgacacaggtgtgtaacattctgcactgaactgcagcagctcattttctagaacagtaaaagcatcagcaaaagcctgccatacaaatgatcaaacagtagagttagtaaatatgcgcaatttgttaccaacaattgatgcttgaaggccaaacaaagttagtcctaatacagtatgaagactaaaatattgctttagaaattctgaagtttaccatacacagtatgataacccagaaaatagtaagaacaaaattccagaaggtgagaaaataaagatacaaacaacttaaaaaacacatactgcagaagaaaggtccaatcaaccagcaaagggagaattataagtaaccttgatacattggtgaatgcggaaacagttcctgcccacattattggcagggcaaagaggatcatcaatgtgtattggatcaatgctgcaaatcaagcatatggaaaaattacagaaggcaatagttgacagaaacagataaactgatacattgatatttaattttatcacctgtgacctctttatcggttcaaataaatgccacttccttggatagagatacgcatatggcgcggatcaaatacattcgtgatatgcagattactcactaattaattccatcttagatgataattatattactactccaaaacgattgcaatttgcacaggataaatcgcatatgagccctatagtctttgaagtttgtgtcctcccttatgtattaaaggataaagtgtccagatgtatttttcttacccaaaaaagtataggaaatccatcaaaaggctgcccagattctgtcaaacatgaaggagcagatatgaaattaacttagaaggaaataagaaaactgaatttaactaagagagattgaaaaaatgactttgcctgttgttacaagttacatgaaggctgattaccaaaataacaaccggatgatacagaagcaaacgtctaataggaaaaagatacaagaactagtaatgaaatagagcatataaaaaacccttcttctctattcatgatttgcaacttacttggttaatgggccgaccaagatgatgctcatgctgaagaaaacgaacgattaacagtacctgcaaaggaagttataaactggaggattatttttcagtgggctctcaagataccaatattgatgcaaataatctggatttgcccttaattgaaagagagaaaaaagaaatggaagaaaggaagatcagcaagtatgaactactgtacaaaagtggcaaggtacaagcacaaattagttagctgaggaccgtactttactgggtctgttctttaaggctaagtcatacagtgctagataatactatggatagaaatgcatctgattaagagggttaatccagaaaaaaaaaacctaaatcaccaaatagtaaatatctgggactaatctactaaagttaaggagaaaaaaaatagctattcactcataatgtttttttattattatagcaacaatttgaacggtaaggtgtcagtttaagttcatgacatcattcacacctaagaaagttatccagagagtaatagatagccacgacaggaacagcaggtgttatgaaaagttacataccaaacaatatgaacttagaccaccagaatatgggtgatccaaactccggtcagccaaaaacttcttcagtattaaggcaagaggcacagcagtgatga

SEQ ID NO: 23410 - DNA, 863 bp, Oryza sativa
ccggctgacgatgcaccccgttttatgtctataattctcaacaaatgcaactcctatgaacaatgaagcaaattgttcttattgcaagcgctattggtttacatgtttattactgagtatacattgtctagaaatatgttcattactaagcaacatcagcgtagaagtcttgaattgtgatccggacagcaattgggattcttgcagtgtggtgctcattgtaccaagttaggctgccgaatgtgtagcctccctgcactttccacagaggtgtaatgcaaatcttgaaggcatgcactttcttgctagcattgaagactaggacaggcggttcgatagtcatcttcactccaaggggggattctatagaggattggtaaaccgcatccacctccccgacattagtgactgctcgtcgtacgtttattggatgccttaggtctggtatagatatagaaggcagattcaggtgataggctggcaatgtcgtaatgttacagatctcatatttcttgatctgacaagcgaagaatttgttgtaatcctttggatcgatgtcataaattaggccaggatcagcagctccaataggatttatgttccctcctccataatcgaaagggtcagcaactttccgaggaagcgcttctgctaatatcggcgtgtcatattcgtcctttgttgatgcttttgcatgcaaaaaagagtaattcatggttgagtggatttacctatatagttgtttcatgtggatagcacactcaagtaatttacctgtggtgacaattgctgatttgagagcagcatgagaccaatgaggatgtagagccttaagcaatgcgggtaccgagctcgaattcgcc

SEQ ID NO: 23411 - DNA, 490 bp, Oryza sativa
atcaagctagccacgccggcggctttgcaagttcgcatggccgcattcccaactcgacggggggaactgactgctcgccgccgcccggtcagcatctagccatccaggtaccccgttgggccttgtgtgatcagcagtagaaccataaaatcgaaggatttattgtagatagtgcaagaaaaatttgccaagtacaagtagttttccgatctaaggtgaccatatgtagatgatcaccgttctttattattgactattgagtaatcctctggattactatgcaacatccgcatagaaatctcggattgtgatccggactgcgatggggatccttaccgtgtgatgctcgttgtaccaagttaggcttccaaatgtgtattccccttgcactttccacaagggtctcatgctgaccttgaaggtgttcactttctttgtggcattgaagactagggttggaggttcaacatcgatcttgactcctaggggg

SEQ ID NO: 23412 - DNA, 496 bp, Oryza sativa
  unsure (1)..(496): unsure at all n locations
nnnnnnnnnnnnnnnnnnnnnnnnnnnnnnnnnnnnnnnnnnnnnnnnnnnnnnnnnnnnnnncatgccaatactggcagaaggagtgcctcggaagatcgctgatccgtttgactacggaagtggaaacattaacccaaacagggcagctgatcctggcctcatttatgacatcgacccaacagattacaacaagttctttgcgtgcaccatcaagacatctgccagctgcaatgcaacaatgctacctaggtatcacctgaacctaccatcaatcgctgttcctgatctcagggatccaacaactgtatctagaacagttagaaatgtaggtgaggttaatgcagtttaccacgctgaaatccagtgcccacctggagttaaaatggttgttgagccatctgttcttgtcttcgatgctgcaaacaaagttcacaccttcaaggttagtttttcannnnnnnnnnnnnnnnnnnnnnnnnnnnnnnnnnnnnnn

SEQ ID NO: 23413 - DNA, 292 bp, Oryza sativa
gagctaggagagaacaacaacacccataggtcacaaaaaagctgtgttccatcgaacgaagctgcaaggatgcagccagagaaaagcaaacgaagttggccacgccactgcaggacgtgtcatgactccatggcggcctccgggatgctctgcagcgcgggcttccagtgcgccaccctgtagtgctggtggtagacctcgccggcgttcatgatgtccgccagaagctccgcggccgaccgccggctcttccggtagacgtggtagccgtggccgccgccggcggcggccg

SEQ ID NO: 23414 - DNA, 605 bp, Oryza sativa
  unsure (1)..(605): unsure at all n locations
nnnnnnnnnnnnnnnnnnnnnnnnnnnnnnnnnnnnnnnnnnnnnnnnnnnnnnncatgcatcctgtcaaccgctggacctccctgagtcttgtgggcaatttcatgttctcgattccctttatcttttcagggttgacctcgattccttgtccggggactaggaagccgagtaatttccctaacggttctctgaatgtgcacttctccgagttaagcttcatttgatatcgtcggaggttgtcgaacgtttcccttaggtcgtcgattagcaaatcgcccgtcttggttttgacgacgatgtctaccacgtaggccccgatgtttcgtccgagttgatcaccaagtgcttcctggatcccgcgctgataggtatttcctatgcttattaatccgaacagcatcttggcgtagcagaatacaccgaagggtgtgatgaatgccatcttctcctcgtcctcttttgccatgttgatctggtggtagccggagtaagcatcaagaaaactcaacgactcacaacaggctgttgaatccactagttgatctattcgagggggagggaagtggtccttgggacacgccttgttaaggtcggtgaagggg

SEQ ID NO: 23415 - DNA, 576 bp, Oryza sativa
  unsure (1)..(576): unsure at all n locations
nnnnnnnnnnnnnnnnnnnnnnnnnnnnnnnnnnnntgctagtaagccttgccgacaatggtgcgtgcagcagcgtggttgccatagataccaaaatgtatgtccttcagcaattgtctcccttcttctaaggatacgcaacgttgcagaattcttgatggacttttcttgtacagctcggtctcatgaataatataaagcctgctgcgcctagaaatctgctcggcttcatctttatcttgagggagttcttgggaggtcagaaatcgtatgaggggctctctccagttggcttcgaccatagctatgtcttgagtgtccgcggcttcagctgtttgtctcttgggtatggttggctcataaagatgttcgacgaacacatcagaaggggccgcttcgtgtttggatccaaaatttgctagtctgtcggctgcttcgttattgtgccgaagaacgtgggtgagttcgagtccattgaacttatcctccaacttgcgtacctcttgtcgataagcgatcatattgtcatcaaggcaggaccactctttcataacttggttaacaacgggtaccgag

SEQ ID NO: 23416 - DNA, 312 bp, Oryza sativa
  unsure (1)..(312): unsure at all n locations
nnnnnnnnnnnnnnnnnnnnnnnnnnnnnnnaacctggatccaattttaaggacaaatcctgatgttggtaaaatatacgtgtttatcaaggccaaggacaatgaagcagccctccccttgtagctggggtagactggtagtagtttcacctataaaattttgcatttgtggaatgtaggttggaactacctgttccgggattgtagaaaggaagggctccacagttgaaactacctgttctggcatttccgaaaggaaaggcaggacagctaaaaataattcgctgtcagccgcagtatagatacttcgag

SEQ ID NO: 23417 - DNA, 929 bp, Oryza sativa
  unsure (1)..(929): unsure at all n locations
caccaaagcgctcatgactgtgagtacggctaatcgattagtttttagaactctgcaaagtttgtacagctttacccacatgatatgaacactctagtttgtctcgtgttggccaaagcactaccacactctacacattgagagcggtctagaggtcataacgaagcctttacattacttagagcctagccttgcaccagcacgatacgtgttcctccatcctaggcatacttggaatatgtctagaaccgttaagtggcgagcccacgccttaaacttaatgccgtggtggcggacacaacgagaatccaccacgtggcacaataccgttgtattggacacgcttagtcacctaaactactacttcgggtaaataggaagctcctctgaattattcgaactcatacacaccggccaccagaatgcaaggctagttctaaatagattaatcagcttaggccatcctatactagcacatgtggatgtacgaataactttaagttggtgacacaagttatgtccttatagacttgggcaaacactccccctatcggtatgcaactaacaccatatgcacaccacttgctgcccaagtctaaaatcacattttacacattttagtttacaaatacccatcacattcattttattccagcaaaggttcatgtgtccaaaatcacattttaatcacagagggtatgagcatttgcatatttctaagcatggctaagcaagtagttgcacatagagcatatataaacccaattgagcacaaagagtgtactctaaccattcctagtggttcaatcagcaaggatcacaattattcaaggtagggaatgcagcaaataggtcatnnnnnnnnnnnnnnnnnnnnnnnnnnnnnnnnnnnnnnnnnnnnnnnnnnnnnnnnnnnnnnnnnnnnnnnn

SEQ ID NO: 23418 - DNA, 17138 bp, Oryza sativa
ggccatggctagcgctttttctatactcgaccgctccctgactttttctgtcatttaatttttcaaatttctgttttcaagagcattcttcaatttacagcttcaatatatacgtgatatcatacccctaataatttcacaaaactatttgtgcttctttattttattttttttcttcttcgtttgcctgctcctgggcgtgtgatactgtgattagcagccggcaaggcctaagcatgcatgagtccatgattgggctttaagatgctagcccgtgcatgcacccgtagcactcatagatgtatccagaattcgcgagacggcaagagtacccgtttcccacgctccccgaaaattaccgtccaaaattccaaagatttatctgacaatttgatagctccacgtggaccaatcagtagtggcaaacctgtcggcttgagattaatagatcaataataatatatattattttgtctttaaaatgttttttatattaaaattattaacgaccctaaataaaaattgttagttacaaaataggaaggagagagggaggattgcatacctacaatgtaagtacatcgaaaatgctacgcctcggtcgctccccctcccccacgaagcgcgggtgcgccctggccccacgatgtgttcctatctatctgctacgtgtccccaccatatactccgttgcaacaaatcacctatatattttagaaaccctctattaagggaattcgtttcattttttgttccacaaaaaatgttttacctagtgtactcacaatgtttcactatgtatagatataatgttgcagtgaattaaagtattcttttgcaacaaatcacccacatatattttgaaaaccctctattaagagaattcgtttcattttttgttccaccaaaaatgtttcacctattgtactcataatgtttcactatgtatagatctaatgttgcagtgaacgaaatattcttttgcaacaaaatcacccgtatattttggaaaccctctattaagggaattcgtttcattttttgttccacggaaaaatgtttcaactagtgtacttataatgtttcactatgtatagatctaatattgcactgaactgaaatattctttcactacttgcagaaacattgtttttatataaggtgaaacaacacctgatttaaacaattgaaacattttcgatctacttagtgaaacaattccgatatacttggtggaacatcgtgcaacattttaaaaaactcaataataagctaaaaatttttcccgtcggaatatatccatgtgtggtcttgttttaaagatttaattgtaacaaatttaatggtgcaataggatcatgattttgataaataatttaagagaaaaatcagtttaaattggtttttcacgcatgcgtggcgctgacgtcagcgcctaatttttccccaaaccatcgggcgcccgacgcgtaggcccttcttaaggacatacgtccagcttggcaggtggaaagagagttggactttggaggggggcgtggctaatgggcgtgtgatcgctgtggtcgatcaccccccatcccccctatacactcctctcctcctttctcctacccttcttttcgtcctactgcaccataaaatttttaaaaaataaaaaagcaaggttagcaaattttatatacggaaatactatatataaaaaatatttgaattcaaattcaaatttaaaatgggtatgtaaacttttgacttataaactttgggcctctaaactttagttgtataaactttagatgtatagaaatactatatataaaaatatttgaattcaaattcaaatttgaatcgagtatataaacttttgacttataaactttggttctctaaactttaggtgtataaaatttagatgtatagaaatattatacataaaacatatatgaattcaaattcaaatttgaatcggatatataaacttttgacttataaactttgggtctctaaactttaggtgtataaaatttagatgtgtaaacttgaggtatataaacttgagctgcataaatttataaaaataggaaaataatgcggtgccaaataaggaaaccacgtggagggggtgatcgctaggggcgatcgatcgcccgttagccttttcggctttgggggattttaaaaaaacaaatataatatttcaaaaacagtgggtccactcaatttgttaaagtgtcacatatttcaaaacagtgggtccaccctatttgttaaagtgccacgtgacggtttatgagtatttgtaggaatagcacgtggcggcctaggagcatttgtagaaagattaatggacttttagtatataatagataatagataggttaggttatgattttttcccttcttactacttaatttacttagcaatttttatttatgtgtatcgttaactgaaataattttttttaaattaaaattattaaaaaattatttgagataaactatgtcttgtgatatactgaatggcttggctatgtgcagcattgaaaagaatatattagataccattgatctccaagctattcttaatgattttgcttaaaaaattcgtgaaaaggacattttttacaagagacattgcatatttgtggtctcctatttaaggtattcatattacctttttttgactggaattactgccagggctttgcccagcagtgtaattttataaagattgaaaatatttacaagattacagagttacaaaaggaaaccgcaaggaagactataaggtttgtaaccaattaaaaacaaattgctttgagggatccttcattctgcacatatgcagaagaacttctttcacaaaaaatgatctccagacttggaaagaaggttgaacgttttgaaagattaaacaatttctttgcttccatatgtgccaagctgtcaaaaagaaaatctccaagaatcccctctaagcaaacttgattcttgctagggcaatcatttggaaaaactccaaattatgattccagtcaattcccaggtgctgccaacacctgatactgaacggacaggaaaagaaaagatgcaaccttgtttctctgcaatccgcattgcacaacacacatgtgaggtcatcatcttctttagcacaatgtcgtctatccagcatatctcttgtgttgagtctgtcacagaacaggagccagacacattttgttttccataaccaaatcatgtgtctgggggttgcaacgcagaaaagttgagcttatagaatttcttagctgtgtactctgaaccccagataaaattcgaagcatcccccttcctgactgtatattcagattgcttagaacttcctgtagctgtaaaaattaagaataggccacatctgagaggggtagggtaaaagaatcttctaaaggtcttgaacacatgactttcactgaatcagttttatacatggtcacagcaaaaagattggggtagctagtgcatttaaaatcatcattccatagatcattccagaaaagggcagtagttcctatcctgatttcacatttggctatccccctgaagatgtttgcaagagatgtgatatccctccaccaaaatgaacccttattcatcatcaagtgtgaaactttagaatcataatatgtttgtgagagtattcatattaccttgccttcataattcttttagttgtcgataacactatcaatattatttatcaagaataaattactatgttgcaatttccactacttgatttattatttagcatgttagtaatgttatgaaaatagatgcacaacggagacacgaatttcacgtggaaaacccttgctggaaaaaactatgggcgtcgaccggcaataatcactagaggagttgattacaaacgtaggagaataacattgggaatatcaccccttcctgtatggcatacaagagtatatatatgagataaaaataaaaacacctaatagaaaaagaaagacataaagtactattaggaaactaatcctaatagtacaacttcatcatgttgatttgcatagctatccaggacagatatgtacactaatccttctgcaatcattttataggtggaattccatctagtcggtggattaaaagaaaaacccaactttgaaggaagattcttcaagtttgctatagaattgaaatcttgcattcttgatgctgaagaatctaaatgcttcaacaactcacgtagcttgtgtattgttggtttaattatcttcataccatcctgaacccaaatatttaggatatgggcacaacatctaacatgcaaatgctgaccctcaaacatcaatgcatccttgtgattctttatcaactcttgacatgagaattgttattactggtattatctaaagttatagttatagtaaacaatttgtttctaatgcccaaatatgtcaagcaactcattatagcttcttcaatggcgaatcctgtgtggggatacttcaattccttaaagcttataattttcttcttcatgttaaactctctatcaatatagtgtgctgtgacaaccatgtcgcctatatttgaattgaagtccacatatcggatgtcagacatacacgcgaatcaagactgtaattcagcacgcaagtcttccctcatttgctcatacaagttaaaggcatcatcatgaagtgtttgacgccccacaactttgaaagttggctgcacggactccacccactccaaaaaataaggatcctcaattttattgaatggcacctctgcgtgaatgaagtatttgaccattagctcccagcttctcttgggatcaaacacgaaaccttccccagtctgtttcttaattgttgcaaggaagttgattctagcagcaccatcaatagctggacatgattcggctatgtgattaataaggtgacttctgcctgactttttggtggctgtcaatcttaagctacaatatttgcattgagtcttggggacaccatctatcatcacaacctcttgctgaaagtgttaccatactttagccctcatacgtgttcttgaagttgattattatttgtattattagtacctgaactctctgacatgacatatttattattgagtttgttcaattgtctgcatagaggaagaaatctaaaatgaagatagttgaaagaacatggtctataattatttttttcacacattgtacacgtgctacaagctaaaaattgcacactagaattccattgaccatagaattaatttgcatctcaaaatcatatcaagactcaatctgtaatgatttgttaaataatttgcatttatttcaacctatatttttgtatattatagaatgcactgtcaatcccagctctacctatttcatgggcaccttttagagcacatagtactattaacattctttattaaagaactcaaaactatcaggcagcaaatcaatataattaaaaaatcaatataattcatccagttgaactttctgaattgtgtgtagacatgtttaataagcctgcttgtgacaagattaaaaaattaacattcaactgctacaaacagccaaattaatacgaatctaattcaacccatagttgtaaacttgtagaatccactatcaatctgaagtatttccaaatcagtattaccaggcataagtcataagtcctgaaaggaatattttatatgtacagaatatttttatagcaacatttaattaagcaatatgcttgattaagttcctagctaattaattaatgtagcacacaaatatgatcttgattaattcatagtgtgcaacaatgtgagcgagtatcagcacagtgggtgcacatcaaagtttgtgggtgaataaaaggtcgacatactttcagttagttgcaaaaacattctgtgacttatgaggcaaccatatggactacatgaacaatcggattcactgcaagaaaaccctcatgtgtccgaataaaaaataatatttcttgcaaacacaacttgaaccgagaggtggaggggatcagcatggggtgcacctgcttataatgtactcaggcgcgaagaaggtgaagtcacgggttggcctggtgaggtactccggagacctcagagtggctgaggccgtgaggttgcggttctccgcttcaagcaggcgaggttggtgcagtatgatcagcagcagcaatggtagcaccatgagctaccaatttctttaggactccagtaagtattctaaaatcaaaataaatcagatttttgttcagtacatgctacatagtaatctaatgatgttccacaacagtagttgtctagttgaggccgtgataaatatccaactattgtgcatataatagtttgctgaaaagagatcataattttagactgttgttaggtacccatggttaaattagcacaactgatcttggaaaacatacaggtcattcatagttgtggccatggcaactccatacatgaaatcaatattcttatgcatgcatggtaatgaaaggtagctgcttgtaaatgcaatttagaacaaatcttttaagcatggcattcagcacacaatccacaatacatggaggagagagtactcgccggatcttgaagggagagagcattgccgaatcttgtggggagcagggacacacggcagcggatcttgcatggaggagagcaacagcttcttggcgctgacggagaggaaatggcgatctggcggagcggtgccaggagatgacgccggagcggaggacgagcgagaaccagtggagctgtagccgcttgcaaccaggtcgaagtggcgagcagcagcaacttcttggcgccgatgaagaggagatcgcgatctggcagagcaacgccgggagatgacgccggagcgaaggatgagcgggatccggtggggccgcagccgtagccgcttgcagcgagggcggagtggtgaggagcagcagtagcgacgcccattggcggcgatggtggtggcggcggcggaggtggaggagcggaggacgcgaggagcagatggcgcgaggaggaggatgagttagcgtctgcgtgtggattcagtccgtagatcagtcattttactcagcccgcatccaccccaaaccaaaccacattttttgtaagcccagtgcagtccgatccaaaatgaaatcccaggccgtttcaatccaaccaaaatgatccaaatgaggatccagcccacttaatccaagcaaagtcagtccactggtaggcctagctgtaagtttacagcccgcttctcctctctctcctctcttttctcctccaccttaatatttagccagtttatagcctactattatacttgctctccaccgaaataggaagagatgctgcccgttcgccgcctaaggttcgcgcgaacgtttgctgattagagttttcgactaatacagccttaggagtctgcttcgcgaccctatgggcttgggccgtctcggactctcggtagccccatcgtttgctcggccgagtgtgggcccatacgacccattccccactgatccgcagaaacccgactcctcgatccccagttccccacctcgtctcctcgagcgctcgccggcgggcggttcgccggcggcgcggcggagcacgtgctcctcttccccgatctcctcctccgcgtcgtggccgccaagctctagacgggacaggacgccatccatcctccaggttatccacttccgctcccttctgctggtaagcgctccgccgtcgcctcaatctgtcgtgggatcgagctccgcaccggtgcctccgatccgtacgtcggtctccgggccgaaggcggacggtggtcggggatggatcggccccaacgccggcgtcgtggccgggcttcggatgaatggtgtgcgggtgacgggcctgtagtccgtccgtccgtctgctgatctgcatcacgcggccaacaagtcaatagatagtgaactgtagtactgtaccactaccaatactgacatattctgaagacaaaacaaaccaattctgggaaattgtagacgagattccaagaaatttcgtgactcttgtctgattctgatgtccatcaagaggatgcaaagcaccaagttgggtcgtcatcagcacgtatgccaggtgacgggaggacacagtgacggctcatgatttggttcgtcgttccatcggcctaattttttccttttgccatacttgttagtagttgagctgtcttaatcggcctaattttcttcgtttagtcgtcttaataaaattattgttcgtttagctaggtgggtcgtctggtctagtgcttaatttgggtattgctggctttacataagtgggatatttaatattgttgctatgattatccagttttgtcatttcttgatgatggaacatataatggccaacatgtcaatcaatagcaggccccaaaggtagcaattgagaactgatcgagcttccaagaaattaaggtaggctatatggaccaatatattgcttgactgatagcaccgcttctccattcaggcatccactctgaccagctagcccattgagcaaaggcgagcaaacacattggttttatgatggcagcagtgaactcttccatgggggtcatggcgccactcctcaccaaacttgccatgctgctcagcaacaagtgcaagaaactcaagggaatgcgtaagaacattgagttccttagccatgagttgaccgaaatgaatgctgtgttggagaatcttgcagatatggagaagctagatggacagcagaagctgtggaggaatgacatccgcgagatggtctacgacatcgaggactgcattgatgtcttcatgtaccatcttggtgatggtaataacaaggatggcttgctcaggaagactgcacgcaagctcaggaatttgcgtgctcgctatcagattgccgacaagattcaagaactcaaggctcgtgtcatgcaggtggctgagcgccgtgataggtatgccaatctaggtgtatctacctcaagcattcccaaagtggtggaagttgatccgcgtctacctgcactctatgaagatgcaaaaaatcttgtgggcattgacggtccatgtatggaaattactcagtggctaatggatgaagtagagaatggttcgatacaacaacttaaagttctctctgtagttggctttggaggcattggcaagacaactcttgccaaacaagtatacaaccaattgaaaaaacgattcaatttcacatcattcgtgtcagtgtctcaaaaccctgacatggttaagctgctgagaaatttactttcaggaacaggatttcaaggctacggaattcttgatgaccatcaaaagctcattgacaccctcagaggacatcttgctaataagaggtatgtataaatccatagtttaactttgatgtggcattcatgttgagttcctatggatgtttctcatgttttctaatattttataaccatgtcttcatttctgctgtattgacttgattttgggcctgtttggatcatatcgaaatattgtctaaggttgacagctaattaggcacatttcccagattaggtgacagttcacttcgtagccacacttgtggcaaggttccttgctatggtccataatcagtactgacaacatgtgagcgctgcagtagacaaggttccttgctatggtccataatcagtactgacaacatgtgagcgctgcagtagaaggcaggccgccacgagataattagaggattagatatcccttgttgctataattaggggactagagaccccagttgctttctttatttatgtttccattcgagctggctttttttttattagagattcttgttaggggctatcctatagaaggatcagccatatcccattatgagttaagcatgtattgatatctctcttcatctcctgtgcacaagcacggccttgccctcgtgctggtcattgtcgatgcatgaggttcccttgctctcttgatccctctttgtgctagccacattaataagcccataacgttcttgctcattcagttgaaaaagtttggcacaattttatattggaaaaagtaagaattacccccctaaactatcgtggtcgaccgaattaccaccctaaacccaaaaaccagacattgctaaccctaaacttttaataacggacgaattacccccctcgactcaatctagagcggttttgtcctatgtggaatacgcgtggcaatccagtcagcattttgtttataaaagaagtgggacccacctgccatactctccccctcctcctctatctcctctctctcactcgtcccctctctcgcacgtgcgggtcgagcggcggcacgcgttctgcgcgcacggcgggcggtgggcggcgccacgggatgcggaggcagcggctgcgcgggacacggaggcggcggcggtattaatgagggtatcaatgagcttttgatcaatgagccaaatcttagtcaaatggggcacacttgggcaaattgttgcaaattatgttttcatatattgctacgattggatcctaaatgtgaaatttactaaataacttttctgcttcgatgttgattcttttgaatttatttttaataaattcctctagtattaatttgcggagtctactgttgccatatcctacaaaagaatttctctatttttctactattagttcaaaagaattatatagggaggcctcaacaaccatatgttaatctatgaaaaatatattcgtaggtaccttattgtagttgatgacatatggaacactcaagcatggagcattattcggtgtgcttttgctcaaaataatcatggtagcagagttatagttacaacaagaatcgaagatgtagctacaaagtgttgcgttgatttccatggtatggtgtacaagatggagccacttaatgagtttaactcacaaaagttattttgtaaaaggatatttgattcggatagtattcctgagcagtataaaaatgtatcagaagatatgttaagaaaatgcaaaggtgtcccattggcaatcattagcattgctagccttttatccagtgaaggcatgaatgtgggtaagtggaagaagattcataactttatgggttctgagtcggaaacaaatcccactctagaatggatgagacatgtactgaatctgagctaccttgacctctcacataatctcaagacatgcttcctgtatctaggaatatatcctgaagaccatacaattttcaaagctgatttgataaggctatggatagctgaaggatttatccatgagaaacctggtttggatctggaggaaacagctgagagctatttcaacgaactcattaataggagtatgattaagctagatgattatcgttccagtgaggcatgtcatgtccatgaccttatgcttgaccttataatatcgaagtgccaggaggaaaacttcatcactatagcatctaagcagcctgtaaagaatgtaacaaagcttccagttcgtcgtctgtgccatcagttgtcatacggaaacttggccatggaaagaatgaaactatcacaggttcgatcctataatactttccctgcgtttggctgcagtatgcagcctcctatttctatgtttgagcatttgcgggtattggaacttagggcctattctacatccgttttccttgatttgtctgctgtgagcaacctcttcctgttgagacacttgagtatcagaggtttcaggttaaagctgcctcagaaaattgggagactccagtgtttgaggacactagatctactaggcagccttttggttactggttttccatcagatgttatttctctatcatcattgtgtcatctaacagtttcaggtgatgcagtgctgcctaatgggattcagaaactggtctctctacaaactttgttgacctttaattcagggggtttgcccgacatttttactattgtggagaaaatttctcgatttaattcatctgctatcagactggcaaaaacacgtcgtttcaacaatggaggtcttcgttctaccaatggaggtcttcgttctccccctgcctcccttgagtttccaagtttcgatgatggttggccaactgaatccattctggactacctatctcagcatctggatacaccagcttcctcacattcggacctcttctcgccaaatttggttgcttgttcaccgcatattctgaattttgcatcgttatggcttcagcaactcatcatccgtaagaacattcgcaatgtcccatcctggctgtggttttctctgaagctcacaatgctagagcttcgtgttgaggagctcagttgccgcgacgtccaatttcttgctgggctgccctgccttgttgacctcgacttgactgctcaagctacccctgagaacatcatcactaaacgcgttaccacgcgtttgggaagaatcacccataccgacaatttcccaaagctgcagaaatttgttttaacatgtgatttggcatgcctgacgtttgagccaggggcaatgccacagcttcagattctgaagctagatgacaagaagccttctaacttggaggaagggcatggcaccagtggagcggcgcaacatggcaaaactccacttattggcatcgagcacctaccaaggcttgaagaggtccaagtgacaagccactccagcaaggtgcctgcatacagggacgccgtccaaaggcatccaaggtttcaagacatacgtgccacgtttaatatctataattgaagtacaaggactcagaaaatagcgctgaaaggtactcatgatatccttatactctgcgtttcttcaataattaatgtttgctgctgttttatgggaatatgttagcttgagtattccccataactgggagaagaacgctacgacatgaagcgtaccagagaagcgcagccacagttgctgctgtcttgtttgcacgacctaagcatcacactttagtacgattaaattttggggcttgtatttaagaacttgtattatgttgcgagacctgtctaggttacttgtatttgtgtatgttcaagtccttacatggcatgggcacaagcatggtctgtgagactttgcacttatattaacaaacttctctagccattctctgttgcagacttgcaatatctctcatttaggctattattggtcaaaacatgatttttgtcgatgaatgataattccatagacttgtactttcacaaaacctccaaaaattcaaggtcgaccaatgactggttttgaagtgggggaaattcaggttttttgatattccagattggaaaagcgaactttaccatttgttagatcctttcacgtccaatttatctgcttttacaggagcacactagttaatagagtgatcagctctaaaaacagcactaaagtgaggctctgcacttacaaatatgaaattttaccacacaattttctctccctttttttaggggagagtagcatcttttataagaagagaaacatgttcaatgagagcatggagaatttatttaaagttgttaggtcgcatgtaccaaccgaaactttgaatgccccctaaatgccagctgaaactactctctgcaggctctacttaatctccttgttgtgtttgtgactgacttgacacaaaaacataaatgcacacaatatccacagctgacctaagttatttcttgttatgcagacgctctcggcgatgaatacaagctactcaagggggttcaaaaagagattgcaatcctgaagcatgagctgagctgcctaattcccttctccagaagcttatcgacttaggagtggaaggacaaggtgcgggaactggcctacgatattgaggactgtatcgacatcttcctgcaccaacttcatcctagagaggacaaggatagactggtctggaaggcggtccggaagatcaaagcaactatgtgcctgcccgccatcaaatcgccctccaaattcaagaactcaaggcacatgtcgatatacatgatcgatgtatcaacctctggcgataggttcataaggatttgattcccgattgtcgttgctttatgcagaagctggaggccttgttggcatttgtaggttgtttagggcctgtttagttcgcgaaaagaaaatttttgattgtcacatcggacgtttgaccgaatatcggaaggggttttcggacacgaaggaaaaaactaatttcataactcgcctgaaaaccacgagacgaatcttttaagcctaattaatttgtcattagcacatgtgggttactgtagcacttatggctaattattaactaattaggctcaaaagatttgtctcgtgatttcccccctaactttgtaattagttttttaatttatctatatttaatattttatacatgtgtccaaagattcgatgcgatgtttttaggaactaaacagggccttattactactagagactaagatttaggatagaagactttagtgcacctcattaaacaaggaattattgggccagagggtggttggcagggattgcaacttcagaatgaaattttggtaattttgcctccaccggcaagcacatgcatatattgtctgaaattttctcctttttttccaaatttttgtaaatttgttcaaagtttattcaaattcatttataatctgttaaattttcaaataattttgtcaaaaagtaccaaaatttcagaaatttcgatttccactgaaattctgaaattttggctaaaaatagaagtgtaaaccatggtggatgggtgtatgagacgaaatttgaatagaaggtaaataatatgaactgtgctagaaggccttatgtttttatataaattttaaatactatgcaaatataaagctacgtgaactcgaactcagatcagtttgactacactgacttttaaaatcgtttttaattggggtaagctataaaagtgaaacaggagagcctagaaggactagggctgcaatcggcaaaaatacccaaaagagaggataggaaaaaattttgaaaatatactgttcatcaatttattttgcaaaaatataccggattgtgaaggtttttgcacaaatataccttcggtatcgctgtttggaagagcgataccgaggttcactactagaaagtgcgataacgtggcgaaatcgcggtatgacatagcgaaagcggagttgagctggcgatatcgcgcaaagggaaagcgagaccgcagcggtatcgctctttggtagggcgagagcgccacgtggagaaatcgccgatttgggaggcagtgtggcgggcggagccatcgctctcgctttgtcgttacgcgaaaccgaggtcggtctcgtaatccgaaagcgcgagaccgagcgtgacgtgatagagaacggcacgcggtatcgcgctttgcgcgcacgagaccggtgacgccgcatgcgcgagagcgacgaggcgtgggggagcgtagtgggcccgtggtatcgcgctttcagcgcgtgagaccggtgacggtatcactctccgcttgagcgagagcgatggagcctcgtagagcacagtgggcccatggtgtcgtgccttgtgcgcgcgagaccgctgtcggtctccctctccgcatgtgcaagagcgatgcagtgcggcaaaggtgcgctgtcacgctttgcgcgcgcgagaccaatgtacagagcgcaggaaaagagcgcagaccgacgccaccgacacctttattttccatctctctttttctttttgctttttgcatgggttctgatagccatctccctttcctttctggaaatgggcggaatacctctgtgcactctcttatcattttactattttgtagtcacatcatgtcggccacatgtgtttagctcgtaaccgctctattcgttcgaatccaatgtgctcaatgcataaaatgagaggagaggagatggtcctcacagaggaagacagaaaagaagacagaaaagggagtgaactgaggaggagaggaagagcaagaaaagagaggagacagtggagagaagaaataaatgatacgttttttctattagcaaaaatttgtacggggaggatttagaaaatatcagttcacttagtttatattagtgttagttaatattcatttttaattatgtcagagaaaatttgagctatatattagtttgtacattatgattttttttgttaactaataattttccgtacgacagttaacacaaataatactctcactaattaaattaatagtgcagttttgatgttactcgtgcggtttaaattggataatacttttattgtgtactactgtgacttaaattacacactaatttcatttcacaaagatgcaatcatacgcgcctaaaatggtctcctctctttccaatcacgggacatttcacgtagaggcaatcatctacatttaacggtgaagattccgacgcaccgaaagtggcgtcatctctttctaattattaaagaaaatagtgaagcaaccagtgccgccaaaagtgacggtatccttttgtaattattaactttaacagtgaagcaggctaacgcttcgaaagtgccgtcatctctgtgtaattattaattgaatagtgaagcagtccgacgcgccttcttctctttctaatcattcacaattcctgtgtacaacccattaataattcagactatgcgcagcttcttcctatcccctataaatagcaaccaaacctagcacacaactacatctcttcttcataaacgttctgctggttccaactgcgtgttgtatattcttaggcccgatcttgtggcaggagctgagtagctggtgaactcgctttatgttgttcattcactcgctacacggttcctgtcccaagatcgagtctgtgaatatgcaaatgtgattttttttaatagattcttacacccactctttttttaagttccaacatccgtttgtgaatatgacctactactgcaaattcataaactcggtgttgcatattcataggcccggtcttgtggtaagaac

SEQ ID NO: 23419 - DNA, 10025 bp, Oryza sativa
atatatacatatttctcaagtttattaatgtatatatgttgcacacatagtaaaaaatatgaaaaaaaaagtttatactttctacatagcaacggcttaatatatcacacatgaaatattaacgatttgcatcgggtattcgcatcaaatgtaaacgcatttagaggatcgctctcgcgctccgggtgcgcatttagggtctctctctttcaaagaagccgtcgctgtcgcctcctacgcgattagtagccgattagcaggtgggccacgacgcaacggtatcgtcctaggagagagcgataccgcgcgcgctctcgctcgcgcatagcttgagaccgctccgggcctgcttcgggccccacgtgcgtcagacgagccacgccgctacggtcttgcgtaagtagaccgtaataccacacgcgctcccgctcactcaaagcacgagactgcttcgtgccccacgtgcgtcagacaacgtcggacaacccgcgctatcgctttacgaaagtgcgggaccgcctcgctcttgcgattttcaaatgcaacaccgatgcattagcactcccgcgatttcaattagcgatagcgctgcggctttcgcatgtagattaagtgatatcgctctcttgcgacatcaaagtgcgatacggcccctaatcaacctattcttgcaattttgatcaaaaacacgtatattttcaaaaaaatttcgaaaggatagctgctgatgaattaggccctgtttagtttccaaaacaaaattttttacactgtcacatcgaatatttggacacatgcatggagcatttaatgtatggaaaagaaacaattacacagattgcgtgtaaattgctagacgaatcttttaagcctaattgcaccatgatttgacaatggtgttacagtaaatatttgctaatgacggattaattaggcttaataaattcatctctgcgaaatctgtaatttgttttgttattagactacgtttaatacttaaatgtgtgtcggtatatctgatgtgacaaccaaacccaaaattttttcccaactaaacaaggccttagcagcgatataatagacgctgacaacgaatcagaagatgttggaagaagcaaagaaaggctctgaaatttttacatggaaaaaagagcaaccgcccaagaaggatggatcacgtagcttgtaaacctgccgatcctgcttcttcaccatgacgacccaatcgtcctcaccatcatccaccagagagtaagtgcgatgaacaatacgtgctctgcccacctttcccatggaagcagcagcaatggaccggaactcgaaagaagcgaagctccccttccccatggcgcacagaaggttgcccggaacaatgcggcacttggagttggatgccaccaccacccgcaacgcaacgatggtcagctccttcttccccgtgacggccgagatcccgaccaccatgcggtacaccgtaacgtcggcggcggcggaggcgacggcgacgaagcggtggtcgtcgtcgctgccgagaggcaaggcctggccgtcgaaaggcaggttgctgtcgtgcaccatctcccactgctcggtgtccatgtcgaaggcgcaggtgcccttgtcttcttgctgctgctgcggctgcagctgctgcaccgagaccgacaggaggatgtgggagccgacgagggcgtacgccgcgacgcgcaacttgggcgggtcgaggaactccagcgggttgaggcggcacgggaagagcggcggcgatgggagttcgcgccacacggtgtggctgaggtcgtcgaggacgaagaaccatggctcgaaatccagcggcctcacgacggccggggtgcgggagagagcgtagagcgtgccgccgccgactacaccgccgccgtcgtcagagatcgagatgaggacggggttcaccttggggaagatgagtcgcgggccgccgcgctccgtggatgtctcggggtcgtagacggtggtcaactccacgccgacgcccacggtgcgtgtccccaccgcggcgaacgacatgccgcggccgcggccgcggccgctgccggtgttaagcagacggcgggcggcggcgcaggcggcgacctcgattacggagtgggtggtgggctcttcctcgactccgtgcgccaacaccatgtacaccggcggctgcttctcaggtgaggcccccttgttcttcttcttgttccctggacgaacgcggaggagacgaggtaccggctccggcgccggcgtcggcgtcggctccggctccgcgagtttcttcctcctcttcttgtccggcgtcaccatcttcttccctcgactggattcggatttacgtatcaaagacgtgatgaaaggaaaccctatcccagtggggttgctttcgtcggccggaggacagcatgggcctagccgagactgggccaaatgttacaactccactacttgagactgggccgccaaggcagtgcaacatgcgtctcacctactactaaactccccgtcgcaatcaggattttttttttctttttggaacgttcgattgcgagtgcaacaggcgaatgatagcattgctgcgttcttttttctggtttttaagcatgctcacttctacaactactacagaaacgaggacgacatccctccaaattacaggtatagaccataactgttcacgcatgaaaaaaaaaagttaacccgagagatggatcaaaggcttcttaaggactgcatgtaaaaaaactaattttgcatgcgggcaagtaggaaatagattttttttctgcaccttttttctcttcctccttctctccaccgcaccgtctactcttctccagaaccagggctatcctattaaatttgaggccccagtgcaaagtcgtgcagtagtaaagaagaataaaaacttaattgatgatataatacaacaataatttatactctataatacatttcatagcaatgtaaaatggtctaaaataatatacatgtgcatagtatatttcctattccaatttgttgaagacatgtcttcaaaattaaaatacaggatgtatctatgtaaggataaaaattgatttagtgtatatagtagatgagcctaaaaacctaataatccatacatgatacactaaaattagagaatagggattagtggattacattacctgattgctgattagagtagacgatcaggccgtcaggcgttgcagccgacaaggactccggcaggcaggccggccaatgatgggtcacagccagcaccagtttctcagttctaggtagcgacggcgacacggcatcaggacttagcgatgacatcgcggcagtgcgccagatgcgaacggagaaagagtcagggaggcgaggcgttgtttcgttttctaagcgatgccgcgatcaagaggcggaggcccatcgtgccatgccacaatcaaaggcgaaacgtgggatgctaattggcgtgggcgcgccactaacggaactgatgagcacgccagcctacccttctgcctttccaccacgctatttcttgttttttcgttatctttttcgctttatctttttttcttccttacccctcgcgtgtttatcctttttttcgtgttttttttccgatttttttattggtagcacacatgttttcaaaaatatttgagttaaaagtttttaaatattaacttaaaagtttttcaatataaaagacgtttcaaatctagagttgaaagtttttaaattttgagttgaaagtttttaagtctggattgaaggttttcgaatctgggttgaaagtttcaaattttgggttgaaagttttcaaatctgggttgaaagtcttaaatttgagttaaacgtttttcaaatttgagattaaaagttgaaagttttcaaattttgtctaaaaaaactcaaatttcgagttgaaagttttcaagtatgggttaaaaagttttcaaaatttaacttcacgtatagttttcttttcaatctattagtaaaagaagaacattaaataaaaaatattatctttattatcatcattatctaaaactaatcaaattaaattagttacgttgttaatgcataaacatctccgggaagaaaagaaagtgcgggaaaaaagaaaatactaaccgcgtgcgtgccaatttgattcaccggcgcgtatttaatgcttatcattattggaagctaattacgtgaagctagcgcctattacaccatcctaatggattagcccattagttaccgataaatcaccacttgcatcagtgcgtgcatgccctggtgaccatctctgcatcttgcgcgtctgcgccatttagcaaaaccgaggcgaaacgacgtaaataaaacatgaaaaaaatcacagatttttagggctaattgggctatatctatatatatatatatatagtgttggagttttgggcctaggggcccctgaaaattggggccttgtgcgggcgcgcgggccgcacagccccagggacaagcctgtccagaaccatcgttcgccgtttccccttcctcctctcctcatctcttccttttccctctctcaccccctcgctcatttcctcccttcctctctcacggtggtggtcggctcatagggtggcagaggtggcggtcaacgggcactgcaaatctggcaacgactctccccgggaagggcggatccgccaccggcgggctcagaagggcggatccaccctcacatgcagcgggtgcaagcggtgatctcaggagtggccaacgacctctttcctccatgacggtgaacccggcagctgtggacctggcaatggggagctcgtcggcagcagatctggcgctggggagctcgacgacggcgaacccggcgggctctccccctcgtgcgcacgtggatctggcggtggggagggtgttggcgacagcgagggcgtccgctcttacctcctcaaggccatcaagtacaaaaactaaaccggtgtgctcctctcttcggcgtctttggcttcgagccgccaaccgggacttcgcctaccgcatgatgctagctgtgttgttcctctgcagcgacagcgacacccctgtgaaacatggatgtgggaactagaggccagcgcgaggggtgccaaggctggggagacggattaaggatggcagcaatggccgctgagcactggagctgctcgctattgtagcctacccatattgtcatgaaaataagactatcacaaaccgcagccacgcctcccgttgtacctggcctccccgcggtgcatgccgtcattgcctacacactgccgccgatgtttgtcgttctaccaatgccaagggtcgtctctccgctttagattgattagacatctatgattaatttgacgattggattgaagatgaatcacgaattactaaaatacccttttaaatttggtggcaaattccaaacgtgccctcgttcataagtatagtatattgtaccgtaaaagttccctttctttattgctcatttttgtttgttcactatgtaactctctaccataagcatctttcaacgttaattgaagctaagaacataaagtgtcagaggcttagagctggtaggtgcgtgctcgacttaatcaatagtattgcctattttctgctagctcagcatttgctgtcctagatttgggactcctaattagcaatacgttgtaccggttgatcaaccagctattctatgttgaagagcgtgaaagcatctaccacttgtgttaggtcagaagattcttcctcccttgaggatacccctcaagatgatcttatgcttaattcggcaaaggaatggaatttgtcttccattcgtaactatttctttattgcataggcacaagagcgtgccagtttctattattaaaaggaagaagaatcactctcctttcgatgttaaagacaagagttgattaaattaaatttctaaagttaaatacgtttatgatattacttcctctgtttcacgatgtaagactttctagtattgctcatatccatatagatattaatgaatctaaacacatatatatgtctagatttattagcatctaatataaatgtgggcaacgctaggtattaaatctacctgtaccatctctttatctaaaacatttgtgaaattatttatgatcaacgtttcaaaagtctaatcgaataatacaattaaacatcaaatatttatgatggatacatgtacgtacaattcgttccaaccaacagagggttgtcatgtgcccggcggttagaacagtggtgggattatgttgtgatggttagccggtcaactaaagaaggcagcaacatcatcagtcattattcgtggcatggaaaattactccatctagctcgcagataagtgaagtgttttttaatgtctgcagtcaatatgtttaaatcttgcccattcatattttttgtcatatctcaaatcattttttttaaaactgtcgtggccagatttatcttcaaaattagtttcaaataatattataactttgctatattttcatatgctttatactcctacttcttaacaatgaaactagtgttttggtgatcagttgctccgtccatactccatagtatcacttattcacgacaggaggtagtgtatcctatcttactaaaaggttacaacccattaaattctaaaactcaacatacaaaagatgttacatcattatgtactaacaattattacacttaaacattatgcatgctatattatctatattttgtaatttattaaattttggagttttaaaatagaagcatgttaaattatcatcgcacataattcacataatatttcaatatatctctccattattttttaaatatactatatacctatatagttcatcctcggttaatattatttttctctcctcttatcaagccatatcatcttaatttttttaacccgtagatgattaatctatactccatattatctatttctttttttctttcataaaaccacaccgacttacataaatttatgttgtttagctattttatacattatttttacttatcggatttgctataaaacttccaaaagtttttgcccccaaaacttttagataaatgaccatccgatcgcctcgacatttgtgcatgaagggaaaaaaattgctagaaataaattttcacacatgtcacgcgtaagattttagtgctagctaaccagggcatggttgaatgcaagtttattatatcgtagttacattgtagttacagtgcagtagttacgcttcaaatatagtatagttacacttacatcgaaagttttttactaaaaaaacttgtggcagttttttgatactacctttaattatttttatcattctaaattcccgcagtaacgcgcggggttttacctagtatgctaagtaatgctagatgtagaaccattaagatttgtcaaattgatcctcgtgggttgtggccaaaatgttttatgatgacatggtcaacgagagaaagtttgccagcagtttctttcatggattgttttaagagagagacagagagaacatgcatgggcatcaccagcaataattttaagattttcaacggttcttttttttttggatacggatcgacgtacaatactcttcacgtaggaaagtacgtgaacgtaccaaattagctgtcattcaaagaaaaaaaattaagacaattaattagctagtatcttatcttatataactggagggttgatctgctagctactgacagtcaaacgcagtgccaagatcattgacaagcatagatcaagaaagagcagagacagagagggattgatcgaggcatggccgtgaacatttcgactggggtgatgaactcactcctggtgaagctggaagaggtgtgtcgatacgacttgaaagagatccaattttctaccgaatttgatttcaagaacaatatatggcacttgaaagaggaattgagctgcatgaatgctctactacagaagctgcctaacatggaggctctgaatattcagaagagggagctgaggaacaaggtacgtgagctagcctactttgttgaggacagaattgacaggttcatgcacagttttggcactgtagctgacaaggccaccttgctcactgacacgatggatctgatgctccctatcttgtttgaaaaaattcacgaaatcaaggattatgttgtcgaggaagtcagaagagtagagagtatatacaatctcgacgagtctattagctctaacccgaggcagatagaaatcgatgatatttcacctgtcctgtgtggaaaggcaaataggctcgtcggtatcaatgtcccatgtgaggtgattacacagttgttaatggaggatatggaaggagagtcagtacagcatcctaaggtggtctctattgtgggatttgggggtcttggtaaaacaacgttggccagccaggtctacaagaaaattcatagcagatttgagtgcgcggtgtttgtgtttgcatcacgaaaccgtagcacgtcaatgattttaaatgacattctttcgcaactcagatatgacggatcggccgatggcataaaaagtctcatcaatgcaaccagagaaaaactctcttgcaagaggtatgagagcatatgcttctatggttctatttcgttgtgtcaataaaactatatatcccaataggcaatggatggatcacagtaacttggtgtaccatcaaaaagtctgtgtagtaaacagtttggtataatatttcatagtactttggaatatatttcctagttagttgtttaaagagaattatattccttgacactcagttcagtaccattcaattatttgcatttagttactctctattccttatatacaatccataaatcaatttcctagacatgttaatggaccatatcagcagatatgcttctgaaaaaaaaagggccataatggccttatggacaaagatgcctcttgtagttcccaacattatatgacaaaagcttgtgcaaaatgttccaatgtttttcttcaagtttcagttgttttggtaaatatatattcttctgcaaactatgaaagaggaaccacatatacaaaaaaaaaacacacaaatattttgttacagcaaaagacatatgcgagatcttaatatatttcctaggtaactacataaatagtttcatagttcttttaaaaaaattatagtggaaccagttcgttgccagccccatcttatttggaattattgtaagaattgccaagtccaatggcctgggatttaaatagttgagaaactcaccagaatatcaattcaactttacttttttttttaaaaaaaaaagccaatacaacagtcctatataaaaacaggtaaaagagagcgaccatggggtaatctatctcaaattgccatacacaaaactcttccatataaaaccatatgtattatatattatgtatacggatcttgtagagaatatctcccatttgtgccgtgaggcaaagataattcatccctgtcaaagtttaattttacattctccagtattgaacatataactcaacatgcatgatcctgctcattctcagtgaagtttctttggaaggcctcctgtaaaacaatatctttaactgatcgcttttgttgattgctaataatatatagcttaggatattctactcacaaaaaggaactttcataacccaaacttcctcgcaaaacttgtccattccccatttgtttaatactttcttttcacaatactcctacaccaccttttacttttatgaaagctcttcaagaattgttatcctttttattcagaactttgaaaaaagtccaccccttaatttgcatctatttgtttatcaacaaatctacacacaagtcagaagaattattttttagttccacaatccacaaaatcagccgatggccaattcttgaatgagaggatagttggtcctagggaatatatcttctttt

SEQ ID NO: 23420 - DNA, 13966 bp, Oryza sativa
  unsure (1)..(13966): unsure at all n locations
nnnnnnnnnnnnnnnnnnnnnnnnnnnnnnnnnnnnnnnnnnnnnnaaatccgccgatggccaattcttgaatgagaggatagttggtcctagggaatatatcttcttttctttttaacatgctgtgatgggagatgataattttattcccggtaaaagaacaaattctatgcaaagattacatgaagaaccatcaaataactgaataactaattttgcctttttatcaaacaccacaacagattttaaccaatgttttctagcaactgctatgaaaaaaaaagaattatatgaagaatatcataatagtcacactagcacaaacttactacttgatgagtgatttcatcttcaatgtaaattatgttgagtataacattgaactaggtttaaaattgcaaaaataacgacagtaatagcatgcagcagcagcaacaacaattgaatagttctttaaggttcttatagaggtacattatacttgtgagatatttatggtacgtacttgataaagctactgggtggtaccatatttttctatgtgaaatttgatacttcataagtaccaaattataccacaaataaactacaaatttaattttgtacctcctaatactgttgaacataagtactataaaaagactatagtttgcaagatctgtactgttgcagacaagaacaatattagtattgctaaaacaatgagtaagtaggtttggactttgaactaggtactatatcaacaaggactacagaaggtcctttagataatactgttggatttgagtgtgagccactttgtttcttgatgaataatgaatttcttgtcacaaaatatttctaaaataaaaataaatggataaatttattcttgcaacaaactgataatcatcatgtgtaattcttgctgataataatcaaaatgcctcactaaataaatgttctgaaaacttaatgtctaaggtttaatactaaattatcttgatttattacactatcagcatgttactggtagtttctaattttgttttagggcattcttttgaaacctataaatcttgttgttttcagtaatactagccacctagtcgcacttcgcgcgactctgagcttcgcataacctgtctgtattagtgggaaatataagcatttctagtttgtttagtaaagtttaagattaatggaaagtgttctctttcaatcatcttattgtcaaagttaaaattttgaattgcttagtttccctggttaactaaaagtgcttggattttcacgcattagaatcaatgtctagaaatgtttatatttgtatataaaatttgaatactaaaaatatttattttctaggaatggagggagtagttacctttagaccctttttagtgattattatgaagaggggtaaaatttaatggaggaaggttgtaaggttgaaattagaaagtatgcgaagaaattaaataggatatgcttgtggttggttgagatgagagagtgggcatagaagtagctgcattttacgataaattttgattgtaaaagataagtatatttaatataatacgaaggagcaataacattaagttgttataacgatttcgtgtacacgtgtttattcatagtgactagtgtgctcatgtgtatatgagctcgtgtgtttgtattatgttttttaaaaaatggtacttcatggtgtatgccaattaggtgccatgtcaaatttggtgtagtgtgttccaatataaaccaaaattatattagagtattttttttaaaagagaaattatattagagtatttgtatatgcatataaactgtgaattgagaatatttgaaaattacatataggcatatatacatatttaggacattccatccacatgtgaccacagaatgtctgggaaattaaagaatgtgatctcatgctaaatttatcacaattcccttattaaggataatcatggcggccaataaattcagaacgaatgtacggctgagctagcttcatttaccttttttttctttatttgataagaagtttaatgtttgtactatgtaaaaaaaaaatctaggtacatgagttatctacttgttgagacctttcatctggaagcctcttgattggcctgatggttttccactcacatataagcctcttaattggtccaacataaattacctatatagatgatcgaacggtgtgttcttttacaagatccatccaacggtccatgttatttagattacgtgtctcatcctccttgcagaaagcttgttgctttcacctagtaagatgttaaataacaatatcaccttgaccagttgaccatactgctgaatatgctcaactctcataaccgagaaccatttgcaatgggcgttacgaatctgtactaatattttctgtcgcagcgcatgttctatacccttgctgcattcagtcgccgtttctatctgcatgtagacttgatagaaattttaacagtgtattatctggacaatataatgcccaggattggtgtagatatagatatactaatgagtctgaaggccagaagttaactatatggtttataaccaaaaatagctcgatatggttttctatagatatctatggttttccgctattgattattgctatgttttttctcaggttcctagttgtaattgatgacatagcaagcatagaaacatggaacagtattagtggtgcatttgtcgaaacgtggaacagcggaagcagaattattacaactacacgaagaaaggatgtagctaatgcctgctgctctagcttccatggcattgtctataagatgaaaccactaggttggacggactccagaagcttatttttcagaagaatatatgggtcagataactacagccctgaacttgaagaactcataattgctattgatattttaaagaaatgtggaggagttccattggctgtagttgtcatagctagtcttttggctagtcaagaagaagttaacaaactggataattggttgaagataaaatactctatggggtttgaactggaaagaaatcctaactctaaatggatgaagcatatccttaaacttagctacaataatttatcttcggatctgaagacgtgctttctatatcttcatatgtatcctgaaaactatgacatcatgaagaaagactcgatgagacaatggatagcagaaggatttattacccaaaaagataaccgagacttagaagatattgctgagagctacttcagtgacctcataaatagaagcctgataaagccagctcagtttaagcatggtgaggttgtctcctgtcgtgttgtgcacaatttgtttcttgatcttattgttgagaagtccacggaggaaaactttgtgactgtaattaggactgatcaagattgcttaagacgacataattttttgattcgccgactcagctaccaatcaaaccgtggtaacttgatccaagcaagtgagtctttacatcaagtccgatccgtcatttattttggggatcggctgcatcagcgtggtgaaagcttgcctcgtcttcagatgtttgaagccttgagggttctacatctgagaatggaaggttattttccattccgtgcaacgtatgatttgtctcctgtatgtaaccttttccaactaaggtatctgaaattggaaggtaatcgtttccagtttcctgatacaagtggggaactgcgatatttgcaagtggttgacataaaatgcagcggtgatctcgtactcatcggtgggtttctgagtgatgcttgtttaccatcattgcggcatctgagaactccatggaatgcagagctcggcagggggattaacaggctgacctctatacgtacacttgaagaaattaacttctgcaattgttctgttgaaaacatccgacatcttgggatgctgaccaatctaaggacgcttggtgtcatctacaatcgccgtcgaggcaacgatgaagatgaccagacagatatggtaaagtttgctgctcttgccacttcccttagggaactgggcagctgcaacgtccgctgtctagatttcaatgttgctctaatggagcacagacaaccacccattggcttcttgtatagctggtttcctcctccgcaattccttcagaagtttcaccctcacatgatattcttcttcagggttccatactggatacaataggttgagactttaactagtttacgtctcattgttgacaaactcgagggcgatgatatgcgtgttctcacaaggttaccctgcctcgcttaccttgacttgcaagcgatcgaggttcctggcatggagattattatagacagtgtatcattttcagctctcaaagaactaaagttgatctataaatcttccagtttgtcgatcgagccaggagcaatgccaaagcttagaattatgcatctcattgtttttggccatgcagagcaagataccaggtctctagttggcattcagcaccttcacaacctcgaagacgtcataatcacatatgattacaataatgtgatggttgcatttagggaagccctcgataggcatccgagggttggttccatccaagtatatataggcgcatctccaaaggcttcccaatcccattcctgagtgaatttcgactatctgttggatatgcttaaggttagggaaactacctcctgcaacaacggtggtagtgtggcacatataggtaattaagaacaaagggctgcttctactgttgtactggaaatgctagagagccaaggagaatggtagtagaaagaaggcacacatatgaaagtgcatatgactattgtgttaacagatatttttgtcttttccttttttattccctcaagtgttttaattgttaaacttgttatctctctatattcataactggccgcactccatcttatctttcccgattctatttacttaagtcaattgagtggagaagggaggtcttgtgactatatgtgccttaaccttgctaattaattaatcctcgtgtttgcgtcaatagttccctcgataatatatatctttacttattataaaagtttaaggtgtttttatctacaaatttcatacgttactgctgatagctcacgatcttttctcgactccgttcctagcaaacaaaagcaatagcacgatttttttttctgtccgactcagttttcagtcgtcattttttttatccgtccgatcatttttttacgcgttttttgtgggcctggtttttttctttctccgcatgtcatttttttcatctgatttttttagtgggtcgcggttttttttggttccgtttttttttcaatctcctccatccgatccgcacgattagagatgtttccgtcgtgcaagggcgaaaaaaaaaggaaagtccgacgtggagaaaaaagtccgtaaaaaaagcccgtaaaaagggcgataaagaaacaaaaagtacccgtaaagaacggcaaaaaaaaaagaaatctgattcttgcgtcattttttttccgttgtttccttttcttcgttagtctatttcttttgctgttttttttccgtgaaaacgcttgtccccgggcgaccggcgcgggtgagcccaatcgggtgctccccccacgcgctctcctccccacatgctactgttggttccactcacttctctcttctttttccacaaaagatgtttcacctagtgtacttataatgttttactatttattgatctagtgttgcagtgaattaaaatactcttttacaacaaaaaaaatccacatattttggaaactctctattaaggaaatttggtttattttttgttccaccaaaaatgtttcacctagtgtactcacaatgtttcactatggatagatctaatgttgcagtgaacgaaacattccattgcaaaaaaaaaaacccacatattttagaaaccccctattaagggaatttggtttattttttgttccaccgaaaaatgtttcacctagtgtacacataatgtttcactatgtatagatctaatgttacagtgaactgaaacattctttcgctatttgctgaaacattgtttttatataaggtgaaacaacacccgatttaaacgagtgaaacattttcgctctacttagtgaaacaattccgatatacctggtggaacatcatgcaacatttaaaaataattcaataataagctaattttttttcaccggaatatatccatgtgtggtcttgttttgaaaatttaattgcaacgaatttaatggtgcaatgggatcatgatttggatatgtaatttaggagaaaaatcattttaaattagtgttgcacgtaaatcggacgcagacgtccgtcatgctgacgtcagcgcccgatttccccggcgccggatcggccgcccgataggtaggcgcgtccttttttccgtcctttttttcccgcctttttttcatccgccttttttttccatctgctggttttttaatttattttccggttttttcaccttttttttcactattattgtattatttcgcatgcggtaaaggatttgttttttatctgccatattttttcgttgctcggccgaaccctagcatcgccgcctcatccatctgtctccccatgcgttccctcttcctgtcttccaagcatagtcgatctatcccccatgcgttccatcttccaattgattgcaaaaatcgatcccccactactcccttgtattcacagaatttaatctccatttaaaagtcaccattcttatcccgagtgaggagataaagtgtatcaaaaaccattaactaattttaaaagatcgagaaaaattcgactggatttgatggggaggatcggttttggcattgcacagacacgagacccttaaccaatattgaaagatcgagaaagattcgacctgatttgatgaccaggaagattcgaccggatttgatagggaggactggttttggcattgtacggacacaagaccctcctccggggatggaagacggcagtccgctatgcgagtgggaccgatgctccactcatgggttgggtcaaagagagacagaccaagcaaagggaggtagcggtccaaaacaaaagagtaaaacgtatagcgatccaaaaatatttttacccattgcaacgcacgggcatttttgctagtatacatatatatatacatatatatatatatacatatatatatatatatacatatatatatacactagcaaaaatgcccgtgcgttgcaacgggcaaaaaaattctaataataatatacatttttcatgcataatcatgttaatgacaatgtttctattttaatgagcggcttgtttgtttacaaacagtatttttttcttgcgtgattttctcaaaccatttttcagaaatggcacatttcttttaaacagttttttcctaccatgtttttttttgctttttttacttatgaagaaaaccatatttttctccttttttttttgcttttcttttctcgtgtgttttttttcttgttttctggcacgtttttttgcttgtttttttcgatggttcttttttgcttttttgcaatacaggagaatatatgacaaaataaagccatgtagtagatggcaaaaaatcgatggatcctatccgactgaagcgtccatcaatttagcttttttctgacagttttttcagggcgatttttttaatagacggtgtttttttcttgcacggtttttaaaaaccatttttttataaatggcgtgttttttcgatagttttttccttgcgcgtctttttatttttatcgacaatggaaataatttttctcgcgcttctttttatttttttattgatgatagagaacatttttagcgtgcttttgcgctttttttttgacttttgcctcacacgttattttaaccgtttttattttctcatgcattttctctttttaaatagttagattagagatagagaagagatatatactggttagaaatcagattttgtttcgccgtttctatttttttctctcttgcattttttattttatatgaaccagctttttattttttgcgaaccaatttttcaccattttcttagggaatcgaacgaattttttagatgtttttttgcctttataggaatcaaactttttttctgtttttaaaggattcggatctagcgttttttttgtcaccacttttttttttttgccttttatatgaatcaaatcttttttccgtcggatctacagtttttttcgccagtaaggaaaaaaaaacttttgttgttatttttttctttattttcttttttgtgcggcttttctttttcttttatgcacctttctgtctttgttctctttctcttttattatttttttaacaaaaacgacatcaagtagcttgttgcaagattatagggacttagatgtaaatataaaaattacagggactcaaaaataaaagtacaaatccaaaaattaaaatcatataaaaatggaatgctctcgacatatagattccgtttttgcaaacagatcttcaatccggcacatcaatttttttcaccaatctaagtcagactttttttttggcttttatttttctttttatgcacctttctgcctttgttctctcacttttattattttttaacaaaaaagacctcaagtagcttattgcaagattatagggactcagatgtaaatataaaaattggactcaaatataaaagtaaaaatccaaaaattaaaatcatataaacatagaatgctctcgacatgtagattccgtttttgcaaacagatcttcaatccggcacatcaattttttttcaccaatctgagtaagacttttttttttggtttgtaagagtgaatctgatataggagtcggacttttttttcactttttttttcactgttacggatataggagtcggactttttttttttgttttttatcggacaaacctggttttttcggtccggtttttttggtttttttcgcctttttttttctggatcggacttcttttttccgttccggtttttttaattggacaaacctggttttttctgcccggtttttttacccggttttttttggacgatggaagcacctcgtattttttaagtagtagagaagagaagagatagagatatatatatatgaccattgggctccccaaattcatctcctaatgtgacatggtcccgtagcacggttaaccctagccatcaaccgagacatcctcaccacgcgccggcaaggtatgaactgcaaccccatcacatccgttggcctaattgatttgtgaagcatcaagcagcagaagcaaatttcatagctcgtcgttgcccacccgtgctcgcccgtcgtgtggacatttttttttcggggtttttttttttcggggggacattgagagctatgaatttatctaattgcaaatttcacattttctataaaatttagaaaatggttttgattattctaaatttttgttttcatattttctatacttctttaaaaagaatccacttccattgcaaattatccattgaacttcttaatattaagaaacaaacaaatctaaatggatagtcacgtataaggttcctatagaaaaagagtgtaacaaatagtcaaaaaaaaaagagaagcagagcagacaggtgggaaaaaaggacaaaagaacactgaaataggagcagacagggagtataacaaaagaaagcagaagcagaatctctagtttcttcctttcttctcactctatctccccacaatgcatggatgggatatggccatccatattttgttagattcgacgattcaatttttttgtttgatttgtatggatatgacgatctaatttcttatttggttggagggatatagcatggatgggaaaagcaataagttagtaggatccatttgtcatatatatatatattttattaaaatataatcatccgaaatcttattttaaaaatttaattgcaacaaacataatgttagaacaagcagaagaaaggctctaaaatttttacatggtaaaaacggcaaccgcccaagaaggatgggccaaatatgcgtgtcgatcacgtcgcttgtaaacctgccgatccagcttcttcaccatgacgacccaatcgccctcaccatcatccgtagtattctccaccaaagagtaagtgcgatgaacgatacgtgctttgcccacctttcccacggaagcagcagcaatggatcagaactcgaaagaagcgaagctccccttccccatggcgcacagaaggttgcccggaacaatgcggcaattggatgccaccaccacccgcagctcaacgatggtcagctccttcttccccgtgacggccgagatccccaccaccatgcggtacaccgcaacgtcggcggcggcggcgacgaagcggtggtcgtcgctgccgagaggcaaggcctggccgtcgaaaggcaggttggtgtcgtgcaccatctcccactgctcggtgtccatgtcgaaggcgcatgtgcccttgtgatcttgctgctgctgctgcggcggctgcaccgacaccgagaggaggatgtgtgagccgacgagggcgtacgccgttacgcgcaccttgggcgggtcgaggaactccagcgggttgaggcggcacgggaagagcggcggcgacggcagctggcgccacacggtgtggctgaggtcgtcgaggacgaaaaaccatggctcgaaatccagctgcctcacgacggccggggtgcgggagagagcgtagagcttgccgccgccaccgccgccgccgccgtcgtccgagatcgagatgaggacggggttcaacttggggaagacgagtcgcgggccgccgcgctccgtggaggcctcggggtcgtagacggtggtcaactccacaccgacgcccacgatgcgtgtccccaccgcggcgaacgacatgccgcggccgcggccgctgccggtgtctgttggttgattttatcggctaatgccggttagttaggatatggttaaaatcctacgggtttttctatcctaataagatacaaactaagagataaatctgttttgtgtgatcggtacaaaatagattcgaattttagattgagataaacccccgagccctaccagtgtcgctatataaagaaagaggagggaggctgtgtaatgactcaactctctctaaccctaaaccctaaataaatcgtccgatcgattaaacactgaaagaggttcgtgaggtatctcacaacagaagaaacaaaaagaagaaagaagaagagcaatggcttcattggcttcatctcacgtcagttagataaattaatttccgcataagcagaaggtgatcatgtttaggctaagactcaattaattaattggattaaatttcaacattgtggtatcagagccttatcttagccttcatgttccctcataatcacatcatccctgtgattagaagccacccttacaaagttcaagattgattcggcatgatgcaattttgaataagattagattaatttccttaagtcttggttgcgtattaagccatgttatgctggttgtctcggccaacagtagaaacacaattaatgaagagtttaatttcgttgcttagtagtagaatttgagagaaagaagaggttcgggataaacaagattgaaattcccaattctcacactaagaattcctagaccgaagctaatctttcggctagcactcagcaaaccaagaaataggggataaactagattgaaattccccactattaagcaaaaggggataaacaagactgaaattttccgaaatccccaataagccagatacaatcggccctaaatccccaaatgaagaaccctaattttttttgggaagaaccctaagtcacaaatacccgaattaaatccaaattcaagtcaaaattaggtttgagttcgggttaattactggatttagaccccctaagcttgccggagctctccggactcctcgaggtcgcgccggttgaccgccgtgtgcgcgccgccttggacctcgtctctccaccgtccctcaccggggtcgggaagcgtcggcttggcggctgccttcgggcctacccccccccccccccccccgccgacgaggtccggccgcatcgacgcttgccgtcgctagcgcgccgccttgtcggaccgccgacgccatagcacacggcttggggccgccctcgggcgcgccccccagccagccgaggtggagccgctgcagcgctcgccgccgcacgcgcgcgccgcctcgccggaacaccgtcgccgccatgatcgccgccgattccactcgcttgctcgccgggagattggatcgggggagagaaggggagaaatggggactagggttagggtttgacccgttcagcgatttcagtggcaaaggcgaaatcttggccatccgtttgatcagacggctgtcctcgctcccgcatcgggccatcgtcttcatgggccgcgccaatctgggccgcgtccacctaagcgccgcgcgcgcacataaatgggccggtccgttttgggccggctttttgataagattgggcctttattttaatttattaagcccgcgaatttaatttctcagaatttatttagccccctttttatgggccggcttaggaagtgatgggccgtattattattttaagcccgccatttatgatttatttatttccagaaattcatttgtgagctttcttagccatttaaattgctggaaagaaattcatggaagtgatgggccgtattattattttaagcccgccatttattattttaagcccgcaatttatggtcaattatttgatcactcaaaaaaaattatttctagttaaatagaaccaacgggaagtttagccagaccaacgttaatatgatttcatgtcaagattattatttccttaagccacttaatttatttctagttgaatggaaatttaactagaaagtatttatgatttcatgtcaacatcattatgatggtcattgccttagtaacttaattatttatagtcgaattgaaccaacgagaaattcgactagaaaacgttaagatctgaatatatatttaacccacattattataaatgcatgtcaattatacttttttttccttaggtattttctaccaaatggtgatataattaaggaattaattttaagattactcataattatttatgaccaatggtgttttgactatgaaattctaagtttattttgcacatgattgattaagccatagtaaactaattatatgcaattatcaatgcttattatttaagatcagttgcaatactgagtaaattatttctagataaatggaaccaacgggaagtttatctagaaagaaatgatttcattaagattgttatttccttaattattgtctacctaacgatgatgtaattaagggaagaaatcaaagtattatcaattattattttctctgtcattttttatttatgccattagtgcattaactccttttatcacttctaccttgcggtgatgtgatcgaggatctaatctatccgtaagcttaattcctttaccatttctgcccaacgctgatatggctaaggattttaattttaattctatggcatcactaatggcatcatttcctaatcatttctaccgtatggtgatttgatttgggattttaaattatttactttatcacttctaccttttggtgatgtgacttaagacattaatgtttattccctaatcatttctgcccaacggtgacttgattttcgattataagtaatctcatctattaattccttcgttttttctctgnnnnnnnnnnnnnnnnnnnnnnnnnnnnnnnnnnnnnnnnnnnnnnnnnnnnnnn

SEQ ID NO: 23421 - DNA, 9627 bp, Oryza sativa
gtaagacgtcattgaaattgtgccattgtcgcttatgtcacatacctaggggagtttgaaacgtctcatgagatagagatattctttcccttaaattttaatggcgttgtttagctttaagtgtaaatttcacaaagttaagatattagccaacaaatgattttttatggctatgtttacccattagcgacctccgatttcctttaagaaatttaagacactaaagctaaaatcaaatgaagttatgagatcggattatggtggtaaacactaaataaagcttgttcaccttataagacattaaaaataagcattcatccaaatggttttcgaaccatgtaagaacaaattgagatggatgaacaaaataagacattaaagtgttcatctaaatggttttcgaaccatgtaaggataattgagattgatgaataaaataaagaatttagtagaagtttctaaatgagtcaaaatagtgggccatttaagtgggttaatgaaattaagcccgactctgatggaaatttcgaacaatccaagtgaggtggacagctgcatgaaaattaaaggtgggaaatttcacaccggtactccatactaatgacattttattgtcaagcaatacatattgctgttagaaattaaaggaaatttttccatgaattattttggtctgaaggagtactaggtttatatcattaagtcatatattgacataaagaaataattccagagaattcagttaaagattagtcaagctgaaattaagttataaagataatcatttatgattcagctgacagaagcttgagattagctcaaatctggatgcatacagatttggcatacattttactgggaatcgtggcagtattaattaaatccagactagaccactggtattaagaatgttttgtattatttgcaaggcaatcttaagtaatatgctcatatttctaaagtccaatgatctcagaagtttagagacatttggacacttattttgtaagatgtgtggatatttataaagattatttagattaagctatatccacacgtaggggagcaataaccatggaaaagctccaaaataatctcttactgcatagtcgacgatgcagttagattttaaagcatgttatgattaatcatatatataagaatatttctcagaactaagagtggtaaatagcgcttataaaccactcaaaaaggtgtaaaccactcaattatactgtgttataagttgtgcactaattgaacacggttttctattctactagcaacatgttatgtgttttttgcctaacacattgatatagttgtgaaagatatgtcccaggatcgaattattattaagccaagcttttgctcatggatctatactctaaaggctcataaagttaagattaattaagatatgttctggctagtacatgcataaataagagcctcactaagatcctggatgagggggacttaatttttcaatcaacacccactaagttaagcttgagtttatttgggtactatagtgaagtataggtcttgttgtctcggtgacgcataatgttgttgaagacacattgccttggggagctattttatttgataaactcgtcagttagtctcaaaatcaaggggagaatgttggttgattttatcggctaatgccggttagttaggataaggttaaaatcccaccggttttcctatcctaacaagaaacaaactaagagataaatctgttttgtgtgatcgatacaaaatagattcgaattttagattgagataaacccccgagccccaccaatgtcgctatataaagaaagagaaggagggaggctgtgtgacgactcaactctctccaaccctaaaccctaaatcaatcgcccgatcgattagacactggaaggggttcatgaggtatctcacaacagaagaaacaaagaagaagaaagaagaagagcaatgacatcattggcttcatctcaggtcaattagataaattaattttcgcataagcagaaggtgatcatgtttaggctaagactcaattaattaattggattaaattccaacagtgtcaagcaggcagcgggcggcagcgctggcggcgacctcgattacggagtgggtgggctcatcctcgactcggccgtgcgccaacaccatgtacaccggtggctgcggctgcttgtcgggtgaggaggccaccttcctcttcttcctgttccctgtacgaacgcgcacgagacgaggtaccggcgccggcgttggctccggtgccgcgagtttgttcctcctcttcttgtccggcgtcaccatcttcttccctcgattggattcggattcacttctctctattactacgtatcaaagacttctctctattactacgtatcaaacacgtgatgaaaggaagccctatccctagtgggggttgctttcgtcggccggaggacagcatgggcctagccgagactgggccaaatgttactactacttgagactggaccaccaagacagtccaacatgcgtctcgcctgctaaactccccgttttttttcctttttggaacattcgcttgcaagtgcaacaggcgattgatagttggcttcctagctggcgcgtgcgcgcggcctgagggtgggttttctttttttctttctgttgtttttttcactttcggattttcattttttctgtggttttttttaatcgcgtatgccggtggatttttttccgtggtattttttccgacgagtatatctaacataactaacatgttagttttagataacgacggcaattaaaataagacatttttctagaagatcttttaagtaacagaatgaaaaaaaatctatacgtgaagttaaattttgaaaacttttaatctagatttaaaaacttttcaacttgaaatttgaatttttgaagccaaaatttgaaaactttcaacttttcatctcaaatttgaaaaaactttcaactagggtttaaaaactttcaactcgagatttgaaaactttcaactcgagattttgaaaactttcaactcgggtttgaaaactttcaactcgggattaaaaactttcaattcgagatttaaaaatttttaagttaagatttgaaaattttcaagtcaatatttaaaaactttcaacacaaaacattttgaaaaacatgtgttgttggaagattaaaaaagtaatcagaaaaaagcggaaaaaaaaggaaagcgaaaaaatcacagaaaaaagaaagcgaaataaatatttaaaaagtaatcgaaaaaagtgaaaaaaggaaaggaaaaaaatcatggcaaaaaagaaagcaaaaaaaaagaacgtggtccgcacgcatgctcgccggcgctgggccttctaggcccgaaacgcgcaccggtggcgcgcgcacgaattagctatcgcgttgatagcatgttgcgttcttttttcaggttttttggcatgttcactactacataatcgaggacaatttcccctccaaattacacgttggccatagctgttcgcgcatgcaaaaaagttaacccgagataaatcaaaggcttcttaaggggctgcaagcgaaaaactaattttgcatgcgggcaatgtggagagcaagtgggaaatagattttttttctacaccttttttctcttacgcctcctttccactacacctatttctcttctccagaaccatcgttcgctgcttcccctttctcctctcctcatgtcttcctcttccctctctcactccctcgctcatctcctcccttcctctcccatggtggcggccggctcttagggtggcagaggtggcggtcaacaagcgcagcgaatctggcaacgactctcgccgggaagggtggatccgccatcggcgggctcagaaggacggatccgccctcacttgcagcgggtgcaagccgtgacctcaggagtggccaacgacctctttcctctagtgctggtgaactcagcagcaacggatctagcggtggggagctcggcagcagcagatctggcgctagggagctcggcgacggtgaatctgacgggttctccccctttgtgcgcacatggatctggcggcaaggagggtgttggcaatagcgagggcgtccacgcttacctcctcaaggccgtgaagtacaacaactgaaccggtgtgctccttttcgacgtctttgtcttcgagccgccaaccgagacttcgtctaatgcgtgatgccgtgcagttcctctagcgacagcgacccccgtgagacatggatgtgggaactagaggcccgctcgacggttgccaaggcaggggagacggatttgtgcaccaaccgcagtcgattgaggatggcagcgatggccgctgagcacgggagctgcttgctattgtagcctacccatatcccttcacatttgtcatgaaaacacgactatcacaaaccgcagccgcgcctcccgctgtacctctcctccccgcggtgctgtcgttgcctacacaacgccaccgatgtttgtcattctgccaatgccaagggtcgtctctccgctctagatcgattagatatgattagtttgccgattggattgaagatgaatcatgaattactgaaatatccttttacatttggtggcaaattccaaacgtgccctcattcataagtatatactactagtatattgcactgtaaaagttcccctttctttattgctcatttttgtttgttcactatgtaaccatctaccataagcatcttacaacgtttattgaaactaagaacataaggtcagaggcttagagctggaaggtgcgtggtcgactaatcaatagtattgcctattttctgctagctcagcatttgctgtcctagatttgggactcctaattagcaatacgttgtaccggttgatcaaccagctattctatgttgaagaggcgtacgtgaaagcatctcccacttgtgttataggccagaagattctcctcccttgaggatgatcttatgcttaattcagcaagggatggaatttgacttccatccgtaactatttctttattgcagatttgcagaggcacaagagcgtgccagtttctattattaataggaagaagaatcactctcctttcgatgttaaagacgtgagttgattaaattaaatttctaaagttaaataagtttatgatattacttttcaaggtattaaatctacctgtaccatctctttatctaaaacatttgtgaaattatttatgatcaacgtttcaaaagtctaatcgaataatataattaaaacatcaaatattttatgacggataatattgcatggcacatacactactagaaaaataatttttttaagtaacgttggccttttatttttccaggcgggtatgaccattggagccaaatgaccgcctacaaaaatgtaaacccggttgaaactcgcagtccgcctgtgaaaatctattttcacaggcggaacatttaagcggtgtgcctgcaaaaataccctttatttttgcaggcggaccgatgccctttatttttgcaggcagaccgcttaagtggtctgcccatgaaaatcgacatggatataaatagacaccacatcacatcgattttttctaagtgtcacaggctcacagctctcctctccctcaggcctcaccactcctctcccttagctccctcagcatggcgatgggaggcggcggggttggcaatggcgaggcgtggaggcggcggggtcaacggcggcaacggcgaggcgacagggtcggcgcggctcccctcccctctctcccagatctagcccaagggggggaggagggaggagagattgtggtggcggcggtcccccctccctcccagatcaggccagagggagggcggcagcggcagcgacagtccccctccctcccagatccggctggaggaggccaggagagggcggcggcggcggcgacatgccccgtccctcccagatctaggcggagggaggctgggggaggacggcagcggcggcggcagttcccctctctcacagatctggtcggagggagggcgagggtggtggcagcagcggaggtgggtgtagcgcccgttccgtcgtggcgcctagcgggaaaactatctcttaaaaaccctatttgcgaatccgtttctttgcttgttgtctagtgtccgtgccatctcagatctcaaatccccgatctatcgtcaagttcaatcccgaatccaaatccttcccaaatcaaatccctccgcaaaagtctatttagcctccctcgagttcgatgggccgaatccctctcggcccatctccccctccctccccgtctctctctctctctctatccctctctctctctctccccgctctgcccgtgagccacgttgagctctccctctccactctcgcggccgttcccgccgatgccgcccaaatcgccgcgccgcccgcgcgtgcgcgcgccgtggtggccgaccggccagtcgccgccgccgtcagcgcctgccgcgcctgccccgcgtctgccgcccgtgtcgccgctccactccaaaccgccccgccgtcatcgccgtcgtcatcgactcggctccgcctctccccgtgcgtgcctccaagggacggaggcagagctcccccccctctgccgcgtcgccctctctccctcctccttttcctcaaagcggcaaggaggcaagccctctttctctccccctttttcccttttgcctcccgccggcgtcatcctccccccctcctgtcgccgttttggctgcgagcgccgagcgccagctcgctcccttgactgcccaaggtcggtttccaaaccgacatcgccgccctataaacccaagcgcctcccttcctctttcccctcccaatcttccccgtttctcgcccgcgccattgctgtctctctcgccggccaccgccgtcgcgtgtgccggaggagttggtgcgcgttaggacgcggaaggggactccaggcactcgtcttcttcctctcccccagcccgaggccggagagatcgctcccgtgccgtcggcccatcgtcactgcgccccatcacccccgcacggtagtgcctccctccgttctctctcctcgttccatctcctccccttagactcgggtagtagcacgagtagccccccgtagctagccggcgccgccccgactgctgccgtcgctcgccgtgtgctcgccgcagtcgccgcccgagctcggaagcgcctcttgtcgccggcctccctcgatgcgattcctcctaatccggcgcaaggggtgggttcccgtagccgcgttgatgctctcgccgccgggaatcggcccctcgtgacctcatcgccgtttcccccttctcccgctgtcggttgccgccgccgcaatccgccgccgtcgagcatcccccggcgaatccgagccattggctcgtctcccctcgtcctgtgcaacatcccggtgtgctcgccttcgcctgtatcgccatggttcgctccgccgcttgccgctgtcgtccgctatccgttccggccggcgtcgtcgtctacctcccgccggcccgcgtggcagccacgtaggcgccacgtcggcaccacctcggccgcgaccgggtcaagcagaccccggtccgccgcttccctccgccccctcgcgcgtgcggtccaccgcgagccgagaggctgcgcgtgggcccgccgcaccacgtcctccgcgaaccgcgcgcatgcgccgcgcctctctccccaaaccctagcacgccccgcgtgcacctcgctcacggtgagccgagtcgccgacaagcgggtcccacacgggaccacgcgggatggacccggcctaccggctctctctctcccctcccagcccgcatgtgcgccttgggccgccttcttgggccagccggcccattaagctcggccgagccgccccattctctcgggccgcgccctagccgcccgagggaagtctaatttccctccctccttcttttcttttcttttctttttcaaaaaggatttaaataaatccttttcctttagaccaaaaatccaatattcttagaaattcaatatcttcccaaccgtaaatccgtttgactccattcaacttccaaaattcctcaaatctcgagatctatctaatggcacgcttagaggtcaataatagggatttaatttcgccgtttgctgagttgtcccatttcgcgtgtagtttcggagcccgaagacccgcagtgcgaggatttcgaggatcaagctcaagatctcgagcgaggcaagccacctttgaacatcttgagcctatattcgaacttaattatgttgcttgaaaaatattatgcattgataggatcgcacttagtctgcttgtcccgtctgcaaggcagattggcggacctacctaatttgttgcatttgacccttccattgtaattgttataccatgttcccttgtacccacctagttgcgcctcggtaatcgtgcactctgcacgggtatcgacggtcaccttcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccagggtggtgtcggggaggacccctgggcttcctggcacagtatggtctgggacctaatctggtgttggtctgggacccctctcgttggcatatggtgaacctatgtcggctttcgaaatgccttgtcatgaaagccttaaggtctctagtcgtggccgttctgcacgggctggatgatctgggttagtaatatcgtgtgggtaaagtgtaccccctctgtagaggttattaaaactgttcgaacagccgtgcccacggtcatgggcggatgtgaggtgattcctagcgtagttttgtttgactactgccttgtgaaatttgctgttgtggaatgggtttgatgtttggaaaatctgcggctgatgggatcagccaggccccgggtggccgtttgaaagctgttggccgggtgccaatcttgatcaatttaaaagactgaaacattgcacatactccgaccggacgagacgcactgtctcatccgtgtcgtttgagaagcactcccttagttgtttcagaaaagagtttaaataaaatcaatcgcaaaaaaaaaatagcggcctttccttgaagcctgcattaaacacttatttcccatggcttgctgagtactcctgtactcacccttactctatataaataatcccccctcagttgctgaagaagacgaagcggatcccgctgacgaggagttcttccaggagcaagccggctacgatgagttttagggtttcggcctagttcccaagtcgcgcctgtgatgtttggtccaagtcttggcttccgcttccctttt

SEQ ID NO: 23422 - DNA, 1094 bp, Oryza sativa
  unsure (1)..(1094): unsure at all n locations
nnnnnnnnnnnnnnnnnnnnnnnnnnnnnnnnnnnnnnnnnnnnnnnnnnnnnnnntggaatgggtttgatgtttggaaaatctgcggctgatgggatcagccaggccccgggtggccgtttgaaagctgttggccgggtgccaatcttgatcaatttaaaagactgaaacattgcacatactccgaccggacgagacgcactgtctcatccgtgtcgtttgagaagcactcccttagttgtttcagaaaagagtttaaataaaatcaatcgcaaaaaaaaaatagcggcctttccttgaagcctgcattaaacacttatttcccatggcttgctgagtactcctgtactcacccttactctatataaataatcccccctcagttgctgaagaagacgaagcggatcccgctgacgaggagttcttccaggagcaagccggctacgatgagttttagggtttcggcctagttcccaagtcgcgcctgtgatgtttggtccaagtcttggcttccgcttcccttttgtattgcagttgtgagctcgggatctgtccgcagcccaacatgactgtactcctactctataataaagagacctctgttgctgtgatattctgtcttcctgtgataccagcgctgtttcctgggactggtatcaattaacaggttaatttggagcgtcacgggctagttccggtcgggactagttcggggcgtgacagtgggtaggagcacgggtggggtgcggcgaatttttttttcgtcgagatgattttcgcaggtgggtgattgggccgcctgcgaaaattatttttgcaggcaatggcatacatgcggatcgctcccccgcctgaaaggttcagttttggcctcatggaaaaaccatttttctagtagtgagaagaagaaaacatacacgtacaattcgttccaaccaatagatggttgtcatgcatgtgcccggcggttagaacaatggtgggattatgttgtgatggttagccggtgaacagcagaaggcagcaacatcatcatagtcattattcgtggcatggaaaatactccatctagctagttgcagataagtgatgtg

SEQ ID NO: 23423 - DNA, 748 bp, Oryza sativa
agccactgagtaatttccatacatggaccgtcaatgcccacaagattttttgcatcttcatagagtgcaggtagacgcggatcaacttccaccactttgggaatgcttgaggtagatacacctagattggcatacctatcacggcgctcagccacctgcatgacacgagccttgagttcttgaatcttgtcggcaatctgatagcgagcacgcaaattcctgagcttgcgtgcagtcttcctgagcaagccatccttgttattaccatcaccaagatggtacatgaagacatcaatgcagtcctcgatgtcgtagaccatctcgcggatgtcattcctccacagcttctgctgtccatctagcttctccatatctgcaagattctccaacacagcattcatttcggtcaactcatggctaaggaactcaatgttcttacgcattcccttgagtttcttgcacttgttgctgagcagcatggcaagtttggtgaggagtggcgccatgacccccatggaagagttcactgctgccatcataaaaccaatgtgtttgctcgcctttgctcaatgggctagctggtcagagtggatgcctgaatggagaagcggtgctatcagtcaagcaatatattggtccatatagcctaccttaatttcttggaagctcgatcagttctcaattgctacctttggggcctgctattgattgacatgttggccattatatgttccatcatcaagaaatg

SEQ ID NO: 23424 - DNA, 917 bp, Oryza sativa
  unsure (1)..(917): unsure at all n locations
nnnnnnnnnnnnnnnnnnnnnnnnnnnnnnnnnnnnnnnnnnnnnnnnnnnnnnnnnagttgtcatctaggctttcgtcgaagtcgtcgagatccgggtcgttgtagagagagctgaactcgtcgtattccacgatgtcggtggggcgcgagtcgacggtgggagagctgtagtagccatccagctgatccgtcgaaaccgtgccgagtggttggaggatgacgccgacttccctgaagctaggcgagatcggtgttgaagccgacttccgcctaggcctacgggatggagacgctgtcgtgatggagatggccgccaaatcatcggggagcttcatcaagaccggtgggtaagccccatcatcttgatctggtgtcgttggagaagatgcgatctcgcccgagtggtttgaagccgactcgattgagatggtcttggggtaacttttagccgcgtttgggagtccaaacgggactgaaatccggttctctcccgactggtttgaccccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctagaaaagtgtatgggtttggagacaaaggatttatacaggttcaggccttcttattcaagaagtaataccctactcctgtccggggatgaatccgccgagtgtattattgattgtatgatttggagaaaatcaacatccgcccctagaggcacccggaccccccttatatatggaaggaggggtaccgagctcgaatt

SEQ ID NO: 23425 - DNA, 4596 bp, Oryza sativa
ctgaatcaaagcggtagcagaagttctcctagaaaatgcaccagcaccaagtccagatcctgcactggcaccagcatcaccaagtccagaacctggactggcactagcaccaaatccagaacctggactggcaccagcaccaaatccagaacctggactggcactagcaccagcattaccagcaccaagtccagcaccaagactggaaccacaagcagcagcaccaaaaattttcccccaagctgtctttttcttaccagaagaagagcttggggttgccctttgtaatctcacagcaccaaatttactttcatacttagcatacatgtcagacaatgcagccctaacctcatttaaatatgcagagtaatcaccactaataagttgtcccataatttggagaacattgctaaaacccctgatcttggccctaggatccaagataaaagcaaatgaatacagaaatggaatctcagaccagtatgacaagaacttatttttcatgggaacaacaacatttctaaggttccaatcattctcataagtatttagatgtccagcaatctcaagaatgtgatgcataattaatggagatgttggataataaacaccagacaaaataacagttgaatcataaaattgttcaaggaataaaagaacagtttcagcaattgtccagtgtaaatcagtcagtaatggctgaccatcagccattggatggtgagatgcaataaacactgaaaaaatgaccctatgtggcaagagatgcttaagcattagataagttgcattccatctaacatccatgtccaaaccaaatttacgaggacgaatacctttagcaatgcagaagtttttgtataaagcaatgcgctgattagatgcatttataaatgaaatagcagttctaaaatcttgaagcatgggtttgaagatttctagaccagccttaacaattaaattgatgatatgacatgcacaacgctgatgcaaatataaatcaccaatataaccagacagagcaggtttaagactatccattgctttagaattagcagaggcattgtccagggtaatagagaagatcttattagtcaaaccatattcttgaacaacagaaagcacacgttcagaaatattttcagcattgtgtgacacatcaattagcaccagtcccaaaatcctcttctctaattgccaattagaattaacaaaatgggcaacaacactcaaataatcctccttagcattaccagaccatatatcagatgtcaaagcaacagagctaacagacttcaaagtatcaataagcatagcacgtctcttgtcgaagaccttaaaaacgtccctactgatagtttgcctagagacaacactaaatctagggttgtgagcattctgaatatactcctcaaaagcagcagattgaccaaaagtaagtggaagatcctctctagcaatcaacctaaccaactcagttctagccacatccggtttatattcccattgactaacagaaccatcagcattaaacctaagcatggactgagacaaagcaccaacatttctaggtttgcacgatttaatatgcctaagcaaatgtccagtaccaccagttgaacgagcagacaatgttttatgacagtaattgcatttagcagaaacgcgaacctgagcgccattgcgctcttcaaagagttcttcaaagtcgtcccatacctcagacctggacctcttgttgctagcacttgagccagacggagcaccgttgccatcggcaccggtaccatcatcgtgtggctccggctgcgacagatctctcagaggtgaagcagtgttgccaaacacctcgatgcgttcctcctccaagtcatcttcgtcatcaccctgcgtccccatcaccctcgcctcgtagttgcatgaggttggatcaccatccatcgcaggcactccggttcctcaacggtggctgccgcctgccgctcagcgacctgcaagaacaaatgaaacaacgacgagaacagagagtagttacggatctgatcgaatagagaaaataaactaaaaaaaaagcttgtacctgcgcatccggagcaccggagttgccgttgatgatagagatccacagatctacgagaagacaagaggagagactagatttggggggtggatgagtggatctgagtatctgacgaagagaaacgatgagggttgcaaaaaaaaagtacagaatggagaggaaatcgacaatgcgaccgtcgatccggtgaccggagaggcggagacgaagagctcacggtcacagatcagccaaagagatgaaagaaaaggatagagaagagacgaccctcaagcccccagcgggagcccgctgaccctcggtgctagatccggcgaggcatccatcggagacgccgacgaagagggatggaggcgtggagggctgaggggtcggagcctggaggtggaggcggagcgggcgagcggcggatcggtcgagactccagactgatgtggctagggttagggtttgtcggtttgatgcggtttggggtatttatacccacccggcataacaggcctcggtcgggccgtgcctgccgttggaccgtgccgggccgtgccggcccaccgtgccgacctctttcgtgctgggccgtgccggcccaccgtgccgagggagcggcccaagcacggcccggctgttgggccgggccggcacgggcacgaccccagtcgggccgtgccgtgcctgggccgggccaatttgtcgtgccttgggccgggccgtcgggccccgggccttatggccatctatagcacgtccccagaaagccacgcattcgccggcgcgcgccatctctttccatcccttcggctcgtactcgtagtcggcggattcttttcttggaacatcgtcgtcgtcgtcgtcggattcctcgacgtcgacgaaggcgtcgctgaaaccgaagaagtcgtcgtcgctgctgcggttggactgtacggaggcggcatcatcgcctttgttctccgcgtcgtcggagttggattcctcgacaagggcgtcgctgcggctgccatcttcgacgggaacggagtagccgtcggaatcgtcggcatcgtcgtcgtcgtcgtcgccgccgtcgctgaagctggagtcggcgccgtgcgcggcgacgtcgctgtgcaggtcgatgcggcgccacagcgcgggctcgtcgcgcgcggcgcggcgccacgaggagcacgccaggccggcgccccggaggatctcctcctggccggccgcggcgaagacgctccacaggaggtcgctcggcagcgccgcccagtccttcgacgccgccgccgccggcggcgaggcggcggccatgacttgctagctagctagggtatttttgttgacgcagagcaccacgtgtctacgtcttcgtgtcgcctcacaaggcgtgcttatatatacaaacacgtggctacgcggaatcctaattttgtttttttaatcagctccctcccctccatattataagtttcatattataattcgtttgattttttttcaaattaaacttctttaaattgaacaaagtttataaaaaaatattagtataaaataaatatattatcaaaataaatttaatataagatatttaatgaaactaatttgatattttagatgttactaattttttctataaatttggtcaaacttaccaaagtttgactagaaaaaaccaaatgatttgtaatatgacacggagggagtatattctaatcgtgcgtgtcactgaatgtgctgtatcagaattgtattagaaacagggtttgaatctttgacgtatttttattttagagctagagcgtaataggagcaattcaatactcacgactttgacaacattcatatggagtacaacacatatcagggtttgcattacgtcggtaaccgcgcggtttttgcggttaccgcagggtacgataatagaaaaaccacggtaacctccttaaattcaaataaattttaaaaataattttaattttaataaattttgtatggttttgtacggttttccacagttatcgcggtaaccatacttaccgtggcatggtaaccccggccggcggtttgggaaaccctacaacatatacttcatgagaaaatcgaaatatcatcatgaactgacaagtgagcattggcatcgcaaaattcaccccttttgtttgacgtgtctaagagattgcagcttggggaaaaccgtggaggatccacctattatatgagtctaattcaactcaagtggcatgtgttttcataaaactttagctgcatatctccgctatatacatgtcctgggtataacacctaccaaacattttagttgaactacgtgacttgatttagaatagctacattagcgcaagctgagttgagttagataagttacattagcacaagttgcactaacaggggatattttggagagcacccaactataaaattagaagttactaagaataaaacccacattctaacaacgcattttaaaaaaacagagtgaagtgaaacaaaaaaggctatcacaacattctgcacgc

SEQ ID NO: 23426 - DNA, 2294 bp, Oryza sativa
  unsure (1)..(2294): unsure at all n locations
nnnnnnnnnnnnnnnnnnnnnnnnnnnnnnnnnnnnnnnnnnnnnnnnnnnnnnncaaaagaggctatcacaacattctgcacgctgtttaacaacagggcagctaacaggtagcttaaaatcacgagcttacagccacaaaggcagctaacttaacctcggatcatacaaccagttaagtacttaactagagataaaagttattggcagatgtaacgcatgccttcacctactttcatggttcttatttttcccccacaatctcagccagctcaccaatcttacctagagttcagatcgagttctcctgatctgcgccagtcctcttgcatatcagagttcccattctcaggttcattttcatcattaaggaaatcttcagatggatcttcatcgtccctttgagcatttccccatccatcttcaccttgctcttgcatcatctcatgactagggccatcttcgccttgggacgctgcagcatgggccctcaaagggccatgacctatcatctccgagtgcgcttgggcctccgctcgagcttgttcagccattgccatacgcatcttagcttcagcagcctcacgacctgctttctcccttgattctatctctgctcttagccccatcatagcttgcttttcctccattaacaaagcctgctccagcatgagccgctcctctgatctgaactcgccgatggctcttttcttggtcattatattgtacgccaaaacttgtttctcaaaagtagttgtgaactcagcaattttgaccagaatgttatgatcccattgctgcaggcgcgaaggaatctgtccagttgtatcactgtcaaggattctgtcatcttcttcagcctcatagtcagcaaccacatggtagggtagtagcctagtatgcacaatacataagatggtatcagtaacttcagatgtcatgaagcgatcaaataatctaaaagtattgaaaccgcacatttgagcaaataaactcaatccaagttatctgccaattcagaacttatgctcaaacatggcatatttgaaaatatctaagatgaaaaatgttcttgaaagaatggttgttaacattatcctgtcagaaggatttatataattgaattctctgacatgtaaagtgaaaatcattgattcccatagttgtattttcactgacagttgatgaagtgcacccatacaggaaaaagagaattggatgagacaggtgagatggtctacccacattggggacccccaccatactcagcacataaagaatttctgcatcacaactaaaatgtttgatcatgattcgatgagctatttcatcacaacactcttggctgcactcctttgcatccttgcatgtgatatcaccagtgaagagtgtctttcttctatcacgaggctaccccttcaaagcatacaaggctattgttgggataatggcccagaagaatttacaggtcaacagatttttgttttgacataactgttagtgtaatattctttactaaatgatttatcagacttatcagttgtttaatgtattatgcagtgttaagagttgtaggcccatatgccatgaggaaatagggcttcactcctgctatactaatcactctttagtgacatttggataggtgatgggtttaggaaaagcatatggagtaggatacaaaagactgggtttggcagtctgggtctataggtgttgatgtttaattctcttcccatattttgtaatcactccacttattttggttcggaaaataaaagtaaaaggaaatcacagaaaagaagaccagatcaaggagcgagagcagtcgagattagcagcaacattaattaggaatacgaccggctgaatggatgcgcagctggcaaagaaacgacgatcctgtatcaattcttcacgccatctcgcctaggaaatcagatggcgagtatctcagagtcaaaatgaactcaaggggatgattcatgaaggtgggtcttcagccgatggctaccgacaacagaacaacccacagagcaacaggcccagtgaatgggtgtcaacagcagagacatcacgctaatgctcaataggtgagtaaaaaggtgctgatgctctttttccacagcccaaccacccaaccaaacacacattccattgtgtttaggctttagaatcatgaaaaaagaactcatttttgtcccaaatcccaaatcaaaacccacttctcttccttttcctcctaagtcataacagggataggagatcccccgaaccccccttttcatttccac

SEQ ID NO: 23427 - DNA, 7942 bp, Oryza sativa
aaagtattgaccttaataagagatgcacgccacctaatccacctgaccactgacagaattacttggaaaaactagtaacagtactgtgaacgttagcatttatcactgaatggaaagaaggaaaaaattgccatcttaaagaatgagtatgtggttttgtctattcaacttcatttatgttgcataactcatgattgcttggacttcatgctttgcttataataacagaatcagtagaagaaaattagtcacagaaaaaaagaatggattatgaaaaagaaaggttaaggatgactggagaagttgcaaagacatccttatcagtagcacaaacattctatagcaaacctacgataaagcaatccatgaaaccactcatggaaaatctagtcgtaattacaacttaatataagtccagaaactaaagtatgccacattaataaaatattaaatatatatgaatcaaaactaatcaaggactatagccctaaaagataaccagcaattcgtgctatactggtcctaatctttgcaatgtgagtttcactcatgatccacatccagggtatgaaattgattgtttagatacatgcttgccaattcggtagattaggtcaagcttgtgaagggagggctaagaggaggatctttgtcattgtctcctgtagtatgtgcgcgactgcaaataatttttgttaaccttttagctgcttttgtgggaatttgccttgttgatcacttttggtatatccagttttgttctacagtaatatacctgaaattctgaacctgccttgctgttagcttcaacaggttgctaagcattaaacagtggagctgtatttgtttatattcatttaatttgaaccatcgggaaaagggaactgctatatctgcctgtgctcatagaattttttgattgtgctgtctgtttatatagaccttgtatgtgtttactcttgattttgttttctgaaatatgcacaacaagaccttgaccaggaaaaaacgttgccctggttctccagtcctagtattcacttttttggacaattttgtttgatgtgtttttccagagttccaagcattagcatgtaacaacatgcacaatccaccaaataaaatggaaattacttaacatttcttagatgttcccaatttttaatcatcaattggaaccccagaaacggcaaacaatccaaacaagcaagaataggcaacaaattcatctcgaatgctaatgctggaatcagtacaggtaaaaaataaaaataccctaatttcagccaagcaagcgaaaccgtactgatcaagattataggcgatatcatggataatggaagaaaaaggaaaaaacttcgatacggttccccacctgttcacggcatcctcgatggactggaagggtgtcttgatgtcggggttgcacacctgcatcacgtcctgcagagccatctcaacctcagggctctgcacccttgccacggctgccactgccgcctgctgctgctgctggagggacgcccacgactgcaacagcgacgggccccaggagtggatctgctgctgcggcggtggtggctgctggggcaggggttgctggaagcggatcgggccaggcaggggcaggtgggcatcgatgttggaggggaagaaggacatggcctgctgcgacagctgctgcggcgtcggtgtgtacccttgcccctgcgcctgcgcctgggcctgggcctgctgcatgaggaagatctggcgctggtgcagctggttctgcgccacggtggatgccgaggaggtcggggtggagttcgcggcggcgtccatggtgggggcggaggtggattggctagaggagaagatctgggggaaatggtggggcttttgtttcgggcaaaatttgttaaaccagtcctaaacttttttggaaaggatacaccagtcctaaacttgccagttggatgtgactacgcagataccttttgggtcaaaaccgtgtgggtccgaatggaaggtagtaatcttttttatgtgctccgctaatcaaaacagtgccgatttagtattttaaacatgactataacattggtaaaaatggtaatatctaaacagaaaatgtggtacacgccacttcaaaacacggcgtttcatgccacccagattcttaaaattggaaatatgccaccctgtaattcccattgtttttaaacaacgcaaattatatttaacaaaatagatgattacaaccctgttattgaaaaactaccaaaactaggactgatctgccttccatcatgcatgttaacaaatagaactcctgtggcaggcagccaaccaattttcagaggttacactattaaacttatggtccaagtattaagctttttatggtctggaagaaaaatggttgctgtgaatttaacaccttgaatgccagaggcaaccacatatatcaaaaggaaacaaatctagaagcgtgtatactgtgtgcccaactataccataaaaagataatagaaaaagatctggttaatatgtgcactaaaaatttgaaggaactcaagtagtaattgtatgcagttagtcctatcgtccacagacagttagaatatttgtgttctcaaaacatatttatataatacttaataatttttgcacagacatcctaacattaaaatcttttttcccagtttttctcataaagagtagtttcatacagaacaaacttgttggtacataaattggccccagtacccagaagcaactctttttctcaagaaaatattcgcactaataggtgcagtcatatttttctaagaaatcatacaaagatatataaggtataccccttccagtgaaaaaaatatgtcaatttggacatgtcctaagtcaaaacttcatacatgtatatcttttcaaatatttggattgtaagcaagaaaaatgaaaattgtatgtgtagatttgttacagaaagtacttttgtaatggagttaggttttataaatacgttgtaaaagaaattagtggtcattgttacattttgaaaaccatgttagtgcgcaaagctccatgcaaagaatgaacaggaagctctcattgtagggtggtcattgtgcctcatacatctcttggaatgcaatagggttcctataaatgttcccaatacaatatgcccttccatagttctacctaaatcattatacaatatagtaagatccgagcaaaataaaagagttttctactagcaaagaaaatactgctaaataaagtattgaccttaacagcagatgcataccatttattccactcaaccatggtcagcgattatttggaaaagctagtaaaagtattatggacctttgcatttatcaccgaatagaaacaaggaggaaaatttgctatcttaaaaaatactgaatgcagtttagtttattcaacttagtttatgctgcataacttctggttgctctgactacattctttgcttgtatgctcattaagcattttgagcagaatgctgaaacaagaatttttcagtcactaaaatggaatggatcagggaaaagaagttaagaatgactaaaacagttaaaaatcttatgtgggttaagaataactggagttaaaacatctaagataacaatctgctaagataaagcaatccatacaatcactcaagttactacacgaagaaaccagcttgcaattactggttagtatatgaccaaaagctaaaagtatgtcaccttaaataaacaaaatccccatcaatagaaaataaccagaggcacatatgccgaaaagcatgtcacctgcaattcgtgctaaactggtcctaaattggaccacgagtttcactcatgaaccacatacagcattaacaatctgctctgtggaaaagaaaagacatacaggccaaaatgttgtcctgatcctccaatcccctaatgcccctactattcaccttttgggagaattttgtctgatttgtttaacaaggaatgaagattaatgttaaaatttctaagacgctcccaaattctaataatcgaaacccaaaaaatgggaaacgatccgggcaagcctcgagcccgaattggcaacaaattcatccggaacgcgtagcctaaatcagtatacagttaaaaatttaaagcaccccaatttcagctgacgcagcgaaatcaaatggatgaggattaccagcaaaatcgtggataataacgtatataagaaaaaaaaaagatgcagagaaatttggtgcgattcccccacctgttgacggcgtcctcgagggactggaagggcgtcttgatgtcggggttgcacacccgcatcgcgtcctgcagcgccatctccacctcggggctccgcaccctcgccgcagccgccgccatcgccgccgcctgctgctgctgctgctgctggggggacgcctgcgactgcgacggcgacggggccccggagtgcggctgctgctgctgcggttgcggctgtggcggaggctgaggcggctgcggctgcggctgcgggggctgctggaagcggatggggccgagcgggcggaggtgggcgtcgatgttggaggggaagcgggacatggcctgctgcgacagctgctgcggcgtcggggcgtggccctgcgactgcgactgcgcctgggcctgctgcatgaggaagatctggcgctgaagctgctggtgctgcgccgcggcggccgcggctgcggcggcggcggaggaggaggaggaagtcggggtggggttcgcggcgtcgtccatggcgggggagcagcgaggagtgagatctgtgggggaaacggtggtggagcttcagtttcgggcaaaatccgttacactgcactgtaacacgcgtacgttttgggagaaaactgtatggatccgaacggaaacgggaggttttgctggatttttcacaatttggtctttttgaaaaacttatttcgtaaatagacttctaaaaaaacttatcctaaaaatgattctttttgtggtgccagccactctggcgccgtccttgtgctgacgtggcagggcggtgatgaggtggcagggggagggcatcagtgtggctggcgccgcccccctccccggcgccattttttttctcttctcctctatagcgtagaggagagagatgtccaacatttttatttttatttttttcacacttatgagcacacaagaaccaaccataaaaaaaataaactcgaataaatgaaatatgtgacttgtagaattttctaaatttctaccgaaaataggtgtcattcgggtgtcatttcttaaaataggcataactttctcatacagactcgaaattaggcaaataattagaaaatggcgcggcagttggcgcgtttattacttttataacgtgtatataacacttatgacttatttagaacatatatttattagttttctagtttttctacaattttcaattttgtcaattttatttgtttttaaaactcatggaaaatagattgtacatattttatggtttatttagaacacaataattttacacaattgtcagaacggctagttcaattctcgtaaaatttatttaggatagagagtttagttttgtactaacttatcgaagattaaaatatttccaaatatcataaggaaatttgatgtatttttgtaaaaaaaaatcacaaatctgaatattttttcctttacataatatttagtgtatatctctatctctagagggggtatgtggaaacatcataatttacccaatagagtttcatatgcacacgacatagcaaaatttagtttgatatatgcacatgaattacataacaaaattacttgtccaacttataaaaaaaatagcctacttattaataagttttatcttagggccatttataaatactccaaactgagggcttatttgtaaatttaaattttttgagatgaaaaagttcagcaaaattgttttggtagaactggacatttttctttatcgtctgcataatttttacccagggtgtgtaaaaatcataatttacccattagaggagcgtacgcatatcatttagcacaattttagtttgatatatgtacatgaattatatagaaaattttaatttgatgcccattgcctcatggcagagcaaaatttgaacttgataaaattagttgcgggcaacctatcaagcaaaaggcacctctcttgctgtttttttttctatccacgtttcattttattcctcgtttcaacaggtgaaaacaatctatctattttattataaagatagcttgaaaataatacggtatttgctttgatcgcatagaaattgttacattaattaataaaaaaatataatagttgtatatacgtaatataatgattgtatttatattaaatgtcacaaaactacaattatttggttaaatctaatcatgtttttaaaatatgttacaaaatatattgtataaaagctaagaattgcaaatttaattctataattaaaatatgttgcataaaacaatagttgcaaaaaagaagtacatgtaatcctagtgatatttgcgtgtgactttcgtcgagttcgggtagaatcatcgagagtttctacagtatttggtgcaccgtactaccatactatataggttatttgctcagtgaatcatagtcgaaaatactcattatttctcatagttcttgttctatgagtgatagggtgcaccataatattcaaaaactgctatccacttagcatactcattcatcagagtagcttggacgtaacgacaagagatagaagtgcttgctcaattacatcgagttagtgaacagaacacttggtttgatgatatgattgagcttctaggtccattataatttcgatattgaatgtatatgtctgatatactatagattcaacaaacttctagttcgcgatatcatcagtcatcttggttaaaattcccgcaaataattccaatatattttacgtaattatatatatattacagcaatattaattaaaaaaataaaagcattacaaataatcaataatcataaatgcgattaataaattttacaatcataaatatctgaaatataatttaagtgtattttacaaatttacaatgtcattcaaacaaatattccaaatacagagggccatttatatattttctagaaatgtcaaggtttgaaacgcaaagtttccaatgtagaggaatatgcgattaattttcgaaaaccacaagggccattttgcaaaatatatggagattttttccttttctactcttctttccttcttccttatctttcttcccttccttctctttctttttctttccccttcctcccttgatggcgccagcgggtgcagaggccggacgggcggcggcggcgcggcgggtgcgaaggccggtgaggcgttgcggctggccgtagacgtcgtggccgggcgacattgaggacgaggccgtgcggcggctccgtgcgatgtggaggccgggacggcgtggtggggctggctgcggcttcggatggaggaggcggtggcagcggctgcggtcgctcgcgaacacggatccggcggcagcggccactattgcgcgcggatccggcggcgacggccgctcgagcgcgcggatccgggtatgtgccccacggcagcggcgcgccctttcactccctctccttctcgtccccttcccctctcttctgatccggcggaggcgtcggtggcccggttgcggcgccatcccctccgccagatccggcagcgagaggggaggcggtggcggcccggcggcaggaggcggtggcggcgtggcggcgggaagcggtggctgcccggtggcgagacgattatttagattttagatattcttgtgtgatgttttagtgaatgatttctgtgatgtttttcaatgtt

SEQ ID NO: 23428 - DNA, 5668 bp, Oryza sativa
gaattttttttttttggactgggtggagcaccggatgaggagggccacgtggcacgatgttaggggaggcaatcctggatgctggtagcgccacgtggcccaatctcaagccgggtcttggacccggaaatcgtatatagagatatatccacgaatatctacagaaaaagttacatccaattcttgcaagagactccatggagtatgggctccaatgttgggagccgttggatggttgctgatcggtttgattggatggttgctgatcggtttgatcaattgagtgtatgagcataatgggtatagacccgtttagagtgcaggttttaatagtgaatggattcaatagatttgaatagattaaaaaaggaagtaatacatttatatatgcatgcatgcagtgcggatgagagaatttccataattgcgtgtacatttcaaaaatggaaacattaattgccagtgaaatttgaaataatatcttgtaaatatggaaagttacgtgattgcacggtgaggtttgaatatatggtaatataatggtgaaaaatggaaactaatcatatggaaaattggactttttttgccaactaggtatgtaatactaaatattgatccttcgtatttgaaaacatggaaactaattattcggaaacatggatactatatatcgcagcacatttttatggtaatgtatctaccaaattattccattcatgacaccattaatttagctatttgagtcacaaaatatgccctgcgggtcactttccaagttttaggtacacagcttgacatatacacgcggacgtaacaccaatatacttcggagtgtatatactcagtgtcgacgtttgatgccgcgattccggtatttgcatggtatggggatcgttggtactaggatatacgcgagactgaggtaaaagagacggagacgaggatttttatacaggttcaagcccctgaattgtcaggtaataactctacatcctgttggccgaagccgatattgctcttattcaccataatcacaccagtataatatttggggtagcctatctaactgttgtcgacatggcggtctgaagatctgactcgtagtcgacaacagggtagttttcctcctcaaatccgtgcccggcgagatcagagatagcgcttttgtttctcctaacagtatctggagacatcgtaggggactagccgtgcctatccctgaagtcgatatccggtgtcttgtcttggcgtatgttggcttgtatgttgttccgtctatggtgggtgttgatcgtgtgtttcccctctcctcctagagggccttgtatttatacccatatgtgtccccttgtccaagtagaactagggaaaccaatatggatacaattcgattagtccttgtcgtttccatgtagaactctggtttttttttccttatccggaactccctcgagatcagtttccgtataagacatggtatgtggtgggctctgtcgagatttagtcaactactattatgtatgtggtatccataaccctgacagtagcccccgacttcaatgcaaatgagcgagttcatattctcaaccgcagaccttggagaaactgttatcgagctcacgtgactgttctcggtgagttcagagataacgttagacttcctttatcagcctcgtgcgggcacctaaagggttagtttgtgtcaatctctgacgtcaaccaagaaagtatagagcatatgactaagtctcctgtcttgctgtaatcgagaatttggattgaagtcaagaaattttatctcggccggtataccatctcttcatttcgtattccttgtcgatatccaccaaccgttctcgagtgatcaagaaggcgcagagtctgcgacggagccttgtcaacatttgtcatactcgccttagtcgatcttggtgtagaaccatagagacatgaagtcttcgacaatgttgaatagaattttcctgaaatcaacactcagaaaagaacattagataaaaatagcccccgagcgagtgctcaaagggtaacatgttatagaatgtatggaaaactgaaaatgaattaggtttacaaaccaatgttttgtatatgagcgtccactcttttaccgacttcgaccaatcagtttgttgagttatacactctccctagcccccagccttgtcgtcggagaatcgttctcgggtgataagactcttggacctttgacctgccttagttgaacaagtactgatcctagcccccagccgtgaagttggaaaatccatttccgattacacggcttggttaatacgcacggtgagaactcttacacgaccagatcttacatggtctttcgtctctgaaggatccgacaaagccttatccgctctgggcgtccccagccgaagttcccttaggttcctcagaggctttgtcaagacgacgtaaagggacattaggataggtttcaatgctaggtgtcttttgtggtaagggatctctgggcaaaacacttggcgatattgtgcacctgatatcaactctgttggagtagaggtaatgggagaatcgctacacctctggtcgaggaccaggtagtagtcgtaacccgaccacttgaagtgaaaatagtgggagaatcgctacacctctggtcgagaaccaggtagtagtcgtaactcaaccactagaagtaaatgtacgagagatcgctacaattgactggttgaggaccagtgagtaggtgtctctcaatcatttgaagtcgtggtgcgaggaccgcttgtgttattgctgtagtcgttcctcgaccatctgaggttgcggtgcgagagattgctacgtactggttcgacgaccagcgaacgagtaaaattatctctcgaacaccaatggaggttgcggtgcgagagagtgctacgtactggttcgaggaccagcgaacgtgtagaattatctctcgaacaccaatggaggttgccgtgcgagagagtgcaacgtactggttcgaggaccagcgaacgtgtagaatcatctctcgaacaccaatggaggttgtggtgcgagagattgctaagtactggttggagaaccagcgagcgagtagaatcatctctcgaacaccaatggaagttgcggtgcgagagattgctacgcgctggttcgaggaccagcgaacgtgtagaatcatctctcgaacaacaatggaggttgcggtgcgagagattgctaagtactggttggagaaccagtgagcgagtagaatcatctctcaaacaccaatggaagttgcggtgtgagagattgctacgcactggttcgaggaccagcgaacatgcagagttatctctcggacaccaatggaggttgcggtgcgagagattgctatgcactggttcgaggaccagcgaacgtgtagagttatctctcggacaccaacagaggtgctagagttggtttattatgtgcgtctcatgtggctagcttgactcacacacccaacttgtagcatatccggatgtccgttcacaatcatatcgggtgatcaagccgacggtgttcgcgaggaattgtccgttaacaaccttttctcaagtagtccagccatggccagtgctatgagataggttgtcggtcttagttggtaggttgggcgcgacgactctgcatttgttgagatcgttctcgataatatggtgtactcgaccacaacctactcgagtgctcaactgttcctgaaaaatgttttctagaaggcaagacatatagcaggtaatatcgagtatgtattcgaaaaactgcatggatcttctagtattatcaggatataacgagcagattaaatatcaggcattatgtacaccgtaacaagcatgatttatacagaagaaaatagagcgagcccccagcgttataccgtagtcgatttaatatcggggacacttgcacaatagatattgtataaaaaacatgctctaggtagacataataaattactgatctgacaatatcgtataaattagaaaaacaggtacgataaattacatataaaatattgcgtacctgtgtagatacatgccggatgtatctacaaaattagtagatcaattaaaataattgatccaccaattacctgtatcgatctgtaattatggaagatgattgggcttgagactttctaagcagacctccattcacacgtagcaaaggacatgccacatatatgacattgaccgatgaccaatcgccgagtaaacttgatgagtcctgaccactgctcggtctaataaccacacgtgtcatgcacatggcggctgggcctgtaatcctccgtatcatgtattattccgtttcattgaccgatacgaagacgatcggaaggcggacacatgattcagaagtagctctccctgtgactggcgcacgacgtggtgatgacccgagggcataatctgctcgaagcctcagcgttgttggttttgatgtcggactgacctgtaactgacattgaattggcatcctccgtggcggcgacgtggtttcaaagtaatcaatcgggccaaggcctcacgatcgacgacattaaaccattattctccgcggtagcgacatcttgaagcttggtcgatctcgccggatcgaatagttgatgatgatgattccgatttcgtcggaagacgtactccggtcgtgttagatctccccacagccgaagtcgtcgagtagtttgttgttagagaatccatcttttgaatccatctcatcaaaatcctgaagcaccaaaatgcccctacctggcgcgtcactgtcgacgtttgatgtcacgattccgttatttgcatagtatggggatcgttggtactaggatatacgccagactgaggtaaaagagacggagacgaggatttttatacaggttcgggcccctgaattgtcaggtagtaaccctacatcctgttggccgaagccgatattgctcttattcaccataatcacaccagtacaatatttggggtaacctatctaactgttgtcgacatggcggtctgaaggtctgactcgtagtcgacaatagggtagttttcctcctcgaatccgtgcccggcgagatcagagatagcgctttcgtctctcctaacagtatccggagacaccgtaggggactagtcgtgcctatccctgaagtcgatatccggcgtcttgtcttggcatatgttggcttgtatgttgttccgtctatggtgggtgttgattgtgtgtgtcccctctcctcctagggggccttgtatttatacccatatgtgtccccttgtccaagtagaactagggaaaccaatatggatacaatccgattagtccttgtcatttccatatagaactctggttttctttccttattcggaactccctcgaggtcagtttccgtataagacatggtatgtggtgggccctgccgagatttagtcaactactattagatatgtggtatccataaccctgacactcagcatatattatatatatatattatatatattatatatatatataatatatatattagcaaaagtggccgtgcgttgccccgggtgattacggagtgtgcacagtgacaaaacactgatgtttggtttagccaccccatatgctaaaaaaaatggttgtt

SEQ ID NO: 23429 - DNA, 2305 bp, Oryza sativa
atacttgtctattgttatatgaggaaaatgtgtggagtttaacaaatcataaaaataaatcttattaattttgtgagagtgagtattgttttttatttacaaattgcatctgaggtagacataaaaaatgaaagaagattagacaatgagggaaaaataataaaaaacaagagcggacaaggacatagaaaaaaaagccgaagggatagggcaagaatttgttttattatttaaacaattttaataagtaaatacccgtacgttgcaacaggttaactaaaattataacaaatataaaaataatggatcattaggatttagtttttacgatatgagcccttcaaaaaaaattccttatagaaataaaaaagttgtaaaaaaaaggcccattataccctatcggcctactattgcgcgtccaacacatgaagcgcgtgtggtgttgtggcccaatatggaggccggcccgacgcgggatcgatatgagccattcgttttgatggacggctcagattgattctaaatccatcaacaccctaaccctatccacacctacacccgaccgcgagctccaccttccgctcggctctccccctcccctcccctctcctgaccagcgatgcctctccccctccctcccctctcctaaccggtggcgccgctcctcctccaccgtcccctctccgccgctccccacccctcccctcctggcggcgcctctccccctctccgctactccctcctccctctcctcccctcttgatggcgcctctatagtgtggcggcttcccgcgggtagatccggcgacaccaacggcgccggccgcttcccgcgtcccaatccggcggtggcggtggcttcccgcagtggatccgacggtgacgacggtgctgacgacttatcgcggcccgatccgccgacggcaacaacggcggcggcggttcccacggcggatccggcggcaccgacggctacgtgtgtggcggcagcagcagctgcttcccgcgttggatccgacggctacgaaggtggtggcggctttcggtgatgtttttattttttttcctctttcgcttgattgtcctattagattttgtatctatgtttgcaatgaattttcacttaatcgctcgtgcatttggttgttgctgcggactctggatgattttttttgtcttgtacgtctcatctcggatgttgtggacgagggatttttttttaggacactaacaaaaatttaacgcgttaacggacaatgtgacgaaaggaaaataatggatcttttaattaaaattaagataagataagaggtgccgttgttttaaaaaaccaacacttacaaaatattataataggtgtcagttaatttaaaatcgaaaactataatatattatacggaattgctagtgctctgttgacagaaaatagggtgctaaatctttcacttttttgaccattcatctctgtttacaattcgtgctgcatttggattgagcaaagtcatgtacggctgtggactttgagatggaccgagcttttgttgttgcattctgtggactttgttgttgcgttctgtgggtctcacatatttaccgttcaatttcgaaacacacgcctgctttttttccttgcatttgagcagtgttttctactgctactttgcttatgatccacgcttactaattacatcgtgcttacattataattacatatgtaattttatgacttacatcgtaaatatactaaaattatatatgtaattttatgacttacatcataaatacactaaaattacatatgtaattttaggaacttacaatataaatacatgccaactttttttgaatagttactctctaaatttaaatagatgagattaaatttatcctatggcttgaaaaatttgcatgataggaggctagaaaatctatcgcatgatgtataggcagtccctatattatattactggcacctaaaaaaccaaacagagtcttaggccttatttagttggggaaaatttttaggtttgattatcacattggatatacggacatacatttaaagtattaaacgtagtctaataacaaaacaaattacaaattctgccaggaaactgcgagatgaatttattaagcctaattaatccgtcattagcaaatgttttctgtagtaccacattgtcaaatcatggcgcaatcaggattaaaaaatttgtcacacaattttcgtgcaatctatataattgattttgttatactatatttgtatttgtgtcaaacattcgatgtgatagcgatgtgatag

SEQ ID NO: 23430 - DNA, 2470 bp, Oryza sativa
  unsure (1)..(2470): unsure at all n locations
caacggagataaggccaagcaggcgagctggcgagcatattgaaaggaaccgagccggcggggcccaccgaggagataaggacgagagcctgagatccctgattttctttctcgctctctcgtattcctctcctctctctcggtcctctctcgtttttctctcctctctctcggtcttctgtttcgctcactcccctctctctatcggagcggcggagccgaggcggcaggcagcggcgcaagaggggaggcggctggcgacgggtggcggcggcaggtggagacggtgcggcccagcggcgggaggcggcatcagcggcgatggtggcgccctcccctccacggcagcagcgtgcggcggcttcggcagcgtgtggcgggaggagtggcagccgcccggaggcgccatcccttcgccagatccgacgggaggaagggcttcagagccgcgccgccaccaaatgcgccggttgccttgatgctgtccctgccgccggcccgcgtcgagctcgtccacaagcccgacaaccacgccaagcacttctgccgccacacgtcgcctgtaacccgacatgcctcctgctgccttttgtttgccagcaaattcatatatgattgcctttgtttgactttctgtattgccggatcagattgggagggaggaaatacatgggtattaggtttattgtggggatcaaattcatgaggtcgagattaaatttggtattttcgtgttgtttttggttgtctggttgattaattgatttgggaatctatctcggggatttttttttaagacagactcggactcggggagggacggattgcacggacaggtgaaaattcgtgcatatggacgaaaatcatgtgacgaccggaaaaatactaatatttatattatatatatatatatatatatatatatatatatatatatatatatatatatatatatatgacactcatatggggcaccatggtgcccgggcaccatggtatctaatgtacaaaatcactcaaatttttcaaaattttcaaattgtgagtatatacctagttataataattcgattcatatctatacctatcaacaaaacaactcaaatttaactttatttcacaatccatgattacatacctaactaattatatgtatggatgctatatacctagaatcaaaatctaacaaaaacaagtttaaattcagtacaaacatgctttgaactagttagtaaagtagttaatgttaatacctaagtaattgaaaaagtttcatactcatttgaattgggtatatactcaatttcaacaatggtgcccgggcaccatggagcaccaaacaaatttactatatatatatgtatatatatatataggatcaatgttttgtactcccgggagtacatactccctctccttagtggataacccattagcatccaattaaattgctggggaaaaataaaaattttaatttccactaatcgctgcatgatgcatgcatgcacaggtatacacaccacatttggtgcacaattgaaccggggtgcatcaaatttgaacattgaacgtacctaaccatcctctaaagacatggatcttctaccgtgcaaactgattagaaaaatccgattataaacattttagtatatacttttttttcctacttagtagtagtataaactttactcattttagttaattagagcagcatatactacttttttcttgtacagtatatactgatttattctccgaaagagtatgtaccgatttatttcacaaagaatatatatgaatgtacatatgtactgctttctgcatactctattatagcaacgtagtaaatagtatgttcgcatactcttataagtatatactgtttattggaacagtatatactgttttcttataagtatatgcgctacttataccttggaacagtatatactattttcttgaaatttctagccagtatatactacattagtattgaaggagcatatactttttttttagtttggccagtatatgctgctatagtactacttttttgttatgctttcttgtttgctcagtatctgcatatactactcttactctttttgtttcttcagtatatggtgcatatactgcttaaataagtatatacactatttcttagatttagtagtatataccactattacttagataagccatatatagcttttcacgtgtgtagtataatatgctttttcacgagcaaaattcagaagtatgatacaaaattcttcgtaaataaaaaaacaagaggtatatatatgatctcatgcatgctcacaagcgaacgaaaaatagagaaaaagaaacaagaggtagatgcatgtatatgcttctgaaaaattcagaatctatattcagttatnnnnnnnnnnnnnnnnnnnnnnnnnnnnnnnnnnnnnnnnnnnnnnnnnnnnnnnnnnnnnnn

SEQ ID NO: 23431 - DNA, 2201 bp, Oryza sativa
actcttactctttttgtttcttcagtatatggtgcatatactgcttaaataagtatatacactatttcttagatttagtagtatataccactattacttagataagccatatatagcttttcacgtgtgtagtataatatgctttttcacgagcaaaattcagaagtatgatacaaaattcttcgtaaataaaaaaacaagaggtatatatatgatctcatgcatgctcacaagcgaacgaaaaatagagaaaaagaaacaagaggtagatgcatgtatatgcttctgaaaaattcagaatctatattcagttatctgggaggttcgaacaaatgcattaggtgtcgcctctgatttttggcagcctatgcaccatgtgctgcagctgtaatgacaggatcttcaagactattatatttatacctctagaggtataaatatactcagatctactcctgggtttagagtagatctactcctgggctactagtatataccatttatttcagaccagtagtatatatatactgcatatactacttaattttctatcagtatatactgcatatactaattatgtttggtcagtatatactgcatgcatcatcctcgctaaaggagggtactgcctttttgtttgctcagtatatatatactacatatactacttttttttcgctcggtatataaataagcatataccactatttcttagataagttgtatatatattgctatccatggaagctggatatatacatatgcttttcacgtgcaaaattcagaagtatgcacgatacaaaaattcatccatatttaaaaaaaaaaaacagaagtgaaacaaaaggtatatatgtgagcaaaaaacagaagtgaaacaagacgtatatatatgagctcgtgctcataagattcagaatcaactaggcgaaaataaagagaaacattcaagaaagatgtatatgtgctgcatctgcatgatcgcctgctacttttggcagactcctgtagacgtatgcacaatgtgctgcagccgacgctggtctgtggttcgtcagtcaccatgcatgcatgcgtcctcgcatggcatctgcatacaccaaagaaattagtttcttatgggggcttaatcattcatggtctcatggagaacatcctcatcggcaataagtaatagaagcagatctaacaagaaaacaagagggatgatctaactagaaaaagaacaagggcttgccgcaccgatctgctgtcgtgcacctgcgattttcgccgcctcgccgccgctgcctttgcttgagacaatctgaaatcaaatcgtaagtgatgacgaaattaaataacaaaccttctatcggattggaaaaatggttatggatactcacaatcgtgacgatcgatagccgctggcctggatgggcatttttgatctggtgtagcgggaggattcatcatatatacccttgcctccacggaaggggtgcgatggatgtcctgctgcctgatggcgtttccatgggatccttagacgacggcagggtacaagacgatgccacacgcctgatggattgcatcgtcgcctccgactcgccgtagagccaaatcagcgttgttccctccggataaaccgtagatagcgcttccgtccaacgacctggcttatctagaccgaccgaccaaataaatattaaagaacagcggaagcttgactacccaatcacaagtacaccgactaggggtttacccccgttaagttctcatcctaaaagaagcaatcgaaacccgtatcactcaaagactaattctaaacctgcaaacaaaaggttatatcaacagcaagagtcagtacattaaacatgtaagcacaagtcaatcctaacatactacatgtaaggcatatattcaaaggaaggcaatatgtagttcaattttagcataaagcaaattttgtttcgcaattcttttgtaaaagagtttatgcttcaattaacaaagacatgttttaagttttaacattaagttcatcatatttccatcataatcaatctcttgatgtcatctttcacaacaagtcataatatatcatcacactcacacaactcaacacattttatcaatttcaaacctagtcacatgttcacattttaaaacatagagtctatacccatgacacttcaccaaagcgctcatgactgtgagtc

SEQ ID NO: 23432 - DNA, 285 bp, Oryza sativa
atttaattaggtaacattaggcggttttacaactctagactttgggatattctcatatcatttggacactatggaattgttggtttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcaggctagtcat

SEQ ID NO: 23433 - DNA, 759 bp, Oryza sativa
  unsure (1)..(759): unsure at all n locations
nnnnnnnnnnnnnnnnnnnnnnnnnnnnnnnnnnnnnnnnnnnnnnnnnnnnnnnnnnnnnnnnnncggacgatttatttagggtttagggttagagagagttgagtcattacacagcctccctcctctttctttatatagcgacactggtagggctcgggggtttatctcaatctaaaattcgaatctattttgtaccgatcacacaaaacagatttatctcttagtttgtatcttattaggatagaaaaacccgtaggattttaaccatatcctaactaaccggcattagccgataaaatcaaccaacagacaccggcagcggccgcggccgcggcatgtcgttcgccgcggtggggacacgcatcgtgggcgtcggtgtggagttgaccaccgtctacgaccccgaggcctccacggagcgcggcggcccgcgactcgtcttccccaagttgaaccccgtcctcatctcgatctcggacgacggcggcggcggcggtggcggcggcaagctctacgctctctcccgcaccccggccgtcgtgaggcagctggatttcgagccatggttcttcgtcctcgacgacctcagccacaccgtgtggcgccagctgccgtcgccgccgctcttcccgtgccgcctcaacccgctggagttcctcgacccgcccaaggtgcgcgtaacggcgtacgccctcgtcgggtcacacatcctcctttcggtgtcggtgcaaccgccgcaccagcagcagcaagatc

SEQ ID NO: 23434 - DNA, 1016 bp, Oryza sativa
  unsure (1)..(1016): unsure at all n locations
nnnnnnnnnnnnnnnnnnnnnnnnnnnnnnnnnnnnnnnnnnnnnnnnnnnnnnnnnnnnnnaaataaattttaaaaataattttaattttaataaattttgtatggttttgtacggttttccacagttatcgcggtaaccatacttaccgtggcatggtaaccccggccggcggtttgggaaaccctacaacatatacttcatgagaaaatcgaaatatcatcatgaactgacaagtgagcattggcatcgcaaaattcaccccttttgtttgacgtgtctaagagattgcagcttggggaaaaccgtggaggatccacctattatatgagtctaattcaactcaagtggcatgtgttttcataaaactttagctgcatatctccgctatatacatgtcctgggtataacacctaccaaacattttagttgaactacgtgacttgatttagaatagctacattagcgcaagctgagttgagttagataagttacattagcacaagttgcactaacaggggatattttggagagcaccaactagaaaatcagaagtaactaagaataaaaccaacatcctaacaacgcatcttaaaaaaacagagtgaagtgaaacaaaagaggctatcacaacattctgcacgctgtttaacaacagggcagctaacaggtagcttaaaatcacgagcttacagccacaaaggcagctaacttaacctcggatcatacaaccagttaagtacttaactagagataaaagttattggcagatgtaacgcatgccttcacctactttcatggttcttatttttcccccacaatctcagccagctcaccaatcttacctagagttcagatcgagttctcctgatctgcgccagtcctcttgcatatcagagttcccattctcaggttcattttcatcattaaggaaatcttcagatggatcttcatcgtccctttgagcatttccccatccatcttcaccttgctcttgcatcatctcatgactaggg

SEQ ID NO: 23435 - DNA, 20273 bp, Oryza sativa
  unsure (1)..(20273): unsure at all n locations
accacagctaaactaagggcaggctcctccttgagcctgaagaaaaaaaatagtagcgattgttacagcaatatctaacggattcgcagcagtcggcaatcaaagtaaatgaaaaatcaagctgacaaatgaaagcatggaggcaagcaaattcttaccccacgactagctcatgccaggtacaatccatcgattccaccgtgtttctacctcatgtcggtgacgacggcatccggaggctgccctcggcgtcaacaagaaggggtgaaggcaaggggggagggggactactgcggcggcggaggcggcagcgggtggaatggcgatggcgacgagatcgatctagggcgccaccatgagctagagccaacgatgagaggggaggagtgactgcatctcgatccccttctcttgcctcagtaacctaatttctgagccaggggcacattggtcacaacacagccgattttgtgcgttaatccggcgaagatggagaatcagcgaagcagcgggttggcactccttggcgatggcattttagcgaagcaactttgcggagtggcattacagcgaaacccactcttgagagtggcataatgtccattttctcccaacccatgcgttgcatactctattaatattcatattataaataataaaattttaatcatgtgatgaatgtgttagttatattttagaaaataatttcttagaataaaataatacttggtaattactaatttcgaaattaaaaatattattttaataaaatatgaaacataaaatctatgatggatacactcaatatttattaatctgcattatggaattattaaaacttaaaagataataaggtgtccatagtattcgcaatgttatttcttatttaatatgaattttcaatactattcacaatacattacgatcatatgatttacccaatcaacggttatatttctagttaacatgggagttttcttcgagagccgaatcagtataagtgttaattctaattttcaaatattattctagaaaacagtagattaaatttcataattgttttgacactgtggaataagaaaatatttctttatttttttttgcgaacaaaatatttctttaacaaaagcatgcgttgcatatattaattaaatctacaaaatagtgaagtgcaaaaataatgaatcgcggatttataatattgatgaaatttattgtgtaaaggagctagtggaggtcgaacaggagcaaacgtcaatacatgcacctttttttcgttgattttggaatacagtaccatcaggtattttttgcctattttgccaggttatttatatcaccttgtactccttgccctgtagttgatttacaaccttgcgctgttcctggtgataccattgctattaacgttttatcagcatatatgtaagcggattgaaaaaaacttctcatcgtaattcctttgcattcaaccgcccccagcatacagcggctcctctgcggagatcaatctgcaacctgcgcctgcagtcattaacatcagaattgctactttcatgcatcgccctgcatggaatttgtgtgtaccgtatacgtaccgccttacctgaaggagtcctgattgatgttggttcagataaaaatcaattttggtcagggtctgagtcaatggagcttaaattgatggctcgagcgacacccgtcattggcgaagaagtactgctcgtggctgcctccagcgaattcctctccttgcgttcccatctcttcttctcgtgatacgtacgtgcgcttggagattagttctgcctctcccggacgctttggctggagattagattagatgtgctttttgaaagagcccacgaccactacacaatgtaaaagcataacatacaatctacggtcctgattaaaccacttatttatctaacggttatatttttctggttaacgtgggagctagtagaaagtgctcaattagtatagatatatagaggtatagattctacaaatcaacatgcaagcatatacaacgtcacctctcacatcattcgcataatattttaccaaatctatctatcatctttataatatttaatatatatacttatcaatatgttttacattaaagcgtggatatcatttgtattttcatgataaactccgatgttttattttttttcctttttactcatagcttgattatcgaaaaaaatatattgagaattgctttgtaattacctagccaagcatggggagtcacctagtacacaaagtctgtatgaaaaaaaaaaaagaggtagctaagccatcccattacttctcgtgtgccacaatgcatgaagtaaagaaagggatatagcttaaagaaccaacatttgtaatgtttcgctaataattaaagtttggatttcatagagaacttgtggaattgtgttttcttccctagcttttaaattttcaaccctatgatgctacgggaaggtttgtactatattacatataagttaaattatagtatagttacaacgtgatattacaaatagttaaacaaattataactcactataacatctatataatttagtataaaaagttgcatatattttttaatactttatataagttatattatagttatggtaaaattatattataactatactatattatagtaaattttaaaggttccaaaaaaacttgtcgtagatttttaatagtccccttaaagttttaagctgaagaatgtagaaaaaaatatataggcattacaattttaaatggttttacattaaagactgtagaaaaattataggccttgcatttttaaacggagagagtatttaagtaggaaaaccccactcctacaaacacaaaggtatgagggtattttttttagtatttgaatatgattggactttttttcatatcaccctttttctagtaagtgtatatatatattctagttccagtccaattagagcaagtttaatggtatagtcaactgttagctctaattaatctatagttagtccaatagttaattcatgcaatatttaactataaatatatactacatcattaataagtaatcccatatgtcatacgcatattatgtcttgaagttcatactatagcctattttttttctctctcctctctttatctccttcacatatgcttgtagctgacttaggccattcccaacccaagacactagacagtttctataaactccacatcattaggaaattagtactagacactactcttccaatgcaagcaccactattctatactaaaatttagtgctacttatctcacatgatattttgaatgttgtgtagaaaccatgtctcatgcatcttttcttatttattcacttgttatattattttttatcctaggtggcagcttgttgggttgggaatggcctaatagtctggtattgttcatgctcttaacgcatgcatccgctcctttgttccctttgttcaggaccctgtgttctcactggaccaggaagcttcctttgtttcacctcgagatcattattcattagtgccttcagcgttccaaagaaaaaggaaagttgccaccagccgaccagcgtcgtccactcctgtccctctcgtcattaatcacgcattaggtagattcgtggttcttgatttgaataagtcgagctcaccatcatgttcctatccagccacatggaaaaagacgagcagaagaaacgacaagaatcctactccctccgcccataataagcgttgttgtaggtttaattgtctaactttaattatccgtcttatttaaaatatttttattgttattagatgataaaatataaatagtactttatgagtgacttaacttttcaatttttttcataatttttttaaataatatggacggttacacgttgggcatggaaacttgcttcacttataatgagacggagggagtaattagcacagacacgtcaggaggtaattaagtggcgggcgtttttcggcctatacaatagacgcgttttcctttccttttacgcagcgaatctgcgaatttgagcaagactcagaaaaaacgagattagcctaacttttatacgtaattagttcctataatcaggtcaatcaagataaatgtttcagataacattttttttattttttactaaaattctgaaaactttcaacttgaattttgaaaacttttaagtcaagttttgacaactttcagctcgactttaaaaacgttcaactcaaatactgaaagctttcaattggaattaaacactttcatctcaaatttgaaaagcattcaacccacagttcaaaattttcacctcaaaactaaaaacttttatatcgaaatttaaacttacaactcaaaattcaaaattttcatctcaaattgaaaactttcataaatcaaaattcaaatatttcaactcaaattttaaaatttttgttcaaatttcgaaatccgtccattacatatttaaaactttcaactatttttcaaaattttaactaaattatgtgtatgtgttttctgaaaaataatgctaatgatggtattttttgctaattatgtaattagcggtacggacatggtgcgcataggtgggcctgagcgctgggagtcggactaagattaatatatgacaaaatgggaaaagtgtgtgctaactattctattggcgcagacacgcgaactaggcgccctactggcgcctggcggccatggctagcgctttttctatactcgaccgctccctgactttttctgtcatttaatttttcaaatttctgttttcaagagcattcttcaatttacagcttcaatatatacgtgatatcatacccctaataatttcacaaaactatttgtgcttctttattttattttttttcttcttcgtttgcctgctcctgggcgtgtgatactgtgattagcagccggcaaggcctaagcatgcatgagtccatgattgggctttaagatgctagcccgtgcatgcacccgtagcactcatagatgtatccagaattcgcgagacggcaagagtacccgtttcccacgctgcaagaaaattaccgtccaaaattccaaagatttatctgacaatttgatagctccacgtggaccaatcagtagtggcaaacctgtcggcttgagattaatagatcaataataatatatattattttgtctttaaaatgttttttatattaaaatattaacgaccctaaataaaaattgtagttacaaaataggaaggagagagggaggattgcatacctacaatgtaagtacatcgaaaatgctacgcctcggtcgctccccctcccccacgaagcgcggtgcgcccttgccccacgatgtgttcctatctatctgctacgtgtccccaccatatactccggtgcacaaatcacctatatattttagaaaccctctattanggaanntcgttcattttttngttcacannaaatgtttacctagtgtactcacaatgtttcactatgtatagatataatgttgcagtgaattaaagtattcctttgcacaaattcacccacatatattttgaaaaccctctattaagagaattcgtttcattntttgttccaccaaaaatgtttcacctattgtactcataatgtttcactatgtatagatctaatgttgcagtgaacgaaatattcttttgcaacaaaatcacccgtatattttggaaaccctctattaagggaattcgtttcattttttgttccacggaaaaatgtttcaactagtgtacttataatgtttcactatgtatagatctaatattgcactgaactgaaatattctttcactacttgcagaaacatggccttctgtgcttcgggtccccactagaagtcgtctgttttctttagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcccctatgagacaccataaaaccaagcagcttccctgacggtactccgaaggtgcacttttcagggtttaatttcatcctgaaagcgcggatgctcgcgaaggtttcttctagatccaagatcaaatcatccttttgcttggtcttgacgacaacatcatccacataggcttcaacgttgcggccaatctgtgttgagaagcatctctggatcatacgttgataagttgctcctgcattttttagtccgaacggcatggtgacgtagcaatatgctccaaagggtgtgatgaatgaagtcttcaagcagtcggattccttcagtcggatctgatgataccccgagtagcagtccaaaaaactgagaagctcacagccggcggtcgagtcgactacctggtcaatgcgaggcaacccaaaaggatctttagggcaagatttgttgaggtcagtataatcaacacacatacgccattgccccgttttcttccatactagaaccgggtttgccagccagtcgggatgaaggacctctttaatgaagcctgccgctaacagcttggttaattcctccttgatcgcgtcctttctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtagaatcagagggatctaggggaatctttttagtcttggcttcgctttctccactttttgaagtcttggtagcgggcacttctccttcgctcgtcgcggctgcagccagtcggatatcctctcgggcagacgccatctcgcgggtttgggccatgtcgcaactctccttgtcgcatgtgacggcttgtttgatgtcgctccgtagggataggactcctcggggaccaggcatcttcatcatcatgtaagtgtagtgcggaacggccataaacttggctaacgccgggcgtccgagtatggcatggtatgctgtctcgaaatcggcgacttcaaagctgatattctctgtgcggaagttttcccgggtgccaaaggtgaccgggagagtgatctggccgagtggagttgcggataatcctggaattacgccgtgaaaaggcgcattgcttggttttagctcggagcgaggaatctgcatatcatccaaggtcttggcgaagaggatattgagtgcactgccaccgtcgatgagggttctgcgaagcttgacattgcggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccgccgaagatatggttgagttccttgcggtggtcttgaaatcctgccggggtgtcgccgtcgtccttcttcctcgacgtgctttgttcttcgtcggagtttttccgtgtagtcttggtgtattgctccgcaaactgcttgtagacgaaacaatctttggccacgtggttggagttaggatggtgcgggcattgggagttcatgatcttgtcgaacgtgttgacgcgcgaacgctgtcgagaagagtgagtggcggttgcaacaagttcctcaggcttacgcttgcggtccttatggttgttacttccacctcctcccgtagccggcgtacccttgtttggcttccaactgggacccgactgctttgatgcggtgacggcgtcttcagctttggcgtactcgttggccttttcaaacatgagcttgactgtcctgggaggcttgcgcccgaacttgccgaccaattcttcgtggcgaatccctttggtaaatgcggcgatgataacgtcgtcggtgatgtcggagatcttgttacgttgttcagaaaatcgccggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccatggggcaatccatggagccaagatcgggcggaatctgctaaagccactggtaaatagttcgccatggccttgttgtctcctcctgctgcgcggattgcgagaccgtagacggtaagccacgattcggggttagtggtaccgtcgtacttctctattccagtcggcttgaagccggctggccaatccactcgacgcaggtcatcggtgaaggctgctactccgtcaaggtcgtcgtcgtggcggtccggcgaatgatgatggcctcgagctgctcggcgttgtatgattgtgtcgcgaagatcgacggggcggcgacgaggtggtgagcgaggccgttccactcggcgctccctatgatgatcgggaggcgagtgaatggaccgctcgtcgtgacccctgctcctgcgattggatcctgcgccggtgatgctgaggcttggatgacggtagtcatgagatcggaagtggggaactcggctgccagtcggcgtgtagacgctttcggagttgactgggactgaagccgcgatcatggtcttcgtctggttcaagatgttgacgacgtgatcagattgattgagctcgttttctttgaggagggtgtcgaggagggtgatcgcggcaaccgcattctgttgaggggtgcggaaaaccggcgttccttcaacatcttgttggccgatgagatcacgcgctcggcgccctgcttccaaagctcgctgccgtcgatcctcagcctccttcgcggtccgctcacgctcctgctgctcacgccgttgccgttcttgttcttgtgcttgatgctcctcctccagtcggcgacgctcagtctcgcgacgtgcttcggtctcccgggcttggcgttgctcctccgtctcgttattggccatgaagacgccgaagaagagaggggtgtagttgtcatctaggctttcgtcgaagtcgtcgagatccgggtcgttgtagagagagctgaactcgtcgtattccacgatgtcggtggggcgcgagtcgacggtgggagagctgtagtagccatccagctgatccgtcgaaaccgtgccgagtggttggaggatgacgccgacttccctgaagctaggcgagatcggtgttgaagccgacttccgcctaggcctacgggatggagacgctgtcgtgatggagatggccgccaaatcatcggggagcttcatcaagaccggtgggtaagccccatcatcttgatctggtgtcgttggagaagatgcgatctcgcccgagtggtttgaagccgactcgattgagatggtcttggggtaacttttagccgcgtttgggagtccaaacgggactgaaatccggttctctcccgactggtttgaccccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctagaaaagtgtatgggtttggagacaaaggatttatacaggttcaggccttcttattcaagaagtaataccctactcctgtccggggatgaatccgccgagtgtattattgattgtatgatttggagaaaatcaacatccgcccctagaggcacccggaccccccttatatatgggaaggagtccgtgttacaaaagataatctatatccctaacggaatatgtagatacagataaaatacagccgtaaccgactaagtctcaaggtgtttccttgatgtacaagttaagaaacaaacccgagatacaaataagatattctatctatattcggtatcctgtattcagcccaaataccgtcgccgtgtagatatgggatatccataatctccacacatatatataaacatataattatcagaatttacaaggttgaccagacgaattatggagcgtgaaataatagatccagaacataagtcgtaatacaccactatttttatatattttgccattttatggtatggcttatgctagcttaagtgactaataaacccgtacgcaccattacacggaagtcaggtaaaataggacacgcaaaccgaggaggccaagaagtagcagccctcatcatgtatcagcccctgtctagctttcttctgtgttaggtttgttcctctttgttggcctcttcctcgattgtgtccataggaggtgttgctgattccatcttggccttcttcagtgtttccactaaacctgccaggcactcgtccgcgtctctcttcctcttgcaccgtagcatgtgattaccggccacgtctgccggtgcgtcgatctcatcgatcagtcgactgatttcaccgttcctcttaccccgcggcatgaggttatcggcaacatctgccggagtcgtgtcggtctcgtcgagcagtctcccgatttcaccaaaaagcgagtgctcggtgatgtccaggtagctcttggccagcaccttaaaggcatcgaggcggcagtaggacatctcgatgtgcttgtccatcctccccggccgaatcagcgccgggtcgagcctgtcaacgtggttcgttgtgaacacgaacaccctctcgctgccgcacgccgaccacagcccatcgacgaagctgagtaggcctgacagcgtcactttgcttttatcatcagtcttgttggaaagctcgaccagcacatggttgttgtcgacttcgtcgctgttgtccatcttcttgcccttgcgcttggtagtgagctcgacctcgatggcgtcgatgtcctcgataacgatgatggatttgtccgtcgtatcgaggaagagcttccgcagctcggcgttatccttgacagatgttaggtcgaggtcgtagacgtcgtagtcgaggaaattggccatagccccaatcatagtggtcttgccagtgcccggtggcccatacagaaggtagccccgcttccacgccttgccgaccttggagtggtattccttccccttctggaacgccctgagatcgtccataatctcaaccttcttggcatggtccatggcgagcatgtcgaacgtcgacgggggattgtacgggacactggtccacatgctgatctccccttgtttggagtggttggtgaacagcagcctctgccggtccttggcggttagctcgcgccaccgccggatgatgccgggcaggtaggtcttgagcacgagctggcggtggcgcttgtggaacaccagcctgtagcaccgcggctcgtccgtgtccccggggaacatgctgatgatggtgctccctgtgttcttggaggccttggggtacagcctccaccacatgcgagcaccatccaagcagtcgacgacctcctggttctcgtctagaatcacaagcgggtcatccccgatgttgttgccgagcttggccttgagcttggttgcgctgcccaggcacgcgctcctcaggtaggtggagacggcgtcgaacatcttgttccgccggaaccgctcctcgccgtactcggacacggtgatctgctcgtaggggttgaagtaggacataaccatggggaccacgctactgatgatgtacctagcctcctcgtggacgtgctccggcatccgggaccaaagcaagcccacgccggccatggccgacccgaaccctacccacgtctccagagtcgccatggctgcgcagtgcagtacgacgtcactcctttgcttaatcaagctggcaagctaggagctctctgtgtaattaatagctgccgattgtggatgtgtatgtctctccctccatcgtcgcttctctggccccagcttatataagggtgttccttgggtgtaaaggtctcgaagtatacggacacgtatttgaattattaaacgtagactaataacaaaacaaattatagatttcgcatgtaaactgtgtgataaatttattaaaactaattaatccgtcattagcaaatgttcactgttaaatcatggtgtaattagactcaaaagatttatctcgtaatttacgtgtaaactgtgcaattattttttcccccacatttaatacactatacatatatctaaacatttaatgtgacattttttaccaaaatttttagatctaaacgaggcctaaccggtgatttagcgcgtaaattaatgatccacagttccacaccgtttcagcgtggaagaaggtgtgagaacgcgcgcgtcgttgaagcttcgttgaaggaaagaggtcgaggtctttgtttggacgtgtctctctataatagggggctccactggtcgtgcaactatatataggtcaaccatggcaatcagcaatcatgccacaatctaacctatattttcataaagttataattatagccatataaccatgccacatcatcacccattagcaataattatttatttaacctcatgcaagcatacaacatcatatatcacgtccaatttatttaactaggaaggtagcccgcgcattcacgcgggcatgcgtcgtacgccaagtttgaggtatttataaaagcgacatttaacaggagaacatctgccacaatttctccatacattatttttgtcagcattaattaattctttaataatattctaacctattagatttatattatatcaaatataagtagtatctataagtaattatttataatattcttcatcattttaaaaaaaaggtagatttattttctttagaaaacatgtcaacgaaagtaaaagtaagtgtaaaataaaaattaaggtgtttttatttttttaattgtataatatattatcataatatgttaaaggatgaattgggtgggacattaatctacacaaaaaatgcacgggtttatatagcctaatatgattgatatattttgagaggcgatctacctatgaacatttcatgtagagtgaatgagaggctccacgcaacctagcaggaatacaataacgtcgaaatatcattgcacagtaatatttttaaaatgtcatgtaccatgaataaacacttgttagaaacaatggttctaccggtttaaaaggtataggagcgcacacatgcatgttatgcagtgagccagacagagattctgatagaatttgttttttccgaaaagatagatatgatggtataaaaattgggtccatcggtttaagtggaaaccgatggtcgattatatgagtgtttttgtaattaatagaatgccacatagcgacttagaagtgtttaggagtgctaggagcaatcatatgtatgatttagatgctatgatcattttaagatcgtttatttatcttttaaatttaaaatatcatttatttacaaaagcatcaagatcaattcgtatatgtaaatagcccccaggtgtatgttgtgaggaattaataaagtttttttatgaagaaattaattaagttggtagaaagtcattagatgtctaataatgtacttttaatgggtttaacagtttcattaaaaaattagctagcatattttgattttcaatgacaaattttaatattttcttttatttagtggagcactcaagatggatgtaggtctagaacgcaataaatctaatatagatattaaaattatatatttatttgaaaaataaaaatagatatataatttatggtacaaataattgtaaagactcgtaaaattaatccggcctttattaaaaagtctaaaatagcacgtttaagtataaattagttaatatatttctttgttagtttaatgcgtacagaatgtaacgatataaactttataaactttatttaaatagtgtattatttgaaaataatgctccacataaagggttcacgtatacctttatttaatgggtaaaaatatagtggtgtaaactttattttggaagagatatatcataatataatcatataagttatgattatataaaatttaactatattaactgttatctcgattatatatatatgaaaagaaaaaggagggagggagatggaaccgtacgtacgtacgtacctacggatggtgtggaattgtacgttttaagatcaatatagttaatctgacggtttctaatagtggacccactattttaaaatcaacggatagatgcttttcttttttctcagaatttctttgatttctctaatttattagagcgccaactggtggcttaagagcgtttgtaggaagattaatggacttttagtatataatagatagatagactagtcgtcaacccgtgcgttgcacgggttattattaaagcatggttggagcaatttgattaacatgcatactacctcaaagtgcatagttagcacaggaaaataaatatgatataatttcataatttgtaattcaaaatttatgagaatcataattttagagctaatataccaaggtaccttagtttgcaggctcaatcatagatatccaaattggtaattattttcatgaattcaattcaaaaaaactcaatgaactggtgtactgcatgctgtctcaattattataacagaatccataataagtttctcttatttcattcaaaattatatagatatccatcttagtttacagtctcaaatatatattttttttcataatttcatttttttcaactttttacaactcgccatgatgtaattccaaaattggaattaataagcatacagctgtattttgtgccggtcctgtgcattcacacgggctatttaatttataacatattatttttcacctatattagaaatatggaaatcttaaactgaaagtgtgaaatatctcggtcaatgagcatcgtcagcattattatcctttgtattacatgatctttactcatggatgtatgtaaatatagtatcaatatcatcaaaaagaatatcacggttataaaaggggaggaatgaataagaaatataaagcacgttataataaatataatctatttctcaaacactgtagatatagatcacccttaaaaattatatatagattcagtaaaatgttttttgttgaagcaactgttatattatctaatagttgaacttacctgaaatcttgtgtgataaatctatgtttgacttgtgcaaagcataaacaaattaactaagaagtctcgatagcatacctgaaaaaagataatatgttccatagtatttatcgaagttactttcagctgtaaaaaccccgaaataaaatagtagcacaatttacacatgcatggtgataatataaaacaaaggcaaggagttagtgaatttagatttatttgaataaggcctccataccaattagtatgccaacccatgagaaaatggacattatgccactctcaagagtgggtttcgctgtaatgccactccacaaagttgcttcgctaaaatgccatcgccaaggagtgccaacccgctgcttcgctgattctccatcttcgccggattaacgcacaaaatcggctgtgttgtgaccaatgtgcccctggctcagaaattaggtcactgagacaagagaaggggattgagagggctgcaggcggcggtggcggtgaccattctgcggcggcggcggtaaatccgcgttgccgatgccctcctcctccctccctccgactgttgccaagcaattttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgatgatctctagacagatagatcttatatgaatcgtatgatgaagtaccacataagtggatatataggaaaggaatccaaatctgccgaatcgctcatgttatgatcttctacatcctaggtctccgcgttccatcatctggcttatgttcttcatgtagcattcatatcgaatgactctatgaaattacgtcgatacttctacatattatgggtaacgtaggagacatccctattttcccccgggggtcttaattaccacagcttagctttcaattcgcctctgaccatcaaattaaatgtgaataacccgtcctcctctctttgaaacaaggggcgcttggccgacaccgagagcagccgccggaagccgtcgtcatcatgcagcgaagacttgccgccggaagcgatgatttgggaatgtcgcaaggtagctcatatcatgctcggctgcctgtaggatttagcggccggcctccctctcgttcgttgccctaggtgtggcgctgcaggagtcgagtgcagatcgatgaggcatggtggaaaggttttcttcaaatgtgaggaaaacgaacaagatgtgagtattccatttgttgcatttggtgtcttttggtctttgttactaatgtgcatttgttactaggtgccaaattcttgcaagtttttcaagtggatcgaatgttacaagaagatggttgaaggattgagtctacatgcagttgatgaagctcccagtgatgttgcattggagcatatggttgctgctcctgtagagatgaagctgaggtcggttgatgatggaaagatggataagttgataaattggattcaagttttagtgatgatcaacataggcctgctagttctttgttttattggcgtgcttgtgatgattttcaagtgaactggcttcccggggatcctctagaattagaccaggaatgtaagcattgcaatgtatctatttagactaatgaatggcatcttttgattgtcctgcttgcttgctgaaatatcaggaatggtattatgttattttcgattgttgtgcaattacaaaaatttgggcatttccatttgagatgagtaattttggcatgttttatgcacaggtgacagatctccatgaaacatcagttcagcacaagtgcaagaagttgttttgtaggaaatagtcctgcaacacataattccagacaatagcatccataatttcagcataagcatccatattttcagacaatggcacataaattcagtaaacgcatacataatttcagacaatagtgaaggcatccataatttcagacaatagcggtgcagcagtgcaccacataatcaagcatccatagtttcatacaaaacatggcataagcatttgtccacatcacaatttaggttcacacatagcacttaggttcaaatatattacattggactcctcatggagcaaaatggcctaatagatgaagtttttaggctaattcgaccagactaaaactaagttcaggttttaagtttcttctttggtgtgagcttctttctaggagacattctgggttgccagcttggtgctgcattgcttgtagcctgagagcttgaagcagcaggctgagagcttgaagccccaatgtcagcagtaggttgagagcttgaagccctaatgtcagcaggctgagagcttgaagatggaatgtcagctggctgtgaattagaagctggaatgttctgagctcctcccttcatcaatgatgctagccggctgtaagccatggtatttgaacaaatgagtgaatagaccgaaataggacaaaatctaaagtaatgtgaatgtattttagatgattaccttcttgtaattcttcctagactttcttcaagtattgtctgcactgttggtcttttgggactaggaatgtcagaagtgttcccatattttgtagtgttcctccttggcttcctcttccagcaaattacaatacaaaataatgcattacagttatgaaactgtactccagacaaaaaaaattggtattagtacactagcctttttttgattccattaagggaacacttgtagcttgtttgaacatgaccaaattccccacatcccttgcatcttctcttgccccttaccagcaccctcttccctgagtcattatcagttggagtagttttggctttagacttgccaccaccctccaggcaacttttgatcctaagctttatgtatcttccatttgtcttctttggcaaaggtgcacccaacacccatggcaattcaacctgtggccagtaagacttgtcacccaatggctctataattctcctataagccttcctgaacagctcaactgaaaaatagggattcacaaagtcctcaatgttgacatccctattttgttgagaggttatcaaagccaatgcatgctgacagggctttccagtgtgctgccactcctcacatgagcagtactgattgtaagccttcacaacatgtttctcatgggtggtgctgttgtcaacaatctctgcacagaagctatcagatttcactactgagaggtgacccaaacccctagttcttgccttaagcttctgtgttacagcaggcaagatgttcccagtcatcttctctgcaattcttctcctcttgttccacaataccataaccaacactctgtcttgtctgcaaggtcacatattggcaatgtcttataatccttgatccaattgttgaaactctccgccagattgttagtaatatagtcacactttattgctggattgaaaccactcctcatccacttcaatggatgataggcttcaagccaaggaagaacatcactacaagcttcaataacttcttttgtgtgactttgccaaatctctttcctgtatgcccttgctgctgggtatatgtgtgagtgcacatcaccaccaaatctcttcacaaagttcttcatcaaatgccagaagcattccctctgctcagcatgctcaaacacagtatgtacaaccttttctaagcctttacatgcatcagtacaaatagctaatggattcacatctcctatagccttatgaagttgtctcatgaaccactcccaattatcctaagtttcagcattaatggacccaaaagctaaaggatacatccagtgatgcccatcaacagaagtggcagcagccaaatgaccattccatcttccattcaaagcaacggaatctatactaatatatggcctacattcctataggaaaccgtctatgcagggcctcaaagcatagaaaaacctatgaaaaaatactttcccaccaacctctacagtgtctatctctatcacactccctagtgaagttcttagaacctctgccctccatctataaagcatgtgaaaactttcttcccatgtcccatatagctcaaccatagccttttctctacctctacatatagtgtcatagttaattgtgcactcgtgatcttccattagttgggtctacaaggctttagggcccatacctggattctttttaagaataggaattgcgttacttgccacccatttagctgttggtgtggtagtctttcttctgctgctagaagtgcatgtatgcaagtcttgtaacacagtcacctacaaattaaatgcaagaatccatcaattctgcaaccattatgccaaaatcaaacaaaaatcactgaaattaaatgccatcactgtcttctggttaggttgtttatgccccactatatgccaagggcaaccttcaactttgcaaccacctatgtatctttcagggtcagttttcaccaacttcaactcaaactcagcatttatagcaaactgtctcattgccaatctaaattccttcatgttagggtacactgtgccagccttcatgcaagaattattggggtcataggccatgaccctctcccctggtacttgatcatcgacaggaattgctgccccagtta

SEQ ID NO: 23436 - DNA, 379 bp, Oryza sativa
ggccctatgtgatgtgtgccagcgtgtcaaggcagagcaccaacgaccggccggacttctccaaccactccaagtacccgaatggaaatgggatgaaattgggatggatttcatcaccggacttccaaaaacccaaggcggatatgattctatatgggtagttgtggatcgattaaccaaggtagcccgatttattcctgtgaagaccacctatggaggaaacaagctagccgagctctacttcgctaggatcgtgagtctccatggcgttcccaagaaaatcgtatctgataggggaagccaattcacctctcacttttggaagaagctccaagaagaactgggtactcgattgaatttcagcaccgcctatcacccg

SEQ ID NO: 23437 - DNA, 1355 bp, Oryza sativa
catatatatatacatatatacatatatccatatatatacatatatatatatattatatatatatagtatatgttgatgcgaaaaacacacactggcataggagatctacttaattccagtgcaggtgctaaatcttgctcttgggttcaaaggcgtgccagttggtttgatcctgtaaccaacaagaaacaaagaacgaaataaatgaggttaaatccataaacgatagccgatcggctaatggccgatgacatatcgtttatcctttagccgatgtcatcttgaattcgatcggcaatgaataataaagcaaaataagattaaatctactcgatcggctgtagatattagaaatatataatctatgtcttgacatatgtttaaatcaagtgattgggatagatcgaacatcatgccgagatagtataaatcacttatatccaaaagtacttcaagatagggattatatatactcatagcttagccgatgaagattggtctaatatgtatcagctattgctccgatacttctctatattaagatattaaaacaagtaaaatacaccgaacggtaggcttaatatattttaatgcactaagattttaatataaagggcagatttagtatatcaagtaaacatatagatgacatgataacttaatcagataatatcggctaaaaccccgacactatctctattgatgatcataaaacaagctagatattatggttctaaatattacctaatagatcgaacctaaccgatgcagcattaagcataacgagaaacaaaagatctaggcaagttgatgaaaacctcttgaagatgaccgatatgttatataacctagatcaacgatggcatctagccctattggtcgctttctgatcgcagatgtcagccgattcaaggttagatgacaatatcgatagagattatataacatatatgataactcgacgatttacttaaacaagattagagtatcatgaagatgtaagcactaatcccgagaacgcaagccgccataacaagttttacctcttactggagatcgaaactgatgcagcccaacttgaagcaagaactcgtcgaaagtaatgaaaatagaaaagggtggcgatgcgctgaaagtgttattgaaccgtcgttgttgtttacatgggatcgggctatatttatacctgagatacataatgggtccttgccggacataactcttatctctaacaaactctaagatatgaacaagtctttacggcagactcttaccggaacatatctctaaaggaactatttaaaatatcttaattaatagatacaattaccttcccaggactcaatccatacgtg

SEQ ID NO: 23438 - DNA, 8789 bp, Oryza sativa
  unsure (1)..(8789): unsure at all n locations
cgcattgtagattggataagtaatttacgagaaaaatcgttttgaatatcgttaaaggtgcatgtgtgtcatattggagatagagatataggcttggatatttgcatgtgcgtcagaggcagcatagttattgtctgcccgatttttctcgtgtccgggcatctgaagatggagagtgctacaaatcggacgtctgatatttttcaaaatatcggacggtgttgcactgtattattgcaaaatgtttcacatgttgcactcctcgataaaaaaatgtttcacttaaaaagttttagatgttttatcgatcgaggaaggtgttgaactgcactgttgaaaaatgtttcacatgttgcactcgatgaataatgtttcacttggaaagtttaagatgtttcatcaatgaaggaaaaatgtttcatcgcttcaactggaaagtttcagtttcagatgtttaatcaatgaaggaaaaatgtttcatcgcttcaatggaagtgtttcaaccaaatgcaatcaaaacgtattgattgcaacatgaagattcaatatgtgcaacatcaaatcaaacaaaaatgaaacaccttaatacaatggagtgccacaagctaaaataataagatgcaacgtccctaaactccaaacaaaacaaacccacctccatcttctccgagaatacaaacccacttcaatcttcctcaactccggtcgccggcccccgagaaaacctacctctcttcttcttcaacaccggttgctggtccccgatgaaccactctcttctccattccgctgcgatggccgccgctgccgccacccccaacttcctcctcctccgacgcccgacggcacccaagctggccacggcagcctagcagctccgtctccccacgcgggctgctaggaatctcctgcatggcagtggccacgcccgcgcagtcttccttctcccccaccggcggcggcgtcgccgctaaccgcaaggtcttcaacttcgccgtgggcatggccacgctgccgttctccgtcctccagaagcgcaggcggagcttgtccactaccatagctccggcatgaggaagatagatggaaatgtgtggggaatggagtaagtagtcagtggggaggagagagagagagagttaggaagttgaagggataaggctaacatgtggctggtggagttgaaaagtgaaccagtaaaatagatgggatggtggagtgccgaccgatttttttccaactgccggacgttcggcttaaagcattatagatccgaagatgctcctatgcatacttggatggaaccaatcctcggatgcctatcgagggcttccctaaatgaaaccaacacattattgtaatcagatgtgattatgacgtcttcaaggctgtgaaggtgctgaatgccatatagagacttggtatcttgttctgcctggccaaaaacaataagatgcataattctaagctttggcattgctcctggcttgatcgacaaactggaggtggaggatccataggtcaactttagttctttgagaactgaaaatgatacactatctataatgatctccatgccaggaaccatgaacacttgcaagtcaaggtaagctaggcagggtaaccttgagagaactcgcatatcatcacccttgagttcaacgaccttgagacacagactagttaaggtctcaacctgttgtatccaatatggaaccctatggaacgccttgtaaaggtgacacctctgaaggaattgtggaggaggagaccagctgcacaagaagctaatgggtggttgcctgatattcccctctagaacaactctgaaatctagacagcggaggttgcagccgcccagttccctgagagaagtggcaagagcagcaaactttaccatatctatcaggtcatcttcatcgttgcctcgacggcgattgtagatgacaccaagcgtccttagattggtcagcaccccaagatgtcggatgttttcaacaaagcaattgcagaagttaattccttcaagtgtacgtatagaggtcagcctggtaatccccctgccgagctcttcactccctgcagctctcagatgccgcaatgatggtaaacaagcatcacgcagaaatccacccacgagtacgagattagtgccgcaatttatgtcaaccacttgcaaatatcgcagttccccaattgtatcaggaaactggaaaaaaataccttccaacttcagatacctcagttgaaaaaggttacatataggagacaaatcgtatattgcacggaatgaaaaataaccttctattctcatatgtagaaccctcaaggctttaaacatgcgaagacgaggcaagctttcaccacgctgatggagccaattcccaaaataagtgatagatcggacttgatgtaaagactcacttgcttggattatgttaccacagtttgatcggtagttgagccggcgaatcaaaaagttacctcgtcttgagcaatcttgatcagtactaattacagtcacaaagttttcctccgtcgacttctcaacaataagatcaagtaacaaattgtgcacaacacgacaggagacaacctcaccatacttaaactgaactggctttatcaggcttctatttatgaggtctctgaagtagctctcagcaatatcttccaggtctcggttatctctttgggtaataaatccttctgctatccattgtcttaccaagtctttcttcatgatgttaatgttttcaggatacatatgaagatataggaggcacgtcttcagatcccaagataaattattatagctaagtttaagtatatgcttcatccatttagagttaggatttgtttccagttcaaaccccatagagttttttatcttcaaccaattatccagtttgttaacttctctttgactagccaaaagactagctatgacatctatagccaacggaactcctccacattttcttaaaatatcaacaacaattacgagttcttcaggttcagggatgtagttatctgacccatataatcttctgaagaataagcttctggagtccgtccaacctagtggtttcatcttatagacaatgccacggaagctagagcagcaggcatttgctacatcctttgttcgcgtagttgtaataattctgcttccactgttgttttcgacaaatgcaccactaatactgttccatgtttctatgcttgatatgtcatcgattacaactaggaacctgagaaacaaacatagctataatcaatagcagaaaaccatagatatctatagaaaaccatatcaagctatttttgttataaaccatatagttaaatcctggccttcatactcattggtatatctatatctatacctaccccgggcattatcttgtccagataataaactgttaaaatttctatcaagtctacaatcagatagagaaacgatgactgaatgcagcatgggtacagaacatgcgctgcaacagaaaatattagtacagattcgtaacgcccattacaaattaaaaatggttctcggttatgtaagttgagcatcttcattgtttttagcggtatggttaactggtcaaggtgatattgttacttatcatattactgaaaacaacaagatttataggtttaaaaagaatgccctaaaacaaaatcagaaactaccacatggtaaacatgctgatggtgtaataaatcaagataatttagtattaaaccttagacattaagttttcagaacatttatttggtgaggcatttcaattattatcagcaagaactacacatgatgattatcagtttgttgcaagaataaatttatccatttatttttattttagatatattttatgacaagaaattcattattcatcaagaaacaaagtggctagctcacactgaaatccaacagtattatctaaaggaccttctgtagtccttgttgatatagtactagttcaaagtccaaacctacttactcattgttttagcaatactaatattgttcttgtgtgcaacagtacagatcttgcaaactatagtctttttatagcacttgtgtgcaacagtattagaaggtacaaaattaaatttctagtcgttanttctgggtaatantttgggacttatgnaagatcanantttnacatannnaatatgagtacctcacaagtatcnttatcnagtnaccataaatatctcacaagtataatgtacctctataggacccttaaagagctattcaattgttgttgctgctgctgcatgttattgctgtcattgtttttgcaattttaaacctagttcaatgttatactcaacataatttacattgaagctgaaatcactcatcaagtagtaagtttgtgtgctagtgtgacaattatgatattttatatataattcctttttttttgcagcagttgctagaaaacattggttaaaatcttttgtgatgtttgataaaaaggcaaaattagatatacagttatttgatggttcttcatgtaatatttgcatatgatttgttcttttatagggaaaaaaattatcatatccaatcacaacatgttaaaaagaaaagaagatatattccctaggatcaaccaactatcctctcgttcaagaattggccatcggctgattttgtggattgtggaactaaaaaataattcttctgacacatgtgtagagttgttgataaacaaatagatgcaaaggggtggatttttttcgaagttctgactaaaaaggacaataattcttgaagagctttcatgaaagtaaaaggtggtgcaggagtattgtgaaaagaaagtattaaacaatggggaatgcacaagttttgcgaggaagtttgggttgttaaagttactttgtgagtagaatatcctaagccatgagtctcactctggtgccctctacctagagtagaaaaaaatctgaactgttgatctcatttgatccaaaggttcatatctatttctactaccaccacatttagtggtagtagaattgtggagggctactttgtccaggaaaaattatctgcggagggatattttcgtcctttaccctgaatcgcgcatctggagccgatgcggagagaaccccgcggctcccatcaccgccttgacgacctcgcctgctccaccgccctcgacgcctcctactcccacgcctccgccgcactcgccgcctcagccaccctcgacgagctcgcatctccgtctgggattgccagagctgcgccctctcccaccgctctcccgcgttggcccaccttccgacgagttcgcctcccggatctccgcctctgacccagcactgcgccaccggccgtcaccaagacctcgtcctcctcgctatccccttcctcgtcgtcggcctcctcccccacgctcggctccagccctgtccatctccgcccgccgttgatcccacagccgcgagggcaagcccccaatccatcgcctcccaagcggaacccgcagcctccggagccaatgactaccgatctctcgacctccgaatcatccaagactcctctcgctggctatagcgctgctctccaacggattagctgacatgataagactcttgttctgctttgcaggtcagatttgatttgttttttttgctgcttgcaggtttgcagctcgaacatctgtactgaatcttcttttttgttggcctctagttctcgaatagtttttctgcttgtctgctcaagctctgaatttcttggtcataatttttcctcctagaagaagggattcaagttgaatgctagtaaactgaatccggagcaagtgagcttgttcagaatagctgagcttgacaaggtggacaagctaatgatcactacgtcaatcaacgcttgagagattcctggtgtgttatgtcctgtaattcctgtgaatccattatctcaagatggctttgggtggctttggcttgttactgatggccatgttttttttcagcttgtggttttgaaagtgcctatctgtgtatatcatcgtttttgtggttcaatgtatattacttgttgtaattgcaattgtaaagtctatgtaaaacaacataccggattattcttccgttgccttgtatctgtcattgctggattggagtgtttcgatttgtccattgtgtgtaatattcagatatataactagtatatttaaattttatatgaaataatcaagctgaatggaaaccaaatacctacagcaagaaacagtacatctatggaacgcgatgcacaagcgccggcggtggctagacttcgcgatctgcttttctttttctttccctgcgctctccttttcgattaatgaggaaacggccactctgctgtacgatggagagggagcgagcgacgcttcaaatgagaaaaaaaactaagtgccaaatttacccctattcgtttttagcactttactaatctgccctttaaaataaacggtcaagattaattctacttgtagtagaatactgcaagtaaagggcaccggagcgtctctctatgttattagcaatcaacaaaagtgatcagttaaagatatggttttacaggaggccttccgaagaaacttcattgagaatgaataggagcatattatgttcattactggagaatgtagaattaaactttgacagcgatgggttatctttgcctcacagcacaaatgggagatattctctacaagatccttatacagaatataatgtatggcaataagagatagattacccgatggccgctctcttttacctgtttttatataagactcttgtattggctttttttaaagtaaagttgaattgatattcttgtgagtttctcaactgtttaaatcccaggccattggacttgacaattcaaagaaaattggggctggcaacgaactggctccgctgtaagtttttttttttataaaactatgaaactattcttgtagttacctaggaaatattaagatctcgaatgtgtcttttgctgtaacaaaatttttgtgctgttgtttttgtatatatgtggttcctctttaatagttttcagaacaatatatatttgccagaaaacctgaaacttgaagaaaaacattggaacattttgctcaagcttttgtcatataatgttgggaactacaaaaaaaatttcataaattttagaagcatatgatgaggccaactatttattacttcttccgtttcataatgtaagtcattctagcatttctcacattcatattgatgttaatgaatctagacaaaatgctagaatgacttacattgtgaaacggagggagtaggtcatctttgtccataagggcattatggccttttttttcagaaacatatctgcttatacgtatcattaacatgactaggaagttgatttatcgatcgtatataaggaatagagacaaacaaaatgcaaataattgattggtactgaactgagtgccaaggaatataattctctttaaacacctaagtaggaaaacccaaaatattatggactattatatcaagctgtttgctacatagacctttgatggtacactaagttgttgtgatccatccattgccaattggaatagttgtattgacacaacgaaatagaaacatagaagcatatgctctcatacctcttgcaagcgagtttttctctggttgcgtcgatcagactttgtatgtcatcagccgatccatcgtatttgagttgtgaaagaatgtcctttaaaatcactgacgcgctacggtttcgtgatgcaaacacaaacaccacgcactcaaatctgccatggattttattataaacctggatggccaaagttgatttaccaagacccccaagccccacaatggagagcaccttaggatgctgtcctgactctccttccatgtcctccattagcaactgcgtaatcacctcacacgggacattgatgccgacgagactatttgcctctccacacaggacaggtgaaatatcatcatcgatttcgtctatctgtctcggattagagctgatacactcgtcaacgtcgagattgtatctctctactcttttgacttcctcgacagcataataatccttgatttcgtcgattttggcgaacaagttagggagcatcagctccatcgtgtcagtgagcaaggtggccttgtcaactgcagtgccaaaactgtgcatgaacatgtcaattttgtcctcgacaaagtaggccagctcacgtaccttgttcctcagctccctctcctgaatattcagagcctccatgtcaggcagcttctccagtagagcattcatgcagctcaactcctctttcaagttccagatattgttcttgaaatcaaattgggtagaaaattggaactctgccaagtcgtatcgacacacctcttccagcttcaccaggagtgagttcatcaccccagtcgaaatgttcacggccatggctcgatcaattcctctctctctctctcgctcgctctttcttgatctatgcttgtcaatgatcttggcactgcgtttgaatgtcagtagctagcagatcaaccctccagttatataacataagatactagctaattaattgttctttttttttctttagaatgacagctactaatttggaatgttcacgaactttcctacgtgaagagtattgtacgtcgatccgtataaaaaaaaatgaaccgtgaaaatcttataattattgctggtgatgcacatgcatgtt

SEQ ID NO: 23439 - DNA, 5308 bp, Oryza sativa
  unsure (1)..(5308): unsure at all n locations
nnnnnnnnnnnnnnnnnnnnnnnnnnnnnnnnnnntgttcacggccatggctcgatcaattcctctctctctctctcgctcgctctttcttgatctatgcttgtcaatgatcttggcactgcgtttgaatgtcagtagctagcagatcaaccctccagttatataacataagatactagctaattaattgttctttttttttctttagaatgacagctactaatttggaatgttcacgaactttcctacgtgaagagtattgtacgtcgatccgtataaaaaaaaatgaaccgtgaaaatcttataattattgctggtgatgcacatgcatgttatctctctctctcttaaaagaatccatggatgaaactgtaggcgaattttctcccgttgaccatttcatatcataaaacatgttggccacaaggatcaatttgacaaatcttaatggttctacatctatcgttccttcgtttttagcagtgacactatggagtatggacagagcaacatgatcaccaaaacacctagtttcattattaacatgtaggagtataaaacatatggaaatatacagcaatgttatactattatttgaaactaattttgaagataaatctggccacgacagtgtaaaaaaaattgaattgaagtacgaaaaaaaatatgaatgagcaagatttaaagttggcctcatcttttcgcttaattatatttatacttataagctaaaatttgaattttcatctttaaatttaaagctgattttgagttttttaatcaaagtgtattttttatcctttgtttttagatcgctaagaacacatatataaaagttttgttcacaaattatttttcatttgcaatcatgtcgttggcttatttcacgaataagccaaaatggcagggtaatttccttgccacgaataatgactatggttcataagttgacctgctaaccatcacaacgtaatcccaacgttggtctaatggccgggcacatgacaacccttagtttggtggaaccgattgtacgggtatgttttttttcttctgtgccgggcaattaatataccctatccgtcaataaatatttgatgttttaattatattattcgattagatttttgaaacgttgatcataaataattttacaaatgttttagatgattagagcaagtataatagtgagttataagcattctataaccttatgtggaggagagaggtaaacaaaaaagaagggtgttgactctcatgcaagagctagcttaacacaagctccaagacaaatacattaaatatataagtgagagatagagataggagaagaaaatcataactaatcttatagctaatctataatatgtgttgactttaggatgggctaatagtagaaagtaggctatatcaggccattcccaacccaatgactaggatggtgttcatagcattaaataagttgccacctaggataaaaaatgatgtggcaagtgaataaatgagaaaagagaaggaaaccatgtcttgcatgagacatagtttctacacaatatccaagacatcatgtaagataagtagcattaaatttaagtatggaatagtgatgtttgcattggaagagtagtgcttagtactggtttcttgatgatgtggtgtttatagaaaccatgtctagtgtcttgggttaggaatggccttattatctttctcttaaagagatagtacatgtatatttcattaataccttgaaaagtaatatcatgtacttttctacatgaagagtattgtacgtcgatccgtattaaaaaaatgaaccgttaaaatcttataattattgctggtgatacccatgcctgttatctctctcataagaatccatgaaaaatactgttggcgagaactttctcccgttgaccatatcatcataaaacatattggccacaacccacaaggattaatggtttacatctatcgttacttcgtttttagcatatatgctacttccagtcgtgaataagtgatactccctctgtttcaggttataagacattttgacttcacttaaagtcaaactgttttaaatttaggcaaaatttgctacaggacactcaaaaattatgtaattagctgagagacaccgcaaaaaagtgacattgcccatagacactataaaaattatataattagctgtaggacaccggacgcattattttattatttttggactgaaagtggtgagttttttttcaaaatgaccggagtgcccctgcccctcgccatctatcccagacttgggtccccggttgaaccaaacccggtaggattcgtcacctggtgttggcgagcggatgagcaccctgggcacgacattggcgaggcgagtgggtcctgctgccgcgacatcgactagtaacaggtggctgccgtccacgtcgcggagccccacatgtaagcccctctctccttctctctttccagatgggggcagcagagcggtgactcgtcgtgcctgccttggcccctgctcacgaccgtgcagcatcgtcgcagccgaggcgtcgcatcggcccgtgccttgccgtgccagagccggcgctctccctcttcctcaggcttgcttgaagaaatagcaaagagagagagaatgagggagagaaaataaaagaggagaaattccttttccacaatcatcagataattgagttgaatcaaacactgcaatagtgcaattccttcaaatccaccacaaattcagagaggaattaaatcacaaactcaaccaaaggaacaaacaaatcaattgtgcaatcactagcaaagctaggcgcagccatggggatgcccacgacaagctttagttcttgtcggcagtggcaagcttgcacttgaccttctggaacaccaccgccggcggcgcaagctgcagcgcttgagcaggcacggcgcggcgagcttgcacttcgtgtagtgcgcctggtatctgacctcaccggagactgtcacctccaccttgaactcccttgtcgcgttctggcgccacctccaccacgtcgtgccggccccagcccctgcgtacgattctgtagcgtcgcctcagccgaggcaccacaccagcccacgcctcgccgcgccgtcgccggagctctgctctccctcgggctcgcttgaagaaggagcggagagagtaagagagaaaagaacaaggaagaattaaaaaaattagaagggtagatccgtacttacacagctgtttctctctccaattcgtccggatataataaaataatccggtgagtgtccaacagctaattaccagttttttacggtgccctgtagcaactacccgttattgcggtgtctcccagctaattacaagatttttttggatgttctatagcaaattttgccttaaatttaaccatatttatagaaaaaaatagtaagatttttaacccaatataaatttattatgtaaatatacggtagggctattcgcgctctacaacgtggaatattagttcgagcaccgcacaacgccctctccttccggttttcccgttttttaccacctcacctttcctcgcatcccacttttctcggttcgttttcaatttttaccacactatctttcgtgtttcttttttctcttttctatctcatcggtgcttcatcaatgggtccgataaatattaaccatccatatttttttgttttctgttttttttccttctttgtagttttcatgttttcgcgttttagtaaaatatttaccgtctattttttctttccaagttttctgtttttctactatatccgcacattttaaaagtaacgaatttactctgtggagttttttatttactcccagcctcccacatctgctcattcaaaagtaacaaatttacttgcatgaatacctccacatcgtatgacgctatacctagatagtcgtaaaagaattactaccaccttacaatgctagtaattcttttaccaatattattaatattgtttagatttcgtggtatgtgagtaaaacaattactaccttcctctcgatataccccataatctcgtagacaccgtgtattaatatattcgtagcaaccgtgtattaatatatttactgatgtgttcaatacacagcataagagtaaaaactgagatttcgtggtctgcgaataaaacaattaccaccttcctctcgatatagccatgatctcatagccaccatgtagtaatatgtttactgatgtgttcaatataagtataagagtaaaaactgataagagtattgttgatctgtatcacaatatagtcttatgaatgaaaaaattacaggctcaatcacacacaagcaataaaattactcacggtgaatcaaactagaaaagaaaaaaaatgatttagccaaaaatccatctggtggctttgctcgatcttgctgtaaggatgaagagcacggtctgtgtcttgtgactagtagtggagagggcaaacgggtggcaagcagtagtcgacgatggaatcatggaaaaatgtagtcgacgatggaatcatggaaagatgtagtcgacgctggaatcatggaaagatgtagcaatgtggtatagagatgagctcgatgttgcgcagtagcatccacccatcatccagcaagcacgaaaaaaaatgcaaaaacattctcgttcgtgtcaatagagatgacgagcaaaagaaaaatagcaaacaacctccatcaccagcggactccaccctatcctttgcggccagccacatggagcacgatgtacaaatgtaggacctgtgcagcccatcaattgagataaggtaatattggagattgtacattaatttgatttgcaaaaaaaaaaattggggcttcatgcatgaagttaaaggagagtatgcagatgcaaatcagagtgtcatttccttacttgcttactctatcaatgtcgtcgacgtggagcaaccgctggttgttgctattggtataggtgaacacctccttgctggttaaggtgatgcccagtgtccggcagcgaggcccgaagtagtgccttcgtctcatccgctgctagccaccgctcgtcggccaccgccatcaaccaccacggtgtcgtcgttctcctccatggtgtgtcaccgatctctgggttgggatggtggatcgattcatatacgaaaaaaaagggaaaaaaatgaagtggggggcaagagtggttggttgggtatgggaaaaatagaatatataccggaagcaaagaagttatttttatcgtagtaaatcatttactccgat

SEQ ID NO: 23440 - DNA, 1228 bp, Oryza sativa
  unsure (1)..(1228): unsure at all n locations
nnnnnnnnnnnnnnnnnnnnnnnnnnnnnnnnnnnnnnnnnnnnnnnnnnnnnnnnatgcaaatcagagtgtcatttccttacttgcttactctatcaatgtcgtcgacgtggagcaaccgctggttgttgctattggtataggtgaacacctccttgctggttaaggtgatgcccagtgtccggcagcgaggcccgaagtagtgccttcgtctcatccgctgctagccaccgctcgtcggccaccgccatcaaccaccacggtgtcgtcgttctcctccatggtgtgtcaccgatctctgggttgggatggtggatcgattcatatacgaaaaaaaagggaaaaaaatgaagtggggggcaagagtggttggttgggtatgggaaaaatagaatatataccggaagcaaagaagttatttttatcgtagtaaatcatttactccgataatagtgggagcacgatgcgggacgtcgggtgggatcggaagcaagggagttgtttttattatcgaagtaattaaatcgtttactcgaataaaagtggactctagaggtccccgcgcgataggagtaaatcgtttactccgacaacggtaagagtggattgacgggatgtggggtggggtgggcttgggctgatgcatgtttggcgcttgaaatattaggagcgcgctcctaatagtagttctagtaaatatattcagttattgatttgatggcactaatttatagtattataaatattattatatttgtctataaacttagtcaaatttgaaatagtttaagtttaaccaaagtcaaaacgtgttgtaacctgaaacaaagggagtggtatatatgaagtatggacagagcaacatgatcaccaaaacacctagctagtttctttattaacaagagtataaaacatatatatgaaaaatatagcaaatttataatattatttgaaactaattttgaagataaatctggcaacgatagtttaaaaaaattgaattgaaatgtgaaaagaaatatgaatgggaaagatttaaacaaatattgactgcagacatttaaaaacacatcacttatctgcaactagctagatggagtattttccatgccacgaataatgactatgatgatgttgctgccttctgctgttcaccggctaaccatcacaacataatcccaccattgttctaaccgccgggcacatgcatgacaaccgggtaccgagc

SEQ ID NO: 23441 - DNA, 657 bp, Oryza sativa
  unsure (1)..(657): unsure at all n locations
nnnnnnnnnnnnnnnnnnnnnnnnnnnnnnnnnnnnnnnnnnnnnnnnnnnnnnnncacgtctttgatacgtaaatccgaatccagtcgagggaagaagatggtgacgccggacaagaagaggaggaagaaactcgcggagccggagccgacgccgacgccggcgccggagccggtacctcgtctcctccgcgttcgtccagggaacaagaagaagaacaagggggcctcacctgagaagcagccgccggtgtacatggtgttggcgcacggagtcgaggaagagcccaccacccactccgtaatcgaggtcgccgcctgcgccgccgcccgccgcctgcttaacaccggcagcggccgcggccgcggccgcggcatgtcgttcgccgcggtggggacacgcaccgtgggcgtcggcgtggagttgaccaccgtctacgaccccgagacatccacggagcgcggcggcccgcgactcatcttccccaaggtgaaccccgtcctcatctcgatctctgacgacggcggcggtgtagtcggcggcggcacgctctacgctctctcccgcaccccggccgtcgtgaggccgctggatttcgagccatggttcttcgtcctcgacgacctcagccacaccgtgtggcgcgaactcccatcg

SEQ ID NO: 23442 - DNA, 554 bp, Oryza sativa
  unsure (1)..(554): unsure at all n locations
ctatagggcgaattcgagctcggtacccatgcgggcaagtaggaaatagattttttttctgcaccttttttctcttcctccttctctccaccgcaccgtctactcttctccagaaccagggctatcctattaaatttgaggccccagtgcaaagtcgtgcagtagtaaagaagaataaaaacttaattgatgatataatacaacaataatttatactctataatacatttcatagcaatgtaaaatggtctaaaataatatacatgtgcatagtatatttcctattccaatttgttgaagacatgtcttcaaaattaaaatacaggatgtatctatgtaaggataaaaattgatttagtgtatatagtagatgagcctaaaaacctaataatccatacatgatacactaaaattagagaatagggattagtggattacattacctgattgctgattagagtagacgatcaggccgtcaggcgttgcagccgannnnnnnnnnnnnnnnnnnnnnnnnnnnnnnnnnnnnnnnnnnnnnnnnnnnnnnnnnnnnn

SEQ ID NO: 23443 - DNA, 523 bp, Oryza sativa
  unsure (1)..(523): unsure at all n locations
gcctgcaggtcgactctagaggatcccccaattcttcgtggcgaatccctttggtaaatgcggtgatgataacgtcgtcggtgatgtcggagatcttgttacgttgttcagaaaatcgccggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccatggggcaatccatggagccaagatcgggcggaatctgctaaagccactggtaaatagttcgccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23444 - DNA, 908 bp, Oryza sativa
tggtcttctgttgtgaagatataacaatgccatagcctggacaagtgttttcatgtatcagaacatggtagtaattattttattggtggcctggatggttagaaatatgataattgataaggattgcagtaaaaatgtcccagctatattctgcttctcatcccatataagtggtgccacctagccatcctcccagtagtatttaactatgatctagtgaatagtgataattacaaaaaggaatagctacataaagccaacattatgtttgaatgttggaatctttagtaccatgatgtgaaccaggctactggaattttggagtgtatcttcatatcttgaggtctagtcctatttttcattttatgtttgttatacagagtgcaagaacaagcgtcctcgaagaaccatcaagccagcagcgaggaatgtttcgaaaagtgcattgccttccggtcttgatgccctaaacccaaatagaagaacgcttcgcactgcatcaagcaacagggacaaaaagaataaagacaaattggatactgagatttttgaattatatctggagtatgtcctctctctctctctctctctctctctctctctctctctctctctctctctctctcttctgtgcgtgcattagtttctcttcttatttacttcataactttgtgaatagggatctttggaaggacattgatgaagaaaagaggagtgcttatgcatactttgactcattgtggtttcacatgtacactagcggacataataaatcaaatgtccttaaatggattaaggctaagaaagtattttcaagacaatatgttttcgttcctattgttatatggtaagttgcttcactaccagtaaccctatggtttattaatttcattatcaaatatattcaa

SEQ ID NO: 23445 - DNA, 1112 bp, Oryza sativa
  unsure (1)..(1112): unsure at all n locations
nnnnnnnnnnnnnnnnnnnnnnnnnnnnnnnnnnnnnnnnnttcctggtggcacaacctgaagaagtttgaagactgtcaagaatttgtttgtcatacagttcatgccgtcaagaggaagatggctatttctcagatacaaagcagcatcagtgtcaacctagcgctgtcgagatctttcgttgatccaggctattgataagctgaaagccccttttttggatagggttccatcaacattcagcacctgttagccgtatagagtcacagatgattcattccttaaaaaaaaaagaatatttaaacgatttgatactatacttatgcattgtctagaaatgctgggtgggatttccaccacctttcagaatatttagctgggggttatatgatgtacatcaatatgtttgtatcagatcttaaagatggtgtattcccccttccagataatatattacagtttcgtatttgatgcattgaaatgctgtcagcgtcagtaatctgaaagttcaaagtagcaatatgttgtgatccatcttgacagtaaagcagaactcaaccaaggaggatcgtgtctgatgttgctgccttctcagagtaagcagaacttcagatgtgacacctttgttgctaacatgccacaccccttccgatttttatatctttgattttgtttttcttttccttttgtgctaaaacgatatggaaattgcttgttttgggtgatgtttattctttttgaaaacaaaattgcatgaaacgctcatcatgatacttgggagggaaaggcactcaagatactgagcgaattagggtgtgtttgaggagatggggattagggagatggggaagatacgcaaaacgaggtgagccattagcacatgattaattgagtattaattattttaaactttaaaaatggattaatatgattttttaaagcaactttcttataaaatttttttgcaaaaaacacaccgtttagtagttcgggaagcgtgcgcgcggaaaatgaaacaatctttctcctttctcctgcgcttgaacgcagccttagtggtgatagtaggcaaaaccattaaccctgcaaatactattatgctccctccagtt

SEQ ID NO: 23446 - DNA, 4356 bp, Oryza sativa
  unsure (1)..(4356): unsure at all n locations
cagaactcaaccaaggaggatcgtgtctgatgttgctgccttctcagagtaagcagaacttcagatgtgacacctttgttgctaacatgccacaccccttccgatttttatatctttgattttgtttttcttttccttttgtgctaaaacgatatggaaattgcttgttttgggtgatgtttattctttttgaaaacaaaattgcatgaaacgctcatcatgatacttgggagggaaaggcactcaagatactgagcgaattagggtgtgtttgaggagatggggattagggagatggggaagatacgcaaaacgaggtgagccattagcacatgattaattgagtattaattattttaaactttaaaaatggattaatatgattttttaaagcaactttcttataaaatttttttgcaaaaaacacaccgtttagtagttcgggaagcgtgcgcgcggaaaatgaaacaatctttctccctttctcctgcgcttgaacgcagccttagtggtgatagtaggcaaaaccattaaccctgcaaatactattatgctccctccagttccataatccgatgtgtcgacgtttgatgtcgagattccggtatttgtatagtatggggatcgttggtactaggatatatacgagactgaggtaaaagagacggagacagagatttttatacaggttcgggcccctgaattgtcaggtaataaccctacatcctgttggccgaagccggtcattgctcttattcattataatcacaccagtacaatatttggggtagcctatctaactgttgtcgacatggcggtctgaacgtctaactcgtagtcgacaacagggtagtcttctcctcgagttcgtgcccggcgagatcagaaacaacgctagatccctacggccggcctatgtaggtaccggatagggccgatccaggcatatctctgaagtcgatatccggcggcttgtcttggcgtatgtcggcttgtatgttgtagcttctgtggttccgtgtatgttgattgtggtaggtgtccattgaggtggtcgtctcccctctcctcttaggggggccttgtatttatacccataggtatccccttatccaagtagaactagggaaaccaatatggatacaatccgagtagtccttgtcatttccatatagaactctggttgtctttccttatccggaactcctcatatatccgcaggttgtttccgtataggacatggtatgtggtgggtcctgccgagatttagtcaactactattaggtatgtggtattcataaccctgacacgatgttttggattttttttaatctcttaaactatggctttctattataatatatagaataaataaaaaatatttacttatattataatatttttaaagactattatatatatatatatatatatatatatatcttgttgtattgtttttgaactaaatattttgttcttgttcaagcggaaaaaagcgggaattttttttagtccgtttgggaaaataaagtctatgttaggaaagatttttcattttttagtgaaatatctaggaagtggaagaagcactttagtggcttctgtggatgctttacttctgggatcgaagcgcgcttagctggcatgccaaaccatttagggtgtgtttagttcatgttaaaattaaaagtttaattaaaattgaaaaggtgtgacggaaaagttgaaagtttgtgtgtgtagaaaatttttaatgtgataaaaaaagttagaagtttgaagaaaaagttgataactaaaccaggccttaggttggaactttatgcatatgacattacattagtctcttaatatcggttatgtcagggttatgggtgcttccaaaagaaaaaaaaaatgcatgattaattacttggtgaactactactccatcgcaggaagacaacatgatttggtcggcaaatccactctaaccacacagagtgcagcgagacacgttgttaccgtcgaaatgtagagatccgtatcctattttcctacgcgtttatgaaaagatttgccacatgccacgacacgcgacacgcgcgcttgttacacaggctttctcaactgctacacgcgttacggaccttccgttatactccttcggtttccgtttccgtttccgtttcatatcataaattgttttaatttttcttaaattcaattaaatcttaagaaaaatatagcaaccaaaacaggacaatggcatgtttaagagagttgattttgagaagaagccgtttactctcttcgtcatatttgaattatttttatgattaatatttttattatattagatgataaaatataaatagtactttgtgtgggacttttttttagaaaaaatataaattttttaaataaaataaatggtcaaacgttaaacacgaatatctacgactgagacacatcctattccaataaatctagacaagagactatccaaattcagattatatttcgtttagatttttatactttatgacagaggtggaactattttttaactcccatctggttggtgagtccgcagcttctaagagtcagcagcttctagtagaggagtattttctaatccggacgaaaagctgatcgttttgggagcaaccatacgagaagacaccgcgaaattggttactacgagcgggagacgagcaataaaattgcgttgggggggtgggcaggggcacaaatcaagcactgcagtggcagtgcagctagcctaaagtttgccgattccccatggagtgaacgcaactagaccttgggagtgagggggaggcggccatggcggtggcggaagtcgggggaatgcttgcatctgccgtcctcaaggtggcgacccagaagctgggcgccgccatagcgggccgggtcatgctccagtggaacttcgacaaggatctggaggggatgaaggccacgctggagtctgtggacgcggtgctcagggacgccgagaggcggtcgatccgcgacgcggcggtgcggctgtggctgaggaggctcaaggacgccgcctacgacatctccgacatgctcgacgacctggagaacatcacttccaaatcggatgcggggaaggtgcgcaatctccactgcagcgattctcgcctctttttgttattccttattattattattattattattattattattacggttttgcctattattactccctatgacacctacgtttgaccattcgttttatttaaaaatttttaaataaaacgaatggtcaaacgttggactaaaagtcaacggcgtcatacattaaaatacggagatagtattatttattgccgttgcgtgccgtcagttttgggctgttcagattaataccattttcaaccataccattgccaaaaaaaaaatgttcgcgtttattttgttgccaaatttagtaaatacataagaaatcctgctaaaatttgataagttttattttggctacaatctgaacaggccctttggttatggatttactagtggatgtttccgattttccccatctgaaatacagtaaattttattgacgagtattcctctattactaactcaaatcagtaaattctctgcagttgggatgtgtgatgatccccaatctgactattgctcacaagattaccctagctaataagatgaagacgataagtgatgaactgaaggagatcactaatcaacatcttagcttcagattcacggaagatagcagctataaggagcacagagttactgataaacgggaaacatcgtccaaggtggaagaagcactagttgttgggaggactgcagagaagcggataattatatcttctctgtccaagagaatgactgaagagaccgtaatccttcctatatatggcattggaggcataggcaagacaaccttggcgaaactggttttcaacgcttccaatttcagagactactctaaggtctggatatatgtgtctcagacatttgacttgaacaaaattagcaactctataatttcacaagtatcggaaagtgagagccagttgactgaaagggagatgataaataggcgtcttgatgagctactttccggtaggaagattctaattgttttagatgacctatgggagagggatcaatttcagttagatgatttgaagactatgttaaaggttggcaggggcagcagggtgattgccatcgtaaccacccgagataaggacattgcagagaagatttgcaccactgaaccgtacaaactagaacccctgannnnnnnnnnnnnnnnnnnnnnnnnnnnnnnnnnnnnnnnnnnnnnnnnnnnnnnnn

SEQ ID NO: 23447 - DNA, 9168 bp, Oryza sativa
  unsure (1)..(9168): unsure at all n locations
nnnnnnnnnnnnnnnnnnnnnnnnnnnnnnnnnnnnnnnnnnnnnnnnnnnnnnnnnnnnnnnnttttggggttgtgcttccttcaacaaacaaaggctccttcagtgagtttctacttaccacatgcatctatagctgaacagctttatcatttctttattagcctatagtacacacataaatacatatctgagatttttttatatattttgaacctttctttaatataattttaaaataaatcctgctaaacttatctccagatttgcatcttttggccacacaatgccatcctcattggtgtggcaggacaacactgttgcacctgttaaagcctgtggcatcacaaaacatatgatgtcacaccatgagcaatggcactatagtaactcgctaaaccattgctcaagaagtggcaacatttggttgctaggtgtccaaaaccttttcttttttaatgaaatttagctattggtagttttcaaatttaaataagtaaatgttctaaaaataaaaagaatttggcaagatacaaaagttacatccatttgcagttacagcaagggaatttgtgcagatggtcctttttagagttggccctactataagctgtggaaaagcacgtaaactaaatttaattgctgtggaccttcagcttcaatattatttatttctttagtgaaatcttagatgctaatatgctatcatgctagcccttctcattgaggcatatctgacacatacccctattatgagctacatgccattgggtggattaaactatttcatagaagtatcaatatactaaagtctttaatggagtactagtgtggtgtaatatatgcaacaggtattgctacaatacgtcctcccctcagctcattctactgccatcttcatgggttcatggacactaccactgtgatgctagtggcacctcccacttccgttggctttactatgcccacctcctaggtacccagacaatcttctgagttggctacccaatctactgttaatagcttgcaattttcttgctcactaattataccaaattcatgggagaaggcctctggcaagtacctaagctaaccggttgcctagcctagcctgccttggaacattcaggctgcctattaaaggcctcaccacaactcgtgtctctggccaccctcaatgcctgaacgtcattggtttcctgtatgtgaggaagaagacaagctcttctctctccatttctttctctgtgattcctagatcccacttcaaagttctatgtggagcttcttgtgccagaactttcttgaacttttaatctgtaatcattgcaatatcattggtcttgttgttgctatggtggtaaacttccatgggggtttgtttgctccttgttggtaggttttaatagagtaccgagttttatatgttccaatgatcttggcctagtaaacgaaaatcagctttaaggagtaaaccacaccagtattccagaaaagaagtccacaaggcctcatacaatgatttggtgcccactgcccaatccataccacttaagcctgcaagatgggtaactgcatgaataccatttacccccttttattttttgaaacttaagatggtaggagatctaccggatatattagaagaagagaattgaccctttttataaggaaaacagggcccgaaaaccgtacagttgcacagtttgctaaagggaaactggcaaaaccttacacagaagacacaaaaaaaacatgtgacaaaacgactagacccacagaagtgatcgagagaagagcaaggcctccaaggaggtgaacaacgacagaagccgctgccgacgcccgcccaaaactggactgggttttcacccgaagtggagagagttcacaaggcaacacctccaaggaggaaacgacacccacaggcgtcgatgtcactgatcctggaagaccaggcagggctttcgcctaagactccctcaagaagtgcaggacctctaagaagctagagcaagagtgttgagtgttatcgttgcccagctcatcggctgaacccgatgcagcagctctgactccactttaacacaaaaaacttacaccgaagggggtaaggacatcgctctgcactcggcacaactacaggtttacacagccacatggcacgtgaagcaccagcgaggcccaagcgccctgactgcagacagactggaccaccaacacggacgaacaaaaaactccaccaccaaaagactccacggccggcctgggagcagacgaccaagagaagggaggaggcctggccggcctgaaggggaactgagagctgtcggcagggggagcaaagacatcggtgttatccatgtttctagcgaggatctccgggcttcgcgggacaatccaaacaactgcggcaaccacctccaacttcaccacaccaccagtgcagagagaggagcactggggcgaacagcagagcaactgaaaggaagaaaatatggggagaggggggatgacggtcaccggtcacccctactgcttatgccgagacgacagagagaggaagaaagagtagggaaggaaagagaaaatggtggttgccggcgactggagcggccggagcctccgacgcgaccccccggcaggactcaaatcccgccgaccgacggagacagctggcgccgatgaaggcaggccgacgcgccgccccggacgccgacccgctgcagcggtggagccccgctagcgccggccaccccgcgggccgccaccaccaaaccagcctaaccgcccccgcttcatgcctctcgacgctgccatcgtagatccggcggcggcggggccggatctgccgccgcccagcctgggagaccccgccgccgccgacgaacgccgcccccccccccccaacccgcgcgcgggcacagaggagagacgtcgccgcgagaaggccccgccgccgccatcctagctcgccagccggctttgccggcggcgagctccggcggcggcgaggtgaggagggggagaggaaggcggcggtggcgctagggtttcgccccccgtgtcgcctgcgcgggggcgacgcggggggaaggcttctctgatcgaatccaagcgtatatagaccaacaactggtttacccccttttagaatatcacttgtcagtggtgtaggatataagctttgtcctactaagtactaaccatggaccttaataccttatcacttcgttgataatcaaagagttgtggaaacggctgaactcgttgataatcctcttggcatgggagatttagaagcactgcagtgaccgtgtgtttaatggtgctagccctaatgtcatggtggtttcacaggcaatagtgaatgagggtagcttatggtgtttagccggagcccatgctctacataagtttcttgtgaggtcgcttgccccaggtgattagttggtcttttcttggggctttggtcgtgcgtcctttgtatgcgacggggagggtccttttggtccctcctatttaagtttgtttttttcctttcttaatgaaatgaacgcagttgtcctgtgttttttagggaaaaaaacttatcatcaaggtccgaacattttcttagaagttgcaaaggatggcgagaatttcacaaacgtgtttctaccatcaatataacattaaaaatccatactcattatgtactaaatctttacctattataaaaattcaagatgtttttgtgtggaattttcgtctgtcaccctgagtctcggacggttgcgtttcactccctccgcgttgcgtcagaatcggtgtcacggaggcaatagattaattttcggtaatttctcaagagcgtgcggatggcctggttagaatcgaacgacgaggcacggaattatccagattggttctggcaggttcccgcacaaactatggtaagtaaacctaaatcagtcccatgcatcttaatattaactgtccacttaatatatgtagagtaacgatactaagatgccatttgttccatgaatccattgtgacatggattgtccttccaacgccatatctctactgttataaaaaataaagatttttttgccggtattttcttacgtcatctgtatttgagtgggtttataaattcgcttttggaaatacagattcgtgtataaatttgaatttaagtttatttacttttggaaatacaaaacaagttgtataagagatttctttaaaaaaacttacatgctaatttgagatgaaagtcagactcctaattgcagctcatgattttctaaaaaaaaatatccaagcgaattgggatagtgaatttcatcctagctaaaccatataacaataataagattaaaatagcattcacccgttgcaacgcacaagcattttttctaatctctactattataaaaattgaagatgtttttgctggtactttggtacgttatccgtatttgagtcggtttttaagttcgttcgcttttgtaaataaagatatgtgtttgagtcagcttttaagcttgtttacttttggagatacaaaggagtcgtataagaaatctcttttaaaaaaactccacattgctaacttgagatgaaagttaaactcctacttggagctcaagattttctaaaaaaatatatattctagtgaattctcacactgaattttaccctagataaacaatataacaataataaaattaaaatagtattcacccgttgcaacgcacgggtattttttctagtgaatcaaaatgctgaattagttgagtatataaatctaaggaaaaaaggataggagaggaaaaactgctcattacaaatacccgtggcaacctctcataggtaatggaagttgtgtaactccttgcctgtgtgtcaactaggaattcacacaggcattacaatgccaaaattgataatgcaaaagaaaagaaaaaaaaagcaaaagaacatgaccagcaaagccttcatgttgaagccaatatctaggtcaactcctggaacagtatgaccaacgaaagtatagcaatgttttcttaattttgtggcatataaggtgatatatttatatgttcttttgttgcagactactagggtccataacgaagattctacgttcttaaccatgcacgacctggtgcatgattttgcaagatcaatcttatttgatgcagttctggattctggaaaaaaaatcaatattggggtaagcagttgtcgctatggaatgctcagagattgcagcaaaccactagagttggttacaccttcacctgcaaagataagagcactgcattttctgggttgtggcaaaattgagcttcatggtgttgcattctcatccgcttcatgcttgcgagttttagatttaagtggctgttccatcctgaggttacctgcttctatcggtcaattaaagcaattgaggtaccttaatgctccgggtatgaaaaatcgaatgattcccaagtgtatcaccaagctctcaaaattaaatttcctcagcctttgtaggtctcgtgctatctcagcactaccagagtcaattggtgaaattgaaggtctcatgcatcttgatttatcaggttgttcacgattaaaagagctcccaaagtcatttgggaagctcagaaggttggtgcacctaaatttgtcgaattgctctcgtgttaaagatgtatcagaatacatttgtggccttaccaaccttgaatatttgaacctatcagtgtgccgtaaaattggatttctaccgagaacattgggcagcctcacagaacttaagtatttgaacctatcaggttgttttgggataaaagaattaccgaaatcatttcagcagctaaaaaatttggtgcatctggatctgtcatgctgtaattgtgttaaagatttgtcagaagctttagatggccttgcaaaactgcagtacttgaacttatcatattgtcaccattatggaaaccagtttcgtctgagagggctgccagaagtcattggcaatctcaccagtctccggcatttgcatttatcggggttcctagacaatatatttggcaaccaatctggagtcatggacaagctcctggaaatagggtatttaaatttatcaacattccagggtaatatttttcagcaactaccaccaggtcaaagtcacagtttcattgagtgcatcggtgccctttcaaatctggagcatctaaatttgtctaataatgtcagcctttatagtgtacctgaaagtctgggtaaccttaggaagctacacacattagacctcacaggttgcattggactattgtggctaccagaaagtataagtaaaattcaaagcttgaaatatgtacttatgaaggatttgttgagacttaagtccacactatcttgtttcaacaatggcccaatcttgttgccaaactttgtggtccaagctgttgacaagaaatccagcaatcttggtcagcttcttgatgcaaaccctgctgagttggacataagtagtcttgaaaatgtgaagtccacaaaagaagcaaagggaataaaattgtcaggaaagagaaatattgtcaaactgaaatttgattggaccataggaaccaagcgatacgtggaggacatggaagtgttgagagaactagtgccgccaagcactgtgaagtactttgaactgcgaggttatcacagtacaagctttcctacctggttaatgggcattgcacactgtctccctaatcttgtcaaaattaagatagtggatttgtcgaaatgcagcatactaccacttggtcagttaccaaaccttaaacaactggttctcggtagaatgaagagcataacaaagatcgatgcggacttctgtggtggtgcgagagcatttcctcagctgaagacatttgacatatacagcatggaaaggttgcaagagtggaatacaacatactcttgtggtgaggatggtgtgactgagttcatgttccccaaccttcagtggttaagcataagtgactgccccaatttggttgtgaaaccactcccgcctagagttacgtggtggaaaatagagggcggtgaaagtgtcatatcatcatggggagggagtgtgcacactggtacatcttcatcctcttgttcagtaactaatctggtcgtcaaattctgtacgttgccgttgagtcagtggagtctgcttcaccaccttcctgccctccgtcacttaaccatccactggtgcgctgatctgactagctcaccagagatcattcaagacctccactcactcaaatcactatccctagatggaaacgaacaggcagagcttccagattggctgggtgacctcccttctcttcaagaactaaagataaccatgtatccagcgctgactgagctgcaagagaaaattaggcagctcatgtcactacagtcattgacattgtcttcttgtcagatgctgacatcattaggtgaatggtttgggagtctcacctctctccaagaattgcacatctcacactgccaaaggctgaacagtttcccagagggcatgcagtatctcacctccctcttgtcactgcatctgagttactgtgagagcatttcagcactgcctgaatggttaggaaacctcacatccctcaagacactccagatatgggaatgcagaggcatcaagtctttgccggagagcatcgaacaactcactatgcttgaacatctagaaatttctggctgtcctgaactaaagcaatggtgtgaattagaggatagcaaaacgaagcttgctcacataaaaaataaagtatgcactctatcagttactgttatattcatctttgtactgactattattattttattcatcttagcatagaatatttgtgtttagcatttcttagaggatactttatgtggatatgtctagattttaatatgcatagtgatgttattcttcttttggacacaaacatgcaagtagatatatcaagaggacaaatacatataaaatattcctaataaataatattccatctagtaaaaaaatgttgttttggacatataacatattaacattcaatacttttagtaccagtatcttcaatattttaattggtatgtctaagtcgcatttatatatttctctcatgtagtagttctctataatattataatttggtcaccaaagctgttcatcaattgccttttttctaaaatttatcagtcgattaaagtttcattgcatataacctaaatttgcaatctgaatactgcaacttatacatttgttgcaacttttagtttatgttgtattttatttcctggattaacctagatgcatttgtatgcttttgtatacatttataccattttataatggaatcattgacagcaaattaaagtatgatttttaatcttagttagaacattctttgtttctcagcaagatatatgaaatattgatatatgagtatatgactttttagatgttaatctagtgattaaaaagctattaacagataaggaaaaaccagttgtttggtaaaaagattgcatttatctatatgtatatatagatactagtatcatagaaacttatggtcaaactagtattttgaacatttgtgaccagaaaaatgacttcgttttttttgcagtgtttttggtagtgctgggaggctagaaggtgtcttcactaatctcaagcttgcgttacaaatccaggagcatctcggcgctatatgtgctgccatgtcactgccggcatctcaaaaataaaatacagatgttttttgttttttgatgggggtacttccaagctccatgtcaatgctagtcatttctgccataggagtttcctaggtacaaggttgtcatgtctctcattttcctacagctcattgcattggaaaactcgattaattagccctaatgaccaatgactaatgcaagtgcttaatatatatacatagcatacgatctgtttttatatccaaatctctcgttcttctcgagggagcatatgtaattttatttttatttttttggtttggaaatatacttggctggacctggaccatatgagattctgacaccatatgctacaaacactaatccaaagagcatctctcattggactaattaatcagg

SEQ ID NO: 23448 - DNA, 4672 bp, Oryza sativa
  unsure (1)..(4672): unsure at all n locations
taannnnnnnnnnnnnnnnnnnnnnnnnnnnnnnnnnnnnnnnnnnnnnnnnnnnnnnnnaatgctagtcatttctgccataggagtttcctaggtacaaggttgtcatgtctctcattttcctacagctcattgcattggaaaactcgattaattagccctaatgaccaatgactaatgcaagtgcttaatatatatacatagcatacgatctgtttttatatccaaatctctcgttcttctcgagggagcatatgtaattttatttttatttttttggtttggaaatatacttggctggacctggaccatatgagattctgacaccatatgctacaaacactaatccaaagagcatctctcattggactaattaatcaggtgcagacatacgtacccacgcctggggatattatattagtagtactaattaatctgcattttgctaatatcatggttagcattggcaacctgcactgagcagaagcttgctccttgtctggttctgaacaagcaaagccaaatctgctcataaccactgtactactctcccggtattttagcgggatggaacatattttaatacactatgaatccagatttatactccctccgtcccataataggtgatgtttttgactttttatttacaacgtttgaccattcattttatttgaaaaattagtgcaaatataaaaaaagataagtcatatgtaaagtacttttgataataaagcaaatgacaaacaaaataaataataattctaaaattttttgaataagaagaatgatcaaacattgataaacaaaaactcaaaaagacaagtaatatgggacgaagatagtactactaaaatatgtcatagccacccaaaatttcctgtatattggaacggagggacgactactactatggatactttctgttagattattaataattctattcatttttatgtataactggattgtatttagatattaacaaataggattaaatatacattatattttatcttcaaaagaacaaaattatgactttctccgttcttgaattgatattagcactattcaagttcaaactttcactcctagtctttttttcttagaaaatttacaaatacttgaaaatattttatattatgaaagtgtgcaacatcataaatacaaccatacaactttcaatcatcaaagggtgtgtttagttttttgcgtgtaaagtttttgaagtatacagacgcacgtttgaagtattaaatatagactaataacaaaacaaattacaaattccacctgtaaactgcgagacgaatttattaaacctaattaatctattattagtaaatgtttactgtagcatcacattgtcaaatcatcgcgtaattaggctcaaaaaattcgtctcgcaatttacatacaaactgtgcaattggtttttttctctatatttaatgtcccatgcatgtgtctaaacaatttgacgtgacgtttttggtcaaaatttttttaatctaaacagtgccaaaatataatcatcaaaatgtactaatttgtggtcaaatcgtgatagctgtcctcaacaatacaacgtcagttttccgcgagcggaggagttaaattgtattgagtgaaactaataatgtttttaaatatgcatgtgctacattactagtatcatgttagtgaatagtgagcccatgttatatcatggacgagtgagctggagacgactagtactactacagtagtactccactagcatactaagggcccctttgaatcgcagggtagaaaaaacggaggaataggaaaaacataggattctgacaggaattgaagtgtaaaacagaggattgcaaaacacaggaaaaacacaggaatggtcgtttgattggagcgcaggaaaaacgcaggaatcggatgagagagatagactcaaaggaaattttccaagagattggagctcttgctaaatttcctccaaaatctacatgcaatgtgtcattccataggaatttcataggatttggaaagcttcaatcctttgaatcaaagggtcaaataggaaaatttcctataggatttgaatcctatgaaattcctacataaatcctttgattcaaaggggccctaagggtttatttggggagttttgacaggttttttactcagattatgctaaaatatagttgtagaatctaaaaaattaccaacttctccgtatttttaaaagctgactaccaaaccgtttttttaaatcttaaactccacataccaaaatatggtcctcaagctgaccaaacaaaaaaaaaaactgaaatcctttatgcaataatactagctggcccgtgggacaaaaagagctctatgattggtattcgcacgtgatctttacagcataaaagttcttttctaaaaaaatgcagattatgcgcaagttcaacttacaatgaggaagatgttttttttaaaagaaaatacggagtatactgcagtttactgatttaaggaaaaacagatttaaaaaatactgatatttgagctgaatttgtgtgtcataattgttctgagactccacatatactgacaagtaagattgcatagagccacacgctcggcctgactccgtccggatcttctacgggcactgccttgtggttcagaatatatactcccaaggattgcttcaaacaaattattaacaaaccttttaatttctacttacctttattgacatttagtatttctagtacagtaccatgataaggaatcacaggagtaagattgttagagatcatggcaaatagcatagtatgaaatattacaatatttgtttataaacttgatcaaacttaaaaaaattaaaacaacttatagtataaaacgaagggagtatcatggatagtaatatactaatgtgtagcatatcacatgaacatgttataaatgattgaacaaatgagagcttcatggtgcaatatatttagttaagagtaattattttgtaaattttcatatgtaacgtattatagtaagatggtgtggtggtgtttaatctatgcaccaaacaaaatgtaacatgcacacatatcatttactccatcagtcccataatataagggattttggagggatgcgatacttttcctgttcagattcgtagtcttaggaagtatcacatatctccaaaatcacttatattatgggacagagggagtaccctttacattataaactgcaaccaaattttaaattttaaaacttgagatatcttttatcatggtttattttccagaatttgttttttaaatactaagagcacatataaaagttttattcaaaaaatatttgcttataatcagcataagtgaaatgatgactgtaatggatgtcagctaccaaagcaaccagatttcaccatcacacacttaaaaggagagatatttactactatttgtcatcgggcaagtgtcaactgtcaataaaacataaaatataacattattattggttttgctagttggacgcatagaaaaaaatatatatgaccagatctttctaacaatgtcggactatcggctatgaaaatgaaaatgatgaccagtcaccttctctatctctcctcttatgtgtgacaagcgactaggttcatatagacaatctcttaagtactgtactgatgacagataatcgacttagtacatatatatatataaatcagtggcggatccagaaagaaatagcagtagggtctaagcaaagtagatcgagttacagtcccccctcctatctacatatggtaaaaaaatttagtggggttttcgtagagattctcaaagtcttcacgccaataatagggttcgaaaccccgccgcctctatgctggatccgcccctgtatataaattagaatgtgcaacaccacaacatttaagaaaaaataattatgcaccccaaaatagaggaaacccaatgatattccacataaattcctttagaaaagatatcaccccaataatgaaaaacagatatgcagaaaggtgtataatccgaacaagtttcaggagatccggtggtattgatggctcacgagctagacgaccgccgtactatgcctgacgcaagggtgccaggtcaatcaatggcatattggcatggctgccatggcatgcctgtaataaatgtctcattatctccatttacccttcccaacggctacctattcatctcaggtcctacttgagccttcaccagttttcctcatgccaaaaatggcaaactactataccatttttttccttttctcatgaacatggaaagtcaatagcaagaaagtggtaattctcaaagcaaaaactatgggtgtcaataaaaaaatttgagcattttagaaagaagcaataatatagtgagtatatttgaggaaattctgattagcacaatgacagttccaggtacaagagtccacctaccagtggtgttgtaaattcctagtcccactaaaatgattctttctgttagagcaaggtcaatagtgcagctagcagtaggctccagcctttgtcatgtctcaggtagagctaacttaaagagcaattcatataacaagctaactacaagttagctataagttgccttgattcaaacaaattaacaagcattttaggtcacaa

SEQ ID NO: 23449 - DNA, 1525 bp, Oryza sativa
  unsure (1)..(1525): unsure at all n locations
nnnnnnnnnnnnnnnnnnnnnnnnnnnnnnnnnnnnnnnattgacaagtaacacaaacatgacataataatcagaactaacaatatgccaagtgcgaggagaattacttacagcatgctatgaacaattagcaaatctggcataagaaaaataatggaaaaaaattgtccaggtacattagttatctcctcatccattttcatcctcgtctacattcactgtaccacaccacaaaatattttcaattcaaaattatttcctcacaccaaattaaatactctatctgttagtgagatcccaaaaaaaacattaaacgaacagaaaatccaaacctaaactcgcaacaacttatgagctaataatccggatttaaaaaaacaatattttcaattattatttttcccacatcccaattcaaaaaggctagaagcccccagtataaagtccccaagagtcaagcactgttcttcatctcttcccaagcttcaacttcaagaacccacccacttctcctcctcttctccatccgctgcggcaagcgcgcaattcagttgctgcgagctcgctcgccggcgacaatggcggcggcggtggcggtggtggttggttgcgttcttcttggtggtgtgtgggggttcccggaggaggatttggtggcgcggctgccggggcagcccgtcgtcgggttcaggcagttcgccggatacgtcgacgtcgacgagaaggccgggaggagcctcttctactacttcgccgaggcggcggagggcgccgccgccaagccgctcaccctctggctcaacggaggtcagtctctctgcttttctctctctctctgactctctctgctgagttcttggatcatactgtgtgatgtgatgtgatgtgttgtgtttattggatttgatcttgaagcattgtgtttttttctcatctttttcaagttgagaatgagatgtgattcttgaagagaggtttggattttttgttttgttttgttttaatcttggagattggtgtggatttcttccttgatgtttttgtctcttgctgcatgtcagtgtctcactcggttctctgaactttctctgattgttttcttctgaatttttcttatggaggtatgctgactgtggagatggtagagtctcactgttgtttgatagagattgctccctttatgtgcatggctttcggttgattccttctagtatggttttctttttgtatccgtttggatctccactgtttgtgcaactatttctgaattcttttcatgaacagatggaattggagttgtcattgtcaatggtactgtgtactactgttccattaatattttaatggagacaactttttttttggccattttatgagttgtgaagccaggaaatgagcttccatttaccatcttctctgatctcttctcagatgcaaaaatgtattttttttctattttcattttgttcatatatattctccatgttttttcctcaggggactatgatggcaggaggtgtttcct

SEQ ID NO: 23450 - DNA, 743 bp, Oryza sativa
atgcaactttggtgagacagactacctgggtactgacaaaggaccacgcatgctgctgctggattcacttaaaacgacaaatccgacaaggttgcgatcgaatatcaaaaggtctgatcctttcccccttcaatatgggtctcttgataatacatatagatctatattgctaccagcaatttgaaatattaaaaacaactgttcttttgttctgtatgggaatgcaacaatatatttttggaacttggaacagcccagcaggtggacttactagatacctgtttctctttaaccataatggatgttttttcaacttcgatatatccaacgttagacccaatataggttttggacacttggacaatgtttcggtaattagggtgcttgttgtcacaggcccacaatcagtttatgctgctcaacatagccacctcaaacttctgcctcttgcttgtgcctactgaggccttagtagtttgttttcacagggactatttaattatacaactcaacttctgatagaatataagcgacaaacttgtgtacttagagtctcttagttaaatttgattcttccttttttttgctggagtaccagatttattgctgatatttttaaaactgaagagcgggaagagaatgagcaattcattaacaaaatctgtcttgagtttcctgaggtatggtgtttaacatctcaaagtgcaccgtttcagtttctgcatcatgttcatcttatctga

SEQ ID NO: 23451 - DNA, 1540 bp, Oryza sativa
  unsure (1)..(1540): unsure at all n locations
ggcgaattcgagctcggtacccatgcaagtacatatatgtgtaatgaggtgacagtcatcgatcaaaattgaaaagcagattattcatggaattattgtcatgagttttctacttgattataaaaataaattgaataatttgagaattaaacttaaataataatttataataggtaggataggaagtaggagtacacatcatcaaaagttacatagcttatcatttacccacgtacatacgagacaaacatactatttataagtgtaaacaactataagacagttgacaaaggcacacggacagtaggaataaggtaaagatcgttctttcttcgaattgtagcacccaactcctccatcatgtccaccttggttggcgagatgccatcagggagctcccaatcaaagtggtaaagcaatgaggctagagcgagctccatgattacttctgcaaatgccatgccagggcacatccttcgtccagctccaaacggtataaattcaaagtttgttcctttgaagtctatatggccatcctcaaatcgttcaggtatgaatgtctcagcatcctcccaatacttaggatctctacctattgcccatacgttaacaagcacagtagtacctatggggatatcgtaacccatgacctcacatgtctcccgacattccctagggagaagtagtggcactacaggatgtaaccttaaggtctctttgataataagttttaagtacttcaattcatttaagtcatcttcagatatcgtttgctttcctttgatgacgttacttaactcagcttgtgcgttcagcatcactcttggattcattatgagctcagtcatcgcccattgaagtgtattagctgatgtctcgctcccagcaccaaaaagttcctatatgcatgaaaaaaaacatgatttcccatatatgtaaaaaaatatgttatcaattacttccttcctttgttcagtgtgcatactttttttttattttcatatatactcgctccattcatcagttaaagttatttaattttattcttaaacggtaaaactttgtagattttgacattaacagtagtcaaattttaagtgcactcaggtaaaagaggtttggtaaaatatgtcttatatttcatcctttcacgaatataatggattatagatccagaaagtgtgattgaaccttcactaaattagggaagagaacgtacgttagggtacgattgtagatacgattgaaaaattaattattggtaagataaatactactctaagctcagaagtattcgtgtgcaattaagggagattagtacagtattaatcagcaagtacttgtctacttaccaggacgacggcttgatattgcccatggtgagaggcatctggaggctcccatccttctgaaccctgagaagcacatcgacgaggtcctcgtcgtcgtccacggcgccggcggccctccgctcctcgtnnnnnnnnnnnnnnnnnnnnnnnnnnnnnnnnnnnnnnnnnnnnnnnnnnnnnnnnnnnnn

SEQ ID NO: 23452 - DNA, 738 bp, Oryza sativa
  unsure (1)..(738): unsure at all n locations
actatagggcgaattcgagctcggtacccaattattgtagaatgatatcctctacatgagtattaactaaaagtccatatcatttgtacttaccctaaagcaaaataaacattgttgtgattgcgcatgtaaaaatggaacaaacggcgctttgatttccatagtcgatcaagagaggaagagagagaaagaaaaaacttggcgcttattgggccttgtgtctcgctactctagtgggccataccggtccggcccagagagagagagtcccttgcttttcttctacgtctcccacccactttcctcgtgtcaagatttcgaaaacttgctttccctaaccccccgccgtgcttcgaccccatccacgaaaccctagaatggaagaggagatcggtggcgcagatgcgagtagcgatagagagaccaagtcagaggaggtgctcactgccacctacatcccccgtgatctggaagacttgcacaaagccatggcgttggactgggtcgtggacaaggaggaggatgaggagatcaccgacgatctgctcgacgcactgtcggtgttcttcatctagtatcaagtaggacaagtttccttgattttatatatcatcgggttcctctctacggttttattttatttgttttagaacttcttttttacagagatatggtgtatttctgnnnnnnnnnnnnnnnnnnnnnnnnnnnnnnnnnnnnnnnnnnnnnnnnnnnnnn

SEQ ID NO: 23453 - DNA, 3202 bp, Oryza sativa
acctctttacttgcccgatcatatcttagatctgtaaattatgttatggtctacgttccactcatagcgatgtgcttgagtccaagggacagggggtcgtcttggggccagagagaatgaatagatagggccccacgagttgttaattggccgctggggaattcacatgaaagggaaggacttattctgaaccaaaaaagtgctcactaaaccgaacatgaaagttgttttccatcgttttccatcataaagctgttcacataacttcacttttgacttggattatatatcccatatatccaggtaccatattaagatgtgattggcatccctcggcaagcactggtatgtacttaccgtataataattgctccacaagtactagtatgtactacttaccgtataataatggattgatatgcatgttttttcttccttgtacatagacacccgagcacatgtcttgtgatatcttagcccaataagaattagacatgtgtagcccatgagagttgtatgcgcatgtttagtaccaccgaagggaggaccattacaaatggtatcagagccgaccctcgcggttgcgcgtatgggtcagtgtgagggcacatggcacatggcgcatgtggactttgcgtgaggcacatggcatggcatatgatgccaacactggacgttcgggcatgtgctaacagggggtgtgtttctatacctttgcttatatgcctgtgtagctatgtgggtgatttggaccgacggggacgtcgggtcctttgaggggggtgtgtgtcagacatcccgacccaataaggattaggcctgtgtaacccatgataactgtgtgcgcatgtttagtaccactttctagtttagcaagggtgcgcccttataaggcctcttccctcaaactatatcactccgggttaaccttttagacgaagtatggacaaaagtataagtgggatggtatgtgtaagtgggcccgtccgtcggatgggctggctacgcggttctggagggatgtgtgattgaggtgaagatggaatattagttcatgtggtagcttgaactactccatctaaaccataaaaactaacttctgctacaaaccgtacatagcctacatttatatttatagctaaaagttgaatttcttttatgggacagagagtatatatacgaagatagctatacatccatctaagattatatgggcacttctaagtgtgttaaatagcagaaataaatattgaggtaaatctctttgatgtacttggaagtttatataattatgtactctacttgactggaaaaatcacgcccaatgatgcaactatcaataattacctaatgatgcaactatcaataagtacaaatttgttggatgaattgaaaagtagtacactacttcacaaacgatttttccatgcgactaaaatcgattttcccagataggggatgacccgcctacacccagatgtccaaaaagtcagtatttttacatggggaagagcaactgcatgtgaaaatacagtattttcgcatgcgggcgcttaagctgtcataatgcaaaaagttaaatcgaatgaaaatgaacaatccaaaaccatagtgtaacgccccacttttcgcgagacgttaaaagctaatttattaaaaatcctaattgtgaaaatttcgttctttgagtgtttgagtctaagttgtgccatagatctcaattaaaaatccctcccttgtctgcataccctgttatcaaagatcgtctcctcaaaatttccatcccaatataatcccgaagttcgatcccttctattcggagttccatcctgaaaccccacccgtgatctttgtcgaatgcccgaaccctaacccagtccaatgattcacctccgagacctaaatactcccttgtttccttcaaaccgactctcgaattcgaacttaacctctcaatttcatctctccctctctctctaccttcccttgactctctttcgaataattgatctcaactcccatatttgtaatctccctccacctatcgctctgtcattcgttgaaaccatttccgagtatttgctccgaatcccctggtgcagatccatattgaattcctttttatgaaacccaattcccgagatttcccctctctttgaaaccccatccaagtaattctagaacaatccccgagtatagatctatcccaggataatatccgttccaaataatctcgtctgaacccttctattcagatttctcttctaaatcccttacccacatatctcgtcgagtagtccaactcaaactcccaagttacactctccttctctaaattatttgactcgtctccgaatattgttcccttccttgactccttcctattatcccgagaccaagtatcgacttcgaaattcgaatccagactccagccctaaaaccttccaattaaatctctctgtgaaagtctatttaacctccctcataggttggattccttcttcctttttcctggtccacttcttccttctattccagcccatctctctccctctccctaaagtttggacctatcaatctacctacaccaatccgagagttcgaatttccgtattcggattcctcttgtaaaaccctatccgcatttgtcgtcaatcctcaaaattcaaactcattgattggttcatttcgtccctctctctttcgatcgatctacctatctacctatccatcgacctatctgtctctcgatctaatcatcgatctctctacctgtcaacccatctaactatccgtctaccgatctctctggtgatctatctatctctacgatatccatcgggccgtccgtctacctatctatctttgaaatctatcccaaagaaataccgaattcccgcttggatgcattcccttgactcctccctgttttcctgagaccaagtttcaagttcgaaatccaaattcaatttccaaatctcgtttcctccccggcgccgaatcccgccgcccccactttgaccgtgccggcccgcgctccgcgttcaaattcgaccgcttgatccaccgacctcgccgcccaacgcatcctcgccgttgccgttttcgggtcgcccacgaaaccatcgccccaccgccagccgagcgccagctcgtctgtgatctcccccttgcctataaatcctacccaccgagccccaaa

SEQ ID NO: 23454 - DNA, 5188 bp, Oryza sativa
  unsure (1)..(5188): unsure at all n locations
nnnnnnnnnnnnnnnnnnnnnnnnnnnnnnnnnnnnnnnnnnnnnnnnnnnnnnnnnnnnnnnnnntgaccaccccgccgtgctctgttcccgccgacgccgcgctcggctgagcgccaccgttggccaccctctcggcgactccccgcgccaccacccgccttgagctcccttgaaccaccccaaacagtcgctctgcccgattcgctgccgccacgcatgaccgcgcgccgccgtcggccatcccctcgccgtatcctctcgtctccaccctcctggagccccctcgactctccccgaaccgccgccctagccgccggccttctttcttgttcccacgtcgtgccgcccgattcaccaccgcggcacacggccgcgctctgccgtcggttccccccttctcttcgaacccgctcgccaccaccttcctcgggcccctcttgacctcccccttgctgccccgtggccaccggcctcccctccagctctcgcgccgcgccggccttttcgttgccgcgccgcgccgccgcacgagcaacaccggcgaccatcagcctccgcgcccaacgcgtgtgcgtcgcaacaccacaccgattcgatcgaaccatagcccgcgcccccttttccctcccatcgcgtatccacgtcggcaatccggcgagcttcgccaccgtcgccggccgccgtcgcgccccttctctccggtccgatccgtggaaccgattccccgcttcctcctctcgcttccagtgcctgccgcccactccgattcgccgccgttcgctggagcgcaccgagcgccgttggccatccgatgagccgcccggcctcctctcccttccctgtccgacgtggcgtccacctggacgccacctcagccgctgaccccaccagaccaagtcaacccctgcctagtcagccacccccccccccttctctctccccgctcgtgggcctggcccatcgaccagctccccctcctcggcccattgaaacaaaggaagtccatttttactccctccgccaaacacaatgaccaaaagtctatatctgctccctcccaattcacctctctctcaccatatgttggccccacatgtcaatgagtgataaaaggatattcttgagaatattcatttccataaatgcaataaatcatatctcctgctccataaaacatttcctatattccaaattccataaaatccttcctcttaatctggggattccaataattcaacccattggtcctgcatgtcagtgactgtcaataatattcttgagaatattatttctataaattctataagccatttctcgtactccaaaaaatccaatagatcatttccttgtccagaaatccaattaagcttccaaaatccatatctcctcaaccgctcgaccgattgactccgttctacttccagtagttccgtaaaattgatatcaatttaatggcactattaattagtctaaataggatctttctttcagtcttttggttaggtttttgattgtttgcgtatagttgcggttaccggattttcgtcaagcggatttcttgaagattcgtgaagatcaagaccctgagcaaggcaagccacctttgaacatattgagcctatatttgaacttaattaatttgcttgaaaaatattatgcattgataggattgcacttaatctatttgccccgtctgcaaggcagaccggtgggcctacccaacttgttgcatctgatccttccattgttaattgttatatcatgttcccttgtaactatctagttgcgcctcgatattcgtgcactctgtgcgagtatcgacggtctccttcaaacttaaaatctgtgtaacttcttgggtaaaacttggtttacaaaagctttggaaaacccgacgcctgggtcggtgccttgtgaaagaaaatgagttttaaaaataaaatttgcgacacaaggccattcctgggcggaatacttgtgcggtcgcatctaaggaccgattcctttggaattacatccgagcatacaatagtgcgaccacacgggtggaatgggacgcccctggctgagtaaatagctaatcaagggagccttgatgccaagagacatgtggattcaacggggtggtgtcggggagaacccccgggcttcctggcacagtatggtctgggacctaacctgttgttggtctgggactcctctcattggcatatggtaaccctgtgtcggctttcgaaataccttgtcgtgaaagccccaaagtcaccagacgtggctgttctgcacgggctgggtgaccaaggctagtaacgtcgtgtgggtatagtgtaccccctctacagaggttattaaactgttcgaacagccgtgcccacggtcatgggcgaatgtgaggtgattccttagcgtagtttttgttttaccctgttttatgaaaaggtgttaaggtttgggaaacctaatgcttgggaagcaattagctgtccgggggacagtgggaccggaagtccctggaagtgattggtcgtttggggaccactattattgggaagtttggaaaaatggtttggtttgggaaaaccagctttgaggccaactctgggagttgtgaaaatcttgataaataaatttgttacttctcaccccgactgagctgagacttgtctcgctctggttgtggaaagcacacacttagattgttgaaaaccttgaaaacaaaactgattgaaaaataacaacctattctttgaaacttgcattaaccacctaagttcccctggcttgctgagtacgtaagtactcacccttgctctctatataaatatagttctgccagctctgaagatgaagttgaagtgaagtgaagattagggtttcgtcctagaccccagccgtcgcctgtggtgttgggggttagtccgttgtttccgttgctgctgccgctgttggtgttgcctcgtccgtgtcgtcggttgtaatctcgggctgtcctgagttgcaacctaagttaaggtaaataagtcctctatttattctaaggattgcaatgattcatatttgtcaccgtgggtaccagcgctatgtcctgggactagtactgagatcgcggtttcgtaggaagcggttcgcgccgtttttcctacgacacgctcctatcaggtgccgttgtacggcgatgccggattggggtgtgacacatagcaactcctatgccccgcagccgttgccgccgcccccgctcccacccccggggttcgtcctcgctgttgctgatgccctccctacctcccatcagcattgccatccctaccgccaaccgccggatgcaccatcgctgcccacccaaccaccggatccattgccgccaagctctccaccgtcctccccaccaccggatccgccgctccctgctcctgtatgccgccggatccctctggtgctggccactcccgctcgtccgcccacttgccaccatcgttgtcgtcgtagccatcgccactatcatcgtggccgcggtggaggaagggggaggggggaggggatggccgcttgaggagggggcgagaagatatgaggagaagataagggagtggagtggagtgtggagaagttaggaaatgagatattttaagaggagagaataaagagagggaggggacgggtaaacggcttggtgccaggcgggcctattaagaagcctgcctacgaaaattgttttttcgcatgtggtctttgaaccacgctctcggggcagcgatttttgcaggcgggagcagtttaatttgccagcaacctcaaggggtctcatccgaaaaaatcgtttctatagtagcggtaattaatttagaaatatcttaatgtaaaatgtagtttgtgcgctgctgcctttaattgtccatgagaagacgcgttccaggcacgaacgtgaccggaacacacgacgctcacgctgcaaacatgcagacgtgctcatgcaaaaaatcgaaaatagacgagctacagtacagtacaatacatcacaggacgctggttacaactttaagcaagaacacatgaaatgaaaaggcataggcatgcaggagaggcgcgcgcgttctagctgtacgtagtgtgtcaggctgctagctagtgctgcaggtagacgtggatctcgacgacgccgccggcggcgaggctgtagtcgtagctgctgctggccatgtacccgcgcgcgagccggaaccggccggtgccgccgacgaccaccgactcgcgcacgccgacgccgacgtcgatccggcccttgatcgccaccgagctgccgcggtgctcgccggcctccatcaccaggtgcatgctcaggtccgtcaccaacccgccctccgacacccgcaccccgaacccctgcgccgtgcccacgcgcgcgctgccggcgtccggcccctccgtcagcgcgttgttcagcaccacgatgtccccgaactgccgcggcggcgacgagccgtcgacgatgtcggtggtggactgcagcaaggagcggccggagacgacgcgcatggcggtgggagccgggccggtgtaggcgtcgtgcatgtagaagtggaggtgggtggtggtggtggtggtgacatcggcgctgtcatggcggcgaaggaggacggcggccgcgatgaggaaggagcagccgaggaggagggaaggagacagggaggatgaccccgccatgatcgacgttatcgagcttgctttgtgtgtggttgctactggcaggcagccctcatatatacacacactatgtacgtactggtttatgatttgttagaatctagttttaaacttaaccaaattgatatttttttctccttgttttaaacgtgggtttatttattaagatactgactagaccacctttcttttgtttcgctttgttccagttgctttcgatccagtactacctccgtttcatttcaggttataaaactttctagcattgcccatatttatatagatgttaatgaatctagacacatatatatgtatgtgtagattcattaacacacacacacccacacatatatatatatatatatatatatatatatatatatatatatatatatatatatatatatatatggataatagtagaatatcttataatattaaacagaggaagtattagctaagtgcaaggaaatatagggtc

SEQ ID NO: 23455 - DNA, 949 bp, Oryza sativa
gtataaatcacttagattgaaatatacattaccataaatattataaacacttatagcatagctgatcagatagatctagcatgtaccggctaatactccgatacccctctatattaagatattaaaatagatagaatatatcaaacataagcataatatactttattgtaacaagatcttaatataaatggcagatttagcatatcaattaagcatataagacataatgctaaatcaggtaagatcggctgaaaccccgatgctacctctctcaatgatcataaaacaagctagatatccataattatagatattacttaatagatcgaacctaaccgatacagcattaagcataaatacaagtatgagatctaggcgagatgatgaaaacctgcaagagatagtagatacaagatacaatctagattaataacaaaacataactctaccgattgctttctaacaataagaactagccgatgacaagttataaagtgcaactaacatagattgtgtcgtgtatatgataactcgacgaattacataaacagggttaaagtgtcataaagatggaagcattaaccccgagaacacaagccgccataacaagttttacctctagttgaagatcggaatcgatgcagctcaacccgaaagcacattcgtcgaaataaatgaaagtaaaaaaggtggcgatgcgccgagattgtattgaacgattgttgtttgattacatgggttcgggttctatttatacccgagattacaaaatatgtccttgccggacacaatacttacctctaacaaactctaagatactataagtctttgcggcagacttttgcccaaacatatctctaagaaaattacatgaaatatcctaattaatagatacaactgcatatccgagagctttatctccattgtagcaatccttatgaagcacttc

SEQ ID NO: 23456 - DNA, 550 bp, Oryza sativa
  unsure (1)..(550): unsure at all n locations
nnnnnnnnnnnnnnnnnnnnnnnnnnnnnnnnnnnnnnnnnnnnnnnnnnnnnnnnnnnnnnnnnnnntacaaaattattaaagggacatgtgagggtttaaaacatcttcatgtggaaatgaagccacctatttaccatttggacctaaagcctgccaatattttgctagacaacaacatggtgccgaaaattgcagattttggtttgtccaggttcatcactaaagacaaaaccatgactacaaaaactcttgttgggacaatgtaagctgaatatataactcatttgaatgtatccttttctaataataagaaatgtgatttatatgaaatccatcatattatttgtccccgtgcagcccatacctgccacgagaatacatagagaggaaagaaatatcaaacaagttagacatattcagcttgggcgttgtaatgctagagataattgctggacctggacctacaggacacttcagaagcaccgaaattccttctcaagaatttaccgatcaagtaagggtaccgagctcgaattcgccctatagt

SEQ ID NO: 23457 - DNA, 1798 bp, Oryza sativa
  unsure (1)..(1798): unsure at all n locations
nnnnnnnnnnnnnnnnnnnnnnnnnnnnnnnnnnnnnnnnnnnnnnnnnnnnnnnnnnnnnnnnaactttctagcattgcccatatttatatagatgttaatgaatctagacacatatatatgtatgtgtagattcattaacacacacacacacacacatatatatatatatatatatatatatatatatatatatatatatatatatatatatatatatatggataatagtagaatatcttataatattaaacagaggaagtattagctaagtgcaaggaaatatagggtctgtttggggagcttaagattctgcgaagtagctggtcggtagccagcttatgagaatctggaaaagctgggtttcccagcttatagcttctaggctgtgtttagttcacactaaaattgaaagtttggatgaaattgtaacaatgtgatggaaaagttggaagtttgtgtgtgtaagaaagttttgatgtgatggaaaagttgaaagtttgaagaaaaactttggaactaaacatggccctagtttattttctggtttatacaattacagcttctcaaaatctagaccaaaagctgaactgtttgggggagcttctgattctggaagaaactgcagcagctagaagctctctcaaacagggtcaatccttgcatataatttttttactcctttcttgtcattttcgaaaagaaaaacttcgctttagttagtactactctattggttcttttgacgccgtcaatttttatatgcgttttaaccatttatcgtatttaaaaatcttatacaattatgcaaaaatagaagtcttaaatgataaaattaatcacaataaaacaaataataaaataaatgatattatagcatttttaataaaataaatgttttacatatgttaagtcaatgatgctaaagagatactatacacaagcatgatgtgtgggagtggtaataatatttaacaatgaaacatagagaggcgtttttaagggtggcatttctggttgtgtgcgagtccctcccgtaggggtgaaaatggagcggattcggacggatagtggtcataccatatcctaaatcattgaagttaaactttatccaccttacattacccagtgcaacacacaggcattgtgcttgtttaaagaaaaaaggaattagcaacatctatattagataagtttcattaaatttaacattgaatatattttgatgcaatatttgttttatattgaaatgttaccatattttgctataaatttggtcaaaattttaaaagtttgactaaaaaaagtcaaacgacttctaatataaaacggagggagtatgatttttcacatgcaggtctatttttaagatgtggtgcttttaacataaccgcctacgaaaatcgcaacaaaatataaaataatgggccgggtgatgggagtggcaaaactctcgcttaattatcctctcccccgtcccctcttaccctccatctccagtacagcgtggtagcgtgggaagcgggcttcggatccagtggagctcgatgaggagtacctctgtgatggcctccatcgcttctctccccctcccttgtgttgggattgctcactcacagctacaagtgttaatcacaaacacttttgtctctctggtgggaaatcacttcctctctctctctctctctaccgtatttttgccaccaaggcttctcaggtagacacacacaagcagcacaagatgcaagtttctggtgaatcaaccacccacggcctcattatttttttcattatatat

SEQ ID NO: 23458 - DNA, 1805 bp, Oryza sativa
  unsure (1)..(1805): unsure at all n locations
gcactaacaaactaaccctttatgcaaggctgcatgtccacttacatgcaagctaacacccagaacgggcatctatccactattgcgtgcatgctgcgtttccacgccaacgaatgacacagccatttcggccacttcggaatgtcatggcgcacgacgttctcctgcagcatctcacgtacccgccgtctcgcacggcttttcggccgcgtatgcatctcgcatacaaccataagcttcttcgggtaccatatcctgctacctatacatttattttctacatgcgaccaaagtaaacatgctaatgctaatgacaagattatttgtaacaccttgctcctggcagctacaacgatgggcatcaagcaacatcacagtggtggtgccggatccagcaaagctcgatttggaggacctcctgcgatggcctacatatcgcctctcctccttcctcacttcagatgattgtgatggcaggctctggacggtggcagcgacgcaatactagaaaaagcatttttcccaatataggggtcttttttttcgcaggcagacatgagtctgggaatcaaatgactgcctacaagaatataaatcagggtgaagttcgctgtctgtctgcgaaagtctattttcacaggcggattacttaagcggcgcctatgaaaatcattttcacaattttcacaggcggaccacctaagccgcgcctacgaaaatagattttcgcaggcgcactttatgtggtccgcctacaaaaatcgtacataccaagaaaacttcaatccttatctactactccaacccttccctatcactcatttctatcttctcaactctctccctccaccaccggcttttcagctccgccatcccctcccctcccatcccatctctccctccctccaccggcggcggcggcgcgcggacgcggcggcggctccccggcttcccctcctagatccagccggagggaggccggggaagggcagcggcggcggcgacgacgtggttccccggcctcccctcccagatccggccggagggaggccgggagagggcagcagcggcgtgcgcgacgcggcggcgacccggtgcggcggccgcagctccccggcctcccctcccagatccggccggagggaggtcggggggagggcgacggcggcggcggcggcaaggcgattttttttgtttttttattggattttcgcaggcgggccatttgcccgcttgcgaaaatagatgattttcaccatcgtccgtctgcaggcggtcctccccttcgcctgcaaaaattgcttttggccgcttgcaaaaatgctttttctagtagcgacgggctttgatcgtgtttgatctgatgaaggtggactttaggtgcactggatctggcggagcttgacgtggaacgcctctagtagagataatacggtgagatctggtggacttaagatgcaatagagcaatgtcttccggcagcgacgatgtgtcaggcgtcgaggaggtttgtggtcggatctagagtttctagaatactttttttatttttgtcccacaattgattttgtcatgaatgttaagaaaatagaagcacaacggagacacaaattttacataaaaaacccttgagggaaaaactacgggcaccgaccggcaattatcagtataaaggagttggatacaaatgcagaggatacattgggttgtctaccatttgttagaaaatagatgcacaacaaagacacgaattttacgtagaaannnnnnnnnnnnnnnnnnnnnnnnnnnnnnnnnnnnnnnnn

SEQ ID NO: 23459 - DNA, 674 bp, Oryza sativa
aattaaagcagtaatttgtcggagttaaaagtccagtacaccctcaagcttagaagattatgaaaacaaatgtcatttttgaaactttgggacagaaaaaacatggcaagatcacatctaaatcctagaagttatgtgttgggcgcagttagatgtacttacttgaaggttatggagttccacagacgaactgtctcatcatttgaacctgtaagtagtattggaagatctggatgggaacaaacacaggtaatgcaatccgtatgtccttcaagtgtttgaacacaagtccttctctggcaatcccagatctgacataacaagatgaattgcattgcaataatatttccaaaaaaatgatctcaactcctatgaaaatattcttctttagtgaagatgccttaccttggctgttttgtcccaggaaccagttatcatgtacagttgattgcctcgagtaaagtaatccaagcaactcactatatatccgtgcccagacaatgtgaattcatgacgggaagaacggatattccaaacctgtatttttttttcattaacaaaagtatacatatgttcgtgttaataacctacactctaaaattgtgcttaccaaattgactggagctaaacgaaaataagaaataaaaattcattgtacctgtgcatccttcaag

SEQ ID NO: 23460 - DNA, 600 bp, Oryza sativa
  unsure (1)..(600): unsure at all n locations
tgagtgcgctgcgcgcgcaccatggcatcgccggacttcccggtgaggccggaaggtggcgaacccgcggcagaaggcgaggggaagaggatggcggtggcccacttggcggcgcggacggttcgttggttggtgcgggattcgctgctcccgatgcggcgacgccgctacgcggggcggcggcgcagccccgtcgcccgatgtggaggcgcgtcttgaggagacatagccggggaaggtgagaagaaagaaagagaaaaagatgagcgaagaagatgatgaggagaggagcttatgggtggtgagtggtgaccccattgccatgatggaccaacccttcgatttcaattattctgagagtttttacttgttgagcgacggtgggggtaaaattgaattgataatgatttgtttagatggtgaatcagaatttttttctctacaaaaatcaggtgaaatttctgctctctcatcacttgtccatcttcgcaacttcaaaatgcaagattgaatctggatgatatcaggaacccaaaagnnnnnnnnnnnnnnnnnnnnnnnnnnnnnnnnnnnnnnnnnnnnnnnnnnnnnnnnnnnnnn

SEQ ID NO: 23461 - DNA, 1251 bp, Oryza sativa
  unsure (1)..(1251): unsure at all n locations
nnnnnnnnnnnnnnnnnnnnnnnnnnnnnnnnnnnnnnnnnnnnnnnnnnnnnnnnnnnnnnnnagatcacatctaaatcctagaagttatgtgttgggcgcagttagatgtacttacttgaaggttatggagttccacagacgaactgtctcatcatttgaacctgtaagtagtattggaagatctggatgggaacaaacacaggtaatgcaatccgtatgtccttcaagtgtttgaacacaagtccttctctggcaatcccagatctgacataacaagatgaattgcattgcaataatatttccaaaaaaatgatctcaactcctatgaaaatattcttctttagtgaagatgccttaccttggctgttttgtcccaggaaccagttatcatgtacagttgattgcctcgagtaaagtaatccaagcaactcactatatatccgtgcccagacaatgtgaattcatgacgggaagaacggatattccaaacctgtatttttttttcattaacaaaagtatacatatgttcgtgttaataacctacactctaaaattgtgcttaccaaattgactggagctaaacgaaaataagaaataaaaattcattgtacctgtgcatccttcaagctcgcaacagcaaatttatgtgtatcttttgggttaaattttatttgatatgctaggccatggaggtcaaatgtcttaatgcactcccagcccttgttccagtcccacagcttgatctggtcttgtgagcctattgacagtaggtaaggctcagttggatggacatccaaagttgtgatgttccatacatgagctttgaatctcttcacttgctttactggggactcatatgtgtaaactcttatgaaaccatcttgatgtccaaccacaaaccattgctttcgcgcgatgaacttggccgcgataactgtagagatggagtttgtaaataagttagcattgttgtgatttgtgacactatgttaaagactatgcatgatcagtagcaagtcatgaagcatgcctagtggtccatatgagccttgaatcaggttcactgtttcctgtggacaaatatatggggaaaaaatcttagttcttgaacatacaaaagcatatttcaacttgctaaaattttaagcatgagataacttatgatgaattctatttacagtgtgtatnnnnnnnnnnnnnnnnnnnnnnnnnnnnnnnnnnnnnnnnnnnnnnnnnnnnnnnnnnnnn

SEQ ID NO: 23462 - DNA, 687 bp, Oryza sativa
  unsure (1)..(687): unsure at all n locations
tttggttgtatgtgacttcccctacctgaacaagctgccactcagtgtattattttttggtacttattcttttttttgctgacaaaccttgcgctgctaatttcaaaactatgttctgaaggggatacggtcctggggagtgccttatgnaacactatcttacttgttgagtgaagatgaccctgacatgtgcctgaagtatgatatgtgtgagtatatcggggcatatgcagcagaagttttaccaaagtttgagaaagaattttcttgcaatacagctggtcatgctgctgaaaatggcattactgctagtgacaaatcagagaagcctatagggtatggtctgaataatgaaatgatattttgtttttcttgttccgaatattaataatgttgcatcagatgagtgacatttggtttttctatactatcggtagggtcagtactgttggagatctgaattgtgaataacccgattcgatgggcaagaatgaacgcgatcttaaggacagtaacgtgaagtggaattcgaacatgaagaagctgaagaaggcgcggaaaagaggtttaagagggcggagaagaggaggttaaagagggagaagaagaggctgacgagggaggagaagaggaagtcggaggatcagaccgaaggttgaagtgtgaaagaagaccaaaacatttagt

SEQ ID NO: 23463 - DNA, 535 bp, Oryza sativa
ggaccgccgccagccgttgttgccgcctccaccgggccaccgccgaggtcggccgcctcccctccggctggattcggcggaggggagggcgcggccgccacaagccgctgccgcctccaccgggccaccaccgaggtccgccgcctcccctccagccggatctggcggaggggagggcatgtccgtcgccagccgctgccgccacaaccgggtgaccgccactgctgcctccgccgagccgccgtcgccaccgccaccgccgctcccacttccgccgggccaccgtcgagctgccgtcgagacgagagagagcgatagagggaggcgaaagagagagaacgatagaggtagagcaagagagagacagagagagcgagaacgatagataaggacgggcggaccgagagatgggtggaccgagatatggataaggccggctcggtggctcggctcggctaaggataggtgccggttttttaagaaaaccgtctcggctcattataggtgccagttttttaataaaaccgacacctat

SEQ ID NO: 23464 - DNA, 450 bp, Oryza sativa
gcgtcctcatgatctccctggcggcgtcggcggacgaggcgacaacgacggggacctcgccgagcctgagcgacatgagcggcgcgtcgagccggcgcgccaggtcggccatggtgcggtgcacgagcgggccgcgcgccatgacctggtggaggttgccgacgagcggcagccgccacgggccaggcggcagcctttccgcgccattgtcgccacgccgcttcgccgtcaacctgaccgccatgagagccagcaagaggaagcaagcgcaccacgccaccttctccatgccatccatggccatggcaacacagatcgatcgagtgctactctaagccaacgctcgcgtccaggtgcagatagatatatgcagaggtgttactgttaattactactaggtggcaagtgacagaagcagctttgttggatttttgtcgccatgggagtaaa

SEQ ID NO: 23465 - DNA, 1235 bp, Oryza sativa
tctgtccaagagaatgactgaagagaccgtaatccttcctatatatggcattggaggcataggcaagacaaccttggcgaaactggttttcaacgcttccaatttcagagactactctaaggtctggatatatgtgtctcagacatttgacttgaacaaaattagcaactctataatttcacaagtatcggaaagtgagagccagttgactgaaagggagatgataaataggcgtcttgatgagctactttccggtaggaagattctaattgttttagatgacctatgggagagggatcaatttcagttagatgatttgaagactatgttaaaggttggcaggggcagcagggtgattgccatcgtaaccacccgagataaggacattgcagagaagatttgcaccactgaaccgtacaaactagaacccctgacagatgacatgtgctggaaaataataaaagaaaagagtgtctttgaagcaagagatgacaaagaacaattggagaatataggaagggaaatagcatctaagtgtggaggtgtggctttagcagccaaatcacttggatatactctgcaacccatgaagtttgatgaatgggtatcagtgagaaacaacgatatctggaaggcatctactttcgaatgtacatctttgccatatcataatgtgcttgcatccttgtgattgagctgcagcaatatgcctccaaacctgaggttatgctttgcatattgtgcaatctttccaaaaggtcacatcatagtaaaagaccaaataattcaccaatggaatgctcttggtttcatagagcaatctgacatattctctactaggcagcttggtgaggcatatgttagacagcttttggggttgtgcttccttcaacaaacaaaggctccttcagtgagtttctacttaccacatgcatctatagctgaacagctttatcatttctttattagcctatagtacacacataaatacatatctgagatttttttatatattttgaacctttctttaatataattttaaaataaatcctgctaaacttatctccagatttgcatcttttggccacacaatgccatcctcattggtgtggcaggacaacactgttgcacctgttaaagcctgtggcatcacaaaacatatgatgtcacaccatgagcaatggcactatagtaactcgctaaaccattgctcaagaagtggcaacatttggttg

SEQ ID NO: 23466 - DNA, 866 bp, Oryza sativa
  unsure (1)..(866): unsure at all n locations
annnnnnnnnnnnnnnnnnnnnnnnnnnnnnnnnnnnnnnnnnnnnnnnnnnnnnnnnttttgaatgattttgtagattcttttaagatgtttttgtgatttgtggatgattttcttattgaatatgtttcgatctatgatttgtggatgatttatggatgatctgtgatctgtgatgtgggggatttggggatttcaaacaagacgtgggggcatggcgcagtgaaggcttgtgaattcagctcgattcgagccggctctttttttttttggatcgtgcaaagttataggtgccgtttatattttttataggggccggttgcttgtattggtaccgattaataggtgccagttttctatagccagctgggaaccggcacctttgatgtttttttgtactagtgagctacgactacagcctcgccaccggcggcggcgtcgagatccacgtctacctgcagctagcactagcatggacggctgcatcgatcgatcaactgcgcatgcctagctattggagtagttatttgagtatacgtgttttatgcatcatttcaattttcaagtgttcgagaagttagtaatgcatcgagaggagattatgcaagattaactaactactccctccatttcatattataagtcatttgacttttttcatagttaaactttcttatgtttgaccaaattaatataaaaatacactaacatttttaaaacaaaacaaacatattatcaaaatatgttcaatactaaattaaatgaaataaatttgatgttataaatgttgctagtttttttttccgtaacttggtcaaatctaaaacaatttgaataacaaaaactgaaataacttataatataaa

SEQ ID NO: 23467 - DNA, 1077 bp, Oryza sativa
  unsure (1)..(1077): unsure at all n locations
nnnnnnnnnnnnnnnnnnnnnnnnnnnnnnnnnnnnnnnnnnnnnnnnnnnnnnnnnnnnnggtggaaatcccacccagcatttctagacaatgcataagtatagtatcaaatcgtttaaatattcttttttttttaaggaatgaatcatctgtgactctatacggctaacaggtgctgaatgttgatggaaccctatccaaaaaaggggctttcagcttatcaatagcctggatcaacgaaagatctcgacagcgctaggttgacactgatgctgctttgtatctgagaaatagccatcttcctcttgacggcatgaactgtatgacaaacaaattcttgacagtcttcaaacttcttcaggttgtgccaccaggaagatgaacaggtaatttgctgttgtattctgttacatatacaagagaaaaacttgataagaaagacaagaggcaaaagcaaaatagaagaggcaatgatttcataacagccattacatacctgataactacatatagctggtgaaatattgccatccaccatgctcacctattctgcaatttcattttctctgttcctgtagaagcaaaaaggaaaaaacaataagaccacaatttaataatagcatacaggatatacacagaaaaagaacatactctcggaatgaatgaacacccttgcggaagttctcccattcttctggatcatcaaactaattcatagagaaaacatattagcatagcttttgtaaggtgcaaaaggaaaacagggtaagggtggaaatgtctgacacaccagctggctgaaatcttctcccagtgctttgttctgaagaaaacagtagataaagtaaagaacatatataccacattcatccccattctgctgtggcacctgaaaagttatttaagtaacatgataagaaattcagataagatgaacatgatgcagaaactgaaacggtgcactttgagatgttaaacaccatacctcaggaaactcaagacagattttnnnnnnnnnnnnnnnnnnnnnnnnnnnnnnnnnnnnnnnnnnnnnnnnnnnnnnnnnnnnnnnnnnn

SEQ ID NO: 23468 - DNA, 130 bp, Oryza sativa
gccgagtgggtcaagatcatgtccgggttcagcctcggcgacctgttcccgtcgtcgaggctggccagcttcaccagcggcacggtgcgccgggcggaggcgaaccaccgcaagaacttcgagctgatgg

SEQ ID NO: 23469 - DNA, 235 bp, Oryza sativa
  unsure (1)..(235): unsure at all n locations
nnnnnnnnnnnnnnnnnnnnnnnnnnnnnnnnnnnnnnnnnnnnnnnnnnnnnnnnnnntttctttgttcatccaagggtaaaatggtcatttttatagaaaatagacggtcaactaacggtgaactgacgggaggggtatggaagggatcagaattaaaaggaagtaagtaaaatttaggggtatagaagggattaggtaaaatttgaggggtatacaagggattttctcttaa

SEQ ID NO: 23470 - DNA, 1335 bp, Oryza sativa
acaggtgatgttccatgaatgagctttgaatctcttcacttgctgtacaggggattcgtatgtgtacactcttatgaaaccatcatgatatccaaccacaagccattgcttccgcgcaatcaacttggctgcgctagctgcagttttggagtgattgatatgttagcatttgctgttacaccaggggtaaagtctatggctagcagtgagttaagtcaggtcaggaagcatgcctcttggtccaaatgagctttgaagcaggttcactgtttcctgtggacaaatatgtggaccaaccttagtcccagaacatccaacaccattcagtttgctaattataagcatggagaaacttacaatgaatttcactcgcataggcaaacattacaatgttaccactaatttttaagattaagagaaggtggttctttttatattcattatatcatcggtggtagttatccgatttacattgggtggtatacatatggtaaattcggaactaattattctgaaatttgtgttacaactgggttcagttttaagaaaatcaatttatgcagggagacatatttaaaagtagaaattgataagtattaaaatgggaaatgtgtttagtgttaatttgtatctttggaacttcctaatgtacaggtaccaaaaattaacactaaaaatagtatatacagcccactgggagtggtcacttacttgtgtatcacagttcaggatgtcgactgagccaaaaatattgcctgtcaaaatcctgcacacaagaaatttattatggtaaaagctggtaacagctgttttgcatatgctatgaaaggaaaagaaatgtattaggtgttcatcacatacatattctgaagtatctaaccttgattttgtgggctgtaacgactatgattatagtataacctaaccactagatgaagtaaagaattttcagcaggaaagagacaagcataaaacacaatgatcgttaaatcagaatgtactgaagaactaggactccctttttttcatgtaaaaagtctagaaaaaactcataatacctaatcttcactaaaaggagcttgaaagcaagtggacaatttattttagaaaaatgtagattttttacaaagtttattattgtaaagctggccacaggtcatgactaatgaggcttttgaagggggctattttcttttcacgctttaaaataaaatgggatcatagcaagtaaagtaaaggatgataaatttatcgcttttagaaatgcaagaaaatcttggtttcaattatcaccatgagaacatgtagtttgtctcctcaaacaaaaagagatga

SEQ ID NO: 23471 - DNA, 7214 bp, Oryza sativa
  unsure (1)..(7214): unsure at all n locations
nnnnnnnnnnnnnnnnnnnnnnnnnnnnnnnnnnnnnnnnnnnnnnnnnnnnnnnnnnnnnnnnttttcacgctttaaaataaaatgggatcatagcaagtaaagtaaaggatgataaatttatcgcttttagaaatgcaagaaaatcttggtttcaattatcaccatgagaacatgtagtttgtctcctcaaacaaaaagagatgacaatttcacgtaccatggctcagtgggatgcgcatctatgggaatgtcaggattttccattggaatgatctgatcaaatgaaacagcaaccaaagtagacaaaattataagatatttgtgaaagggtttaccgatgtaacaaaagtaagcaattggcatgattccaacagaatatagagataaaatttcacctgatgcacctctcggtcctcttctttctctttgaaagaagaaccgttatggtgataagcttcttggtttacttgggtgtcacttaagttcaaatggctggccaacctgctctcaagggtgataaactcgtcgctgtatgaggtttgcttctcgcggtggtcgttgacgaaccggacctctgagccatggcttatcggcaactaaatgatatagccaatgtagtcaattaaagaagatttacatgcagctaaaaagtctttcaaatataaatacatgttcctttttgagtaagtggaaatacatgtattgtaatgtgcagctatgaaactatatacccaacactgcaggtacataaaagagcaataattaatagggttcgaccattataaaacatattaaattattgaatagcctacttcacatgattaaaaacagggttgatgtagaaaacttcaattaattttacttcttttttgtgaaactgcaattaattttacatttttgatcccctaaaaggataattgtcaacaaaatgcaatcccaaaatacagcggaagtgttgtgagacagaaggatgttgattcctagaaatccctaacatacaaggagaacattctgaaaatgacgatcaccctagacacttagatcatctttgtggtattgcttttggtcgcggacgttttttcagtttcttaaatttgttatgtttgtatttggctcctgacgagggggttttctcctccgttactttcttctcttcttagtggaatgacgcgcaattcttttgcttgttcgagaattaaaatagtcattctttaatatataaggaattttacagaataaataaagaacatgtcgccgcttcatttaccaaagtaaaatcattccactttatgcctttatgaagagcttcgcactaggtttattttttaaaaaaaaaacatgccagtaacaatattgattaccttgccaatcatagtttctgtctcattaatcttattgacgatatccaaaatattgggtcttttgtgtctatcaatctccacacatttcagagctatttcagtgcacgtcttcacctgttggcgatatgcttccaatgaggaaccattccatgttgcttgtaacctgactgtccaatttcctagtacctgcgaaattagaatgtaaagctaaactattaatattcaatacaaaaggagtagtttttcagagatgatcactgatcctgataaagacaaacaacatttcttactagatcagtaaattcttgggaagacatttcagcacttctagagcgccctctaggtcctgcaattacgtttagcattacaacacccaagctgaatatgtctagcttgtttgagagtacattcttctctatgtattctggcggcaggtatccgctgcatatggacacatatgtaagcgcatccttattagaaaaggattcaatcaaataagtaattgagcttacactgtcccaattggagtttgtgtgacccttgttttctcttcggtgaagagcttggacaatccaaaatccgcaagttttggcaccatgttcttgtccagcaatatattgcccggtttaagatccaaatggtaaataggtggcttcagtccctcgtggagatattttaaaccctcacatgtccctttaataattttgaaccgtgtaggccagtcaagaccatgaaattcgtctgcaaagatacagaaaagaggtatcaacataataataaacataatctaaatacccaggattatttttttcttagcgtgctaaggaatatactagaactggagaaacatcgtacctgaaagatgattctcaaggcttccaccggttaaatactcgaagcagagcgctctatgtattattgcagcaaaaactattcttcctttgtactctgcgtatttatgttgtgtttcatagcagtaggcaactagccgtacaatatttggatgctcgagcctcataaggttctgaaattcattctcgaattgcttatcgtcaaatcctagagtatcattatgaagcatcttcactgcaatctcttttccatttctaaactctccctgttaaggatctattgtcagtacttaatacagcttgatttagcattactggtgaaaacatttgacaaggatgaaattgtaaagcatgtctttatttgctttgtagtcacagtatactacaattaagtatcatggacaataaaaggcggggcatggttaattgctcatcatagtaatataagtatgtgcaaacatgtagcgcatgcttattctttacaacccatacagtgctttgtcaagttattcgcaataaacaaatgatgccctcaacttaccttataaactgttccatatgcaccttgaccaatttttcgctcctcggagaatccatctgtaatttcttctaacaatcggaatgttatatccgttgggtccatagttgaatctggagcttgatgtcggtgtcctggtttatgctagtaaagaaggccttctgcatgaggacaatacaaagtaagttacgctgttaaagagcaagaagttgctactagctctagcactcaactcaacatcatctggccttttttcttgccctttcattgttttgccttttgggttcctgatatcatccagattcaatcttgcattttgaagttgcgaagatggacaagtgatgagagagcagaaatttcacctgatttttgtagagaaaaaaattctgattcaccatctaaacaaatcattatcaattcaattttacccccaccgtcgctcaacaagtaaaaactctcagaataattgaaatcgaagggttggtccatcatggcaatggggtcaccactcaccacccataagctcctctcctcatcatcttcttcgctcatctttttctctttctttcttctcaccttccccggctatgtctcctcaagacgcgcctccacatcgggcgacggggctgcgccgccgccccgcgtagcggcgtcgccgcatcgggagcagcgaatcccgcaccaaccaacgaaccgtccgcgccgccaagtgggccaccgccatcctctccccctcgccttctgccgcggcttcgccacctcccggcctcaccgggaagtccggcgatgccatggtgcgcgcgcagcgcactcagcatccgcgaccgcgaggccgagccctagccgtctgcaggcgcgagcgccatggaagaggaaaacgacgttcgggtgtgtttggcgctacgagttgccagctccgactcttcattttccacccgcacacttcctaaactatcagattattaaatagtggtatactttttgtaaaaaaatataaaaattacttttaaaaatcatattaatctatatttttatttttttaatgtgtaaatcacagttttttacgtgcctagagaaaaagtattagcatccactccccaacgacctccaagagggagaaaatggacatttggcctcgttcaacacgtggtttcgctggaatgccatcccgaaacgtgtttcgttaaaatatcaatatagagcgcgtgctcatcgttagtttgccattttggccagtatattttcgaaatcatttttgctcctccaccgggtgatgagacaaaattaaccatcatgtcctccgcgccgtcgttgagaaagaggagctcgtcctcaccggccatctccatgtcctccacaagcagctcaccgtcttcctcctcgtcctcctccatggatggcgtccggagcagtgctgtctgggaaaggccagacgacgagatggccggcgggtcctccaacatcttcccctccctcaacctcgccacctccgtcgatggtgacggcgacgaccgagggaatccccagcctcctccaacaacggctgatgaccgtggaggaggaatccttcaaccgatgacggcgatgaccgtggaggaggaatccccagcctcatccgtcggtggcatcctcgatactgccaccgacgccgctgctccccaagcactagccgccgccccccgtccccgcagcagcagtcgcagccgcctgctccagtggcaacctactgatgacgacgacgggcttcgcctcctcttccggagcaggcctcctcacctcctcatccacctgccattcctcacggcggcgacctcgacagcagctgcggtcgcggctgccttgacgacgaacaccatatgtggctgcgtaggtcgaagtggaggaggaggcggtggcgacggtgctgcgcggcgaggtggtcgaggaagtcgtggtgatggcgcgggtgaagggggaggaggggggaaccatcttccatggctgcaaccgcgaggcccgctcgtcgctcaccgtcggcgagacgctgtccgcgcgcctccctggcgaccgactcacactcctctgtcgcttctctcgtggctccccgacggcctggacacaacggcacactgcctctcccagtagtcgtccacgccgccacctctcctcactgtgtcaaacggtggcggccgagatgcggtggcgaagcaagggcatttccgtcttatcatcgggtggatgagctaaaatcattttggaaatgaataaaatggcaaaaatggcaatattgcggtaagcatgtgcttcatataggcattttatcgaatcacgttttgagaatggcattctagcaaaaccgtgttttgaacgtggctaaatgttcattttctccccaagataggaggattagaagaggaaattccagggtatagcgaggagtggttgtttcaattattctttcaggatttgccctcacctttactgaattttagaatttcaccattgttttcgttaaaataattagattttttaaattttaagattcaggcccttgttttcactaaaacaattaggattttcagatctagagtagtgttataattgtttttaaatagggataagttttttaagaccttgatgagccttattaatattttcttacatgaagagccttattaatattgcataacagttatatcatcaaataatcttatacccttttaaagggcctgatgtcattttcaactataccttttttggtaaaattatcaaaaaaatatctacgtttaatttgttgctaaatttagtcaatacataagaaatcctgccaaaattttggcaatattgtcatcttaccaaaattttggcattaccaaaacttggtaagatttattttggcgacaatctgaccaggccaaaaatattttaatggtggtggtgagtagtgaatctatggcccaccaccaccttctacctaagagcaggtacaatagcaggcttagccagctataaaaatattttaaagagataaaggaaaagagagaagagcagcgggctacatatctgtagctagctgcagcactgactacaagacgtaatgtgtatatgacaggtgggactagatattgatagtatagtaagcaactattgtatgaattggctattacattggctataaataatttggagctagtagtgggctatactattaaacttgctctaataggggagtccttgttagggtgtagcatatgggtctgttcggaacccagggttcccaacccctctccattgtattctgcacgcacccttttcagactgctaaatggtgcgttttttgcaaaaagtttctatacgaaagttgcttaaaaaaatcatatttatccatttttgaaaaaaaagctagtacttaattaatcacgtgctaatggaccactctgttttctgcgcacactccggatggaaccaggtgatgcgaacacacgtctttcaaattgccatataaaaagttatctcagaagtagctaatttgtttggggcttttaaatggaagaataaccaatatggtccctaaagttttactcctgggttattttgggttattttagtccttaatcttttatattgtccaaacaagtcctttaaatttatcacataggctgatatagttcttggtcccaccaaattcaccacatggacatgccatgtcaccctcctatgcaaaatctatatgatttcttcaatttacccttacatatatcataggaaaataaaaaacaaaagaaaaaatttttaaaaaatatggtacatgtaagagcaaaaatatacgtcaaaaaggtgaaaaaaaaggaaaagtattttttcctgtggttatgtctagttcacccttacatttatttttctatgatatacgtaaaggtaaactggacaattcattatagattttgtatgaatgatgacatggtatatccatatgacggttttggtggaccaaggattattctaggccttttgataatgtttaaggatttctttggactatttaaaagattagagactaaactaatcatacaaagaaaactttagggactacaatagctattctccccttttaaaaggtgtataattaatgacttaattaatgagtcccttctcacttcaaattccgttacgatgcacgaagcatttagctagtttgttgacaaggaagctaggggttgttaacccactcacaaaacaaaaatttatcaaaacatcctcctacctacactggtggagaaaccatctttactcggtcgcccaaaatccataatagtcccggttcgaataggaaccgggactaaagatcatttttagtcccggttcaaaaaaagttattggaccgagttagaccccaattcttttttagtcccggttggtataaacaannnnnnnnnnnnnnnnnnnnnnnnnnnnnnnnnnnnnnnnnnnnnnnnnnnnnnn

SEQ ID NO: 23472 - DNA, 1855 bp, Oryza sativa
  unsure (1)..(1855): unsure at all n locations
aaccgggacaaaaaaaaatcaaccgagctggcgccactgcccccacccggctgcctcggtctctccccctttctttcccctcccctctcattaattaaacagcctcatccatcctttgtccatccttatcctcctccatcccttctcctctcccattcctctcccttctcttctcttcctcctcctcctcctcctaccacgtgaggccgggtggcgcacggcggtagggagggcgcggagcggcgggcggccgggcaggcggccgaggcggtggaccgtgaggtaggcaaggcgggcagccggcaaggccggcggcgggcagccgagcaggcggccagcgaggcggcggcgctccccgggcgggcggcggagcccgaggcggcagcgggcgggcaccggccgttgaggcagcgggcagcgggcggcgacgctccccaggcggcggcggagcccaaggcggccgggcgggaggccagcgaggcggcggacggccggcacccgatctctgcgatgtggttttttcctgatctgtgcgatgtgtgcggccgatctgtgcgatgtggatttctttttctgatctgtgcagccgatctgtgcgatgtgatttctttttctgatctgtgtgatgtgtaatgtgtgaatgaatttgtggagatgattttgtgattttgtgaatgatttatgatgtatttggagatagaaaatgcagcttgatgtatttggggattttgtgaatgatctgtggtgttcgaatgatttgtggataatatgaatgatttgtggggctcgaaatcatggaagcagcaaggaaaaaaattaaaaaaaagaacattagccccggttgttaactctaaccgggactagatctcccggttagtaactccaaccgggagtaaagatccttctttagtcccagttattttaaccgggactaaaaatgggtatttttagtcccggattcgtagttccggttgcataaccgggactatagggggttgtgaaccgggactaaaaagggtttgtccaccagtgctagctagctaggttatgtgctactgcaccttatgtgccttttttttttttgacaaagcgagaatgcaacattcccaatattccaatattccgagcaaaaaggccgccgcaatatcaaacagtactatctctgtagagtatgtatccactacttccgtacaatccgtctcgataagattaatttgtggttaacgaggaagaattggattgagacgatacagtcagaggcaaaaattatctcctttaatttccctttgcattccttaccatttaaccatagttggtgtcatggggtgtgtgattttcttttttatattacatggtagctagatgcacataccactacacacgcaacaccatactcacacaccttgtgaatgtgtcccctaacatatactttaagagacggaaaccagcgacatatcactgatctcactaaagtcttattgaaagtccatatgcatgtgtgtaatattcttagacattaagattttaaactctgatagatagattcgtacacctacgactctaccaccatactattggtgattcccatggttgtatgattttgggcctttgaggtgtggagaaaaacataaggtagctcctaaatcaaacttaaagttaaaaggaccaaatactgccccagttgacacgtaattagcactaacctggagattaactgaagacccttctcgagaagccggagagaggacatcaaccagaggatggatggagctcaatcactggagattataaannnnnnnnnnnnnnnnnnnnnnnnnnnnnnnnnnnnnnnnnnnnnnnnnnnnnnnnnnnnnnn

SEQ ID NO: 23473 - DNA, 3164 bp, Oryza sativa
tgatagatagattcgtacacctacgactctaccaccatactattggtgattcccatggttgtatgattttgggcctttgaggtgtggagaaaaacataaggtagctcctaaatcaaacttaaagttaaaaggaccaaatactgccccagttgacacgtaattagcactaacctggagattaactgaagacccttctcgagaagccggagagaggacatcaaccagaggatggatggagctcaatcactggagattataaacgggatttacgacgatggcgccatggatagacgaggcagctgtaaagaaggcaggattgcttgcgatgatgatgaagacagtgttgacaaaaccgagcaagttgtaattgtgcagacatgccgtgcatgcgttaatcgcgtatacagtacagtttgtttgtccaaagcttggcagagctcctcaagtacaatttctaaggattaatataagagcacggttacacgtactaaactattagacttctactccctccgtttgtaatacatgacaccgttgatcttttgagatacatttgaccatccgtcttattaaaaaaaattatgtaatcatttattttgcttgacttgatttattatcaaatgttctttaagcatgatataattatttttatatttacataaaaattttgaataagataaataatcaaacgttggtcaacaagtcaacagcgcatacattagaaaacaggaggagtattaacattattgatctcaatcaattgatttaactagataggagctatagaaaatttatatgtacttctacagcatggcacatcagtgtttgttagtataggagtttactaaaaaaacaattagatttccgtgtgatatatggctctaaaatatgtcaacatacagctaggtagtcccttttccttaatataaaaaagttgctttaaagtaaacctatttgttgtttggaggaattaaattaaactaataaaaatcatatgagtaaattttctactatttaaaatagaggctactacttgataataacaaatgttatgcaagtaaaggacttcacagcattttcaagaataataacggcttgtgaggattatgcatgccagcctaattttttgctgctactaacaagaacggcgctagaataacggttacggtttgcacaagtttttcaatgctaactcaagtaggaaatgggtgattcatcatcggaaccgtcgaaattcagcaaatgtcgtggacggccagcttctaacattgacgaaaccagtggcggccagctgcatatatgcccactgaattgggcattttgatgcgtcatttacacataagttggaaatttgaagcatatatttccatcagttgacttcctccaggattaatttaactgcatctttaaaatatggtttctgaaaatctcttgcattagaacatcatacatctgcagacaattcactgtttgctggtttgcaggtgatatgatttgagcaagttgcggcgccattgttgactgatcacgttttagcttgtaaaacaaattatgagatggcgtgcgccatagtgtgaggatactgtacaacattatactcatgtagaacagaaactatgtaaaatgacacatgtaatgacttcgtgaatcctaagatatactgatatagtttttaaaggtactcataagaatgagatgtgcatgcatgtttgtatttatagaagtatgtacatctttacctgagcgccagtctttaatttatttccaaaaaaactacgtaaaacataccgagcttatatatgtgcatcaacgtcaatagtcacttacttcctccgttccaaaataaacgaatttaggataagatgtgatattttctaatacaatgaatatggtagaaacatatccagatttattatactagaaaacgtacatcacatcatagtttatgttagtttttttacttcctccatttcacaatgtatgacattctaatattttctacatttatattgatgttaatgaatctagatagatacattgtgaaacggagggagtataatacaggggaagtacttacaacgggagggaacaagaacagtgcaccaaattaggtgaacaaaggtacaaaacgcagtatgagtaaatgctacagtgttgattgcatcagccggtccaaattagattgacaagttcgaaaggaaaaaggatgaaaaatacgagtacgtcaaacatagtggtaagggtgtgtatgatgatagtacatagatatcgatccactacatcaaattacatatttttttccccatggccggcctccgaatttcaggtgttgattgccaaaagtctcctctccacattgctcaattggtcttctcaattaggcagtccaaactgttctgtgactagagtttgaatatcctcatgtgttgcttagaccgatagaagcgaccactcgtctggacctctcgtctcccaacccctcgtcttcgatggccttgccgccgcccgagcaggccaccagcgtgccaagcggctgtgaggaatgcggcagtggggcttcctcagcagggatctggctccgtatcgaaggggcgtcgggggcggtgcaggaagcggcaagaaggtgggcggcggaggcgttgcggtggcggccggaggtggtcgggcctacgtatggccgtgcgagctggtgtcagcggtggaggtggttggcaggtgtcaacgacagcatctcttcgggcggcggaggacgacggcagcctaagcatcgccggcgtatccttagcagggaaacggcaggtttgggtagaggtggactcgttcgcagcggcgtgggagtccgggtggaagacttctccggcggcgacggctaaggccctaggggcagcgctggtccgagacagcggcggcctgagtgccggtgcaaggttcacagtgaggaggaggcggatcccggtggcagcggccgccctaggggcggcagatgcctgtttatcgggtggaagaggttttcctcgatggaggttgcaaaggtctccggtagagccaacggccctaggggcggcgatgagctgggaatccaggaggggaggaggttcacgaagatggcggtggccctaggggcagtagaggcgtaggaatctagcgaagcggaggtgtatcat

SEQ ID NO: 23474 - DNA, 22395 bp, Oryza sativa
  unsure (1)..(22395): unsure at all n locations
aaggccctaggggcagcgctggtccgagacagcggcggcctgagtgccggtgcaaggtttcacagtgaggaggaggcggatcccggtggcagcggccgccctaggggcggcagatgcctgtttatcgggtggaagaggttttcctcgatggaggttgcaaaggtctccggtagagccaacggccctaggggcggcgatgagctgggaatccaggaggggaggaggttcacgaagatggcggtggccctaggggcagtagaggcgtaggaatctagcgaagcggaggtgtatcataagtggatcttgttggctcgcgtttggttggctagttttagctggacggcgacggatgaaggtgggctaaactagtgacgtgtggcgtcaactcacctgaagcggaggaagatggcatcagcggagattcgcaacgacgacgcactaggtgtggcggcgactagacgactcacactcgctgaattttttggttctatgttcttctctttcttgagaggatatgtgagtctaaatgctcttgtatttttttggctgtgtatattatttgtggatatagaggccggattaatgaaaatccattatttaaaaaaatgtgttgctaggaccaggcttttcgtgacgaatttcagtaatcatcaggtaatacaatccttatgcccagtgagtgtttaaacacaactcttgctctggcagtcccaaatctgactcaacaagatgaattgttttataacaatatttctgtcacaatgatcaactgctaggacaatattcttctttttagtgaaatgatgccttaccttggccttttgtcccgagaaccagttatcatatatagctaattgccacaagtgaagttttttttttctttttgaaacaccatcctcctgctggatatgggccagttcggctgccattcctgcggcagcagcgcttgtgttgtgcggttgcaaaacaaataccagccgaacatgccctatattaagaagaatgggcctagtctacgagggagaccaaacccaaaaaccatacaaccaaacaataaattaagaaaaccatcaaaacctacacaaagggcaaaagagaaacaacctgtggcgataggactactaaggcacgactgaagacatcgagcaactccgacttcctaagacaagccagaacataccaacaaacccaccaaggagcgggaattactaggcgaagcctccgacaaggaaacaatatcaagaatgttgtcaatgtccgtccatagcaatatactaggttttcatctaaagaagaagatgaaaattgaagccaatgcaaattgccacgagctagtaaagtataaaatgatgacacgaagaacggacatcagaacccctgtattttccattaacaaaaagtatatctgtgcgttaatatggaccataattctaaaattatgtttaccaaaataacaggtggtattattatatataggaaacctccttaactgtacatgtgcatccatcaagctaacaagacaaaatttagttactgctggtgcatcatgcactgtttggacttcttccgtttgatcattaattactgtaacacattactgtgaaatcatgtcagaaaaaacaagagaaaaaaccaacaattaaaaacaagataattacgcttatgtcaaacaacaccaaacatttgctaatcagaagcatatattcatgaaaagtaaacttaattaacgatgcaagttgaaagcatctaccatgactaaaaaagtgagcaatatacagattgcatgcaagtaggactgagcagtaagctctggtttcccaaagaccccaaattatcaggattccataacttgtattcttcccatttcaaaagcactgcggtatgcaagacttcctaatttgaaaacattctcatctgccttcgttagctcagatgtctgcagagacttcccttccaggagcttgtccctcataattgtcaaggcttcaacaaacaaataatacatgccagtgatgacttgtgcacaagaaacatctatactactttaaaaattttaaaagtaggtaatggtgatggcagtaaatctgccaccccgcaaaccccattgcaatttttttgtagattaccccttaaacttttttataataaaaacaatcaaatctataatggtgttggcaatgattctgccaccccaccaatcccattgtaaatttttgtacgttgcctcttaaactttttgataatataaacaatcaaatctatcaccccaccaaccccattctaaatttttgtatattaccccttacacttttcataagtaaaaaaaattcaaatacaaatagattgccacatataaaaatcaaataaggtgaatgttcactataaaaataggtaatatatttcaagatatatatnnttatttgttttagacaatattatatttaatattttttatctgttacagactgcggacatttagctagtaaaagattaaatcaagaactaaatgttttggtcttctttcacacttcaaccttcggtctgatcctccgacttcctcttctcctccctcttcagcctcttcttctccctcttcagcctcctcttctccgccctcttcaacctcttcttccgcgccttcttcagcttcttcatgttcgaattccacttcacgttactgtccttaagatcgcgttcattcttgcccatcgaatcgggttattcacaattcagatctccaacagtactgaccctaccgatagtatagaaaaaccaaatgtcactcatctgatgcaacattattaatattcggaacaagaaaaacaaaatatcatttcattattcagaccataccctataggcttctctgatttgtcactagcagtaatgccattttcagcagcatgaccagctgtattgcaagaaaattctttctcaagcttggttaaaacttctgctgcatatgcccggatatactcacacatatcatacttcaggcacatgtcagggtcatcttcactcaacaagtaagatagtttcctagcctcctttgcgatccccttcagaacatagttttgaaattagcagcacaaggtttgtcagcaaaaaaaagaataagtaccaaaaaataatacactgagtggcagcttgttcaggtaggggaagtcacatacaaccaaagcagcagcggcaatggcagcatccgattcattcactttacagagcataagatttaaggcagactgccggagacctcattgctgaagctgatcgtctcggtgggatccaactcatgttccaatgaaatgcatatcaactcagcctccatcgtgatacacttgaaaccaccatttgcaataattgatgccagaaaaaaaaggttagtaaacatcataaaatgataattactgtttattagcacttgaattaggtagttaggcatgcatgcgtaccaccaagcctgcagctgcagcagaagattcgccctctgactgaatcatatggcttgcacactccttgatcttggagctcaggatgatctcttcaaccgtgagtgcactatgacagctcctaagcaacttgttctcaatcttgatacactagaaacgtttggttgttttgcaatggtgcaatgaagtttattaattaggaactgaatcaatgaaacaagtaaggtcgccacagtaagtatgcgtttgcagaggcaggaagacattaccaggttggctgcatcatggaggacaccacatccagcaggaggaatgccttgtccctggacagacctgagctgggagcagagagtggcaacttggccagcattgtggctggaatactcctcgaggtatttcttgaattgtggccactcaacagaactagaatggtacggaaacaacctttcccatccccatcctctctcgaaaagatcttgagtagagattaaaaaaattactcagtaatactgtactctccaaattactctgtccatcctaaaatatactccatctgtcccacttgttaaggcgcgatcaaacgtcgtacagtcttcaaaaataatatttgactttaaaattataataacaatgtttgtagcaacaaaatcataatcatatgaaaataaatttaaataacaatcgaatgatattatttttatcaaatgaaattaaatttatattaaaatatttattggtcaaatatttacatagttgaattttaaaatatgtgtatgtcttagtgagtgggacggagggagtaggacacaactatttttttatttttttaatgtttcataatacaatgtatgcatgtatataattaactaacgcctcccctctcccctaaattcattttttttatcatttactctcaacatctctaatcccgttaagtgcatacaatgtacttgatatgattcaaacgagaaagataatagtaattattttttgtttcttatgttagtgatggttgtaacttatatcttgggaggaaaagagtaaagtacacggtactctccaaattatagacccaaaaatacatcatatctctgtcaagaagaaaaaaattccaaaaaaataaaataaaaatctcttctctagatggattgaatcaggatccagcaaaaaggcaaaacattgaaccaagcatacatataacatatatccccaaccgtagagaggaaattcgtactacctggatagtcgatcaagaacaccggcggtgcgtcgagcagatcggcggtagtctcctcatcctccttgtcggcgacccactccaacgccatggcttcgcacaggtattccacatcacgggggatgtaggtggcagtgatgggcacctctgatgacttggtctctccattgctactcgcatctaccaccatggatctcctcttccattatagagtttcgtggatggattgtggggggcgaaacgcggggaggttttttttctttttgaaatctttgatgcggggagagtgggagacgcaagagaaattggacattaggccactaccaatagtgggtttcatcacaatgctattccgcggaatggcgttgttaaaatgccactcacaacagatgccaaacatttgtttttgccatttaagccaattctctccatgtccacctaattttccacccgggctgactaaaatacccctccggctgtcacaagcgagttgttcgtgccgccggcgcccgcaccgcccaagctcaccgccgatgacgtcccgcccccatggctgaagcccgctgcccacacatcggagaaagagaaggaaaccctaagccggccactgcgtcgcgtgccacaatctcccccgtcgtcgcgcccgccggccaccgcgccgctcctctcccgctaaccaccgtgcgccgctcgccaccatctcctctgccgtcatctccaccacatgccgcaggctgcacgccaccatggcccaagaaggctagctccaggaggagctcgtggtaggacaggacctgcgttgccgtcttgggctcagtcggcacggtgactgtggtggggatggagatcaacgagccggtgaccaaggcggcgggaggtgagccgaagccctcacgctcatcctcgctagctctccggattgtgtgtggtttgagctcaaagattgtgttcttgaatttgtagagcaagaggaggagccgagctccgccgagcctgaggttggcgcacccctgccgtcgtggtcttctcctcatcccacatgttcgccggagaagagaaagaaactgtaggagagaggggtattttggtcagttgaagtgcaaggaatggtgaatatggcaaagcaacggcttggtatcggttgaaagtggtattttaacgacgccattccacggaatggcattgcggtgaaacccactcttgaaagtggcataatgtctaatttctcgagacgcggagcaaaagcagaggacgctctctctgggccgggcagcccactggcatggtgagacacacaagacccagtaagcgccatgtctctctctccctgctttgagaggagatgtcagatgaaaagagaagatcgagaaatacaaaatagtgcatgaataattgaatattaactattttaaattttaaaaatagattaatataacatttttaaaaacaactttcctatagaaatgtttttttaaaaaaatacatgcggagaacaaaacaaatctcctctcaatcttagctgccgaacgcagtagtcagctatacaagtactattttcttttgaccggcgcaatcaaaagcaccgttttcctttgttcgagagctgaagaaaatagaagattgagagagatgaaaatcgagctgagttattagtatatgattagtttagttgtatattaattaatctaaacttgaaaatgtattaatacgattttttaaaacaatttttctattaatatgattagtttgaaaaatacgcgtgcgaagaacaaagtatttctcctctgtatccactgcaaaacaatacagccttagtatgacaaattatccgtcatcccccatccgatggaaaaacatctctatctccaccatctctactactttaatttaaatgtgtaatcctttacccgaaattgctaattggctcatacgcgctagataaataactaacgcgcgtttcagttttggcatatcattagcaaggccaaaggcccaagcacacttttaactttatgttttttcgtctgacggcgccagcatatgcacgtgctagtatagataggaattaacacaaaggggcagttgggcaagtgaggcaaatcaatgtacaacgtgattaccgctataattcttcattattagttttaatttttaattaggtgacgtgattaatatgagcactcatacctgaaaattttcaacctgtttttaaaactttcaacttaaatataaaaatttcaactcaaaattttgaaactttcaacataaattttgaaactttcaacccaaatttttgaaaactttcaactgaaaattcaaaattttcaactgaatttttaaaactttcaaatccatattttaaaactttcaagtcaaaattaaaatctttcaacgcaaattttgaactcgaatttgaaaatttcaactcaattatttataactttcaatttatattttcaaaaactttcaactgaaaattaaaaattttcatccaaaatttcaaaactttcaaatccaaattttaaaactttcaaatcaaaattgaaaactgtcaactccagaattcaaaaaaaaatcaattccaattctagaactttcaagtctaaaattcaaatcttttagttcttaatttcaaaagtttcaactccgaatctaaaatttaaatcttcatgttagatagtactccctccatctatttttgatagtcatatttctaaatctgaaaaatttatttttgatagccatatttcaatccaacaccctatcattttaatgactttctcggattcaatgcatgactctccattcttccacacataattggttacatgggcattgagaaatgtaaatattaatggatcgcttgtttacgaggaatgactagtagcatgtttaaatggatgataagtagaattacttatgtttggtctgtgtgccaagatgaaatattactatcaaaagtagatggagggagtatttattagcgttaatcatgtcattaacgctaatcacattattagcattagtagagaggggcagcttacgcgggttgatcggaggatttttatttttgtcgctaacaagaacgggaaaatcgccaaaagggtaacgacaaatcaccgattcctctgctccacgcgctcgcgacttgatcttccggcacgtgcgcattaggagcccccatcctttaccatcattgtagttctcccacacaaagaaacgtctcgaaaaaaaccatctcatccaaaaaaaaaacaacaatatttccacgcaataatcaaccagaaaaggatagaaaaaattaaaccttataattcatatctctcttctggcccttatgccactgtcgcatccatcctctccttctcatactgcaggcgcaaccaatgcacgaatagaacacatgcattgtattttgaattgatattttatttggtatatatccagaattaattttcaattggtgccggatttgagttttccaattggtagtgttgttgcaagaactcaacaagtgtatcaatttcccttccctctattctctgccctctatgggtgatatttacacatttatatacatggatatacaagaggaaaatgcctcggtgtccctatgccttacgatatgcctatgcgactggccggtgggccagccttggtcctagtggtaacttggtggaggacaggagagctgccccggtatgggggcaccactgttctcgaggggccttgctattacctaggtaaaggcatcctccgggtaatagcgtgctccgcctggcagccatcaacagtgtcagagttagttggggcgcgtagtgcgcatttattcgtgcccgctagcgcttgattcttgacttggcatgcgagggcatatcgaggcatgattcactccggccggcacactgagctcttcagacccctcggaggcccgtagcccttaggttccctccggagctccccttccgggctccgggttcccctctgggcttcggagctcggtcatttggagtggcaccggagcccgtggcgctgtgacctcccggagctcctccggagccgatcagccaccatccggagcctgcttaggtctcattcctctcgcccccaatgagatccgattctcctggatctccggaggcctccggagcgagggggccatccgcgaaccgacatggccctgattcatggtcatctcccggggaggaaggttctccggagcgctgcagcccttcggaggctagcgtctcctgatccggagatacttccccaacaggtagcaagatttaatttgataaaattttcaattactatcaagaatttgaagttgtgcgtgtcggtttcaaattggtatatcatatacacacagcagaccccacaaatgcaaaagatagggggagctctcacatttcttacaaatatgtacatattagtttcacctcacatgttagtatgcacacatttaagggagctcaaactcaccctttggaaagtaagttattatcaatctattcataagccttaatcgtttcatcatcaatcaatgatgcaaaaaggtgaagatttaaaatgcatctaggccctccagtggattttggctaattgataaaaacattccatcaagattctacttatgccgataatctagattcttccatagatatatctcctttaaccgagagaatggtgtatttgaataccaacaaacaactatgtagcgtgtgcctagctttaccaacacgatacccataaattatacggaattaggataacaagaatgaacacaagcccaaatttgctctatcatggctggtactccctcctttccaaaatataaaacataatcacccttaacctaaaaactaagaaacaattattatcatctctttgtttgaatcaccccaattaataccatacatacacccaatagaattaaagatcttatgagtataggatttaaaaaaataataatttaggtcagaggagatgctaattaattgcatacatacatgtatgacttatattataaaccaactttaaaaaatagttgtaccctatattttgaaatggagtaagtaattaaggtcgtgttggcccgttggccttgcaggcccacaccaaattgaagttacacacgactaacctcaatgattcgtcaatacgagataccaaaggcattaaagatgtggcgtggcccactctgatattctcaattcaaattaatacatgtcttgacgattctaagatatagtagatccaataatacataaaaggaccataagaccaatacacagaaaggaccatagagaaccaatatgtagaagggcattggcccgatctgaaggaaatttacggttaactttaaaagtgagcggcttgtggggtccaattgcaagatttcaatatccggccagttttaccaccaaattaattccgtataagaattagaatttacataatcatgaattggctaaggatctgattatataagttttggaactataaactctattttactttttctggacagaaatattttcagaatacactgggactgttaattcataacaaaaacactggactgcaaaagggatgagaaaaaaaaacaaactttgtatgcttaatgtaggtaatatccactacatcagattacaaatttttttttcccatgttacctccgaatttcagatcttggttatctaagtgtcaaaacattgttcaaccggtgttctgaatgagctaattaagcgcactaccattatctgtctccactccagtttgcctacttgacaccaacagtttgaatatccttatctgttgctgggagcaggctttccatgacgaatttcagtaatcactaatccagcatcatgtccaatcgcaactctgcaacagtaaggtcgtttcaaaaagaactctgaattaataaagaatgcagagcacatccgtaatgcatacaacgtaccgatagagttcacatgccacatagaagaagatgaaaaacatgccagttacaaatgttaaaaggagttcataaggaaaggtgtgatgacagtttttacacaaatagacaattgcagaaaagacagatcatctacttcataactcaaaaaatgagctgttctgatataaagtaagatctttgaggaatggataaattttaatttcaacaaatttaccgaaattcatgttctcagtcaagtttattttaattttacacttgcagaagttgcagggaagcagtaacattgtcaacaacataacatcaagataaatagtagaatccttttaatcactcaccgttttgaaccctttaagcaaactatagcagtaactttgccgagctcaaagtccagtacaccttccagcctagaagattatggaaaacagtgtcatttctgaaactttttggacatgaaaacatggcaagatcacatctcaaccttatgaagttgtgttaatatgtaccgcaaattaggaacttacttgaaggtagtggcattccacagacgaactgtctcatcatttgaacctgtgagtaggattggcagatctggatgggaacaaacacaggtgatacaatccgtatgtccttcaagtgtttgaacacaagtccttctctgacagtcccagatctgatcagcaacatgaaatgcattagaatgttacttccgcaaaaaacgatcaagagataccacaatattgttcttcagtgaacctgtcttaccttggccgttttgtcccatgaaccagttatcatgtacagctgattgcctcgagtaaagaaatcaaaacaatccactatagatacatgcccagacagtgtgaattcatgacgcgaagaacgtatattccaaacctgtattttttttccattgacaaaagcatacatatatttgtgttaatgacctaaattctcaagctgtatttaccaaattgacaggagggtacctgagcatccatcaagcttgcaacagcaaatttatgtgtatcttttgggttaaatttgatttgatatgctacgccatgggggtcaaatgtcctgatacactcccagtccttgttccagtcccacagcttgatctggtcttgtgagcctactgacagtaggtaaggctcagttggatggacatccaaagttgtgatggtccaactccaagcatgagctttgaatctcttcacttgctttactggggactcatatgtgtaaactcttatgaaaccatcgtgatgtccaaccacgaaccattgctttcgcgcgatgaacttggctgcagtaactgtagtgttggagtgagtaaatcagttagcattgctgtggcacatgtacaagtctatgcatggttagtagtgagtcagaagcatgcctattggtccatatgagccttgaatcaggttccttgtttcctgtggacaaatatatgggcaaatattagtccttgaacatccaaaagcatatttcaacatgctaaaattgtaggcatggagataactttcaatgaatttcactcacataggcaaactttacaacttataacttttttgttgtcattggcagttttctaaatttatagcgggtagtatatatgcttttagacaacagaatatgtttcttttttttttacatcactggcttctatatcagaaatatacgcaaatacctgtcccaccaaacaaacatgtaactagccgattactggacaaaagtttacgtctaaatatttgaattaaaaaaaaagttacacaattttttgcacgcctgctaggacctcacactccatgtgtagccaccttactttctcacatatgaagcagtacctcatgacaacgagataaatgttgttcatttgacttcacctctccaaaacttgtagtgagtatttgatagtactgtacaactttgagagcatgtctccatcaacagtatttgaaaaaaatgaagaaaaatgttttttaaatagaactaagagctcgtgaagaatatttgattccctagatgaattcaaataaaaataaacatttaactagaaagtttaagatatcatcgagagctataattttcgtacaagttttcttttcatctgacgtaatattaaaagctgtaattttttattgaaatgtggccattccttaagagaatcgccgatgaaaattgaactttatgggtggcttcttaagagaatcgcttatgaaaatgttgtattttgttccaggttatttccaaagaaaaccgcatgtgaaattttttcccttattatttgaaaatgacttgattttgaaaattaatagaaaatatattttaagtccaactaaagtgacccaaagctctctgtgatacttaatatttcctttaatatgatcagatcaaaagtattctaatatggttccttacttattaaaagttacctctatgtgagttgacatattatatatcttaagtgaatgactatatccaaggaaatattgaccacatcttattaaaggaaatactgtaggggtctcagataatttttggttcacctcaatcagatttaaaatgattttaatgtgaattttgaaagtttggccactttaaaagaataagaaaaaaaaaggatatgacggttcgtaacgaatgtttgagacattaaaagatctcaaatgaaaaaacatcaaactacaaaattgtattttccgtaaagagatataattataatataaagtttgttctcatccacttcataagaaaaaaaagtgattttttaaataggacccttgccatttttataggcggttaacaaatagatctgagaccttatgatgaatggttgagcccctaacaatatcaatatcaaattaaggcaactaaaaagttgtacatattgtcaacagctaaacttttcatatgaaaagattgttctgatccgacttcatacggaaagattgcgattttgtttacggaaaaagagtcatttcctttttataggcagttaataaatatatccaggaccttgtaatgaatgtttgagctactaaacaatctcaaatgaaaaaaaattcaactacaatgtagatctcattgggagctataattttcatataaagtttattctcatctaacttaatattaaaaaaatgactttttttattaaaatagagttgtttacatttttacagttagtttcttaagagatcagtccatgaaaataaatttttacaggaggtttcttaagaaagctgcaaattgaaataaattgatgtactacctcataaaatcacctaattttcatagacggttttcttaaggaataatatgtggaaatgtgttttaacaggcaattttaaactataaggccaggcttcttgccattattccacctataaaataaagaaagggtgcccacgaaaatattttttaaaagtagtgattgaaatgggttttttcttatatgatccttaaggaggttctgtgagataccataccattttatttttacatgtgcctttggtattttccttgtatagcggtagcacaaattaacagtaaagtagcatatgcagcttaccaagagtaataacttacaagcgtattatagttcaagatgtcaactgagccaaacatattgctcgtcaagatcctgtgtacataagaagaaatttacttatagtaaaagctatagtaacagacattttacagctgcttcaaaaaagatagaaatgtagtagtgttcaaagaaattaaaagataaacagatatctggccctgattttgtggaccctaactttattatagaataagcgcataaccaagtaaaagaacttacataaggaaaaagataatgagaaaacatgaccattgttttagtcatttctcctctacttccctttttcaaaataaaaaaaataaaaaaacataaccattcttttttagaattaaacataaccattgttaaatcaaaatttacgtatcagcgtatgttcccacaaatttttatttttgttttaggtctaaaataatatgggatcatgctaattgccaagtgtagttaacatgaaagtagtgaactaatacacgaacaatttgtccttttcttttggatataaacacaaatcttcgtttcatttgttattatggaaaaaaaactagaacatatgcagtttatctcctcttagaaccaaaaaagaaagactattcacataccatggttccgatggatgcacatctattggaaaatcaggatgttccattgggatgatctgatcaaatgacacatcgactgaagttaacgaaataataaaatgaatgggttttcaaatgttataaaagtatgcaacatgcatggttttggtgatacaaaaacaactaaaacttatttcacctgatcttcctctcggtcctcctctttctctttggaacaagaactgttatggtgatcggcttcatgattttctttggtctcatttaagttcaaatggcttggcaatttgctctcaagagtgacagactcgttgttgtgtgagggtagcttctccaaggcatggtctatcggcagctaaatgaggtccaaattaatgaagttaatagaaattctatcattggtgaataaatatgactttcaaatatatatgcatgttttcctctctgagaaaaaaaatgtaaataattattttgtagtatatagttataaaattgtacactcagcatcgcaggcatgaaaaatgagcaatagttaacaaggttggacctcgataacgcatattaaattattaaatagagcttacttcacatgatttagagcaggttagatggtacaaaactggaattggtcattccgtcattacacttttgattccctaaaaggattactctcatcaaaatgcagttccaagatgtaggggaaatagtgaaacagaggttgttgattcatggaaatcactaatgaaacaaggaatatattgtgaaaatgaatgtaaactcatcccttgatacattatagtttttcttatcaaatagatgacaaatacgataatgccacatcggcataagcaaaatgattcctctgcattatattcctccaggaagaacattgcgctgtagccttttataaacaaaacacacgatagtaataattaattacctcaccaatgatagcttctttctcgttaatttgattgatgatttccactatattaggcctattttccctatcagtctccatgcatttcagcgctatctcggtgcatgtcttcacttgctggcaatatgcttccagtagggaaccattccttcctgtctctaacctagttttccaattccctagtacctgtgcaatcagaataaaagatgaagtactattcaaacgaaataaaatatttcctcagttctaaaatgtttgatgttggttagttcatttttaactaacaaacgccataaaaaaataaacagattgagaagtttagttagaaataaatagggagtagtttagttagaaataaacgttggttctgaactcctgattacttgatcggtaaattcttgagaaggaatttcggtgcttctgaagtgtcctgtaggtccaggtccagcaattatctctagcattacaacgcccaagctgaatatgtctaacttgtttgatatttctttcctctctatgtattctcgtggcaggtatgggctgcacggggacaaataatatgatggatttcatataaatcacatttcttattattagaaaaggatacattcaaatgagttatatattcagcttacattgtcccaacaagagtttttgtagtcatggttttgtctttagtgatgaacctggacaaaccaaaatctgcaattttcggcaccatgttgttgtctagcaaaatattggcaggctttaggtccaaatggtaaataggtggcttcatttccacatgaagatgttttaaaccctcacatgtccctttaataattttgtaccgtataggccaatcaagaccatcaactttatctgcaaaggtaaacaaaagatatatcaatagaatgcaaatacacatgactaattttcttccgagctgaatatgtactccaaccagtttcataatacttgccgagttgtcattttggacaaggatgtggtctaaaataaaatttctaagtcaaacttattaagtttgaccaagaaatatagcaatatttccaacacaaaacatactatcaaaatatattcaatgttagatttaataaaactaatttgatgttgtaaatgttgttatatttttctgtaaacttgatcaacctcagaaaagttcgacttatgaaaaagtcaaagtggcttataatatagaacggatggattataataaatatataattttattaaagtatctttcaagattaagctatacatatattttccatgcttcttaagtaaatattttaaaatttattcatagtcaaagttcaaaacattttaacctcggccttatccaaaacgatagatattatgaaattaggggagtagtgggactttgagcaatatcataccagaaagatagttttcaaggctcccccgaggcatatactcgaagcagagtgctctatgtattgttgcaaccaaaactggtcttcctttgacttgtccatgtgtatgttttatttcatagcagtatccaactaactgtacaatgtttggatggttgaccatcataaggttcccaaactcattttgtaatttcttgtcgtcaaaatcttgcgtatcatgaagaatctttactgcaattttatctccatttttatgctttccctattaaagatctagggtcagtactcaaaacatgataagtttgtgataacatttcacaagccgaaaatgaaagcatcaggctctgtttgttttgtcatcacacttttactagaactaagtttcatgcaacaataaaatgtggtgcagggttgattgctcacctcagtgttatatgtgcatgtattgcaggcttattattatttagaaattagaacccactacaatggtttcaccaattattcacagtaaattggtgtttacataccaaacttgcctttaacttaccttgtaaactgttccatatccaccttcaccaagctttcgctcctcagagaatccatctgtaatttcttctaacaattggtatgctacattagttggattcatagctgaatttgtaacttgtccgttttaccaatatctcctctctgtgtgatgagaataaagagtaataagtttctgagaataaagagtaataatttgggtaattttactatgcttgataaggtactgggagatgttatattttctagtgtcaaacttgatacctccagctaccatatatctcaaaataataaaattttgatacttacaaatactttcttaaataccgtaaaattttcctaataatttactcgttttatgagaagagaaagactggagttaacagtagcactctaaatcttgaactgaaatttctcaaagcctggtttatggcattgactaaatgtgaatgaagggattaaagaaagttcaaaatgagccccgagatatgcatcatttggagaaaaatcaagtgaatttcgactagttttcttactcccaacaactcacttcggaactcatagccacggcaatgtgtaagaatttgagtgagtactagtggagaaaatcctagccttgtattaaaagggaaaaaaaaggaaagaaaaagaaagaccagcaggccaagcttgcttatccatcaacagagacacaccatcagtaaccaacattccatcagaccaatgtgaatcatgaatcaaatgtaaaagcccaagctaattaaggagcaattgaacaaacagtactgcctgcacaggaattggaagcagtaattaattaattaattagcactaacctggagagagataactgaagatcgacctagctttcgagaggctggagaggagaaagtagagacgggatcaggctcaactcaatctatcgcaggagatgagatgaggagatgattataaactgcagtttacgccggcgccgtagacgacgagccagctgtaacgccggattgcttgactgattgattgtaccttctgatgatcagttcatggaccacgatcgagcaagttgaaattaaggacatctagggcacgcgtatacagtacagttatcttgtccaaacctgcatgcttattctagcttgctattccctcaagtcccattttaagtatagttgtgggtttctatgtccaatgtttaatcatttgtcttatttaaatttttttttaaaaaaaataagttaagcataaagtattattcatgttttatcatctaataataatatagatactaatcataaaaaaatttaaataagatgaacggttaaacgttggacaataaacccacaattgtatttaaaatgagacggatggagtacggattagtagtggtcattggccaagaaaatccgtagtgccaaaggatgagatggctaggtggggataattctgttctctatggaatcctagatttgtcaccaggtgtacctttttgttttaggaataaaaaccactcctgacaagtttgccgaaaacagaccgacgtctgatggaagcagtaaaaaccgatgacttttgatcaaaataattacccacagcccaacattgcatggctcgtgagttgtgatatatacagggcccagggacagggacagagctagaacgaaatggtgaaggatggcacttactttactctactttagactaattttagactgatatgaacacttgagtttggattgaggtggtgcatatatgatgaaaatagacgaattatagctaaaaatattttcttgatcagatttctaggcaccccctcttctacctagcttcacccctgaaaatatggcaagcctaatttactctgctgaaaaaggacggtactactatcagggacgggagatcatgattttagaaatacctcatggtttaagccttaaattgaaaaaatatatcttatttaatttttcatcgataagatattagtgtaatgtttgaataccactatcaaaaattatgtgcccgctctgatactactaagaaataggaaaatgcatatcacattcacatatggttgcatcggtgctgctactagtagctagtggaagttgaccgtcgacgttgagcaaagcgtgtgggctgcaggacttggattggacggtccaagaagacgaccggcctaacataacagcgactgcagcagcagccaacaagcagctgctctctgcagcagtgtgtacatacattcaaaataaaacaactgctgtaggattttgggctgcagccgatcggctgggctggacagctgcagcccaaaatgccgcaggcagctgaaccgatcagcccttgtattaattggatgggttgggcctattacttactccctccatcttaaaagacagtcatgagttttttgtctaattttgatggttcgttttatttaaaaaaaatagtatttttgttgttattagatgataaaacataaatagtattttatttgtgacttatgttttttaaattttttcaaaaaaagttaaataaaacgaataattaaaattgaatacggaaacttatagctacgcttaaaatgagacgaagggagtagttggaagtatctgttgacttcctatttacctcacgggataacttctttcactgattgaagggcttgtaatggcttactacaagagacacaaaggtaacctcaagaagaccgtcactagctgcaactaatagtatggctacttgtcgaataaaaaaactaaagaaactggaatgtccgaataccattcgtaacccaaatcaaagaactcgaccccaggttcattttcccttgccttttccttaaatactagtatgattttgaggaagaaattttgttgtaatctgtgatcacttttgtatttgagtatcatacagatgtctatcagaatctctgctaccacaaaaaaaaactttagtggtggtggtgagtcgtgaacaatccaacggttgaatattttcctaggatccttgtcatcaccgcaccagtcaacgcccctcccagagccatgggcggtggaaatcctagctcccaaagttggcgtcattgtcgcaggcgccaccgctgtcaccgcagctccccgcaccggatctatcatcgtcaaggtcatccacatcgctgaggtcccagtgcctaatccgccgccgttgagctccccatcgaattcagcgggtcccttaaggaggcgcttgcgaaaatcagattcttacatatggcttcttatgaggcccacttgcgaaaataactttatttttatgtatggtctcataagatgaccacattttagcaagcgtgacttgacccaccccgggtaactgattgttgcatgtggacgaccattacagctcgcctagaacctgtagtgggcctcgtccgcaaaaatcaattctgttgatagatatagaaacaatgctctactgaagtacaacttttacatacacatatgagctaactaacaggagggccaatgggtgcgttgttgataaatacattatttttccgttgcaagagcacccagaaatacaccatatctctgtaaaaaagaagttctaaaacaaataaaataaaaccgtagagaggaacccgatgatatataaaatcaaggaaacttgtcctacttgatactagatgaagaacaccgacagtgcgtcgagcagatcgtcggtgatctcctcatcctcctccttgtccacgacccagtccaacgccatggctttgtgcaagtcttccagatcacgggggatgtaggtggcagtgagcacctcctctgacttggtctctctatcgctactcgcatctgcgccaccgatctcctcttccattctagggtttcgtggatggggtcgaagcacggcggggggttagggaaagcaagttttcgaaatcttgacacgaggaaagtgggtgggagacgtagaagaaaagcaagggactctctctctctgggccggaccggtatggcccactagagtagcgagacacaaggcccaataagcgccaagttttttctttctctctcttcctctcttgatcgactatggaaatcaaagcgccgtttgttccatttttacatgcgcaatcacaacaatgtttattttgctttagggtaagtacaaatgatatggacttttagttaatactcatgtagaggatatcattctacaataattgagacaacaaaaccttttataaccattaatgcaccaatataatcttttattactcttctttccttttcacaaccccaaatgtttcctttaatatatgctaagagtcgattgtaagccatgattatacatagcaatgatatttctcttcgttttcttctctcttctatgttaccaaatttatttgcgtggcaatggagagagaccgtcaataaacatcattgtacataccattaagatgatggaaattatccttcatcaccaatctgatggaaaatatatctctctatatctctacttaaaaatggagtcatcatccttcagtcatatccttccaccgtgtgcatgcacgcgtgtgtatatacatagccattagatctaatgttttattcacaaccacacttatatggacctggcccgttacaacgcaggggcatgttgatagt

SEQ ID NO: 23475 - DNA, 16776 bp, Oryza sativa
  unsure (1)..(16776): unsure at all n locations
tattcacaaccacacttatatggacctggcccgttacaacgcaggggcatgttgatagtatactaagtggagtcgtcttttccccaacatcgtactttcgcaaataaaagacttgctaaaaaccatctcatcttaaaaaaaacaatagtgttttctctactccttttaaaacagagttgttttcctccttcccaaccatcttagtttcccaaataaaaaaccgtctcaaaaaaccacctcatccaaaaaatacaacttcaaaaatggagttgtcttcttccttccccacaatcctactctcctgaattaaaaaaaccatctcaaagaaaccaccttataaagaaaatgacaatgttttctatactactaaaaagtggagtcgttttcatccttcccaatcatcgtagttccccaaataaaaaaaaccacctcatccaaaaaagaaaccatatttgcacgcgaaaatcaaccaaaaaactagattaaaaaaacaaaaccctataattccaatctttttttcatcccttctcccaccgcacgcgtagcacatccatcctctccttctcgtattgtgtgcacaaccaatgcatgaatagaccacgtgccatgtcttttgattttatattttcatttggtatcaataatttggttttctgaattggtatcggatttgagttttttaactggtatcaagatttaatttgatattttttttcattagcataaataatataaagttgtgtgtgttggtttccaattggtatatcatgttacacacaacacacctcatgaatgcaaagagataggaggagctctggcatttctcataaatacgtgcatatgagtttcacttcacatgtccataataacatttaggaggtgctcaaactaaccttttcggattcaaagtcaaatattatcaatttgtttgtaaactttaatcgtgttgtcatcaacaaacaccgtaaaatagatggaaattgcaagtgcatctaggccccatattggattatggctaattgatgacaacattccatcaagattctacttatgctggtaatctgaattcacccatagacatatccctttaactgagagaacaacatatttgaataccagatgactccgtggtgtctgcccaactttatccgcacaatacccacaatttatatggagtagggataacaagaatgaacacaagcccaaacctttcgctgtcatggctggcaagaaattaaagtcgtgttggtccttggcttttatgggcccatgctgaattgaagttgtaccgactaatctcgaggaccactcgtcaatacgagataccaagggcattaaagatgggtctttggctccattggtggtgtggcccactctaatactctcaactgaaattaatgcatgcttcgacgcaatccacaagatacagtaggtccaatacacataaaggaccatagagaacaaatatgccttggtacaatctgaaggaaatttacagttaactgcaagagcgagcgggttgtgtggtccaattgcgagatttcaatatccggttagttttaccacaaaattccgcataagaattagaatttacgtgatcatgtattggctagatctgattatataagttttgaaactataaactctgttttatttttgctcgacagaaatattttcagaatatgctgggactgttaattcattcaaaaaagaaaaaaaagcactgggatgcaaaaggaatgagaaaaaacaaagtttgttttcttaatacaggtaatatccactacgtcagattacaaaactttggttatccaagtcttctctccacgttgctcatttagtcttctgaatgagttaattaagcgcagtaccattatctgtctccaatccagtctgcctagcttgacaccaaccctccaacagtttgaatatccttatctgttgctgggaccaggcttttcatggcgaatttcagtaatcactaatccagcatcatgtccaatcacaactctgcaacagtaagatcatttcaaaaagaactctgaattaaataaagaatgcagagcacatccttaatgcatagtgcatcatacatctttgtagtcacagaagaagaaaaaaacatgccagctacaaatgttaaaaagagttcatatggtaaggtgtgatgacagtttttacacaaatagacaattgcagcaaaggcagatcttctactttaaaactcaagaactgagttaacaaatttgaggaaaagataaattttaatttcaacaaatttatcaaaattgatgttttcagtcaagattattttgatttacacaattgcacttgcagaagttttatcagggaagcagtaatattcccaacaatctaacatcaagatgaataccgttttaattactcaccgttttgagcccttcaaacaaattatagcagtaacttgtccgagctcaaagtccagtacaccctcaagcctagaagattatgaaaaacaatgtcatctctgaaactttcggacagaaaaaacatggcaagatcacatctaaatcctagaagttatgtgttgggcgcagttagatgtacttacttgaaggttatggagttccacagacgaactgtctcatcatttgaacctgtaagtagtattggaagatctggatgggaacaaacacaggtaatgcaatccgtatgtccttcaagtgtttgaacacaagtccttctctggcaatcccagatctgacataacaagatgaattgcattgcaataatatttccaaaaaaatgatctcaactcctatgaaaatattcttctttagtgaagatgccttaccttggctgttttgtcccaggaaccagttatcatgtacagttgattgcctcgagtaaagtaatccaagcaactcactatatatccgtgcccagacaatgtgaattcatgacgggaagaacggatattccaaacctgtatttttttttcattaacaaaagtatacatatgttcgtgttaataacctacactctaaaattgtgcttaccaaattgactggagctaaacgaaaataagaaataaaaattcattgtacctgtgcatccttcaagctcgcaacagcaaatttatgtgtatcttttgggttaaattttatttgatatgctaggccatggaggtcaaatgtcttaatgcactcccagcccttgttccagtcccacagcttgatctggtcttgtgagcctattgacagtaggtaaggctcagttggatggacatccaaagttgtgatgttccatacatgagctttgaatctcttcacttgctttactggggactcatatgtgtaaactcttatgaaaccatcttgatgtccaaccacaaaccattgctttcgcgcgatgaacttggccgcgataactgtagagatggagtttgtaaataagttagcattgttgtgatttgtgacactatgttaaagactatgcatgatcagtagcaagtcatgaagcatgcctagtggtccatatgagccttgaatcaggttcactgtttcctgtggacaaatatatggggaaaaaatcttagttcttgaacatacaaaagcatatttcaacttgctaaaattttaagcatgagataacttatgatgaattctatttacagtgtgtatagtatatactcccccggtttcatattagttgtttcacttttttcttagtcaaacttctttaagtttgatcaaatttatagcaaaatatagtaatattttcaatacaaaacaaacattgtatcaaaatattttcaatgttaaatttaataaaactaatttggtgttgtggatgttgctatttttttctataaacatgatcaaaccttaaaaactttgattaagaaaaaagtcaaatgacttatagtatgaaacggaggaagtatatttttaaataacaaaagatgtttcttttttacatccatggcttctttatcagaaatataaccaaatattagtccctcgagaaaacatatatctaaatatttgaattaaaaaacaagttattgagaaacctaggacctcacactccatacatagccactttactatcccatgtactatgaatcaccttgttttgcttacaatatttctattagtatggttattcagttatgtcaagttacctctatgtgagttgacatattatgaaactagatattagtgaataactatattaaaggaaatattgacctcataacattaaaggaaatattgtaggaatcccaaataactttggttgacctcagtcagaattaaaatgatttttctaagaatttgtaaatatcaagcattttcaaagaataagtaaacaaataataaaaaaaggatatggaggcttgttacaaatgtttgagcccttaaaagacctcaaatgaaaataaaaacattaaagtacaaagctatctcaccgagagtcataattttcatataagtttgttctaatccaacttcatatgaaaaggttgtgattttttttttttggaatatgattgtttccactttttacaggtgattaaataaatagatttgagacattgtaacaagtgtttgagcccctaaacgatatggaatgaaaaaacattcaactatatcgttgatagataaacttttcataaaaagaatgttgttttcatccgacttcatataaaaagttatgatttttttttcattgggatagggttgtttccatttttatatgcggttaatagataaatatgagaccttgtattgtaatgaatctttgagtccctatatgatctcaaatgaaaaaaaaatcaactacaatgtagatttcgtctagagctataattttcatataaagtttgtctgacttaatatgaaatagcgaggatggcacccacaaaagtagttttttagtagtgaatgaaatgaggtcctttttcctgatccttaaggatattctgtgagataccacaccagccattttgttttaacatgtactacttggtattttcctagtatagcggtagcacaaattaacactaaagtagcatatgcagcttaccgagactaaacttatacctgcgtattacagttcaagatgtcaactgagccaaacatattgctcgtcaagatcctgtgtacataagaagaactttacttatagcagatgttttacagctgcttcaagaaggaaatatagtagtgttcaaagatagtaaaagagaaacaggtctaacctgattttgtgtaccctaactactattgtagcataagcgcataaccgagtaaaagaactttcataaggaaaataatgagaaacataaccattgtttaagtcatttgtcctctacttcactttttcaaataaaaaaaaacataacaattgttaaatgaaaatttacacatcagtatatttccccataatttttatttttgtttttagctctaaaataatatggggtcatgccagttgtcaagtgtatttaccatcaaagtagtgaactaatacacaaacattttttccttttcttttggatatacacacaaatcttggtttcgtttgttattatggagaaagactagaacatatgcagtttatctcctctcagaccccaaaaaagaaagactattcacataccatggctctgatggatgcacatctcttggaaaatcaggatgttccattgggatgatctgatcaaatgaaacaacaactgaagttaacgaaataataaaatgaatggtttttcaaatatgataaaagtatgcaaccggcatggtttcagtgtaaaaaaacagctaaaattaatttcacctgatcttcctcctggtcctcctctttctctttggaacatgattcgttatggtgatcttggttttctctggtctcatttaagttcaaatggcttgccaatttgctctcaaggttgatagactcgttgttgtatgagggtagcttctccaaggcatggtctatcggcagctaaataaggtcaaaattaatgaagttaatataaagagtaaatttcataaaaccctacctattatggtccaagtttcacaaaaccagatgaactttggcacatggcacataacctcaggtgttatggtcttaacgtttcacaaaaccacattactaaccattttgactttgatctaccacacttttgagttctacaatcgcatctcaaaattatgagcattttatccatcatataaatgttacaaccgcctttactattttgatgtagcaatatgtcaaaatggtaaacggtatggttttgtgaaactttaggaccataattcctgtggttatatgccacgtgtcaaattttatgtggttttgtgaaatttagaccatattagatagagtttgatgaaatttactctaatagaaatgctacagtcggtgaataaatatgagttcaacatatatatgcatgttttcctttcagaaaaaaaatgcaaatacatgtttgcgatacctagctatgaaattgtacactcagcatgatatgaagcaggtttgatggtagaaaactggaactggtcattacacgtttggtcccctagattgattactgtgataaaaatgcaattccaagacgcaggggaaatagtgaaacagaggatgttgatttgtggcaatccctaataaacaaggaatatactatgaaaatgagtgtaaactcatcccttgatacatcataattttttttgagtaaatcattatattatcaaatagatgatgaatacgatactgccgcatcgacgcaagtaaaattattccactgtattcgtttatgaaggacattgcactgttacctatttataaacaaaacacatgctagtaatgattaattacctcaccaattatatcttctttctcattaatttgattgatgatttccaatatattaggcctattttccctatcaatttccaggcatttcagtgctatctcagtgcatgtctttacttgctggcaatatgcttccagtaagggaccattccttcttgtctgtaacctgtttttccatttcccttgtacctgtgagattagaatatatataaagatgaagaactattcaaacgaaatagaatactcccttcgttttgaaatgtttggcattggatagttcatttttaactaaccagcgtcacaaaaaaaacagagagttgtttagttagaaataaacgttggttctgaactcctgattacttgattggtaaattctagggaaggcattttcgtgcttctgaagcgtcctgtaggtcctgcaattatatctagcattacagcgcccaagctgaatatgtctaacttgtttgatatttctttcctctctatgtattctcgtggcatgtatgggctgcaaagggacaaataatacaatgaatttcatataaatcacatttcttattgttagaaaaagattcattcaaatgagttatatattcagcttacagagtcccaacaagattttttgtgatcattgttttctcttcagtgatgaacctagacaaaccaaaatctgcaatttttggcaccatgttgttgtctagcaaaatattggcaggctttaggtccaaatggtaaataggtgggttcatttccacatggagatgttttaaaccctcgcatgtccctttaataattttgtaccgtatgggccagtcaagaccatcatcttcatctgcaaaggtaaagatatatcaacagaatgcaaatgcatatgactaattttcttccaagctgaagatgtactccctccagttccatagtacatgtcgttttggataataacgtagtcttagaaacacttttttttttctaaaccaaagtttttaagtttgatcaagtttatagaaaaaatatagcaatatctataacataaaacatactataaaatatatattcaatgttagatttaatgaaactaatttgatattgtaaatgttgttatattattctataaactttatcaaactcagaaaattttgacttagtcaaagtgacttataatatggaacggagaaagtacaataaatatatgatttcattacagtgtctttcaacattaatttatacatttagtttccatgcttctaaaataaacattttaaaattcattcatagtcaaagttcaaataatttaaacttagccttatccaaaacaacaaatattatggaattgggggagtactaggactgagagcaatgtcttaccagaaagatagttttcaaggctcccccgaggcatatactcaaagcaaagtgctctatctatggttgcaatcaaagctagtcttcctttagccagtccagttgtatattttatttcatagcagtatccaactaaccgtataatgtttgtatggttggccatcataaggttcccaaactcattattgaatttattatcgtcaaacccttccgtgtgaagaatcttcaccgcaattttatctccatttttatgctctccctgttaagtatctagggtcagtactcaaaacatcataaaagtggtgcagggttctgtttgctttgtcgttagacttttactagaagtaagttttatttgcaacaataaaaagtggtgcatggttgattgctcacctcagtgttatttgtgcaaaacatgcagtgcaggcttattcttatttagaaattagaacccactacattggtttcgcccattattacaataagttggtttacataccaaagttgactttaacttaccttataaactgttccatatccacctttaccaagctttcgctcctcagagaatccatctgtaatttcttttaacaattggtatggtacattagttggattcataggtgaatttgtaacttgtccgtgttaccaatctctcttctgtatgatgagaataaatagtaataagttttttagaataaagactaataattagacaagtttagcatccttgagaaggtatcaggaggtgccacattttatagtataaaacttgatacctacacctatgaggtatctcaaaataacaaaactttggtacttacagatagtttgtcaagtgctataaaatttccctaataatttactcgttctataagaaagactggagttaatagtagcactttaaatcttaactgaaatttctcaaatcctggattagggtatagactaaatgtgaatgaaattaatacagagagaaagttcaaaacaagccctcagatgtgcatcatttggagaaaaattgaatgagtttttacctagttttgttaccccaacaactttcatctgaactcatagccaaggccgtgtgtgaaaattcgagtgagtatactagtggagaaaatcttaggctttgtattaaaaggcaaaatgaaagggaaaaaaaacagtctctacagtgctctctatgggccaacggaagggttgtatgtgaatgtgccaatggagcaatgatggacgtatcatacgaggcttgcaaatgtgagatcgattcggttgtgatggactctgttttagaaaggagaaaaataactaatgaacgatgatatgggaagtactatcataccctcacaaattgacggtgtagatcgtttctactactatagtagagagcaccgtatataaagactcaaaaagaaaaagaaaagaccaatagatcaagcttgtctatccatcaattgagaataccatcagtaaccatgataattaatggccaagttcatcgatcgtgaagcatacgacttaacttaattaggctcctaaatctagataaaaaaacccaagctaggagcaattgaacaaattgcatgcctttcactggaagcagtaactaatcaattgatgattaattagcactaacctggtccacctggagatatatttgacgatcgcctagcttctcgagaggctagagaggaggagagatcaggctcaatctatcgcaggagacgagaggaggatgagatgattatataaaccgcactcaggccggcgccgtagacgacgaggaggagccagctgtaacgcagatttgctgcaggattgcttgactgagggtgggttcaattcgcgaaaagaaaaatttttaggtgtcatatcgaacatcggatgtttgatcagatgttgaaaggggttttagacaaaaataaaaaaactaattttataaatcactgaaaaccgctagacgaatcttttgagcctaattaagccatcattagtacatatgggttatggtagcatttatggctaatcatgaactaattaggctcagcccagaagattctcctcgcgatttccatctaaaatgtgcaattagtttttgtttttagctatattaaatacttcatacatatgttcaaagattcgatacgatgtttttagaaaaaaaaatttggaaaactaaaccaggcatgactgactgaaagtaccttgtgatcaagttgacacatttatggcacgcgtatacagtgcagttagcttgtctaaatatgcatgacagtctatctaagagtctcatcttttcacttatacttattagccaaaatttaaattttaaaccttaaatttgaagttgattttggagggttttcattgaagtttattttttaacctttatttttatatcactaagaacatgtatataaaagttttattcgtaaattatttttcatttgtaaatataccgttttgcttactaagggcctgcttgctacggaatagtagtactgatcaagaaaatccgaagtgccgaaggggatacagtaggcatgtgtgaccagatggctaggtgcatttatatatgttaaccatgttcattacggttgaaatcctagatttatcctgatatatatccaccaattttaagaaaaaacatatactccccagttctctttaatttatttattatcacttttaaccataaatttttaaccatcaatgtttcaactttggttattaataacttttagacgataaatttattattattgaaagtttatggttgtatctatacaccttttttttttccaatgtacgtccctatgttatagaaagcaagtcgatatagcatacgggtaaaacagctcatatccttgaactaaggtactagttgttgaaactgaaaagtatacgtatgcacatttgaaatattaaacataaattaataataaaataaattacagattacacctgtaaactgtaagtattaaacctaattaatccgttattaacaaatgtttaatgtagcatcatattgttaaatcatggcgtaattaggctcaaaatattcgtctcgcaatttacgtacaaactgtgcaattggtttttttcccacatttaataccccatgcatgcatccaaacatttaatgtgatgtttttggccaaatttttttagatctagataagcctatatattgtttaggattatacacgccgcatgcactcttgaccctctaaggatccattatttggtgccaccgacaattctagcatgtgtatagaaaatcacaattctccactggacggtccaagaagacggctgacctaacatatagcatggcgagcaagcatgcacactgtattaattggatgggtctaacttagttggaagcatcacagttgacttccagcttgtaaatatgattctcagaaaaaaaaatacttgtaatatttgatcacttttgtatttgagcatcgtacatatgtactatcttcattctatttttgtcatcacctagacaaagagcgcagggaccaaggacaactaaaaattcatcattccgtaattaattctcatcggttaaagtaacacgttgcttcgtatttcatgggttgcatcaaattttaaatatattaggtagttgtactaatacgaattaaattagggcaattttttttctaccccactttaatgtccaatattgattttactcttactttttagggttttcgtttttgcccatacttttttgaaccgaacaatatttttacccctgttttgttttgaatagagaagttcacggtattaactacatggcaaaaagatatttataccctctcctatctctattcatgaattgtgtttttctctattttatgcatggctttgaaaatttatttttgtgaatatgtttaaaattaaatgacctatattgactaacataacaatttggacagattctaaatttgatggaattttgacaaaatttcagcagcattttgatagaaattgaacaaactttgaaaaaatttcaagaacattttacacaatctcggccacctcctccaagccccctgccagtcgccgcctagacccctcaacgccgtcgcctacccctctcctcgccgccgcctagcgcacgcctcctgctcgccggcgggaggggctgcacctggtcgcggcttgctcgccgacggaaggggttgccactggtcggcacccgcttgccgactcccgctcaccgccgcctatccctctcctcgccacctagcccgcgcagagcgcgctctgctcgccgatgggaggagctgcgcctggccgccacctgctcgccgctgccgcctagccgatgcccacgtgctgtcgcctacccctctccccgccgcctagcccgcatacagcgctccctgctccccggcgggagaagctgcacctggctgccacctgctcgccgccaccaccaagccgatgcccgcgcgctgcggcctaccctctccccgctgcctagcctgcgtagagcgctccctgctcaccggtgggaggagctgcgcctggccaccgcccgctcgccgccgcctgtgcggctgtgacatcctgacccaattaggatgaggcccttgtgagcttgtgcgcatgtttagtaccacattgctagtttagcaagtgtggaaccgacttataaggccttgtctctccaaccatgccactctcgggttaactattttacacgaagcgaggacgaaaatgtaagtggagtggtatgtgtaagtggacccgtccgtcgaatgggctggctacatggttctggagggagggctgttacagccacctggatagtcttagatagacactcttagaccctttttctcgtaatgaaaaggtatacaaattcaaaaaacctttatttcctttatttatctatttctttactatcataaacccggttctttactaccataaaccccgtcccactcacttcagtctaaaccaggggtaaacgtctcttttggtaaaaaaaatagtggtaaaaataaaaaccctaaaaaataggggtaaaatcaatattggacatcaaagtatcagaaacaaaattgtcccaattattggacattcaataatgctcatttactctttacacagataaataaatagacatttgttagacgacaattgctttgggaagacctcaaaaccttatgtcataatcaaactgggataggagtactcggtaggtcagaatatacaataatgccgtagtaattggtccttcactacttctgttcagtcaactgtaaactgctctcggctggtttgcgtacgaagttcagttttgctttccggaagtcaaacggtagggacaagcgagaaaatcaacgcgtaaattgggggcaagggctatcgatatgcaatcgtgagaacctgaccggaaatggctggacaattgtttgaatttataagagtttatcaatatggaacagcgtgagccgacctagctcagtggtagagcgcgtggcttttaaccacgtggtcgtgggttcgatccccacggtcggcgactatgtttatttgaacttaaatatcttttttattcaaatttaaaatttaaatttccgagagcttcccaatatgatgatcttgtttcacatgacgaaccaatctcgcaaggatttgcgcgacgcctcgcctgatcacagatcagttggattatggatccttgcacgaacgaatcgtgtagcgcaatgagtaaagcatgactgcatgagcataggaaaaatagtcttaaaaaaagaataggaaaataaaagaaaaaatatgtattcgaaacctcattagcagaaataacaaaaaggaaaacgtacagtagtattactaccgatgaactgcattttgtttttaatccaaaagatcgtttttgtttttttagaacaaaagatcgttcttgttgtcgacatgtttttccaatggtatatcagtcaaattcttactgttctatacgctttaatatttgtgtgctttcatgggccagctagacatagcacacgggcctgcaggtgtcaagataagggaagatcagctgaaaggcctaaattactggatcagcgagagttctgggctgcatatacagttgggtacttgggttgccaaacttctacgatgttttagtatatctatcatcaattggtacgttacagtgagtatttacaatgttctttttattaacacagtaaaaacacagatgcccgcgcacactcacttttatgaatacacacacgcatattttatctatatgagcacctttcaaagactatgtcttgagattaatgaattcgccacaagcgactcgttgtcgatgaatatgtatgaatatgtacctcccactgaaaaaaattaactttgagtacttcctatgtttaataacatgaaagtttacattttacagtggatattttgataatattcattgttttttttaaattacatcatagcatatgaaatttaattcatttgtttcatgagcaaatagatgatgagcctcattgtttggcttatgcttatacatataaaccaaaatttaaattttaaaacctaatttgtagttttttattgtagtttattttatattatttgcttttaaatcattaaggatatgtatataaaagtttcattcataaattatttgttggttgctgataagcagtttcaataagcataaacataaatgaaaagatagggctaagcatatacgagattgatgactttttaaatccgttcgcgtattcatgttttttagaaatatttatgaaaatagataaacaatacaaggcgcacttaaacatactttagatgatagatatagtggtacctcttttcacttcacctaatccggtttaaaaataattatcattttgaacaagactgatatcaaaatttaaaactttaactataaatatttctaaaatatttgtgtagcaaacatggagagcatatacattaatcttaaaaagtactccaataaaatcatgcatatgttgatatttctatatattgtaaaaaaaatagtggtcgaagttatttttagacaatttcaagatgacaattatttttgacccggagggagtaattgaataaatgatgccggtcaataaaaatgagaaaatggtcaattgtgtcatataggaatatctaaaaaccagagggagtatttcctacttggctgtacgcctgtgccctgccgtattcttttgttatattgctcttctgccaaagtgccaagttgtttaatatcgtgttcttttgttaaaactgctcttctgccaagtcttttgtgtttaaagttcacaacatctcactagaggattttgtttcagatgatgaatcaattcgttttagatccttgaagatttgtgtgacacctggtcacatattaattaaatggatcgcgtggcgcaatgagcaaatgagcaagataaaagaaaatgactacatgtcatcaatgtaatcacaatcttcaattcgaaagattctgaagatgagcatggcgacctgtgtactgtgagctaactctgcactgatgttctgatgctaaagtcgtgtattgttaccatgaatctggttctaggaaaagcatagatcattcttgattgctggcatgctcctcgtgaacaaattaaaatgaagattatagaagctggtcgatctagagaccttgaaagctgaaacattccaggaccaatatctagagcaacatcctgcatcatgtaacacgatcctctaatataaagtcaaacactcaaaggagcatggttactgatatgtgagcccgatgttgatgggtcccacatgatagtgatcacttgggcatagtatgtcagaggattctcttcccatgcatcatatatgcatcatgctgtggggcaaggagagcaagagggcagggattgaaatttcggtaatttcaaacctccccccgccataacaatatcaaattttcgggttttctcaattttttgtgaatttagtcaaattcagttaaattgtgtcaaaatttcagaaaatttcgctccaaaaattaccaaaatttcggacatttcgattctactgaaagggctgaaattttagccaaaatcgaaattgaaaaccctgcaagcgggtagctcttttagctgaaacggttggtatctattctgactgccatagtggtaacactcataggattaactaggtaataccccgcgctttgctgcggaattcataaataagtatatattaaatattgttgaaatgatgaaagttgaaatgttgagaaaataatatgaggaagatgatttgacacatacttattaatctctataatataatattgtagatgatgtgccatgtttgcatggaatttaaaataggttagaatagtaattgctagtgagtgaagatgtggcatgcttacatgggatttaaaatgggctagaatagtaattgctagtgggtgatgatatggtatgcttannnnnnnnnnnnnnnnnnnnnnnnnnnnnnnnnnnnnnnnnn

SEQ ID NO: 23476 - DNA, 13288 bp, Oryza sativa
ttaatctctataatataatattgtagatgatgtgccatgtttgcatggaatttaaaataggttagaatagtaattgctagtgagtgaagatgtggcatgcttacatgggatttaaaatgggctagaatagtaattgctagtgggtgatgatatggtatgcttacatgttgagctttaccttctaataattgttagtgggtaccaactatatagaaatatatagaaagatagatcagcatatggctcaaatatagtgcttctgaacattgcataagggaaattgtgaaaatcttctccaaggataactttttaagagttcctttcagccaactggaagggatggggtgaattcattcaaactagtcaatcatggttatgacgggaacatatcctatgcatataaatttcccgtgcacactccatacacactaattagcaaatgccacgaaacattctaaaaaaaaattggacatatactcctaatatttatgcatggttcccttcttggagtacagcatacctttgctggtttgtctctccataacgagttcaacacagcaaccaaaggaagctgtgcatagtgagtgtcactctccaaggtcacaaatgggttaatttgttgctgtgattgctatcaagcaaatctgtttgtttagtgtcgaaggaaacgaaaccgtcattagttttggagcaccgtgtatgagaatttgcctttaatttgcaccactcatgcggaagataaatggagcaccaaatgacccaaaccttgcgcacacgctggctctggcctatataaaggcattacacaacccatgaacaatttaccagtacgttcaccaccatggttagctcagctgcctgcttcttcttcttcttcttcttctcccggctcatcaccatctacttctgcttctctcccatcgcccacgcacggcatccggtgaacccgagcaccggatgccggcgatggctgcgtgtgcaaggagagggacgcgctgctggatttcatgcgtggcatcaacgacgccgacaacaccctcgcctcgtggcaatgggagaaagattgctgccggtggattggcgtcacctgcagcagcaaccgaatccgaatggccggcaatgtcatccggcttgaactctctgaggcttctttgggtggccaagttttgcaaggccggatgagtccttccttggcttctctcgagcatcttgagtacctcgacctcagtgctctcgtccttccgggcatcaacagcagtagcccaaagttcttgggttctatgacgaacctgagatatcttgatctctctgggtgttttctctctggtagtgtgtctccttggctcggcaacctttccaaattggagtaccttgatctctctttctcaaccttgtcaggtagggttccacctgagctcggtaacctgacaaggttgaaacatctggaccttggtaacatgcaacatatgtactcggcagatatctcatggattactcatctgcgatccttggagtatcttgacatgagcttggtgaatctgctgaacacaattccatctttggaggttctcaaccttgtgaaattcacacttcctagtacaccccaagcactcgcgcaactaaacctcacgaaactcgtgcagctcgatctctcgtcgaacagattgggccatccaatccaatcatgttggttttggaacctgacgagtatcgaatccctcgagctctctgaaacatttcttcatggtccgtttcctaccgcgctaggaagtttcacggcactccagtggcttgggtttagtgataacggtaatgcagcaacgttgctagcggacatgagaagtctctgttctatgaaaagcttgggtctaggtggtagtctatctcatgggaacatagaggatttggtagacaggttgccacatggtattactagagataaaccagcacaagaagggaattttacaagtttgtcttatcttgatctttctgacaaccatcttgctgggattataccatcagatattgcatataccatccctagcttatgtcaccttgacctttctaggaataatctgactggacctatacccataatagagaactctagcttaagtgagctcatcctccgttccaaccaactaacgggtcaaataccgaaattagatagaaaaattgaagtcatggatatctccataaacttgttgtcagggcctttgcccatagatattgggtctccaaaccttctagcactaattctgtcctctaattatcttatcggtcgaattccagaatcagtttgtgaatcacagtccatgattatcgtggatttgtccaacaattttcttgagggagcctttcccaagtgttttcagatgcaaaggttgattttcctcctcttaagtcacaatagcttctctgctaaactcccatcatttctccgcaactcaaatttgttaagctatgtggatctatcatggaacaaattcagtggaacattgccacaatggattggacatatggtgaacttgcattttctacaccttagccacaacatgttttacggtcatattccaatcaaaatcacaaatcttaaaaatctccactacttcagtttagcagcaaacaatatatctggtgcaataccacggtgtttgtcaaagttaacaatgatgataggaaaacaatcgacaataatagagatcgattggtttcatgcgtattttgacgttgtggatgggtctcttggaagaattttctctgttgtgatgaagcaccaagaacaacaatatggtgatagcattctcgatgtggtgggcatcgacttgtcactcaatagtttaactggtggaataccggatgagatcacttctcttaaaagattgctcagtttaaatttatcatggaatcaattgagcggagaaatcgtagagaagattggggcgatgaattcattggaatcacttgacctctcgcggaacaaattttctggtgaaattcctccaagtttggccaatctggcatatctaagctacttggacttgtcatacaataatcttacaggaagaattccacgaggaagccaactcgataccctctatgccgagaaccctcacatatatgatggaaacaacggtctctatggtcctcccctccaaaggaattgcttgggcagtgaactaccaaagaatagcagccaaatcatgagcaaaaatgtttctgatgagctaatgttctactttggacttgggtccgggtttacagttggtctctgggttgttttctgtgttgtattgttcaagaaaacttggagaattgccttgtttcgcctctttgataggatacacgacaaagtatatgtgtttgtcgccataacctgggccagtattggtagagaggctaccacagattaataggtactactacgaagcaacaaacagtgattttgctaccagggaaccacactaaaattgggttgggtggaacgaataaacaaagatagtatcatgcaatgaatgttattctttgtatttatatgaacacattaaaattttgtaataatttatagggattggatcttgtgtaatactatatggtttgggatcactaatacattgtcgacagatgtaattatagtacaattgtgatgtaattacactgtaacattctatttcggtgacgaatcctctcacatgtgtgtgcggtgtgaatttttcccttcctcactttgtacaaatcttgaaacaaatctaacggtttaaaattatgtgaaagttacatacaagtgatattgtagttacatacaagttacagtgtactaacacttcaattgtattgtaattacatctatcaaatttttaggagaaaatttgtcgacaaatatatagcaaaattgtatggttttgatgcatgcactattcccaccagcaattccatatatcacaaacttcgggagtgagagttgataattgtggaatttggggattttactgtgtacaattgacttacggtaagaaccacatataatgtttacaagagatatgaaaagacacatataccctttaacatccccgctcaaatgcaatgtgtatgcaataacattgcatttgaaaggtatagcttaacctacactaaaaccaaagtcaatgcttgaagatgttgtcaaagcgtgcaaatcttggatgatgatgaagaagaaaagatagcatcccctccgcaatgaagtggacctcggagccttcacaaactgttcttcggccctcggaatcttgaagccttcacaacccgttctgcggctcttcaccgattcggagatgttggtgatgatgttgaagggcctttacaaattgttcttcggcccttgattggtgacgatggcctgctccgatatggagctagtgagatactagtatactgacattacttcgacgaattgaaaggatgtgatggactttagtggactcgataaagaacataggaaattgatttgtagatgatactatgctagcaaaaggcattgcaatagacaaatagcagatggcaacaaaaggggaaatagtgaccgtcaaattacttaaagatggaaggcggatctgaaacaatacggtgaaggccatgaccagtcactgctcaaataagatggtcctactattgcgagctgaggagcacataaggctgcaccggagatagtaccaacaacactcatactagatctagcagctatggagtcagagaaaccaggaacactagcagccacatgaggacgtgaagtgattgcacgcctcgcttgataatcaaccaacttctttgggtgaagatgaaagcaatcatggaaagtatgaccgaccttcttgcaataagagcaaataattgtaaccgaatctagggacactccccataggaactccaacacgatgagttgctgccaggacattatgagcaaccgaatgagtggaagtaatttctagggtgataagacgcgtctcctcagcaatcagatctgcaagagcctctgtcatagttggaagtgtactacgcgcaagcaattgaacccgtttaggttcaaatttagggagaagtcgcatggcaaactgatatactcccttcgtcccaaaatataagcatttttgactttgatatagtcttcgagatgcatctttgaccaacaatatttataaaagtaatatgttttaaataaaaagagttgtatattgctccagtatgatagtttgtttaatgataaatctagtgacatcaaatttatatgattgatctttttttggctattaatagttaaaatttaaaaagtttaacttgcactattccaaaaatacttatattttaggatggagaaagtactaaattttcctgatcatgcttctctctcgccttgcattgtgcacatccttaaacaactttttgaatctgtacctcaaattgtccggttaaccgagtaaaaacattgtaaaactcttcaatggactgattttgttgctgctgtaagttgttcagattttgcaacaaggagaagcgtaaggctccactttcttgagtgtatctctgtttgagatagttccacatctccttagcacttgtgtgagccttaaaacctatccgaatagccacatcaacgctcataaatatgaatcccatcacacgatcatcagcaattttccaagcctttacctttgttgcatctgttttctcatcaggaggatcatctgtgaggtgtgatgcttgaccaattgaccgcaaaagcataagtgctgatagttcgataattttgaccatttaacttaatgtctgtacaaagcaaagccccacctcccaggaaaggatcagttgttctcatcaagatcagcgcaagaagtacatcaagatcagcacaagaagtacaggaagtagatggttgtacgatgttatctgaagttctgaacttggcactagcacacagcagcagagagcagcaatagtagtagagagcagagagtaccacagcttcaggaacattcaggagtagtaccaaacagtggaggagcagcttgttgatgagggccttatccatcaatagtccatatgcacagggttgcagcttcagcttattgatgacgagcttgataaaatggcagcctgatgaggtcgatcagcagcaacaggtacggccagtgcaaaatttctcatctttcggtaaaaccagtgcaaaatttctcatctttgggtaaaattcctcattttcaagttgttcaggtggtatattgtgttaaaatatgcttatgctcccaaacgtctcatctttgggtaaaatttcttatttgaggattaaggatcatcattttttttcaaaaaaatcaaacctgagccctcaattagatacatagaaataaaaataaaacatcaaatgaaatgaaattcaaaagacacaacaaaaacatgtccaaaagacaaaaaaaatttaaaatactttagacaaaaacgaaattcaattcgaaataaagaaaaaaacccttacagaattaacaaaaaaatattataagatttaaaaacttagattcgggatcagatggtaaaatattggagtgccctgttgtcgtaacaggcttggttggggcagacacccctctcgcaacattaattagcgagatgttaccactcatcatctccctttaactgcctgaaggatcatgccctcctcgtcccacccacccgcccttttatagcctctctccctctcgccatccgcctgcgccgccgaggtgggactaaaacccccctcacgcagcagactagcacgcactagcgctgatagttagtaagacgcttatttgggcctagctctcagcccaaaggtttagttgggccgggccgagttgggctttacggatggtaaaacatgtgacacgatgacgcagttgagcgaactgcttggttgggaatggcggcgcccgtggccggccgcctctccgggctcctccggcgatgcgcggcggccggggcggtccggccgggagagcaggcgcacgcgagggcggtggtgggcgggtggctccccgacgccaccctggagaccgacctcgtgctgatgtactgcaggtgcggcgagcgtcggcgcgcacgcagggtgttcgacggaatgcgtgcgccgtccatgcacgcgtacaacgtgctcctcgcggcgtcgcctccccgcgacgcgatggaggtgttctcccgcctcctcgcgtcggggctccgccctgacggttactctgtccccgccgtggtacgtgcctgcgctgagctccccgacgcggtgcttggcggggtgatccacggcttcgccgtccggctcggcttgatggggaacgttgttgtggccgctgcgcttctggatatgtatgccaaggctggtttcctggatgatgcggtgagggtgttcgacgagatgacggagagggatgctgtcgtctggaactgcatggttgcagggtatgcgagggctgggagggcagtagaaacctttgagattttcagcagagcgcaggttgaggcggtgaacatggtgaatggtctgcaggctgtgcccagcgtgttgaatatctgcgcgaaggaaggggagctgatgaagggtagggaaatccatggtaggatggtgaggtgccttgcatttgattcggatatcgcagtggggaacgctttgatcaacatgtatgcaaagtgcggccgggtcaatgtatcacaagcagtgttttctggcatgcagcagagggatgtggtgagctggtctacaatgattcatagctacagcattcatggcaagggggaacaggcattgaaagtttacatggaaatgttgtctgagggagtgaaaccaaattggatcacattcacatcagttctgtcaagttgcagccactccgggcttgtaaccgagggtcggaagatcttcgagtcgatgactaaagttcatggtgtccaccctgctgctgagcactatgcatgtatggttgacctcttagggcgtgctggagccattgaagaagctgttgggcttataaggaagatgcccatggaaccttgtgctagcgtgtggggagctttgctctctgcatgtgctatgcataataacgtcgatgttggagagattgcagcttttaggctatttgagttagaagaaggcagtgctagcaattatgttaccctctgtggaatttatgacgcagttggtcaatctgatggtgttgcagggttgagatcaaggatgagagaactcggcatggtgaagacgcctgggtgcagtcggatcgatgtgaagggaagagctcatgctttctaccaggggagcatcccacgttatttgaggagatgaatgctttgggtattagatcagttactagacgatatggcaaattcagattcagaagatgagcatgctgacttgtactttgagttaactctgcactgaagttctgatgctgaaagtcatgtattgctacaatcaattttgttcaaggaaaagcatggatcttccttgatggctgccatgctactcatgaacaaagttgaatgaagaccaacaaagaatcctaagaaattggtcaatctagatgtcttggaagctgaaacttttcaggaccagtatctggagcaacatcctgcatcatggtatggtgccaggatgagagcaagagggtggctcttctggtcgaaacgactggtatctagtctgaggtgactgcaatgacagtaatacatgtgtaatgttgtcagtctaatttatcggcatgtggctcaaatatagtgcttctgaaaatatgcgacaatattggatgcaggagaaactgtgaaaatctcctgcaagggtaattcttaagagttcccttcatccaactggaagggatgaggagtattcattcaaactagtcaatcatggcaatggccattctgggcttaaaggatcatcaagcactaaccaagtatccaatgatatttatggtttccttagcttaaagtacagcatcacctttgtctccatacgaatttcagtacagttacaaaaagaagctgtgtatcctgtcactctccaagatcaccaatgggttgttgcatctggtgctatggttgccagcatgcaaatctgtcttttgaggtcattttgcttggatccacatacccactcttttaaggtaaggaaaccgtcatttggaagctccatttatgagaatttgtctttgtcacgagatggttgaacaactgactcgttttctccgcatagctatccctgtatttgtctgtattccaacctgttacctggcaatactatcaaaacaggtatatgtaaaatagtgtattcttgtatcttttctaagcttcattacagcactgaaatgtggtccttatttgtatgccacacatcgcaatagatagtgcagcaactttggatgtggtccttatttgtatgtcatacatagcaatagatatcgcagcactgaaatctttgtgcaagttgggaacaattcatcatcttttcaaccaagccagggaggttacaaatacattttgtactggggatttttgtacttactacactatatatgagacagtgcaaatgagggtgaaactactcattgatttcgtcccaagcaagattggagagcacataatgacaatggcaaagttaagttgtttataaccatatagtataaaattgctgatgaaaaagttgtcaagttttatcaaatgcaagttgctaaacctggcacctcgatactatccaacatagctcccatccagaactcacttggtgacaacaatttggtactgcccaagaacaacaaaaaaaaaaatgtattttcaattgctgttgtcagcttttggcctttggggagcaaagagacgacatccagcttccaactggggtagcttctatgctgcgtgttctctccaggtcttaacctaccattacatttcattctttgtatcttccaaagcagataagcctgaatatttttacccttgatgcagtttatactcccttgaccttgtggtgttgcacactggtcaagcataaatttcttcaaaaaggactggttaaaggtatgatcctgtccctgccgactagcattgccggtagtttagttcacagcttggataatgtgacattagaagataaagtttgtcaccctatctcaactaaaaaaaaaacttatggatcaaggtgttacagttgttccattttttcagtaagatcccgagcatatgtaaatcacaatactccaattagatagactcaattagaacattcattctaaaatttaggcagcaacttcttcaatgagccaactttttccatcagtttgcactaatgaaattcctcagacatagataggtacagttgcaaaatgcagtgtgcccccaaaacccctaaaatgacatagttatacagattgctcaatgttccagacttccaggaatgcaatctgacaatccagatagagaacaataaagaatttaatctagtattatttccctgttctctctaatagataaaatattcgtatttgaccatctaatacacccttatgaactaatcttctgtagcaaaactgaaaatcctagactatttgtttgtatcttcagctcctttcgtaggtacacttagttaataggtgggtgggttgtattcgggagtctccgtccaagtgcgaatgattgaaaaagtccgagagctcggtctggctgcgcaaatggcaccatgtgagatgctcctcgcaccgtcgcaaaggtcagaatattaccatactctgttacccagcctgcatgcctgaatgccaaagggtcacatatttcaactattagtaactttcacaaatttgcattatgttttcatagtgtatcagctaatttgtttaaaagggcgaaagtatacctgccctctgcggaaccagctgctgtatgggactgtgacatgcaagcccatgtcatgagctagctctcgtacaagagttcgggagcccaataggggcaccacagagtcttgatctccactgtagtgtcaattgatattgtcataacattcttcacattaaacagaaacaaattatctggaatataagtggaaatacacattacctgaacacccaaactggtattttgtgctctacaattctctgaagtaatggcaagatgttgatgttgccatccttattgctgtagttcagcacactggcacatgtaaatgttcaatatgagttagacttggaaactaaggcctgttcactaaatactatttggcattctatacatgataaatattttctaaaaaaatttcaaatcatcggtagtttcattagaaaaatatctatttgaaactttactagaagggcctacagttatactcattgagtccgtacttacagcatccgaagtacttagaagaaacagataatagacagaagttgacagataaatacttactcgctgcacatgctccagccatagggcaaatgtgttctgttagcatgaagagcttgctgcacttctggaaggttgaaatagaaatacctttcgtaagtcatacaaacatccacacctacactcattttagtcacctgcatagaacaacaattcagtcataccacaagggaccatatgttctcaagtagaagattgtatcaacaagagtaagcatacatatttccgcagccgtagctcctgcatcacaattgatgggtagcacacatcaagaataacatcgtaattgttcacataatccccaactatactgtttgcctctgcaatggcatcattgcatgacttgctctcattgtgggggttgctaaaggtatagtcctcaaaatcacaactgtggctgattgatagaaatatttcgtcagagatcatgccatgggaccagaaatactcatatgttgcggggacatctctgtcaagcttgagaagcggattcccgatctattcaaggtaatatcagagttacagaaaacatttagaagaacaaagttaacagatattgaccaatgtgcgatcaaattcttacagctactcccttgatgttgaatttgaacccatttgatttctcattatgtgtgagaagtacatcggtgagttgcggtatataatgccctgaattattcgccaatcagtcaaagtgcacgacagaatttaaacatttaaatgtgaaataagactcaggaatactctctgacctgcatagctctctccactaagaagtagccctcttgacctgtattcagggaacttcttgtaccatcccaacagaaatttgtacatgtcattagctgcatagttgagcaggcatacatacagtcaggccaacatattcaagtttaactggtccttttcatctgaagaaacatcattagaacttaccggtctgtgcatcgccagtattgtaatctgatgaagtgttggagtaggaccatccaactccagccggtgattcaacaaacagaagattggatactgcaaaatttgaggtaaggtaacacagttagagctaaagctacattttttatgcattctgaaaacatgtgctgggtggagattgcaactaaaagttcaacctttgttccaagacttcttgttcaatctcaggcctctgccatctcctctcggataaaatgggccgagctctgtgaacgcgccacctccaaccgaagaacatccaggacctgataacaacatggccagcggttataaatcagttaatcttacagcaaacattggcaatcagcaagtcacatttgattctgtagcattaaagttgttcacagttcattatgtgacaatgtattgttccatggaaaaaattcacccctaacttcattttgtgcatggaatgatggagatgaaaccaaatgatacctaaaactggtctaaaaatgctacctaaaactttaggtagtcttttgctacatggaaatcatttctttaggtagtcttttgctacatggaaatcaaatgatgcatcacttctttttaaatgctctaggaccacatcacacagacaccaatgaggcaagggtccaaggacacatggtgacctcaaagataccctattcctcctttgcaagttgcaaagtagtaggagtactagtgaaaaggatatcaacatgcaagttaaaattatttttgatttcttttttcttggaaggtgtagagcagatgtagttctttttatgtttccagttcaggaaacacctcctgccatcatagtcccctgatgaaaaaacatggagaatatatatgaacaaaatgaaaatagaaaaaaaat

SEQ ID NO: 23477 - DNA, 1516 bp, Oryza sativa
agcgcataaccaagtaaaagaacttacataaggaaaaagataatgagaaaacatgaccattgttttagtcatttctcctctacttccctttttcaaaataaaaaaaataaaaaaactaaccattcttttttagaattaaacataaccattgttaaatcaaaatttacgtatcagcgtatgttcccacaaatttttatttttgttttaggtctaaaataatatgggatcatgctaattgccaagtgtagttaacatgaaagtagtgaactaatacacgaacaatttgtccttttcttttggatataaacacaaatcttcgtttcatttgttattatggaaaaaaaactagaacatatgcagtttatctcctcttagaaccaaaaaagaaagactattcacataccatggttccgatggatgcacatctattggaaaatcaggatgttccattgggatgatctgatcaaatgacacatcgactgaagttaacgaaataataaaatgaatgggttttcaaatgttataaaagtatgcaacatgcatggttttggtgatacaaaaacaactaaaacttatttcacctgatcttcctctcggtcctcctctttctctttggaacaagaactgttatggtgatcggcttcatgattttctttggtctcatttaagttcaaatggcttggcaatttgctctcaagagtgacagactcgttgttgtgtgagggtagcttctccaaggcatggtctatcggcagctaaatgaggtccaaattaatgaagttaatagaaattctatcattggtgaataaatatgcaggtcaaatctataggatccccttcctctctgagaaaaaaaatgtaaataattattttgtagtatatagttataaaattgtacactcagcatcgcaggcatgaaaaatgagcaatagttaacaaggttggacctcgataacgcatattaaattattaaatagagcttacttcacatgatttagagcaggttagatggtacaaaactggaattggtcattccgtcattacacttttgattccctaaaaggattactctcatcaaaatgcagttccaagatgtaggggaaatagtgaaacagaggttgttgattcatggaaatcactaatgaaacaaggaatatattgtgaaaatgaatgtaaactcatcccttgatacattatagtttttcttatcaaatagatgacaaatacgataatgccacatcggcataagcaaaatgattcctctgcattatattcctccaggaagaacattgcgctgtagccttttataaacaaaacacacgatagtaataattaattacctcaccaatgatagcttctttctcgttaatttgattgatgatttccactatattaggcctattttccctatcagtctccatgcatttcagcgctatctcggtgcatgtcttcacttgctggcaatatgcttccagtaggaaaccattccttcctgtctctaacctagttttccaat

SEQ ID NO: 23478 - DNA, 668 bp, Oryza sativa
  unsure (1)..(668): unsure at all n locations
cagccgctgctccgggcgcggcggcggggggccatggcggcgggggtgggggggggggcaggaatggctcgcggcctagggtttcgatccgggggtggggataaaaagtgggggaggaagcgggagctcgaattcggggacggtttcacactactcgcctttgttcgttcttcttcacctcctcgcggtgtgtgtgtgtgtttttctttcctctttggggaagaaggagcgtttccactggggcgggtgacacgtggagggcccggattaagcgagggggttccccttgtcggctgctcgtggccgttggatctgggccttcacgggcccaacagggggatcccccccaacggccgaatggcttgtccagttgttgtcctcctgcccctacagctgtacactgggattgatatcctctaccttcgaactcaccgtgtgatcacgatttgttaggctcatatatcagtgataaagtctctgtgcacttgtagtataaaacttctgaataaaaaatctatgaatatttggatggtttggataaaatctgggtcgactttgaacctctttctggttcccacgaatgtagctagtctcaccaatctcgctcgnnnnnnnnnnnnnnnnnnnnnnnnnnnnnnnnnnnnnnnnnnnnnnnnnnnnnnnnnnnn

SEQ ID NO: 23479 - DNA, 1893 bp, Oryza sativa
gtccatgtcgatgcgccccttcgccgtcaccgagctccgcggtgctcgccggcctccagcaccacgtgcaggctcacgtccgtcaccatgccgccctctgacacccgcaccgcgaacccatacgccgtgcccatgcgcgcactgttggcggatggcccctccgtcagcgcgctgtttagcaccacgatgtcgccgaactgccgccgcggcggcgaggacgacgacggcggcgatgtggcatcattgttgttgccgtcgccgtcgtcgagcaaggaacggccggagacgacgcgcatggtggtgggagccgggccggtgtacgtgtcgtgcatgtagaagtggaggtgggtagtggtggtggtggtggtggaggcgccgatgtggtggcggaggaagacggcgaccgcgaggatgagggaggagctgaggaggagggagcatagggaagccatggcctggtcgagcctgctgtgggctatgacagctgcttgctttgtttgtgttgttgcagctggcatgtatttatggatgtgacgagactgtgagcgctagtatgttataaaagttagttgatattgcggaacgactaaccttctcgatcgcttcgatcatttatcacccaaaacatatcagataatgatacaggaatatacgatatttgttaacgaagtttagctaaagtcctatatcttcggggctttgattatgggcgctcctttccaaccaatatagctcctagctactaagtacgatttccgacaaactcacctttcactccgtttattcgccacagttatataacttttttatcaaacatgtaggacaattgcgtatcattgcattacagaagaaccggtgattatatgtgcatccttgataaaaaaaaaacaaaacacggccacgaccttacctaaccatcttctagtgcaacaacgatgaggtaagaaatgccttaagcctttggccatgcccaacaaagcaactcctcactagtatacgataaagctccagcaaggttaattaggataagcatcttcaaatacacatcgattatgatgcttccaaattaaccaaggtcctagaatgatcagagagttaaggcctttttttcgaacttaaccatcaaccaaaccatccatcgtagctcaccaatccctcaaaagaggcttcattacatgaattgtgtaaatggttgatcgatcgtctccctagtctgatcacaatgagtgcattggacaaggtgtgtgacttcaacttgcaagaaagtcagctgtccagaacctattgtgttttgtatacaaccaaccacatgaaaaaacttcatttgcagggcctagcgcatgtattccaaaatacgttcccattgcagcctaaaaaaattagatccaaagaaaaggccctcacactactggaaaaatcatctttggtcggtcgaccaaattccacaatagtcccggatgtaataaaaaccgggactaaagaacatctttagttccggttcaaaaggttagagctactttttgatttttagtcccggttggtaacaccaaccgaaccgggactaaagatcatttttagtcccggttcaaaaaaacggcaggtggtgtcagacccctcctttatctttaatccttggtgttaccaaccgggactaaagatctatttatagtcccggttggtaacaccaaccgggataaaagaacaatatgatccggttggtgttaccaaccgggagaaaagagcgacatgcacggagaggcatggtgtcaaaccccctcttttatatttagtcccgtgtcaccaaccgggactaaagataaatttctagtcctggttggtattaccaaccgggaaaaaagatcgacaggatcaattaataaagtcaaaccttta

SEQ ID NO: 23480 - DNA, 2177 bp, Oryza sativa
tcctcctcccatctcttcctctacctcctctcctctgtatccgccccatcccctcccctaccctattcttaggcggcggcttccggatgaaacacgccctcacacggatgccgggaggcggcggagccggcctcgcacaccggtggtgaggcaatgcgcgaggcacgaggcggggccgcggacgaggtggcaggcgctacctgtggcaagcaacggcgggcggcaccgcgccggatcttctctccttttttttataatttgtgattgagagatgtttaatttcttttttaaaattgtgattcattgcatagatctgagatgtataatcgatctgtgatgcatttgatttgggtgtaattttttttaagatttgtgatgtatttgatttgtgtgtaagtaacttaggatttgtatttgtgatgttaatgatttgggatgttaatttaatttggggatttgggtatatgtatgacactcgatttgagggtttggtgtttgatctggtatatacatcttactcgatatgggagaaaataaaaagaaaatggaccaactgggactgcccctatcctctctttactcccggttattttacccgagactaatgatagcgatctttagtcctggattcgtagtcctggttggaaaaccgggactacagagggttataaactgggagtaaagacggattctccaccagtgtcataaacactttttgctgaatattgtctagaggttgagaggggtcaaatatgagaatcctccacaaccggctgaagaatcacatgtgcaataatgtcccataattcaaggtactcagcaaagacacccaccgtgagaacatacaaaatggtcctttgttggctcttgttttgggtaccatggcaaacaattagggtgcaagatcagcaatgtgctgtctatgaagccatttatcagtccaaaacaaggtgctaccatcatcacccaccttagagaaaaccgcgatagtgaaaaaaaaataacgagcacaccggttgacctgaatagggaaagctttttttttttgcatccattaattccaccgcatccaaagctccaaggttttgaagttctgagaaccagcccggcaaaaactttagtccaagccacaagacaatgaccgcttttcgcgtccttccatcctctccaaaggaaacttcatcatatctcatcgattgccttaatggcccatgatggaatgtccatagccatacaaagataaaccacacaaagatgtgagcacaaattgaaccaaaattctccgattggcccgtgctagaagatccacttttcatcctagatgttgatccactaatttgtcaataataggctgaactttgttgacaaccgaatttggtaaattgtgaaccaggttagacattgggatcaaggcggattcgagaaagagatcgattcaaagaacagagtgtgcttcggctgagatggatcggacagaggacagccgatacagcgaatggacgtgatgcagccgattccgatgacgatggtatcaaaggtgtttctagagtcgtttgaagtgcttcataaggattgctacaatggagataaagctctcggatatgcagttgtatctattaattaggatatttcatgtaattttcttagagatatgtttgggcaaaagtctgccgcaaagacttatagtatcttagagtttgttagaggtaagtattgtgtccggcaaggacatattttgtaatctcgggtataaatagaacccgaacccatgtaatcaaacaacaatcgttcaatacaatctcggcgcatcgccaccttttttactttcatttatttcgacgaatgtgctttcgggttgagctgcatcgattccgatcttcaactagaggtaaaacttgttatggcggcttgtgttctcggggttaatgcttccatctttatgacactttaaccctgtttatgtaattcgtcgagttatcatatacacgacacaatctatgttagttgcactttataacttgtcatcggctagttcttattgttagaaagcaatcggtagagttatgttttggtattaatctaaatggaatcttggatctactatctcttgcagggtttcatcatctcgcctagatcccatacttgaatttatgcttaatgctgaatcggctaggttc

SEQ ID NO: 23481 - DNA, 1526 bp, Oryza sativa
  unsure (1)..(1526): unsure at all n locations
nnnnnnnnnnnnnnnnnnnnnnnnnnnnnnnnnnnnnnnnnnnnnnnttaatgcttccatctttatgacactttaaccctgtttatgtaattcgtcgagttatcatatacacgacacaatctatgttagttgcactttataacttgtcatcggctagttcttattgttagaaagcaatcggtagagttatgttttgttattaatctagattgtatcttgtatctactatctcttgcaggttttcatcatctcgcctagatctcatacttgtatttatgcttaatgctgtatcggttaggttcgatctattaagtaatatctataattatggatatctagcttgttttatgatcattgagagaggtagcatcggggtttcagccgatcttacctgatttagcattatgtcttatatgcttaattgatatgctaaatctgccatttatattaagatcttgttacaataaagtatattatgcttatgtttgatatattctatctattttaatatcttaatatagagtggtatcggagtattagccggtacatgctagatctatctgatcagctatgctataagtgtttataatatttatgttaatgtatatttcaatctaagtgatttatactgtctcggcatggcgactgatctatcccaatcacttggtttaaatatacatcgacataaggattatatagcgttaatatctacagccgatcgaatagatttagtcttatcttgtttatttataactgccgatcgatttacatatgacatcggctcaagaataaatgatatgtcatcagcgactggccgatcggctatcgtttatggatttaaccgtggtttcttttgtctttccttcttgttgattgcaggatcaaatcaactggcacactcacgaatctaaaagcaagattttcgacctgcactgaagttaagcagatcttccaggccaatgtgtatttttcgtatcaacaaatttgtgcatttatcaatttcctcaaagagaggggcacaccgaggtatttacaggggagatcaagcagctcatgtgagagaaggtcctgagtaaccgtgatgtccatctcactgcactaaatagggaacacactgctcttctgtacattagttttgagccatggtgctttgccaaagagattgagtatgtccagcgttgtgccaatgtcacttgtggagggtcaaaggaaagagccacattatccgcatagagagatatccaatgttgcaaggctcacaaagatagaggctgcagcaaacccccgtcctcgtcctttgacaccatatagtttaggacacccatgacaagaataacaagcatcatggatcaaggatcaccttggtgcaacacatgccggtgtgaaaatacctcaccggggtaccattcaagagaacttgaatcgacaaagatgccaagagcctgctgagaatatcacaacaaataggcctaaaacccaacttgtgcaagaactcaaaatggaaacacatcttaccaagtttatta

SEQ ID NO: 23482 - DNA, 4136 bp, Oryza sativa
  unsure (1)..(4136): unsure at all n locations
nnnnnnnnnnnnnnnnnnnnnnnnnnnnnnnnnnnnnnnnnnnnnnnnnnnnnnnnnnnnnnntagttttgagccatggtgctttgccaaagagattgagtatgtccagcgttgtgccaatgtcacttgtggagggtcaaaggaaagagccacattatccgcatagagagatatccaatgttgcaaggctcacaaagatagaggctgcagcaaacccccgtcctcgtcctttgacaccatatagtttaggacacccatgacaagaataacaagcatcatggatcaaggatcaccttggtgcaacacatgccggtgtgaaaatacctcaccggggtaccattcaagagaacttgaatcgacaaagatgccaagagcctgctgagaatatcacaacaaataggcctaaaacccaacttgtgcaagaactcaaaatggaaacacatcttaccaagtttattaccatgaaacccgagaatgagagagcaatgatcagaatcgactgggatacactttgcaatatactattggggaagggttgctcctagttatatacatgatgctacgttaaaagtcagtacaactcccaacacgatgcaaaacaccatgcacgagagcctcaagcctaaatctgttctttttctctaaatatccgcattagatagagggggcaccccttgttgtgtaagtgtgttgcatggactatggtcatgtggatcattaattgcataaacatatcactactattacaaggtcacgtgaaaagctagcaccagcaggcatggtgttctcacgtgtgcttggtggcgccctagaggaggttgtgcagtggagttgcaggctacatcaagcagggcatggagatcaaaacaagtaaacagacttgatcaggagaattgatggatccatgcggtagaagagatggcaggagccatcttggttgcgtacggcatggacagatcaaatttacaaagagttttggacttggtgattggtgcaaggctgtgattcgacggagcggttcatggccacaagacaacaagcatggtgtagatatgtggtggtgatcaaggtgatgcagtgataggggtgaaagcagtcggaaacgatcaggaaaaaccctaaaccattaccacaaccatattatttttctgaaacagaatcgataacggtaagatggtaacggaaacaatatcggaaatatcagtaaatcgaaaacggaattattcaatcgaaaacatgtcggtatcgttcggaagtcgataattactgtcggaaacatcgaacaataacatcgcacatttagctagcaatctagaatgattataaatatttgacgataattataaatatatttgtattcgacgataattattccccaatttcataaagataaagcaacacaggcacatagcaagttctcttatacataacaagtccactagaaccataaccacatagccacagtaacactgttggaccggatggaactcatcatggtcatcattttcttcaacaactgtatcatcaccagctacaacatttgctgagccggccggcaagctcccgaacggcgtgctagaggcattactgccgtgaggtggtgggggcggccccaataggaggcgacgtcgtgaggaagcttcgccggctagcgccatcatcgctagggggcgggagggtggggaacggatgggagctgccactgtgttggcgccgtcgcgccgctgcgttggagctgccacactgctgcgccgctgcgttggtgcctccgcgccgccgcgccgatgcgtatgagtacgacggcgctggttggacttgggacaggtcgactgggggattgggcagccaggagcagccaagcagctctaggttagggatttagggtttttgttgggctgagaaaatgggccaaagaaaaataacttgggccagccggccagtgatgtttgtaaaaatggtaattaccgggataataccgtaaccacacaaaacagtcggtaaattaccaaaccttttccgatatcatttccgtattttttttaccgtttccgtttccgacatttaccgtttccgaagcatccgataggtcaaattcggtagcggtagcccggtcagccggtaattactgctaccgttttcaaccctagcagtgagtatacggctcgagacaaggtgtgtgaggtgcgcgtgtatgatggttttgcactataccggtagggtagttagaccgatggattggttaaactgcagagcttggacggttataccgagtacaatggacggtggtttgttgctgaaacttatgaacagatccataagaaggccaagaaggctctatggtttggatagttttcaagtgagaagggcgagtagactgacggcggcaggtaggtatagcaatttcccccacggggccgggtcccctgcgtggacgggggtaggttagattttcaacccgcaggtccattgggtcggggccccggtcatcccacgggtttgccttcgggggcccggtaaaggtgtccattagttattttccatacaatttatgtagaaagcccattaacattggcccaattattactgctatagtataaaaggaaaggtcaaaactctaaatcaactcctcccagtcgccgccaggcaccaacctctcactcaagcgcgagaggcgagagggtagcgacagcgcaacacgcctgccccgcccgagccgcacgccgtcggcctttcccgccgtccccacactgtgcgtcgtcggcctctcccgctgccctcacgctatcgccctatgtcgccgcccctgggcctcgtgtcatcatcctctgtcgctgtctgtacgccgcgcgctgtcgccctctaccaccgcccctgtgttgtcgtcttcttgtcgatcggtcaccaacgctcctctccgttgcgcgggccccggctaggtggcgggttccctgcggggttgggggcgggtcctgtgttgcacctgcatccttcttcagggccggggacgagtgaggaaatcggggctcggggtcggggccgttcttgtccaacccggacctgctccgctccgttgccaaacctagcggcaggtcggtcaggtcacatatggaattatctggcggagacatgatatatctgagactcgacaatgagttgagatatatggagttagaccaaaactgaagaaaagtcccgggcaacatcgggttgaatacattggtggtgtcaacgagactgtttggtagtacaagatatatccaggatctgcgtggtttacatgatggggatatgtggaatatgtgtcgctgaaaaggaagagcaatcactatggtggtaatttcttcaattgattcaaagcaacaatgaattttctcaaattatcaacgactcaaactactacagatgcaggaaagcatggatggatttgttagctcggtccataagattacaaggaagaaagggttattcatcagtctggtgagtttaatttatctattcggtaatgacatgggttatctagccatggattaaataaaatcaaatttacgatagaagatgaaggtgaacatggtcttcgaggagtctatgatgtgacatctaagaaggaattcaattttacttgtcaagacgattgtgatgatgggatagaagatggagcattgttgtagatggagtccagagaaataagttataggaatagcagagtttcttgaagggagtaggtctggtgcaggctcatcgggcagctcatcatgaagttgcggagggaagacaaccgaagtctggagggcaggtggatcggcacgatgactctaactacttctgggtgtcgtatattcgtcaaggtggagtttgttagaataggtatcgaataattgatgttagttaggcttcatcctaattggttcacaatttcatttagcttttgttgtgaaaaaagttttttcttgcacatctctgtggttaatttattgctcgaaatatgcattcatcttaggaaagaaagatacataacttcaagcaattagttagcgacaaattctccaaagcacaatgccatagggctcacaaattgtttgctggctatgtgaaatgggataattgtatgctgattgctacgtgacatactctccctg

SEQ ID NO: 23483 - DNA, 430 bp, Oryza sativa
ttatggatgggcgcagttaatgtagcagcttaggaacttacttgaaggtaattgagttccacagacgaactgtctcatcattagaacctgtaagtaggattggcaggtctggatgggaacaaacacaggtaacacaatccatatgccctatgagtatttgaacacaagtcctgctcttgcagtcccagatctgactcaacaagatgaaataattacaacggcatttccacaaaaaatgatcaagaggtatgacaatactcttgcaattaaaatgtcttaccctagccgttttgtccaaagaaccagttattatgtattgctgatttccacgagtgaagtaatcgaaacagctcactgcagatccatgcccaaacaatgtgaattcacgacgggaagaacggaaattccaaacctgcatttgccatattat

SEQ ID NO: 23484 - DNA, 707 bp, Oryza sativa
tatatatatatatatagatatatatatatatatatatatatatatatatatatatatatatatatatatatatatctggtggattgtttttgaactaaatattttgttcttgttcaagcggaaaaaagcgggaattttttttagtccgtttgggaaaataaagtctatgttaggaaagatttttcattttttagtgaaatatctaggaagtggaagaagcactttagtggcttctgtggatgctttacttctgggatcgaagcgcgcttagctggcatgccaaaccatttagggtgtgtttagttcatgttaaaattaaaagtttaattaaaattgaaaaggtgtgacggaaaagttgaaagtttgtgtgtgtagaaaatttttaatgtgataaaaaaagttagaagtttgaagaaaaagttgataactaaaccaggccttaggttggaactttatgcatatgacattacattagtctcttaatatcggttatgtcagggttatgggtgcttccaaaagaaaaaaaaaatgcatgattaattacttggtgaactactactccatcgcaggaagacaacatgatttggtcggcaaatccactctaaccacacagagtgcagcgagacacgttgttaccgtcgaaatgtagagatccgtatcctattttcctacgcgtttatgaaaagatttgccagaggccacgacac

SEQ ID NO: 23485 - DNA, 853 bp, Oryza sativa
cttggcaatttgctctcaagagtgacagactcgttgttgtgtgagggtagggtctccaaggcatggtctatcggcagctaaatgaggtccaaattaatgaagttaatagaaattctatcattggtgaataaatatgactttcaaatatatatgcatgttttcctctctgagaaaaaaaatgtaaataattattttgtagtatatagttataaaattgtacactcagcatcgcaggcatgaaaaatgagcaatagttaacaaggttggacctcgataacgcatattaaattattaaatagagcttacttcacatgatttagagcaggttagatggtacaaaactggaattggtcattccgtcattacacttttgattccctaaaaggattactctcatcaaaatgcagttccaagatgtaggggaaatagtgaaacagaggttgttgattcatggaaatcactaatgaaacaaggaatatattgtgaaaatgaatgtaaactcatcccttgatacattatagtttttcttatcaaatagatgacaaatacgataatgccacatcggcataagcaaaatgattcctctgcattatattcctccaggaagaacattgcgctgtagccttttataaacaaaacacacgatagtaataattaattacctcaccaatgatagcttctttctcgttaatttgattgatgatttccactatattaggcctattttccctatcagtctccatgcatttcagcgctatctcggtgcatgtcttcacttgctggcaatatgcttccagtaggaaaccattccttcctgtctctaacctagttttccaaattccctagtacctgt

SEQ ID NO: 23486 - DNA, 676 bp, Oryza sativa
ggggagagtgggagacgcaagagaaattggccattaggccactaccaatagtgggtttcatcacaatgctattccgcggaatggcgttgttaaaatgccactcacaacagatgccaaacatttgtttttgccatttaagccaattctctccatgtccacctaattttccacccgggctgactaaaatacccctccggctgtcacaagcgagttgttcgtgccgccggcgcccgcaccgcccaagctcaccgccgatgacgtcccgcccccatggctgaagcccgctgcccacacatcggagaaagagaaggaaaccctaagccggccactgcgtcgcgtgccacaatctcctccgtcgtcgcgcccgccggccaccgcgccgctcctctcccgctaaccaccgtgcgccgctcgccaccatctcctctgccgtcatctccaccacatgccgcaggctgcacgccaccatggcccaagaaggctagctccaggaggagctcgtggtaggacaggacctgcgttgccgtcttgggctcagtcggcacggtgactgtggtggggatggagatcaacgagccggtgaccaaggcggcgggaggtgagccaaaccctcacgctcatcctcgctagctctccggattgtgtgtggattgagctcaaagattgtgttcttgaa

SEQ ID NO: 23487 - DNA, 775 bp, Oryza sativa
  unsure (1)..(775): unsure at all n locations
nnnnnnnnnnnnnnnnnnnnnnnnnnnnnnnnnnnnnnnnnnnnnnnnnnnnnnnnnnnnnatcttcactcaacaagtaagatagtttcctagcctcctttgcgatccccttcagaacatagttttgaaattagcagcacaaggtttgtcagcaaaaaaaagaataagtaccaaaaaataatacactgagtggcagcttgttcaggtaggggaagtcacatacaaccaaagcagcagcggcaatggcagcatccgattcattcactttacagagcataagatttaaggcagactgccggagacctcattgctgaagctgatcgtctcggtgggatccaactcatgttccaatgaaatgcatatcaactcagcctccatcgtgatacacttgaaaccaccatttgcaataattgatgccagaaaaaaaaggttagtaaacatcataaaatgataattactgtttattagcacttgaattaggtagttaggcatgcatgcgtaccaccaagcctgcagctgcagcagaagattcgccctctgactgaatcatatggcttgcacactccttgatcttggagctcaggatgatctcttcaaccgtgagtgcactatgacagctcctaagcaacttgttctcaatcttgatacactagaaacgtttggttgttttgcaatggtgcaatgaagtttattaattaggaactgaatcaatgaaacaagtaaggtcgccacagtaagtatgcgtttgcagaggcaggaagacattaccaggttg

SEQ ID NO: 23488 - DNA, 464 bp, Oryza sativa
ccccttaaaggacgccgaaccagctcgctgtcgccctcccggaactcctcgcgccccctctctgtttccccggccgtgcccctctcggtgcaatgaccgccccgccgtgctctgttcccgccgccgccgcgctcggctgagcgccgccgttggcctccctctcggcgactccccgcgccaccacccgccttgagctcccttgaaccaccccaaacagtcgctctgcccgattcgccgccgccgcgcatgaccgcgcgccgccgtcggcctcgccgcccaacgccaacggccttcctcccattcccatcctcaaatcgccgccgacaccattcctcaccgattggtgagctccccgtccccttccccttaccgtacgccgaaccagctcgctgtcgccctcccggaactcctcgcgccccctctctgtttccccggccatgccactctcgatgctatgaccaccc

SEQ ID NO: 23489 - DNA, 731 bp, Oryza sativa
  unsure (1)..(731): unsure at all n locations
nnnnnnnnnnnnnnnnnnnnnnnnnnnnnnnnnnnnnnnnnnnnnnnnnnnnnnnnnnnnnnnntccatctgtaatttcttctaacaatcggaatgttatatccgttgggtccatagttgaatctggagcttgatgtcggtgtcctggtttatgctagtaaagaaggccttctgcatgaggacaatacaaagtaagttacgctgttaaagagcaagaagttgctactagctctagcactcaactcaacatcatctggctcttttttcttgccctttcattgttttgccttttgggttcctgatatcatccagattcaatcttgcattttgaagttgcgaagatggacaagtgatgagagagcagaaatttcacctgatttttgtagagaaaaaaattctgattcaccatctaaacaaatcattatcaattcaattttacccccaccgtcgctcaacaagtaaaaactctcagaataattgaaatcgaagggttggtccatcatggcaatggggtcaccactcaccacccataagctcctctcctcatcatcttcttcgctcatctttttctctttctttcttctcaccttccccggctatgtctcctcaagacgcgcctccacatcgggcgacggggctgcgccgccgccccgcgtagcggcgtcgccgcatcgggagcagcgaatcccgcaccaaccaacgaaccgtccgcgccgccaagtgggccaccg

SEQ ID NO: 23490 - DNA, 1892 bp, Oryza sativa
  unsure (1)..(1892): unsure at all n locations
nnnnnnnnnnnnnnnnnnnnnnnnnnnnnnnnnnnnnnnnnnnnnnnnnnnnnnnnnnnnnctatatatgtataacgttgcaatataaaatatttagcatgagaattaattactaattaactctcttactttacttatatatagtcagcaaatgttggcgtaatataagaattggaatgtaaggtgagcctcatatgtgccggttgttacatacaatcagcacaaataatggactcatatatgctgattgttgtttttaacccaagtttcccaattcatcccctcgttttccgcgcgcatgcttttcaaactgctaaacggtgtgtttttttcaaaaatgtttctatacgaaagttgcttaaaaaatcatatcgatccatttttgaaaaatattcagctaatacttaattaatcacgcgctaatccattaatagaccgttccattttctgtgcgcattatttcggatgggaacttgctctagcgaacacagcctggccggatgggaacatgctaactcgtccctggtgagcctcatgccgggtctaaacaagaaccaacatatacgagggactaaatatgccagttgtagaacgtactggcactaacaatatgttattagtgccgcttttgtgatgcctaactgatgttggtacttatgaggagtttggatatgttggttcatggaaagcaattagcatcttaccgttttttaaaatgataactagcacctcattgcgggggacatcctctcgaggagaaaaaaaatgttcagttcaaatatatgtacttcttctagatttattaacatttatattaatgtagactaacatctatataaatatgagcaatactggaaggtcttacaatatgaaactgagggagtagctattattagagatatatagctgtgaataataatacctatattacatttctttagggaagctaggacatgatataactgtgaataataatacctatattacatttctttagggaagctaggacatgatataactgtgaataataatacctatattacatttctttagggaagctaggacatgaaaggtgtgttgaagatggtgggggctgtttttggagagaatgtcctattggtgaatgccagatcaatgcaatatgatacttttgtatgaaatgatgttagctgtgcatcttcttttgacttaggcacattgtaataaatgatacgctatcatgttcttgtggttaatggtggagtactggagtacgcatttccaattattttttattgtgaacttactgcagctctgctcttttacggtgaattggctgtgtaattagccttgtgatgtactgctttgcatatatgtaaccctgttatgctttgcagatatgtaatcctgtgatgtattgccttgtatatgtgtggttgtgtgctaggttcaatcggttaaccttttgctctattggataacctattcatttaatagaatcattaagggttgcccctattaaaccatggattagcgttgtcacatgaaatggtttaggttcaatccagaacctaaccattcccatcctgagggaggagcgccgggcagaggaagacggctcgagaccgagagaacaacacgagctgagaaaaaattgggaagcgcagaaatttcttccgtattttttttatgttcacccttgaatagttttgagggttgtgtttagcgacactgctagagatgctctaaccatatttattttacatttgccatttcccttctatcggtatttcctaaggctgacatcattaggagagttatatccatgagctgcacgagctagctatttggggataatcataannnnnnnnnnnnnnnnnnnnnnnnnnnnnnnnnnnnnnnnnnnnnnnnnn

SEQ ID NO: 23491 - DNA, 3670 bp, Oryza sativa
  unsure (1)..(3670): unsure at all n locations
nnnnnnnnnnnnnnnnnnnnnnnnnnnnnnnnnnnnnnnnnnnnnnnnnnnnnnnnnnnnnnnnnttgcccctattaaaccatggattagcgttgtcacatgaaatggtttaggttcaatccagaacctaaccattcccatcctgagggaggagcgccgggcagaggaagacggctcgagaccgagagaacaacacgagctgagaaaaaattgggaagcgcagaaatttcttccgtattttttttatgttcacccttgaatagttttgagggttgtgtttagcgacactgctagagatgctctaaccatatttattttacatttgccatttcccttctatcggtatttcctaaggctgacatcattaggagagttatatccatgagctgcacgagctagctatttattaataaatatcataaatattatatttttgtcatactaactcacctcaatcacaagaggcaatgtccttgtcgtgtactacggcagtacaggtggtaggcttatatgcctatcagaatattcaaacatatgtttaaacatgtgctcggatttatccactttaggaatcggtgacagccacgtactctatctaaaattaaatcaacttatgaggatggatatgaacaagcttttatccatattcccatccatagaagttgttttttttataagatggagagagtttatttttttaaaaaaggggtattaattatcgggtaatttcattaaatgcaaaactctagctttgcttggaaaaaaatgtctaaataaataggcaaatagctatagtttagacgaatttcctatccactagccaggggagggattgattgttcttcaaaagaaacatgcacacatgcttttctttttcccttgaaaacacatatgttgaaaagcgggttaaaaaagtcgagtcaagccacgtgggtcctcatcccgttcacttggagctgtatcaaatgtgtggtttccatatgtgtcagctatccaggacaaggctaccataaatcgagcctgtttgcaccgtagatgcaccatttttttttggtaatttagaagcatgccattataattttgtaaagtttgagatatgctatcgatatctcaatgacatttaggacccgtatgagtcaatgacatgtgggtcaggatgatatatctcaaattttgtaaaattataatggcatggttctaattttcccttctttttatgatccaatccccttaaaaattccatgtcataagagtcgccatttctgtttacttttcatcgctggccatatggtacaaaactttgataagtgctgattttataaaggggttgctacaacgatatctggtttgaatagtatggtaccggttaggtatcttgataccgattagatatcacgacatgatatctcagagatatcatcccgttcaaatggaataccgtcctatagcatttccgatatataaatgattaggttgtaataaaaacagagaggttaaatggttatattaataatgtagcaactcttgtaatatagcatgtttctaaatacttatgcatagacatagtgatgaaagtttgatgaataactgatgtagttactagaatatggcggaggaagaatttttctaaaagaaaatttaggactgttcagacagaaatatatagacccataactcaggagataagggactttggaggacgacaaattaagccacaaaaggcctctctggctcgcaaacaagcataatagtgtaatattataattagagtaaagatattttttttcaagaatgaccattcaagaaaggaccaggatggaataattgatattaaccacttggccagttggcctccagttgtatgtaaggattggtccggtatggcttatatttcgtcgtacttagctattagccactagctgaaagcaaatgaccagttggcctcccagttgtatataaggattggtccggtatggcttatatttcgtcatgtttagtttttgaaattggggagaagtttggggaaagttggtagtttggaaaaaaaattgagaatttatgtatgtaagaaagttttggatgtgatgtgatgtgatggaaagttgggagtggggagaatgtgaagtgatggaaagttgggagttgggagaagtttggtgtgaactaaacagggccttagatattagccactagttgaaagcaaaacaaacaaatggtagtctagtctatactatatatacacaccgtaataaataggacgtgactcccgctcgggcgcccgatgggaggaggttaaaatcgggcgctgacatcagcatgacgtcagcgtctgatttatgtgcaaaactactttaaactgatttttctcttaaattacttatccaaatcatgatccgattgcaccattaaattcgttgcaattaaatattcaaaacaagaccacacatagatatattccgacgaaaaaaatttagcttattattgaattatctttaaatgttacacgatgttccaccaggtatatcggaattgtttcactaagtagatcgaaaatgtttcactcatttaaatcgggtgttgtttcaccttatataaaaataatgtttcagcaaatagcgaaagaatgtttcagtttactgtaacattagatctatacatagtgaaacattgtgagtacattaggtgaaacattttttggcggaacaaaaaataaaccaaattcccttaatatggggtttctaaaatatgtgggtttttttgttgcaatagaatgtttcgttcactgcaacattagatctatacatagtgaaacattataagtacaataggtaaaatatttttggtggaacaaaaaataaaccaaattcccttaataaaggttccaaaatatgtgggttttttttttgcaaaagagtattttaattcactgcaacattagatctataatagtgaaacattgtaagtacactaggtgaaacatcttttatgaaaaaaaaggggagagagaagtgggtgggtgggccgggtaggggcgcgcggggggagcgcccgatccggctccccagcgccggtcgcccgtaattaagcattctcgtaataaataaacacacgaagctttttctaattaaattgctaatatgacttttcacaggcagctagagcaaccatagggatctagatgtgtctgtgaaaatcccggtggacgacacaattgttaaatatgtgatccgaattttaggcacacaatatattcggattagtttcttaataggattagtttcccattaagacttcgactctttgcccatgaggactcctagctatatatatctgttgtaagccgcacagggagggtgtgacaaccctatgtttgtatccaactactatatagtgattattgccggtcggcgtccgtggtcttttcctgcaagagttttctacgtaaaattcgtgtctttgttgtgcatctattttctaacaaatggtagacaacccaatgtatcctctgcatttgtatccaactcctttatactgataattgccggtcggtgcccgtagtttttccctcaagggttttttatgtaaaatttgtgtctccgttgtgcttctattttcttaacattcatgacaaaatcaattgtgggacaaaaataaaaaaagtattctagaa

SEQ ID NO: 23492 - DNA, 800 bp, Oryza sativa
ataaacaaggcatggactccccagcgacccccgtggacttatctccgccacttctcagtctggtgctccgcaatgaaccatgctatacaaaaggtaaatccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgactatcgtgaactattattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaagagagaatttaaatataggatcaacatgctcaaaggattgtgtttaggatctgtgtgacttgccttgcaatattcggtcttcaattaatcttcttgaatacttccgacgcactcgcgaaccttcgaaacgacggaaacgacaagctaacacgcaaaacgaagaaaaagactaataaaaaccaaataaacagtacaaaaacaagcataaacagtacatataaagtaaagaaacatgtagatcatgattttagatgaattagcaacttgaccactcaaaaccgag

SEQ ID NO: 23493 - DNA, 624 bp, Oryza sativa
gaataagtccacttgctgtccctcagctttacgtcgattttcagttggcattcctaaactgcagtacaataaatgatttttgcaaaaccattcaaaccagatcataaggcagcaggaggcatcgtagtcagaaaaaaaatgattctaaggttttcataggttatgtatgataccattgaccttttgagatacatttgaccattcgtcttattaaagaaaatgtaattattacttattttattgtgagttgatttatcattgaatattctttaaggatgacttaaatatttttatattttcttaaaaatattgaataagacgaatgatcaacgttgattaaaaatcaacaacgtcaagggagtagtatatgccctctgcatctctaattctagtacttgatttggcgaaatattcctacttcctttgatctcctctctcctctactttgcaggttctacatcatgaggttggaggagtgaccgctcaagttctggacgatcacccaccacgcaacgtgccccggtgcctttggctcgatggggttgtttagattgtagccaaaataaaccttatcaatttttggtaatttggcaatattgtcaaattttttgtaggttttcttgt

SEQ ID NO: 23494 - DNA, 9352 bp, Oryza sativa
tttagtcaatataaccaagagagcaagataccactattccaaaaactgctgtacacccctaatctatacagttcatttattgtagcatacaaggaagtcacaactacagcacaaaagaacagaaagacaagctgaaagcagtaaatctcaaaattcatttcatgttaacggaaaacagtaagatgtatactacaccaaatatatattgttacaactaatactattgtttaattaagtgattactaccaaagaaacccatatcactagttcagaattacggtttatcagcaatgttgattttcagtaaatgtaaccaagagaacaagataccactattccaaaaactgctgtacacccctaatctatacagttcatttattgtactacaaaatgagcaccatgtcatcaagacaacctcttattaaagtagcaagaatatttcttcagaacatgctaacagtcaagaaagatcatgtacactggtagcatgccaactcaaccatacaggcccgaactcatccaattgtcatatgtacagaacatctaaagttctgacaaaaaaaacatcacatggacagcaacatatatcacacaagtgatagggattcacaagagaaatgtgctgaatcttatccccgatcatccttgaggtagagggtgatcttagtaccccgtccaagctgctcaccagaggtatcacgtgtaacagtgaaggacccaccggcctgtgactcccacacatactgctcgtcgtcgttgtgcttggtggtcacaacaaccctctcagcaacaaggtaggcggagtaaaacccgacaccaaactgcccaatcatggacacatcagcaccagcagcgagcgcctccatgaactccttggtccccgacctggcgatggtaccgaggttgttgacgaggtccgacttggtcatgccgacaccactgtcgatgatcgacagggtgttgctagccttgtcggggacaatgtggatgaacagctccggctgcgcatcgagcttgctcttgtccgtgaggctctcgaacctaatcttatccaatgcctgcagaaaccacacacacccatgtcacatcgaattcatcacccaaacacacagatctgtaaaagcatcagcacactaccacactatacagattacacgcacgggtaaacacacaaccctcgctgatttgtaacaagtttatgctagtgctcagatgtggccatattcacatttcgatgagtaaaacaaacaaataaactagcacaaactctacaaatcacgagtcaacgctcacacctcattgatttgaaacaggtctacgccctatcagtatatgatcctcagatgccgtcacgctcacagatcgacgcgtacaacaacagcaaagagcacataagcaagcaccgatttcgattcctcgacgagaggggattaatttcgggggcggcgcaaacttacatcggaggagttggagatgagctcgcggaggaagatctccttgttggagtagaaggtgttgatgatgagggacagcagctggttgatctcggcctggaaggcgaacgtctcggtctccgacgccatggcttcctcctcctgtgctcctgagatctcgggggcgtggagaggacgagaagaaacgagaggcggctagggtttggaggggtttccaagaggacgcgagatggaagaggagggagagtatttaagggatcctgtggttctagaagcatctacacgaacctagaagccggcgaggccgtagtggcccttgactaagttgctgctgggccttttctcggggaagtcacgggccttcaataatctgtgatccgctaggaataagtccacttgctgtccctcagctttacgtcgattttcagttggcattcctaaactgcagtacaataaatgatttttgcaaaaccattcaaaccagatcataaggcagcaggaggcatcgtagtcagaaaaaaaatgattctaaggttttcataggttatgtatgataccattgaccttttgagatacatttgaccattcgtcttattaaagaaaatgtaattattacttattttattgtgagttgatttatcattgaatattctttaaggatgacttaaatatttttatattttcttaaaaatattgaataagacgaatgatcaacgttgattaaaaatcaacaacgtcaagggagtagtatatgccctctgcatctctaattctagtacttgatttggcgaaatattcctacttcctttgatctcctctctcctctactttgcaggttctacatcatgaggttggaggagtgaccgctcaagttctggacgatcacccaccacgcaacgtgccccggtgcctttggctcgatggggttgtttagattgtagccaaaataaaccttatcaatttttggtaatttggcaatattgtcaaattttttgtaggttttcttgtgtatttaccaaagtttgacaagaaactaaatggatgcacatatctaacaactctatcaaaaaaaaattgtatggtttgaaatgacatcaatctgaacaaaccccatgcctctatcggcgacgaagattggtacctcggcgtggcaagccctcgaccatgaaggatggggcacacgagcagggcggtgatgggaggcctccaccgccatggcgcactcacaaagcatgtcatgcctgcccaagatggcaagatcgacaccgtggcgacgctgaacgacctaagcatgctggacatgcaggtgatggcggaggagaagagcgggcactggtggttcgtgggaggtggtccactggtacctcatgcagatgggctcgtcggctgccagccctctctccgccggcaagctgcgagggaagagaggggagaggaagagagatggggaagagagggaagaggtgaggagtcaacttacatgtgaggccacatcagccaaaacagacatctatattatcttagaacttgacttgaacggtcttgcaaagataaaagagtgaagagtatagtattgcaatttagggatgccaaataaactcgatgtaaagatgaggaacaacaaacgaacttattccaatccgctatggaagctgatggaaattggaaatttgggaatattcggtgctaggccatataaaagaaacatttgtacttcttatagatttcttaatattaaaaacaatcaaatcaaatatgaaaacatataaaatcatcaaattaaggcaaaaagaaaaaaggatgtgtaacacattttatagaaaaaaatatttttaatttattttagactatattgtaaaatattttgacgtgacaggaactcttggttaagatatattagggggaaaaaaacataagtggggttattgtgaccggaagccaagtgcacgtttggaatagaaatttttgcaggaattaattagggtaaaattccccagaaaatcaaccaaaacatgccttgaagctacatcctagtattctcataggctgattctacataactagacgaaaagcaatactgtcaagtttcatcactgaactccatgaagatgcatggcaacagatcaaaaataggattagagcaaaagtgccttcatcaaacttcatcgttaaagaaagcagataacctagcgaatcttacattcccacctatgatcctctttacttacatacatgtcgaactatcctagtgtgtgacgtatacatggctgatggctcaaacatttgctcttgattggaatgcgcagctcttgaaaaattttcgtgcgtcatgtttgcattcaataatcatgagttcatgatcctccaaatctgcaggacctctacatatcctcattcctcaatgattcatctgcttgttttaccagaacatatagttatttaccaggaataaatgctgaacggaaaaggatggagaaaaaagtaagccaatactgctttgcctctgatgagggaaagcatctttgatattgcttgactataaagttaagagaaagatggaatgcaggtttggtcttactgataatatcctcatcgccgtcactgttatcgtcctcgttttgagaggtaaaaatgggagtaaggtaatgcttgtccagtaaagcgaaagaagaggtgctgtaatggcaggaaaatatatttaagcgattaggagatcacctgctcctcagcaatactacataataaattatagaaaagtaccactctgcaactaaaggctactactggttggtactttaacacaatgaaattttttaatgaaaagttcatcattttagaaatcaaactaaagaagagcaatgagtagatacaacttcaatatcaaatgtgaactgctgtaccttctctggagctctttgagtttcattgtgaaattgcttgatgttgatgtttcttccccgtaacgttgcccagggtagccagcattgttcccatcaaagttatgctgcatattgtaagtacagcatcaataactggcaaaccaccggaatgctatggtgttaatccatgagctgtaagaaagataaacaaggacggatagtagctacatagttagggtgcatatggcattcagcaacaccaacggtccgttagtaagtgctcttattgaataaataataacccatgatgatcatttaagcataactattatctggttttttgtacgtagaacaagcaggttgcacctcaagagagaaccaattagttttttttttaaaaaaaggaatagatctaattcattatgaacaagaaaacagaaaaaaaatcgtgaccatccaaagattgtgtgtaatacctatctatccaaataagccctatggggagagtgcatggaatgcaatggaattgcatcctccatagaactgcaatgtcatttgatatttaggctgagaatgtccagcaaataaataagattgcgttgtttaactaacctaatggcaaacaaagagaaatataatgttttttgcatgtacttatgatacgcggtgtaagtacttgcctcatatggatggcgatagcgattactatccccaactacttgcagggattcaagcattgttccagttgagcctccaattagaagcacctgcaatgtttgcataaaaagacatttagaatgattcatagaatagcatgaactgatacatacaaaatcctttgcataaaaatagtcgtggctattatgtaacatcacaagaattacaaccggtaacctacagttagaacaacaatagatgtggtagcggtgaaaattgtctcgccatgtccttcaggaagatcatgaatagactgaagtgcaagggcaaaagccattgcccccctaagacctgaaaaagaaaaaaccaacaatattagcagtacaaacatgaaacttattttatgacatttttgggcatacataattacataccactataccagagtgccagctgatactgcctaggtatttggcagtgcaccggtcgtgccaaatttaatatatatgcacaagagaagacatttgcggccctttaaaataagataatatcagaaaatcggcacaattatatagctatggggcttaagcttgtataaatacacagaaagcatctccaaaaactcagcaactagtccaacatcagaccaaaagatagacagttccgttggagaagaaaataccttgcaagtaatataaagatctggatgcataagcaaaagggaaaaaaattaaggaaacaagaagaaattattgtattcgtaacaagcatgggtaagagttggtgtgtaatcaatgcgaaggatacaactgagaaaaaaatgaatccaatatgtgaccagctttgacgctccatcgcaatatcaaatcccatgtatatgaacctgtgtaaatgcattacagtttcagtatttggacttgttaaattattgcacttgaaggtcttgcttacacgaaagcctctgctagtgatgaaagtagatggaaaaaacgagctgtaaaacgctgagaatcttctgataagttatagaaggtgtatctcttcataacctgaaataaaaattcacttcttgtaagcatgtttataatatcttcctgcaaagttgcttatctataatatgtaataagaataaaatctagagaaaatattgtcacaggctaacttacaattccagtaaacagaatagagacaataccagacaaaccaaagccttcagctagcatgtacctacaaacaactggcaattatttacagcagatatttaaagagaacatgaaatggaacaaatttcaaagataggcttacgagaagtaagggaaaaggacaaacaagcaactctccagattatgaaggctggaagtgaaaaaaaaaataaattagcagtttatgtgtggggtactagtttgggcaaatcggaatgtacttacttctcaacacctagagctgcatacttgaagaggtttgatagaattaaggactgacaattgagtctcaacggggataacataatataagcaaaaatgaagttcaaaaaatgcatttgttttgtttttgcaagaattttttaaaattttctttttcgacttattgtcgttggcaatgaagttgttgatctggccatgtacatagcctaaatattgttgcatggtgggggttgccttttttgttctccagagtaaatggaaaacgtttgtaaatagaccaaaaagatgattacacgttaaacatattgaattttcttgtcaaccctggaaaggtaatgctcaaggcatgcaacaataacatattggtttctaagaggatccagcaggagtattctaagttttgatagcaaaaagtgggaattcaggatgattacatagactaaacccctctgagagagtagcatttaactctttgcttgaacttttgtaattgtttcctccttttcaatttaataaatctttaactgtgggggcttcccctacagtgttttggaacaaaaataaattttcaggagggtgcaaacaggtatacatttctttacagatattaaactaatttaatatatgttataaaaaactaggtgataccatcacatacatgtaacaagtttatcagttttactttgtgtaaataaaaaatatacattaggtctctactgatagaaaatgtcaaaataaaggatatgagggcagaaatgaatccaaccccaacacctgcacataaaaaaatggaattgaaatatcaaatgttaaagtacaaatagatactcatatataatcataagtgcaagcgaagtcaagaaatccaatggaaaaagcaaaatacataggcgactcgaaatttcttctgctaaaggcatttgtaaatatttaaggtacagtacctgatgacattgaaccaacaaaattctcaagaaacttaaggatagctagaaaatagttctgtccagaagaacttgttctcagtgaagccatactcctgaaaagttcaaggtgttaatgacaggattctgagaaggagccatataggcagaaggagctcaggcaatacattctcacctatacaaggatatagccaccttaatttccaaaccgtagttagacacgaagaaatatgcacatttcagtagaaataaaaaaaaacagctagtattaaataataatagggttatgcatacagcatcattgagaactgattctccaaaaaccagcgcatagaggttcacatcagtgccaagttcctgcgatttgatggacattatgtgatccttttatctcaaaatttgtaaatatagtctgtatagggatatggaaggaacctgaaatatggacagtacagtaacaggatcagttgctgacaccagagcaccaaacatcatgcactcaaccagaggcaacttatagacaatgtatattaacccaccaacgtatctgtgacaaatggaaaaatataaattacatttttatagatgaaataaatatcagcgaataggaatggaggcaatatagaagatactcttacactaaaagaccagtgacaatagaagcaatgaaggttcccaagattgcaaatgttataatggcaccaaaatttgaaaagaatggtttctatcaggaaaaaatatgatataattagctgagaatgatagaatttaaccaacgaagagtagaatttaactaactaagaggatccaagaattccacacttactggtgctaagctgaatccagactgagtaagattcagtcaagtaaaacatggtaaatttccgtacaagtaattaaaaaacaaaatcaagatacaaaaaaggatataatataattggaggaagtaagaaaagaaggaagaagtcctcccgaaaattgaaccatctcctgaattaataaagcaaatgaacaccacaaaatgttcagacttaacagcgatgtcatattttgcagggaaaaattgtatacagtgagtaataagaaatattatcacctaatacttctttgagtgtttgatatcttagcaaggccgccaacaatcatccctgacaagaaaagctattaaataatttcgtaataatatggtgtcatacgattctaacattttcaatgtacctctaggctctacaaactattaaataaaatggtaagatccatcttagctagggtgttttatttccaaggcaaatagtatatgataatccaccggatgatccaaataaaacgtagctagaataaacccaaatgtcacatcacttatcttagataatcagaaatcagtaaaagctaagctactgaaatgtaacggaaatacgcttatctgaaggaaaagacatctgtttgcgctacatgccaactttttaaaggttcattttatcctccaaagccctcacctgttacaaccaatcctcaaccatcgacagtaaattttggaaaagcacagctcgaactagactacagcgcgcgtcgtgaatgcaaaatttgttcgtctgatttgtgcataaacgcacagtcgaagccgttcctcctaatcacacactcacaccgttactgctcgccactaaacatcgtgtgaataaacagttcattcggcgtcagtaaacaacaccaaacacgatcacccccgcatcaaatgcgctagctcaaagcatcgcacggcgtcgcaaatacacaacgatcgcgaagtcagacacatgaatcgataggaccctcagcgacgatcggcattcttcagtttccacaagcccaaaatgctgtaactgggtgggaacacataccgatgaggagggaggcgctggcctcggggatgtagtagaccttgcggcggcggaggacgtggccgagcacgaaggagaccaccagcatcgatatctgcagcaggatccccaccc

SEQ ID NO: 23495 - DNA, 2532 bp, Oryza sativa
  unsure (1)..(2532): unsure at all n locations
ggtcccgtagcttctggttgataatttgatatatttgttaagttttgccgatttgatcgagtgcatgacttgcggaaagtacaagtagtgtgatcagtaacaccttttgggctaaatcatcatctttatctgatctgtaactacttactagtgacgaagccaggatctcttcaaaaaatcataacaattcacgcagattttagcactgattaagcctttgagttttttttcttgcacaacttcgtgatttgtttttcaaagaacaaggatgagctagaacaaactagcatgtaacagtaaatacttcctccatttcataatataagactttctagcattgtctacattcatttatatgttaatgaatctagacatatgtatgtgtttagattcattaacatctatatgtatgtgggcaatactagaaagtcttacattatgaaacgggggtagtagtctactactccaatatcatcatcatcatcatcacaacattatactccctttgatccttcccaaattgaacatcacataaggaaaatcatttttttttcaaaatgatcattatataaccatgtggacatatggatttcatcataatacaattaatataacatcgtataatgtggtgtatgcttgtgttttagtcgatactatatgcatcatgggagaatgtgtgtatattttgtatggtgtgttgactaatgtagtttaaataatccttagtcttggtgcacaaacattatatgatgatcaatttgaaatgaagggagtaactatctagacactccccatgtactattagaatccagtccccatatactgttactagtaaagtcacaaattaaacagcacggtcagaaaacgcggcgtgtactgatctagcacgatgactgagtgactgatcggatatcaatatctccatctatgaaaaatctgtggttgccgaacaaaagaaaatctgtggcgtggcttcactccttcagtcaggtcaagcaaaacccgtggacgtatatactcttcgtcttgggtgagccattcttcagtatttcttctgctgatcgagccactgaatcgatcagctccatggcgccctctcctgttatccttgttatggctgcactgtttctccaagctgcaacaatggcggcaacaaccgcgctaaccgtatcgctgccgggctgcccgagctcgtgcggcagcatggtcatcccctacccgttcggggtcggcgccggctgccacctcgccggcttcgccgtcacctgcaaccgctcctaccacccaccgaagctcttcctgcgcgacgccgacgccgctgaggtgctcgagatatccctcctaaactccacggtgatcgtcagcagcgccgtccggtacgacgccgccaaaggcgagggcgcgtggggccccggccttcccggcgcgttccgcctcagggagcggcggaaccggctcgtcgtcgtggggtgcaacctgcaggccgtcctcctggacggcgacgacatcgccgccgcgtgcaccaccatctgcggcggcgccggcgccacctggccagcagcggccgacggcgagctcgcggattactcgtgcgcgggcgttggctgctgccaggcttccatctacctaggcctcacgtcgtacggcgttcggctgtcgccgttcggcacaagcaccgggccgccgccgccgccgccgacctcctccgcctcgtcgtctaaccaatcggattcggctctcgtgttcgtcgcggacaacgagtggttcggcgggaacgcgagtaagctcggatcagcagcagcgacgatgcgaccgggcggcggcggcatgccggtggcgctggccgtgctcgactgggcgatcgggaagtcggggtgtccgccgcatgggcccgacgacacggcctgtagcagcagcaacagctactgccgcaactctaccagcacctcgcttggcggctactcgtgccagtgcgacaacgggtaccaaggcaatccgtacgttgcaaatggatgtcaaggtaatttgttactccctacttccctaaatgtttgatgccgttgactttttaaaacatgtttaaccgttcatcttatttaaaaacttttgtgaaatatgtaaaactatatatatacataaaagtatatttaacaatgagtcaaatggtaggaaaaaattaataattgcttaatttttttgaataagacgaacgatcaaacatatttcaaaaagtcaacggcgtcaaacatttagggatggagggagtataagggtgtaaccatgtaagtggagaaacaactgagggtcttctgattagcttcacaaggtggtgggctagctgttctgggttcgatgcctcacccttctatttagtttgatattaaatcatttcctaatattttagcttataagtgtgtttaacggattagtcatttacacttgaagttgcataagtatagcatcgttannnnnnnnnnnnnnnnnnnnnnnnnnnnnnnnnnnnnnnnnnnnnnnnnnnnnnnnnnnnnnnnn

SEQ ID NO: 23496 - DNA, 1435 bp, Oryza sativa
aaccaacgagtacatagaaatttctcttcatttcataacttaaatttatccttgcaatcttctctgcaaatccttgcacaaacagggttcagaaatttgaccgtatcttctgctggcagctctccttgtggcgataggaggaaccatcggcataggaattccatccgtgttcgtgataggcatggcaatgacgaacatgatcaaggcacggagggccaagaaactgagagccgtattcttcaagcagaaccggggtttactgctgctgcaacttgttgataaggtgattgctgaaaggatggtgtttaccttggaagagctcgaaaaggcaacaaatcgattcgacgagatgagaaagctcggcagcggcggccatggcactgtctacaaaggcaccttgccagacagacgtgtcgttgccatcaagaaatcgaatattacggttcgtaaggagatcgatgatttcataaacgaagttgtcattctttcgcagatcaaccatcggaatgttgtgcggttattcggatgttgccttgaaacacaggttccactactggtctacgagttcatatcgaacggcactctttccgaccatctccatgttgaaggccctacattgttgtcatggaaaaatagattgaggattgctcttgaagctgcaagcgctttagcctacttacattcatccgcttcagtatcaataattcatagggatgttaagtctgctaacatattgcttgatggtcgcttaacagcaaaagtttcggactttggagcctctcgaggcattccggttgatcaaggtggtgtgacaacagtgatccaaggcacatttggatatcttgatcctgaatactatcaaacaagtagattgaccgataagagtgatgtgtacagttttggtgtcatactcgtggagatgctcacaaggaagaagcctactgtttttgaatcatcagataatgtcagcctaattgcactttttaatttgctaatggtacaggacaacatctacgagatattagaccctcaggtaatttcggagggcatggaaaatgtgaaagaagtcgcggcgctagcatcggcatgcctaagattgaagggggaagagaggccaacaatgaggcaagtggagataaggctggaaaggctgttaggcggtgacattttgcaagggctttcagctgagctgcactgtctaccacctcaactgagcaataccgacactactagcaagctatacaacatggagcgggattttttgctatcgtcgagcttcccacggtgatcttactacatgtgtacaaactacatacaactttaccacttaaagttgtttagcatgtgtttgatttgaagatgaggtgagatgtgttagatgaattgggatcacctgcagtggctatagaaagtgatatccgaaaccttcctgaat

SEQ ID NO: 23497 - DNA, 716 bp, Oryza sativa
gcgtcaaacatttcgaaacggagggagtatatcgtttgtcccaatgttcttatcagaatgcatagcagcataacaccttgttgaaataaatacttgtattgtttgttttgtttcttgtctcttgtgttctcttgctgtttgttgtttaataaacaactgcaatttatgcttgcagctggaataccttgaggagcgtcgcctcaaggatctggtgaagaagcattgtgagttcatcagctaccctatctccctatggactgagaagacaactgagaaggagatttctgatgatgaatacgaggaagagaagaaggatgctgaggagggaaaggttgaggatgttgatgaggagaagcaagagaaagagaagaaaaagaagaagatcaaggaagtctctcacgagtggaacgtgatgaacaagcagaaacccatttggttgaggaagccagaggagatcaccaaggaagagtacgctgctttctacaagagcttgacagacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgatt

SEQ ID NO: 23498 - DNA, 2209 bp, Oryza sativa
atgtacacaacccgcacaaggggcgaaatagttattaagcactaaattgtccaagaaaggtgagaactagaacttttggcttgctaactatacttaaattgacctagggagttatacctggctgggtatagcatggtgagtctcaaatggtctggcaacaaggtcattacgtatttcaaatgtctcccctgaatgcaatcgtagaaacattagaaataaacaaggagagagaaacacagaaagaagaggtgaaacgagctcaaacccaaatcaagcgcaaccaattccactttaaggtcgacttgactcattctacgatggatttgaagtagatcctcaacatcatccttgatacatggtggtacaaatacaacgggtggcttcaaattatagaggccacgagttgctatgtacattgggagaccaccctgaacaatcaaaataacaaaactgaggtggatatggctgcatttatgttgtgattctgttagagcagcaaatggaaaaactgacagtgaagcatattcgtcagtttaaagggaaaaacattggaaaattctcccgttgctatgcaaaggagaaatatgttggcacaatcatgattttcttgacaccgctccaaagtaaaagcaggtatagagcaagatgagactatttattatttaagaattacacgcagactaacttaggccaacttatcagaagaattggtgataaaaatcctatccatcacgaattcacgatagcatgttgttgaacaaataaactaagcagacatttactaaaggccacagtccaaatagtaaattaagcaggcatttccccggtgacaattcccttgaaattactgaatcaatccccttacatcagcttttctatgaaacttcaccgatggcgcacccaagcttagctagaggcgcagttgcctctacacgaaattcacgaagcacaagcagcacaggaatgaatcaaaccaggacagggctcggggcgctcacgatgtggtcgaggtgggcgtgggtgatgaagaggtagtcctggctcacggcgaagagcggcccgcggccgatgtcgaaggcgacgttgagggacggcacggtgacgcaggtctcgtgcccgccgacggagaccccctcgatggcgtacccctccacctccacgcccttacggtgcacctgcgcgcgcgcccggcggtactcctcctcgtccgccatcgcccggtcgagcaccgacagcagcccgccgcccgctccacgccccccgccgccgccctcgccggtgcccgtggcgacggctgccttcttcgcggcgagcgtttggaactgggagcgggaggctggggcggacgacgacgcggggacgaggaggcggtgggtgaggcggagcgaggggagggagaggagggaggtggccgccatttccggcggcggaggcggaggcggagacgaacggtggcgacggcgtcgtggggttttctgggttttggggggaactcgactcgaggataacggagagtcatttttgcggggtagcccctgtcttatcctaaaattgtttttccaattggaggaggaggaggaggaagagagtcactgacccctgattactcaaggcctcaaggagcttcctgtaaaatgccaaattctatttgtttatttatttattttgatagtgtaaaatgtcaaattcagctacactgaaaataaagagagatcagtttgtgtttacaggttcagtgaggcagattgcagtgataatttatatcttaccaatacaagaagtcaggaattgatactggaacgatgatacatttccagattatggttaaatacagcaaattcagcatagattacagaactgaacactatacagtggagtgtacatttttttttttgacagaacgtgtacaagtatattgccagttcatttggaagaattgtgggtacatcacaaccaacccaccatttctccagtatagcagcggcctatttctacagttctatggttcctagatttacatatgtacaactcctacggttatttacaaaagaacattatacagcagaacgaaataatgctaacatgttgaggaagtagcactacacgttccatgggacatggcgatttctgatgctttgctgattgagcaacaagcctacttcttgccagatgctttcattggcttaaatagggagtatgacctccgatg

SEQ ID NO: 23499 - DNA, 1150 bp, Oryza sativa
  unsure (1)..(1150): unsure at all n locations
nnnnnnnnnnnnnnnnnnnnnnnnnnnnnnnnnnnnnntgccctccaatgccacgtggtactcccccgaggggggtcgggcccgaggtagggcggcggccactccctggccgagactagagggagaaggccgccccaggcgccacgtggctccccccccccccgaggggggatcaggcccgaggtcgggcgtcggccgccccctcccatgactaggggtctgttgaagaaaaaatcgaacacaccggcctgggagatctgcttagctcctgtgcaggtccaaagattaatgagatgcgggcgtgccagtcagtttaatcctgcaactgacaagatttgcaaataatagatcaaacagccgatcggctgacaagccgatggagtagttccagccgatagccgataatagccgatgccgataccagccgatagcgatagggtttaagcaatcggctatatgtcaaatgtagatactgatataaaggcaatcggctaatgatgatgtaatatagcaatataatcctgtataaaccaatcggctaacaatatgatatagtagaacaagtattgatccgaaggttaaagcacccatcggctagaggtccgatgtcatgaaatccacaagattagattaaacaatgaaacctttgttgccatcggctaaatccaacttatatgtatatgcaatccttatgagccgatgcaacgtccagataactcaccggctgaaaccccgatgaatcccttattggcaatcaataagcatgctagagattatggttctaagcacgacttagtagatcaaacttaactaatgcaacactaagtatgaaaagaaacacaatatctagacaatcaagtcgttgactgattttcagggtggtaaatgcctaggctaatctaatatagcaacgcgatttagccgataccggcagaaaccctaaagcgagagacagccgatagagctaaattgatatgctaagactagattaacagagacatgataaataggtaggcaaatatatcatccaaaccagagcaatccaagaggtcgaatatactgatgcagccttgaacgacgccgatgtagatgagacaattgcctggaccgacggaacattggacttatcccttcgccggagatcgaagac

SEQ ID NO: 23500 - DNA, 479 bp, Oryza sativa
tatattagagtggcagtccattttctaagacattatatttaattatccgcacaaaagaaatcaatatataataaaaaatagtaattaccgttagtaaatttcatactcctaccattttttattctcgtgcgttgtctaactcgaatatgagttgcgcaaacgtggcacaataacgaaccgccatccttcgaggccgtgggttctacatgatcatctctgtgcgcctcaacgtgctctctaagcttgctttcaatgctcggactctatgatcagtctgaccttcaccttcacctcctcaggaatcaccagccctaccagccatccctccatctccacgtcgatgcccatgtagtcaaccttgagcaccttgttaatcgtcagctccacatacagcggtcagtagagcatgggcatacctgtaatgatccccttttgcaccaagttccacccgtagtgcgtcacaaacgtgtcggttgtaa

SEQ ID NO: 23501 - DNA, 755 bp, Oryza sativa
  unsure (1)..(755): unsure at all n locations
nnnnnnnnnnnnnnnnnnnnnnnnnnnnnnnnnnnnnnttattatgttgccttgaaacacaggttccactactggtctacgagttcatatcgaacggcactctttccgaccatctccatgttgaaggccctacattgttgtcatggaaaaatagattgaggattgctcttgaagctgcaagcgctttagcctacttacattcatccgcttcagtatcaataattcatagggatgttaagtctgctaacatattgcttgatggtcgcttaacagcaaaagtttcggactttggagcctctcgaggcattccggttgatcaaggtggtgtgacaacagtgatccaaggcacatttggatatcttgatcctgaatactatcaaacaagtagattgaccgataagagtgatgtgtacagttttggtgtcatactcgtggagatgctcacaaggaagaagcctactgtttttgaatcatcagataatgtcagcctaattgcactttttaatttgctaatggtacaggacaacatctacgagatattagaccctcaggtaatttcggagggcatggaaaatgtgaaagaagtcgcggcgctagcatcggcatgcctaagattgaagggggaagagaggccaacaatgaggcaagtggagataaggctggaaaggctgttaggcggtgacattttgcaagggctttcaactgagctgcactgtctaccacctcaactgagcaataccgacactactagcaag

SEQ ID NO: 23502 - DNA, 698 bp, Oryza sativa
  unsure (1)..(698): unsure at all n locations
nnnnnnnnnnnnnnnnnnnnnnnnnnnnnnnnnnnnnnnnnnnnaatatattgcgcaataaatgatttaaggtttttcttgtatagtaataaacatagtgaatcttctaaaattcataactaattcatccgagctccgtttaagcccattcaagtctcaataaatcaagaaaaatgtgtagaatccattaaaaatggttttgttccctgtttcagtagtcttatagcctgtttgcaatgtttgctttgtatgtcgctagattccgattcctccgacgctccggtgtacttcgaaatagtcgctgaggtttctccagcagcagagcaaggcaagtcatgcttgtcacttgaacatgttgatcctatattgcaaatgctctattgttttctttcaaatattgcattgttttataatgttactatgggatgtttacctattgttacagccatgctattttgataccatgctcctttgttagcttgggttataacatgaatagactttggactaggaattgcttagccatgcttagttcaactagttcacaatggggaaaatcacattaatgtttagactgttggttctaatggctttgttggattagtgacaccgctttggtgttggttaattaaaataaaccacatggtgggctgtgggtgcatggtttagcaggtcgcacccatggcagttaaggaccg

SEQ ID NO: 23503 - DNA, 5385 bp, Oryza sativa
ggaggtgtctctgaggagtaggcttcgtccgtgccgtcgaggatgcctgtggagtggtgttcccactgcagttctagtcaaggcttagctcctgttgtctttcgtttttctgctgcatttatgtaagacttttatgatgtttgtaagacgtggatctgaatgtcaacattgtcgtttgtgtaccccggctggtcctggacgggattttaatgcacattctgcttgaaattctattcgggaatttctgggcgtgacaagttggtatcagagccaggttgaccgtaggacaagccaaatggaaaaacctaagagccctctgaatccttttcattgcatatgttctttgcaattggattttattccgggaaaattgggatctgttcttgtggttcaaggaaaaaaatcttggtcgctcgtttaagtgagattttttttcaaaacaagtcagtccagggttttagtaaaactgttgagatttattcgtcagtcagttgggatctgatgggtgaaatgcattaggtcatagctcaggaacatgggttgcaaggtatttatgctttatttgttattattagtatgtatctaatttctcattattttatcgttatgtgagtccgtcttatttattcgctctcatgtaaaatgatctatgcataaaaatttcgctcttattcgattcccttatttgagtcttttattgctttatttaaatttggattgagcatgcattgatcctactcctttgtcttccctagatggccggccacccacccaaccaccgcggagaaggcatgatcgactttgtggcagagttggcatgtatgacgctggtggtaggctaccccaacgcgccagagtacacgacgattccaccgctcagtggcgagcttcctcaccgtgttcgtctggaggtccacggctacgtgggtacctgcctagctaacatggtggtggaggcatctggaggcacagcagatcacgcctgtcaggaggcagcatacctgatgatggccagactacgggagcgccacaactacatcttccacgacacggcgtactggtttcaccctcgtcgagccagcagtgatgatgtcagtactttccgtccgacagccggcgagaacgacaccacctttggtcacatgtgtgctgtgatgaggggattggataggatgcactcggacctgcacaaggcgaccaaggccttgaatgatgggaagctcatgaggatcgtcgctctgaagagggagaacgctcagttaaagggtcttcccgcgccaggaggagtccggatccgcaccacgccccgcaagacgacgactgcacccgtgcgcatccagcttgcgcccaggaacccacctccatcagcagctcccgcagcacctccagttccgcccgcagttcctgcaactccagctccagctcccgcgtccgctctctccttcgctccagcatcagccgccaggggcccagccagaggcaacggaggttggttgtctgctactcccagtggcagccgcgatctcagcagcagcagctccagtggctcagagtcgggcagcggcgagacttatctgccagggtccggaagtcgctcagagggacctggtgacgagcaggaggacgccttcgattccaccgaccgcaggagccgttccgagcattaggctcgttttccattagtttaccgactgtctagcttctgcttgttagtttgtgtgtttaggttgcttgtttggggttagtcgacggtcgatatcatgtgcctatgatatggctgtcttaataaggatttttgcttgctctttaagtgttttaattcagatcagaacaattgcagtttaaattcctatgtaataaagcttagttcctgagcatctgtttttcttcttttcccccgtctgcttttccctccagatggtctacaccaggaatggtagccgcgcaacaggcgagggcagcaacagcgaagagcgcactgagggtgtgcatcccaacagcaactccggcaatggtccgccaccacttcccgagaatccgacgctagcccaagtgatggcacatcagacacagatgatggcagccatgatgcagcagatgcagcagcagcaccagcagatgcaccagaggatgctgcagcacgccgaacagcagcaccagcagtttggtccccctccccctcagtccaagttgccagagtttctacgtgtcaggccacccaccttctccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccaccaggtactgaagtcacttgggcagagttctgccgtagcttcaggaaggcgcaggtgctagacggggtcgtggcacaaaagaagagggaatttcgggcacttcatcagggcaacaggactgtgacggagtacctccatgagttcaatcgcctcgcgcgatatgcaccagaggatgtccgtaccgacgccgagaagcaggaaaagttcatggcaggtctggatgacgagctaaccaaccagttgatatctggagattacgccgatttcgagaggctggttgacaaggcaatccgtcaggaggatcaacgcaacaagatggacaggaagaggaaggccgctcagttcagggtacctcagggaagtcaccagaggccgcgcttcgctcctgggcagcagggtggacctaccaccatgatcgtccgtcagtaccgcccgttcaaccctagcaactttccccagggcgccggtggcagtcagacccaccatagaggtcagtcaaaccgcggtgcagctccacgcccaccaatggcaccggcacagtcaggcccgcccgcgcaagccaagaaggagactggagcaaaaccagggtcctgcttcaactgtggcgagcttggccacttcgctgacaaatgcccgaagcctaggcgtgccgagccaaggtttatccaggctcgtgtcaaccacgcatctgcggaggaggcacaagcagcaccagaggtcgtactgggtatgttccctgttaactcaatccctgcaacagtactttttgattctggtgcaacgcattctttcatttcaaagaaatttgtcgggatgcatgggttaataagagaggaacttagcacaccaatgcgggttcataccccagggaatagctccacttcggttcaattcagcccttctataacaatagaaattcaaagatcaccatttctagccaacctcattcttctcgaatccaaagacctagatgtcattcttgggatggattggctgaccaagtttaagggggtcatcgattgtgcgaatcgcacagtcaccttgaccaacgagaagggagaaaccgtggtgtacaaatcactagtctcaccaaagcaagaggtctctttgaatcagattgaagcggaaatcccagtggacaccgtggagaagagtttgaggaaattggaagatatacccatagtctgcgagtatccggaagtgttccccgaagacctcactaccatgccacccaagcgagagattgaattccggattgacttggcaccgggaaccgctccaatttacaagagaccgtacagaatggcggccaacgaattagccgaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaacgaggtcacaaccaagaacaaatatcctttgccgcgaatcgatgatttgtttgatcaactgaaaggagctaaagtgttttctaagatagacctgcgatcaggctaccaccagttgagaattcgggaagaggatattccgaagacggccttcaccactcggtacgggctatatgagtgcacggttatgtcgttcggacttaccaacgcacccgcattcttcatgaatctgatgaacaaagtgttcatggaatttttggacaagtttgttgtggtgttcatcgacgacattcttatctattcaaagtccgaagaagaacatgaacaacatctccgtctagtactcgagaagttgaaggagcaccagctatacgccaagttcagcaagtgtgacttctggtcgacggaagtcaaatttctgggccatgtcattacagctcagggtgtggcagttgatccatcgaacgtggagtcggttaccaaatggaccccgccgaagaccgtgtcgcagattcgaagttttcttggacttgcaggttattaccgccgattcatcgaaaacttctccagaatcgcccgacccatgactcagttgcttaagaaagatgagaagtttaaatggacagctgagtgcgataagagttttgaggagctcaaaaagaaattagtatccgcaccagttttgattctacccgaccagatgaaagacttccaagtctattgtgatgcatcccgtcacggacttggatgtgtcctaatgcaagagggcagagtggttgcgtatgcctcgcggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaacctccgacaacgaagatggttggaactaatcaaagactatgacatgggtattcactaccacccgggtaaagccaatgtggtggcagacgctttaagccggaaaagttactgcactgccctgtgcatcgagggtatgtgtgaggaattgcggcaggagtttgagcatctcaacgtgggaattgttgaacacgggtttgtggccgctctgaaggcatggcctacgcttgtggatcaagtcaaagcagctcaagtaaacgattctgaaatagcagagttgaaaaagaacatgagagtcggaaaagcccgggatttccacgaagatgagcatggcacaatctggttgggagaaagattgtgtgtacctgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcgtcgcactctgcgatgtttgccagcgagtgaaggcagagcaccaaagaccagcaggtttactccaacctcttcaaatcccg

SEQ ID NO: 23504 - DNA, 1003 bp, Oryza sativa
ccctctctttttcctcttttttttcaaatgggccgtcggcccattttttttcccttccttccccccctccctgctgggccggctgcaggccgaggcccaccaggccgcccgccgccctctctcccggggtcgccgacaggtggggcccacctgtcgggtccttcccccacctccggccgacgccgcgccagcaaccgccgcgcccgaaaccgccgccgcgtccacgcctccgcctcctccgggccacgtcgaccacgcccgcgcgtgcgccgcgttccccgcacccactcccctctctctcccgctcgcgcccgcgcccgagatggccgggattcgattttcgaatcccgcctctctcgcctcccccactcccccacgtcggccggcgattcccgcctctcccggccacgtccggccctctctctccctatttaagctcccccgtcgctccgtctcgctttttccccatttcgcctccctctcccgagctccccatcgctcccgcgctgtgcgcccatccgccgccgccgtttccgctactccggtcgcctctagccgccgctacactcgccgccgcaccgtgccgtcgccgccgttgggttcgcgcggccgaggtccacctcgtccacccctcctccgtagagattcgccgccggagcccaattgatgacgtcagccctggaatatattgcgcaataaatgatttaaggtttttcttgtatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgatgctccggtgtacttctgtttataaatgctcgctttatgcaaatgaaccacttcagctcttctttgatgattccctgcatcataccccta

SEQ ID NO: 23505 - DNA, 1155 bp, Oryza sativa
  unsure (1)..(1155): unsure at all n locations
cagcatgaggagagaaatagctgaattcgtcgcactctgcgatgtttgccagcgagtgaaggcttagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggttgctcacttcataccagtacataccacatatacgggcaaaaggttggcggagctttacctttcgagaatcatgtgcctacatggagtacccaaaaagattgtatctgaccgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttaccatatgcggaattctcgtacaacaacagctaccaggccagtctacagatggcaccgtttgaagctttatacggccggaagtgccgcacacctctcttctaggatcagacaggcgagcgtcaattgttcgggacagaggtattagcgaaagcggaagagaaagtcagaatcatcagggaaaggttgaggattgcccagtctcgacagaagagctacgcggataaccgttgaagggagctcacttttgaggcaggggattacgtgtatcttcgtgtcactccgctccggggagtacaccgctttcagacgaaaggcaagttggcaccacgcttcgtggggccatacaaaatcctggaacgaaggggggaagttgcttatcagctagaacttccatccaatatgatcggcatccatgacgtgttccacgtgtcccaattaaagaagtgcttaagggtacctgaagaacaggctgattcggaacacattgatatccaggaggacctaacatacgtggagaagccggttcgcatacttgataccagtgaaaggagaaccagaaacaaggtcacccgattttgccgagttcagtggagtcatcattcagaagaggaannnnnnnnnnnnnnnnnnnnnnnnnnnnnnnnnnnnnn

SEQ ID NO: 23506 - DNA, 859 bp, Oryza sativa
  unsure (1)..(859): unsure at all n locations
ataataattaatttgagaaattttgaattccattatatgatgatcaatttaaaaggagggaatacatgtgtgaaaggaagcttaggtaatttatatgatgtgaagtgggtgtccgagcaattattacaattactttattgtattcataagttactaaaagagttacatgtgagttggataaaattgaagcagctgcctactctacgagtatcgacctcactctacgagaggctggaattagaaaacgagccgagctatacaatagagaatctggtaagcaaccaaatctttccttttcacggagcagcccagccttcccttttcctccgttttctctaaggtgtatgagaaaaaagaaacatactcaactaaataataccccactgtaaaataaaataattggatgtaaaatatcctactactctatccgtttcgaattataaagcgtccttatttaaaaaaaatcaaaatcggtgacttttgactaataatcaatatctacaacaagtattacatatgttaataataagattgcattttaaaatactttcatgtaatattaactttatagttgttgatgatataatatgaaataaattaatggtcaaagtatgtcgttgaagactgtgtaaaaaatataggccttataatttatacttcctccatcccaaataaatacagctttacactattcatgtttaacgtttgaccgttcgtcttatttgatttttttttaagattagtatttttattgttattaaacgatagaacatgaatagtactttatgtgtgtgtnnnnnnnnnnnnnnnnnnnnnnnnnnnnnnnnnnnnnnnnnnnnnnnnnnnnnnnnnnnnnnnn

SEQ ID NO: 23507 - DNA, 674 bp, Oryza sativa
  unsure (1)..(674): unsure at all n locations
tttgagatatgaattcacatagggcacaaacaattttttcaacaagatctgcatcacactctgccaatacaaaaattagaatcaattagacattcagaagttaagaaacaaatgttcaccaatgataataaaatacatgtgcagctccacaattaacaacttcattcagaaattaggcctttccgctatactaggtaaaagaactttatgaagaaggcattttcaaccgaaattacttttttctttccaataggataacgcatgtcttagttagcccctcagagtccctcttggaaattaggcatatccataaatataggatggagattcccaagctcacctcttttctattacaccatcataaattacaaactgtggaatgtcattaaatcgtataatacaggccaaaatacctgaactatgaaggtatgaagtttgccaactttgctccacttcaaggtgaatgagaaataatctaactcgactcttccagcaagattgttcccagaaaccactgcagctccagagacagtaactgactgtggaaacaatatgcgacaacggtatcaaagaggtggaaattgcacgtgtttcctcgtgtagaaatgtttatgtataatnnnnnnnnnnnnnnnnnnnnnnnnnnnnnnnnnnnnnnnnnnnnnnnnnnnnnn

SEQ ID NO: 23508 - DNA, 564 bp, Oryza sativa
  unsure (1)..(564): unsure at all n locations
cctcctcctcctcctcctcctcctcccgctctactatattttctagcatcgattcgagatgcggatcgccccgctgtgttctgatcctgatgcggtggtttttggccggcgtcgagctgcagggttgacgagctcgatcgtgctgcggaatggccggctatctgacgtgttggcggagcttcaggtcggtggattgcctgatgtttcttgagtagagtagttggattctgggcatctaattctgttgattgcttcgcgttatcgatcgtaagttgccaatacgctaatataggcgcgtcagtgttgcccgtgtgtgtttcaagcgatgttgtgatttatatatctgtttgtgggactccaatttatcaaatgcattacagctacatttcaccgatcaaacgttgggcgtgcacatgggcataactttttgtcgcttaatttcaatgtcgaatcatttcgatgcaccaattggaatgtcatgcctaagttaatcacccaatggnnnnnnnnnnnnnnnnnnnnnnnnnnnnnnnnnnnnnnnnnnnnnnnnnnnnnnnnnnnnnn

SEQ ID NO: 23509 - DNA, 526 bp, Oryza sativa
ccagggttttactcgaatcggcacaacggtgacaccgtgacagaatgcaacccaagaagcagctgcttgacgactgtaaaaaaacggaagatctgattctttttttcacctgtcgtacgtacgatcgacaggcaaacggaaccgacaaatctgacatccaaaggaacatatatactcccatcttatcgcgtcctggctagtaaaggggtacggatctcattccagggaggcgagaagatcctcttcttccgtgctgattgtcaccagcttgtgattcgtgagtacctatgatttgctgtacatgtgtagtaattggtgtatacgggcatacggcatacggcattgaggagtgaggaccatgtttttcaccgtgtacgtaactagtgcatgtaatcctgtttatgcttcacggcttacactttgtgcagcaaacaagaaaatgttgtacacgaacagagcagaatttatccaggacagggactaccgtggccctgtgcctgtatgcaagtaaaatccgatcatccag

SEQ ID NO: 23510 - DNA, 751 bp, Oryza sativa
  unsure (1)..(751): unsure at all n locations
cgaccagcagctgaaggagatcgccgccggcctggacaagtccggccaccgcttcctgtgggtggttcgggcaaccagcacccaacacctcgacgcgctcctaccggaggtgttcttcgcaagaaccagcggccgcggcctcgtcgtcaacagctgggtgccccagccgagcatcctccgccaccgcgccaccgccgcgttcgtgacgcactgcgggtggaactcggtgctagaggggatcaccgcgggggtgccgatgctctgctggccgctgtacgcggagcagaggatgaacaaggtgctcatggtggaggacatgggcgtcggcgtggagatggagggatggctggaagggctggtgaccgccgaggaggtggagacgaaggtgaggctggtcatggagtccgagcatggaaggaaggttagagagcgtgtcgaggcgcacagagatggcgtggccatggcctggaaagatggtggctcgtcgcgtgtcgcgtttgcccgtctcatgtctgaattactcaacgtgtaaggttgaaaatagtatggaatttcccaattgtatcttactactccgttcaaaaatataataatttttcacaagaatcttgatatgcagctgtttagatttatagctagtaatttttatattttgaaacccagaaattcttatattttgacaaggaggaaatactattttcgttttttaatcgtnnnnnnnnnnnnnnnnnnnnnnnnnnnnnnnnnnnnn

SEQ ID NO: 23511 - DNA, 902 bp, Oryza sativa
gttaatgaatctaaacacatacatatgtctagattcattaacatataaatgaatgtagacaatgctagaaagtcttatattatgaaatggaggaagtatttactgttacatgctagtttgttctagctcatccttgttctttgaaaaacaaatcacgaagttgtgcaagaaaaaaaactcaaaggcttaatcagtgctaaaatctgcgtgaattgttatgattttttgaagagatcctggcttcgtcactagtaagtagttacagatcagataaagatgatgatttagcccaaaaggtgttactgatcacactacttgtactttccgcaagtcatgcactcgatcaaatcggcaaaacttaacaactatatcaaattatcaaccagaagctacgggaccacctatatatttgtcgacaaattttcttctaaaaatttaacatatataattatagtacaatcgtagtgtaattacactgtaacttatatgtaattacactgtaacttgcatgtaactacagtgtaatttgtatataagtttcatgtaattttgaatcattaaatctattacaagatttgttttggtgaggaagaaaaaaaatcacagcatacagtataattacactacgattatactgtaattatatctgttaaatttttgggagaaaatttgtcgataaatatataacaaaatcgttttggaaggcccgtctcttccttcccgccgattccattccattccacccgcgaattctaggcaccgggccagtgcccagtgggcccctcgattccaggcccaatctgacccgtcggatccacagtcgaacgcatctgtaccgccagtctccgcggtgggcccagcccacaacgggagggagaagagcagagaggaggcgactcgct

SEQ ID NO: 23512 - DNA, 772 bp, Oryza sativa
  unsure (1)..(772): unsure at all n locations
atatntaggctatgtacatggccagatcaacaacttcattgccaacgacaataagtcgaaaaagaaaattttaaaaaattcttgcaaaaacaaaacaaatgcattttttgaacttcatttttgcttatattatgttatccccgttgagactcaattgtcagtccttaattctatcaaacctcttcaagtatgcagctctaggtgttgagaagtaagtacattccgatttgcccaaactagtaccccacacataaactgctaatttattttttttttcacttccagccttcataatctggagagttgcttgtttgtccttttcccttacttctcgtaagcctatctttgaaatttgttccatttcatgttctctttaaatatctgctgtaaataattgccagttgtttgtaggtacatgctagctgaaggctttggtttgtctggtattgtctctattctgtttactggaattgtaagttagcctgtgacaatattttctctagattttattcttattacatattatagataagcaactttgcaggaagatattataaacatgcttacaagaagtgaatttttatttcaggttatgaagagatacaccttctataacttatcagaagattctcagcgttttacagctcgttttttccatctactttcatcactagcagaggctttcgtgtaagcaagaccttcaagtgnnnnnnnnnnnnnnnnnnnnnnnnnnnnnnnnnnnnnnnnnnnnnnnnnnnnnnnnnnnnnnnnn

SEQ ID NO: 23513 - DNA, 645 bp, Oryza sativa
cgaagctgaactgctgaagtggtagtggtggtgtggtccatcgatcgatctgtgcagcagcagcataagctgcttggtggtgcgctcccctctgcgcgccggacccgccatcgttgatcaacatcaactggggcgcgatgctatctatcatcaaacaaagcccgggccattgtttgtcatcatcgatggatcgtgtggggatattgcatcagagctaagcaaacacagacaatgaatggtccagtggggaggtaaaaagatttatcctggcgatcgatggtcgggtactggtgtctggtgcagtagtggtttttgcaactttgcatgcagtactccacttgcattgggagggtattaaggattggtgtacggcatcaccccacgcgtgcttttccacgcttttccaggacaaagattttgatgagcagggacgaaaggtcaccacaccagttccccacaagcctacactacacactagtactacatgtctacatgtaagaacgaaccgtctccatttttcatctttttgttttcgtttttgctattttacctagtacgatatattttttaggtttttgcctttcaatttttcacctttacatcaagattcgtgttcctatacagagcacttttatatacttggtt

SEQ ID NO: 23514 - DNA, 741 bp, Oryza sativa
  unsure (1)..(741): unsure at all n locations
nnnnnnnnnnnnnnnnnnnnnnnnnnnnnnnnnnnnnncgggcatttgtcagcgaagtggccaagctcgccacagttgaagcaggaccctggttttgctccagtctccttcttggcttgcgcgggcgggcctgactgtgccggtgccattggtgggcgtggagctgcaccgcggtttgactgacctctatggtgggtctgactgccaccggcgccctggggaaagttgctagggttgaacgggcggtactgacggacgatcatggtggtaggtccaccctgctgcccaggagcgaagcgcggcctctggtgacttccctgaggtaccctgaactgagcggccttcctcttcctgtccatcttgttgcgttgatcctcctgacggattgccttgtcaaccagcctctcgaaatcggcgtaatctccagatatcaactggttggttagctcgtcatccagacctgccatgaactttttctgcttctcggcgtcggtacggacatcctctggtgcatatcgcgcgaggcgattgaactcatggaggtactccgtcacagtcctgttgccctgatgaagtgcccgaaatccctcttcttttttgccacgaccccgtctagcacctgcgcctttctgaagctacggcagaactctggccaagtgacttcagtacctggtgggcgggtggccatgtgattgtccaaccaagctgacgcaagacctttaagctggtgtgttgcgaaag

SEQ ID NO: 23515 - DNA, 710 bp, Oryza sativa
tgtgattgtccaaccaagctgacgcaggaccttgaagctggtgtgtggcgaaagcaaccttctcctgatcattgcactgcaggagattcagcttcttctctatggcatggagccagtcattcgcctccatagggttggtggtgctggagaaggtgggtggcctgacacgtagaaactctggcaacttggactgagggggagggggaccaaactgctggtgctgctgttcggcgtgctgcagcatcctctggtgcatctgctggtgctgctgctgcatctgctgcatcatggctgccatcatctgtgtctgatgtgccatcacttgggctagcgtcggattctcgggaagtggtggcggaccattgccggagttgctgttgggatgcacaccctcagtgcgctcttcgctgttgctgccctcgcctgttgcgcggctaccattcctggtgtagaccatctggagggaaaagcagacgggggaaaagaagaaaaacagatgctcaggaactaagctttattacataggaatttaaactgcaattgttctgatctgaattaaaacacttaaagagcaagcaaaaatccttattaagacagccatatcataggcacatgatatcgaccgtcgactaaccccaaacaagcaacctaaacacacaaactaacaagcagaagctagacagtcggtaaactaatggaaaacgagccta

SEQ ID NO: 23516 - DNA, 1344 bp, Oryza sativa
  unsure (1)..(1344): unsure at all n locations
caactgactgacgaataaatctcaacagttttactaaaaccctggactgacttgttttgaaaaaaaatctcacttaaacgagcgaccaagatttttttccttgaaccacaagaacagatcccaattttcccggaataaaatccaattgcaaagaacatatgcaatgaaaaggattcagagggctcttaggtttttccatttggcttgtcctacggtcaacctggctctgataccaacttgtcacgcccagaaattcccgaatagaatttcaagcagaatgtgcattaaaatcccgtccaggaccagccggggtacacaaacgacaatgttgacattcagatccacgtcttacaaacatcataaaagtcttacataaatgcagcagaaaaacgaaagacaacaggagctaagccttgactagaactgcagtgggaacaccactccacaggcatcctcgacggcacggacgaagcctactcctcagagacacctccatctgacacatactcaaactctggggttgggaaaaatagagcaagactgagtactacccactgtactcagcaagtcataccggaataggggtatgatgcagggaatcatcaaagaagagctgaagtggttcatttgcataaagcgagcatttataaacagaagttgaaagatttaaacagttgtaataattaaacaatatcaactatccactgtccaacgctaacccacgttgcgacaggcccaaccatccacctaaactatccaattttaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatatcagaaagaggccgtgacaggacccttcgcataaccccctctagccaagcacaccacacctcaggtttcacccccgtccccagcgggcaacgggcagccccctctcgtgcctaggtgaatccggaagcgacagaggccgtcgcagggcccgccccgctccatcacgcccacccttgcctggatgcgtcgactagaggaaagctatactacaagcccagccgttgcccacgctggcttgtggtaagtacgataagttcttccagggcatcccgcgaaccggtccttaactgccatgggtgcgacctgctaaaccatgcacccacagcccaccatgtggtttattttaattaaccaacannnnnnnnnnnnnnnnnnnnnnnnnnnnnnnnnnnnnnnnnnnnnnnnnnnnnnnnn

SEQ ID NO: 23517 - DNA, 1940 bp, Oryza sativa
gcggtttcgggcgcggcggttgctggcgcggcgtcggccggaggtgggggaaggacccgacaggtgggccccacctgtcggcgaccccgggaaaggagggcggcgggcggcctggctgggcctcggcctgcagccggcccagcagggagggggggaaggaagggaaaaaaaatgggccgacggcccatttgaaaaaaaagaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgcccaatccgattattatttgcattactttcttagggttttctcttgatttgcacctgcattttcttggggttgtttacaaattaaatttggcttgggaggagaacttcggggtgtgacagggagctcgctacccgggaggggaaaaagcgaaaggaggaggaggaaagggagctttgctccttccggtttgggaggaaagggatgagaacgagccgcgcctcacggttttggatgcatgcggcatggggcgccgggcccgagaggatgacgccggcgatgactgcaaaaggacggggacggtttgaaggcaagcgcggacacggtggtcgtcggggcaggcgacgaccgagggtggcgatggcggcacccaggcggtcggccactcgcacgggcgcgcgggaatcgaaggaggcggccggaattttgggcggtgtcggcgggaagcgacgccgagagagagagagagagagggcgctctctgagggagtcacgtgcggcacacgtgcgatggagaggctggcgaaagaagaggatgggccgaggatggtttcggcccgagcgagttggagggaggcaaaatagacttttactggaaggtttgatttggagagaagtttgatgtggagattgaatttgaattcaatttgtgtatttgtacacgagggttcaaggtggatccaagggaggggtcaagaaagggcttcaaaagcgggaattttggtatttttgggatggatttatatttggcggcacgaaggattatttcagaggatttcaaaaatggaagatcattattcaaaaatggaacaagggagatagcggtagaatgccatggatagatagatagacagaaaggtaggttgataggtagagggacggatagacagatggattgacagatggatagataaacagatagataggtatagtagatagatagatggatcgatcgatagatagatagatcgagactcagagagagatgggatggaagagaaggaagagtggatcggaaaaagaaagaaggaatccaacctatgagggaggttaaatagactttcacagagagatttaattgggaggttttagagttggagtctagattcgaatttcggggttgatactcggtctcgggagaataggaaggagtcaaggaagggaacaatattcggagacgagtcaaaaggggatggataatttagagaaagagagtgtaacttgggagtttgagtttgactactcaacgagatatgtgggtaaggattttggagagaagtctgaatagaagggttcggacttcaagattatttcggaacggaaatcattttggggagaactcaaggcgaaggggattgaatcttgggatttagagttcaagggtggaagtgatctcgatttgcatattcagacttgggtcagaagttcgagaaagaaaacagggtagattgatgaaccaatacagagagaaagatagatgaatcaaaacctaagaggttgaattcgaatttgagaatcggtttgaaggaaccaaggagagagttattgacgcgaaggtgaatccttggacgg

SEQ ID NO: 23518 - DNA, 18127 bp, Oryza sativa
  unsure (1)..(18127): unsure at all n locations
atccttggacggagttagggttcgggcattcgacaaagttcacggatggggttccaggaggggattccttatagaaagaatcgagcttcgggactacattgggatggaaattttgaggagacgatctttgataacagggtatcgagacaagggaggatttaaattgagatctttggcacaacttagactcaacactcaaggaatgaaattttcgcaattaggatttttgccgaattagtttttaacgtctcacgaaaagcggagcgttacactaactgagctaccacgcgagttaaaggaggaggagggcgagcgaggaagaggaacggagggctatcgcttcgggacagggcgccgtgacgagcgacggcggcgcggagcaagctctccgggagcggccgggaaaggggaagaagaggtgcccggagctcctcgtcacacgtccatgcacgcaccggccttcctggtgcttggcgacgaacggcgacggtgcgagccgagcagggcgacaaggcgcggcaggcgaaaacgagagggatagagaggaggaggagctcggcttggttttataggcacgggaagtcggttttggggaggaaaccgacttaggtggtcaagggagctcggctgtcagtcgtgctcggagctagcggccaagcggcagcagtggaggtggtcacaggtggcccggctgagagggaaaaagcaaaaaggggagaggaaaggagctcggctccttgccgatatgggcgagcagagggaggagggagagcgcatgagacacgggagccgaggctctgcctccacgtcttggacgcacgcgcgcacaggtggagcgagtggcagggcggcatgggctgctgcgcggcgcaggcagccagggctaacgtggcggagaccgagcagtcgcccacgcgcgggcgagcgctgtgcgctacgcgagggcgcggcgaaattcgaaaaggcagcagcgggaatcggcgccgaggggagttcgtcgggagagagagagaaacagagagagagggagagggagagagggtggggacagggagggagaggagctctgcctccattgtttggaaggacgcgacttggagcagcggacagggggtgacgccggtggtgaccacggaggtctctgcctcccggttttggatgctagcggcgtgcagcggcagagcggcagcgcgcgaaattggtccatccaaaatagagggatgcaaaatagacttcttccaagaaattgatttggagaagatttgaacatggaatttgacttggacttctggattgggatctggatgagaggaagggtctaggaaatgatcaaaaggggaaattttggatattttgggggtcgggcgaaaatttggtgaggatttcaaagagaggacttgaattttggaatttgatttggagacttgaatcggaattggaatctcgaggtgggcgattttgatggcgacgagagggaacaacgatggagattgaattgagatccatggcacgacttaaactcacactcaaagaacgaaattttcgcaattaggattttgccgaattagtttttaacgtctcacgaaaagcggagcgttacatctgcacccttgaatcgagcagggtgagaacgatatcatgcaggaatccggaaaactcaaatcataccttaatgggaaatcctctcatttttgcatgtcacttaaaaagtcatcaaaaaatttgaaaagatttgataggatagaccaatatgtgatatgccacttcacaaacatgcaaatttaaattcaatttatacaagtggaaacaaaaataacaaatttgactatgaagtgaacgtgcaattcacgatcaaatttattatttttgtttagaattatataagttgaattttaactcgcatgttagcttaaagtggtggacgacaccctcgtcagctactacaagagaaagtcaggaaagagtgagagagaaggaatgagaaagtcaggaaagagtgagaaagaaggaacgagtgtgtctatctcgggaagaggaggcacctcagggttcatgccttgacttaggctcggtttagatggcaaaaatttttgttttaaggtatcaaatcagatatacggtcctagttgtaatgctgccagcggccggctagggcgaccagtagcaggccaggatggcgagcaatggtgagtcgacgaccaacggatgagtgcctgagtgtgagtggcaggagtagacggcgactcgatgagcagtggcgagaggagattgtgttggatcaaagacaaacagacacacagccgtacagatgccgtattgcggttaggaaaaagaaagaaacaaaagcgaaaaacgggagtcgagaaggtgtgcggcgccggcgtggttgtgattgacgctccgaggcgtcgtctcgcttccagtagcccagacggcgcgccgttttcatgggccttagaccttccacgacttgctcataggtcacgggtgatgcacgaatttaggccgaggggtttcccatgtgatgaaaatagggggggtaagtactaaagctaaaaattggaccaggtgcctgagaacccccttcgtctattgggctccgcacctacggccacggcctcgtcgtcaacagctgggagccccagccgagcatcctccgccgccgtgttcgtgacacactgcgggtggaactcggtactggaagggatcaccgcgggcgtgccgatgctctgctggccgctgtacgcggaacagaggatgaacaaggtgctcatgggtggaggagatgggcgtcggcgtggagatggagggatggctggaagggcgtgtcaccgccggcgaggtggaggcgaaggtgaggctggtcatggagtccgagcaaggaaggaagctgagagaccgcgtcgaggcgcacagggaagccacggccatggcctggaaagacggcggctcgtcgcgcgccgcgttcgcgcagctgctgtccgacattgacgacgcccgtggcaagcagagtagtgtcagcgtttagctccactttagaacacgaaaataatttcacaattcccactgaaatcatgtttgtagtactcgaaatcgtttcatcgaaacgttgattttattgctgacaccaaataattcagatcaaacaaaattttccatcccggattacatagctgaaaggctgaaatgccatttcagcaagaggacagtacgcacttgattagtatacactctgtaaatactacaaaaatctctcgatacacctgcaaatctgtaggcagaatctctgacgcctggcgatggcgatggcgatgatcaggcagctttggcgagctccctctcgacggccctcttgaggaagctgccttcctcgacgaccatctgaacggggaggaagccgaggccgctggcgacggcgagcatcacctccttcatctcggcgcggaactcctcacggtcgacggcgccgtcgccgtcgcggtcgaaccgggcgaacaggccgcggtacaggtcgacgagctcggcgtccgtggcggcggcgccgtcgacgccgaagtgggtctccagcacgcggaggctcatcagctcaccggccatgtcggcgtaggacagcctgccgtcccggtcgccgtccagcgccgcgaaccggtcgtccaccgtcgagttgaaggccccctcgtcctccacgaagctctccaccgtcctcccatccaaaatctccacgctcatctcgcccgatcgaattcttggctagctctcagctggttcaggtgttgtaggtgtttgacgagatgtgagaacgagttgccgctatttatactgtcgaatccgcgtgtctacaacgcgttaattaatcagattattgcgcatggtttttggcctggtaatatgctgtgggatgtgccaatgttgacgagttgtttttcgccaagtgaagaaatgctaaacgtaagcaaagttcttgttcgcctcgagggagatacgctagctgttgtataaagaaaaggagaggaagcccatggattcgggccggtttaggcaggttgcagatcatatgacagtgacagtgagttggaatatcattgacaggacgcggcgaatctgcgccttgctctgtgcgtggttaaattaaacatagcattgctgcagaggcagaagaagcgaagaacttttccttcatttattgttgtaaaaccaagcacttacgcaaagcttatgttagcatgtgaatatagtacgtgcagttgcagttgagccaaatagtactcccttcgtcccataatataagggattttgagtttttacttatactgtttgaccatttaactcatttaaaaaattttaaaattattatttattttttttgacttactttattatccaaagtattttaagcataacttttcgtttttcatatttacacaaattttttaaataagacaagtggttaaatattgtaagcaaaaacttaaaaactcttatattgtggtgacggagggagtaattggcaagctaactttggtccgtagctcaaatcaggtttggcaacttcatcactttgaggaaaggcgtccggcagaagcaggcaagcagcagcatcagcagcaagttggtcgagatagaggataccatgaaatgaaacagcatgtgccaagcccactttaccacaccgatggtccttactccttaaacttgtgccgatttgtggttggtctgccgacagacatcacctcgatcggccactggtttctctcgatttcaagaagtttctatgatgcccatgtactctcatcatgtgaggcccatacggtgaccaacgaataggactcctacggccccatcttttatgtatgcttatgtttaattattaaccaaaatttaaattttaatattaaatttaaagctgattttgagatttttttttcatcgaagtttatttttcagcctttacttttaggtcgttaagaacacgtaggtaaaagttttattcacaaattatttatcgttttgggtttgtttgtgggtcccgataggatgtgcttttggcataaaattacaatttgtcaattcaaaagcatacatattcagttaaaaattgtttcaagttgacttttatatttaaaatattcggtttaaattttggtccccaaaattgtttgcattaaaccatgccaatgaatgaaatgtctaccacgcatcttgtttttttttggcacagtttgcccctaaaacaatttcgccctaaaagtgtgcgtagggtagtttagacgccacaatagaaagttcatagaatatatttttttctttttgaaattgttttaaaattcttctaaaattcattagcaaagtgcatatatcaaataattttgggatggtttggttttaagcctaaatttggcttaccaatatttggcaatttcaatagtgtttagtgtctatttggtttaaagccaaattttggcatgcctaagaaaatatgccattttaatagttaacttaggctattttggcttcaatccaaatacaactttaccttctcaaaattagtcataccaaaacttaccaaaaattggtaaggccaatttaggccacaaaccaaaccagccctttatacataaagttttaatgtataaaatttatgcaaaaattagtagtgtacgtgttaggctagtataaacccactcaaattccatgggccaacgggcctcctaagggaaagggaaaacgggcaggaaacaaatgggccacgaaagtttatgcacgtgggctgtattggaaatttggaatgcatttgcgtaggcctcggacacggcctactaaatagaactggactgcaaaagcccatgtccccaaagcccaaaaatctgtgagcccaatagcctgcttccttgatgctctgaagtctgaattgacaggcatggcatgccttgcaagagaaagaaaattgctttcgatttgcctttttctttgcgtggatggatgcattgtttgaacgatggcggcagatgtggatgtttgtccagcaaagcgtgtgcttcgtgacaaccatttctccccgttctacgtcaatcctctccttttcccgtgttcattttccggtggttatcgtgtcattagtccacaataattgcattccagggacatctcctgccatgctgaagaataaggcatcgtcatctgcatgcaggaatggaaacacatagtattagttttttttattttttctggtcttggattcattaaacaaagctatcaaatgcaatgcttttcttcggtgtgatgggaaggaatcatgtttcatgtggacaaacatccctgctacgaaaatgcagagtcgattatttaggagatgtagtaattgtttagtgatttgtttccttctgatggccgtaatgtgacctgaatatgatgttaaagattttggggatagtcaaaaagagaaagaaggttacatgcgaagttctcagggattgcatcaccctacagtttaagggggtaggttaactagaagtgatccataagggcagcaaccacttaaaacaactgttctattcaagttcattagagaagtcagaggtagtgaaaggagaaggtgactttatgctactgagtagtgagtactagtataatcttgaagtaggcattgattgtttaatattaaggagtagtgcattgcttactgcagttctagaagaaacaaaaacaagggctctgttcttggcagaatgactttaaatggaagaaatagtatattttaaccaatgttcacgtttcttggaaaggagaaaaacaagttgaaaattggattggtttcattaattataacctgctggcctccaaggaattttatttccacaatgtgatatattaattaagaaagctcaatatagcttgatatgcacaaaagatatgatattgttgaaatgtattggagatagtctgtacacaaagttatatttttttatataggaataaaaatcattctgtcggtagtaatttttaactgagtcatcgatatagatatgaaaattccaatatgctgtcagatccgtcgattttgtagtcaatggattttaaggatctcacttgattggaaatgacgaagcggtacgaaatctattttttcttaaagcctaattggcaatgacagctcatgaaatgagttttcatttctcggatgattaacgagttgttacctaccgctgaacaattattattctacatttgatgcaagggaagatgcttaatcccaccagatacaagctgcatcaggccatcacacgagtcaagtggtcatctcaccgacactacaaaatcagctcaaatagctcattcggttatgatttccaattattcgaatccaatttttatatactatgttcagtatattttattatccttgctgcttttttttttgggggggggggggggttcacaagaaagaagtacacaattaatcacaacaatactctatgaaaattaaaagtgtacaatatttaatttgtcgccgggcattttctgtttaatctgcaacaaaagctgccagttacacatagggtgcagttgaaaaggtgactagaaatggaagctatcgtacctttttaatgtgattatactttaacatgaactctattcaagagatgtattcttttcttttctggaaatatcattatcgggaagcaaaaaaagctagctgatagcagtttgccacattttttcatggaaaaaggttctatgtttggttcctttaaggagaaaaaatgagtttggtcttagtactttgagtatcaagcaagttgggggaatccttgatagaaatggagcattggttgcgttgtcaaatttataaaccacacatgataccctaaggcctaagctgaattggattcttccgagaaatagccttgataatcaacttctatactatactcatcagtgtcttctgaagtttgcagtacatggtctgagctccagcaaagagtgattccctttcactgcagatagtacttcaaattggaatttctgtgctctgacctttgaggacacacccttacttctcagtacattgtgcaatcttctttgtcctgcatgcatctgtacttgcaaaatatgctaaaatatttttgtttgtctaatggatctaggtgccagacagtgaatagaaaaattacattagtcatcttacagttttgaacaagaacaattaaaaaatgccaaagcctgcaagttggttttgagaagtcagatttgcgagaaatacaacactgcacaattacaagttggactttacattaaaactagtatcttggccagacagtacacactccagggaaaaaaaagagtgcgaaaaatacacgtttgcgccatttgttcccatattacatacaccaagaaaaggcaaaacattacaaacatcaaatgtgaagaggaatttatcagtaaatgtgagataaatgctaccctatttctctcaaataaatcgaaacaaacagaatggaaattatcgtgtacacttatgtatcggtgatccgtacacgatatgcacgaggtacaaaaacttaaaactaattctacaagcacttaataatggtactaacactaaacaagcagtgcaatttactcaagaacagggagggaagaaagctaggacagaaagaaaagggcagctaatacctggccagctttcattatgcacctcttggttgagaggtgtggtcgtggtggtgcctactgacctgcaatgcaatggccgcaacagccgccaccccccatatgaatctcataatttattctcttcctttccacacaaacaccaacctttctatatagcatcccctcccctcaagtctcaacactttgccgtccagttgccctcttcttctcttctcttctccttcccctgctctgctcaggtttgcagaatctgaattctcccctgcatttgcaatgcaatttggagttgttgttaccttttgcaaatttcatagtttcatctcattgagtcattgtggttaatagcttggggctacttattgttgaatgtacttttatgcttatggtatattttgatctttttcatatgtaattcttgaatgatcttgagaaattaagattttttttagcacatgagggtatctctttttctttaagtcgaagcgaagattgttgtgtatgcttggtgtagactcttgaatgttcagctttggtagttggtccttctctttttgtctttgtgctgtgctgagatctaaaagacataagtatcttttttgttgttgaagcaaccagtttatcatgtgtcctgattttggtaggtgacactatcagactactactataatgtgaccacctaaactagatctaatgatcgtgatgtcactaagcagttcagttcaaatacagatagatctcagccaaaaaacaaacaaacattttggtttttatgatcaagaaaattcatcttgcattgatcactgtacaatgtacattgcttaaatgatctcagggatcaggatcagaggagaagagaagatggagttcaaagcagccatgttcgcggccgccgtcgtagccgtcctcctatcgtcgccgtcaccggcattggctcagaagaagagcccgccggcggcgccgtcgccggtgtcgcttccaccgagcttggctccggcgccggccccggccccgaactacgtcaacctcgccgagctcctcagcggggccgggccgttccacacgttcctcacctacctgaagaagacgaacgtcatcgagactttccaaacccaggcgaacaagaccaaggagggcgtcaccatcttcgtcccaaggactcggcgttcgccgccatcaagcagtcaaccttttccaacctcaccggcgaccagctcaagacgctgctgctgtaccacgcgttccccaagttctactccctggccgagttcaagaacctcagcgagctcaacccggtgaacacgttcgccggcgcgccgtacacgctgaacctcaccgacgacatgggcaccatctccgtgcagtcgatgtggtccaggcccaagatctcgagcagcgtgtacgccacgaggcccgtggcggtgtacgcgctcaacaaggtgctcctgcccatgcagatcttcagcaaggacccgccgctggcgccggcgcccgccccggcgccggtgtccggggcgtccgacctcgcgcccggcccggcgtccggcaagacgggcgccggcggcggcaaggcggactcgacgagcgccgcgtgcggcgtcggcgccggcgtcgtcaatggcttggtgatggcattggctggtagcttgatgctcctgtggtgatgatcagagagagagagagagagagagttcttggagtcaaatttgcaacagcagcacattgttcatgcttctccacacttgattctattttgaattgatttgaaagagccattcttttggacatagtaggcaatgtttgtaggatcgaattggagtatttttttttacaacgtattacgatcataattcataattactcatctgctgatggatgaatgaatatgaaaaggggtttctcttacatttctactacatctcttctgctcctctgtttgacgatgacatttcactagttcattattcagaaaaacaactacgtactactataattgatttttcaagaaggaaaggaagatcactactactccctccgtctcctagtaatttatccaaattcgttatactagggagggatatcttcggttacttttttttttttagacgaagggagtactccgttgtgaccgacagtgtaggtctttgatgaatcagtcccttccatgtacgaaatgattcatttcaaatcactcccattgatgctcaccaccaccagccacgtgagccatgtcatggtaagatatgttcagtctactacagtacactgatgattgatgaggttgttccatcttggcataaacaacaagtgtgagatgaaccgtcattggcgagtggttgtgccgagttgaaagattcacagataggactataggaacacgtagtttatgttcgaaattttgaaggattcttcgcttgcctttggcgtgtcgatcgtccgtagaaatttagaggccaaccatgtgcgacgagcatatggtgtgctcgtctcctcacatgcggttagttttttttgcgtgtccagagattctgttccggtgagaaattaatgttctcactagttcagatcttcggttcgatccccatttgactcgtgaattattagtctaagtttttgaacatgtgttcgtttctctactggagtaagagtatgttagtagcagtcagtcagtgaaacactcgggaagtacgtttctcaagtcaactttactacagcaagcccttataactctaggtacttatcttttcgcttttcgcttatgattatacttatcagccaaaatttaaatttttaatcttaaatttaaagttgattctaaggtttttcatcgaaatttattgtttagccttttttttttggatcgctatgaatacgtaagtaattatttttcgtttacaaatataccgtttcatgaaacgatggctccatactaactttactacggaaatcaccaccaccagcagcagcaagcaagcaagcgaacaccggcgtcgactcttcggtcgtcggcgccgagccgtctctcgcgagtcgcgcctcgtgcatccactcgcacaccggcggtgtcgtgcgcgcggcgcggagacagtcgcggttacgaggccgtgggggccttttttccgcgaaagggacggagatgatggtgcgtggctgttacaggggctgtggcctgtggcgtccgcgaacggaggcccatgtgcaaactcccggaagtttatcactgccgcgcgcgggatcagaggcagcgacacgcgcgggccgtgggctggtcgggtgaaccatccgttgccggttgagggctcctttctttctttctttctttttttcaaaacgaatggaggagcgtcaatataaacaaactgtacagtaaggaaaaggagaaaaagtaacggaattgctagaaaacttccgtaagtttttctctcaaagcttgcagatttgtagtcatcggatcgcttcgagatttgtacatactgagaaaaaattgctagaaaaaattatcacacatgtcacgtgtaaaatcccgatgatagtcaatcaaatcatagttaaatacaagttttatataggttacagtataattacaatacagttatatttctattatactatagttacttctaaaagttcttcactaaaaaatttgcggcggtattttagatactcccaaaagtaaaagctagatccttaaacccagctagtgactagtcaaccaagtagccaattttctgaggcccttgggcttctccctgatctttgtgactaggccggttgcccagagctacttgtgctaaaggttcttgattcatttacttccaaatccctcgcgagactagcagtattaacgtgcggtgcggactgtttgatttggtgctcctttcgaacacatgagtagaaagtcacaaaaaaagaagaaaaacatattaattaaatgtcatggcatatgctattatatgaaaatttaaaacattgtaatttgtcaaatgagttgtgtggatgctcaacatgaattttacaaggaaaatatccgcatggaagtatgactgtaaaacatctaaaggagtaaagtacaccgtactatctctgtttcatattataagtcattttatctatttttatccagtcaattttttttagatttaatcaagtttatagaaaaaatttagcaacatctataacactaagttagtttaattaaatgtaatattgaatatatttttaataatatcattgttttgtgtttaaaatattgctatatatttttaaacttgatgaaactttaaaaaataattagtagaaatggttgaaacgacgtctaatatgaaacacgggtgagtacgacgacattataagactacaatgattaaagggcatcacaatcaatgaatcaaatcaaacccattaaaaaacaaaactcaaaccaactagttactcccaaaggagaactggagatcgtacagtcgtgcaagtttctgtttttattgattaggattatacttccaagagcacggcttgacacatttttcacatatgccatatctctacactacacatgacgcctatttcattatttaaaaatatctacaccacaactatcatattcgcacgaacagagaggtatggaaattaaacgcactaatagccctctggactctggagcatgggcatctgcatacccgtttaatgccatcagcatcaaactaaggtgttgctaggcaaatcttcatataagttttaaaattttatttcagattgatttcagtggtttacttagtaattttcgttcattttcgttgcttgttaatctacctaaaattacttataaaaaatcatattcgaaaattcaaaatcaaattaggtcgtaatgcacgtcaaagtcaagtgcggtatgttaagggtctattgggttcaccgattgaaaaaacagaactgaataatatttcctccgtatcgaaataaataaaattaatattggatattacatactatagtactacaaattttagatataaagtaagtgcctacttcttctgtaaaaaaacaaacctagaattggatgtgacaaaacatagtataataagtatggacatacttgttataaaagtggctccaaaatcacatcggaaaccaaacacggaagaaaacgctataagatcaatgtgtgttttaattcttattctgtgataaacaattggcatgttttggagataatcaattttcaggtgatgatcggattcactgttattttatgtgaccggtccgaccgggtggaggttgccagtcagaccggtgctatgtgtgtggtcagaccggccaggcccgcggtctgaccggccgacgctgagtcggtttcggtttcgggttgtttctttggatatccgtgattgtttcatggttatggtttctagatggattctatacgtatgtaatactgttgtttgctactaatgagtcaagttgggaatagcttggtctcggaatatggtttctgtcacgcctggaaattcactaataatttccgaactaatttgtgcataaaatcctcatccaggaatcaactgatgtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatacttaacaagccacacagcaaatatgcaaatgcacaaggataccaaaggatggcacaatatagtctcatttgcgaaagcagcatttagcaaagagttaagagtagtaaaacagtagagtaattaattagaaattttaatcaacactgaacagcacacccatgctgcacaggcccaaccatcctgaacaaccatacccggctatacagatctaactccaaaccaggagctaagcaaattattaccaggtataacatccataattattgtgagaggtgtgagactaatcacgaaaaacattgctcaacccgcccataaccgcgggcacggctattcgaatagttttactctggcaagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtggacttatctccgccacttctcagtctggtgctccgcaatgaaccatgctatacaaaaggtaaagccgttgcccacgttggcttgtggttggcacggttaatgtttcacaatagtagcttgcgaaccggtccttaattgtcatgagcgcgactctcaaaaccatatgctcacaacccaccattatcaagttttagttggcaagtaattaattaaccaatcacgattgactatcgtgaactattattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaagagagaatttaaatataggatcaacatgctcaaaggattgtgtttaggatctgtgtgacttgccttgcaatattcggtcttcaattaatcttcttgaatacttccggcgcactcgcgaaccttcgaaacgacggaaacgacaagctaacacgcaaaacgaagaaaaagactaataaaaaccaaataaacagtacataaaaaataaacaaacatgtagatcataattttagatgaattatgagacttgaacggcctcattctgacttcatatgaatttattacgaattttacaagatttaatctaattaaagcccatttaaaaagaattaaataaatttaattctatttatggataattttaatatgtagatctttattttatataacttttgcaacttgaaccacgttaaactgagttacaatgaattagttatgaattttcaaagattaaatcggattaaatcctttatatagattttaattgaattatgacgcaataatgaattatttttgaaaaggaaaagaggattattgcgtcagcgggtcgggttcatggtggaccgggtgcatggcggcggctcacggaaacgaacggccgagatcgatccaaccaaaacgaacggccgagatctatcggtccacggccagagcacgggagacgacgacgatgacgtcagcggtgacgtcatcaccggcgacgactcgggcacgcatgcccgccggcgaacgacggcgcggtggcgcgaaaggagagcaccaaaacgatgcgggcgacgcggcgaactcaccggtgaccaaaacaacggcggaagatcaacggacggcaacggcgacgaggaagaagcggcgaagaccttcggcttgacgacggcgatggtgttccagcggtcgacagcgacggcagaggggcggacgagatcggcgacagcttggcgatcccgatggcggctttcccgagcgacgacgacgaccggagcgacggcggcgcacggctagacgaacggcggcgacggcggcgcaaaagctcacggggctagggcactacagacggcggcgggcgaaggcgagagtggctgcgggtagaggggagctcgggggtccttttataggggcaaggaggcagcggcgaaggcccacggcgaccggcgacgcgaaggaaagtttatggttcggagagagagacgaatctgattcgagatcgaatccacgagtttccaaactgaattaggcgatgattccaaaagagaaaaggtagaggagatcgagaagatcatttcccctctattgatttcaccggatcgggaaataggcgagcgaaaaaggaaaggcggcggcggcgcggctcggctagggttcggccgggcgacggctggaggaggaagacagccctgacaggtgggccccacctgtcagcgggcggatgcgcgcgcgggtggctgctgccggactgggccgactgggccgagggagagagaggttttgggccggctttctgcccaaagccaaaagagacttttaaaaaccttttttaatttaaattattcatgaaatgcaattccatttattaaaaatactttcttggctcaaataaatcccagaaaaatctaggaactaaagattcaagagaagtatttaacaaaattttatctagcccaattttatattgagatttagcaaattaaaattagatcttctcttttaggcttttaagatcatttctaataattccttttaaacaacaatttataatttaaggattttcaaacaagaaaagctcttaacaattataattagatcattaatgatcaaataattactgaactgttctttgtatcatttaggaattgagctccaaaaaatccgagaaaatttcagagagtatacttaatcatagagaatttaataaaaattaaatccatccatgctttaaatttaggaaattttatttcccacatttaacttcacttgtaaattaatgaacgtttaatataaattctaataataatttattaaataatttataaatcctgaaacaaaaatcaggatgtgacagtttctttgtttgtttcatgtgtaggtgactcgatgcctcgggagagtatttgcggaaatgatcttctcgatctcctctaccttttctcttttagaatcatcacctaattcggtttggaaactcgtggattcgatctcgaatcggattcgtctctctctctgaaccctaacctttccttcgcatcgccggttgccgtgggccttcgccgccgcctccttgcccctataaaaggacccccgagctcccctctacccgcagccactctcgccttagcccgccgccgtctgtagcgccctagccccgtgagcttttgcgccgccgtcgccgccgttcgtccagccgtgcgccgctgtcgctccggtcgtcgtcgtcgctcgggaaagccgccatcgggatcgccaagtgtagcgcccgttccgtcgtggcgcctagcgggaaaattatctcttaaaaaccctaattgtgaaatttgtttctttgcttgttgtctagtgtccgtgccatctcaagatctcaatccccgatctatcgtcgagtccaatccggaatccaatccttccaaatnnnnnnnnnnnnnnnnnnnnnnnnnnnnnnnnnn

SEQ ID NO: 23519 - DNA, 13091 bp, Oryza sativa
  unsure (1)..(13091): unsure at all n locations
gcccgccgtcatcgccgtcgtcaccgcccggcccccgccactccgcgcgcaagccgccaagggacggaggcagcgcccctcctccctctgccgcgtcgcccccgctcccctcctcctttttcccgaatcggcaaaagggcaagcccctttctccccctcctttttccccttttcccccaccggcgtcatcctccctgtcgccgctttggccgcgaccgccgagcgccagctcgcgccttgaccgccctaagtcggttcccaaaccgacattgccgccccctttaaaccccagctccttcccctccaatctccctcgttttcgcctcctcgccatagctgccgcccccgtgctctgttcgccgtcgccgtttgttgttgcgcgtgtcgaaggagtcagcacgagcaaggacgcggaaggggacttcggccgcgccctctccttcctcttccccggcccgaggccggagagattactcccgcgccgtcggcctctcgtcacagcgcccctcctcatctcggtgatgcctccctccgttcttcctcctcgctccatctcctccccctagctttcggtagtagctcgagtagactccccgtagttagccggcgccgccccgaccgttgccgtcgctcgtcgtgtgctcgccgccgtcgccgctcgagctccgtagcacccacacgtcgccagcctcgctaggcgtagctccgtccaatccgacgctagcatcgagttcccgaaaccgcgtagatgctctcaccgccgggaatcgatccctcgtggcctcgccgccgtttccctcttcccccccctccgccggttgtcgccgccgtcaagcttcctccggcaaatccgagccgttggctcgtctcccctcatcacgagcaaccgcccggtgtgctcgcttttgtccgtatcgccgtggttcgctccgccgctcgccgccgccgcccgccgttcattcgcggccgggtcatcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgccgcatccgcgtccaccgcgaaccgcgcgcgtgcaccgcgtccctcccccgcccgcgcgcatgagccgcgtactccctccgcacggtgagccgagccgctgacaagcgggtcccacccgggaccgcgcatggtgagccctgtccaccggctctctctctcctccctcccgcgcgcgcgcgtcttgggccgctctgggccgccttcttgggccggccggcccgttaagctcggccgagccgccctttctctcgggccgcgccctagccgcccgagggaagtctatattccctccctctccccttttcttttctttttcttttccaaaaaaaaaaggatttaattaaatccttttcctttagaccaaaaatccaataatcttagaaattcaatatcttcccaaccgtaaatccgtttgactccgttcaaattccaaaatttctcaaatctcgagatctatctaatggcatgcttagaggtcattaatagggctttattttcgccgtttgttgagttgtcccgttttgcgtatagtttcggagcccgaagacccgcagagcgaggatttcgaggatcaagctccagatctcaagcaaggcaagccacctttggacatcttgagcctatattcgaaatctaattatattgcttgcaaaatattatgcattgataggattgcacttaatctgttgttccgtctgcaaggcagattggcagacctacctaacttgttgcatttgatccttccattgttaattgctataccatgtccccttgtaatcatccagttgcgcctcgatattcgtgcaccctgtgccagtatcgacggtcgccttcaaacttaaaatctgagtaacaacttgcgtaaaactggagttttacaaaagacttggaaaacccgacacctgggtcggtgcttgcgaactaaatgaatttccaaaaccgcggaccgggaaacgtaccgggtgtatggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcataaggtaaacctgtgtcggctttggaaatgccttgccatgaaagcttggaggtctcccgacgtggctgatccccacgggctgggtgatccgggttagtaatgtcgtgtgggtaaagtgtaccccctctgcagaggttaacaaactgttcgaacagccatgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgttggcccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaaataaaattaattgcaaaaacaccagcctttccttgaagcctgcattaaacacttatttcccatggcttgctgagtactcccgtactcacccttgctctatataaataatttcccccccagttgctgaagaagatgaagcggatcctactgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgttccctgcgactggtatcgattaacaggttaatttggagcgtcacgggctagttccggtcgggactagttcggggcgtgacaccaagccgtcgccgatctcgtccgcccctccgtcgtcgctgtcgaccgctggaacaccatcgccgtcgtcaagccgaaggtcggcaccgcttcttcctcgtagccgttgcttgtcgtagatcttcccccgttgttttggtcaccggtgagttccccgcgtcgcccgcatcgttttggtgctctcctttcgcgccgccgcgccgtcgtttgccggcgggcatgcgtgcccgagtcgtcgccggtgatgacgtcaccgctgacgtcatcgtcgtcgtctcccgtggtccggccgtggaccgatagatctcggccgttcgttttggttggatcgatctcggccgttcgtttccgtgagccgccgccatgcacccggtccaccatgaacccgacccgctgacgcaataatcctcttttccttttcaaaaataattcattattgcgtcataattcaattaaaacctatataaaggatttaatccgatttaatcttcggaaattcataactaaatcatcgtaactcggttttgagtggttcaagttgctaaattcatctaaaatcatgatctacatgtttctttactttatatgtactgtttatgcttgtttttgtactgtttatttggtttttattagtctttttcttcgttttgcgtgttagcttgttgtttccatcgttgcgaaggttcgtgagtgcgtcgggagtgttcagaagattaattgaagaccgattattgcaaggaaagtcacatagatcctaaacacaatcctttgagcatgttgatcctatatttaaattctctctttatttcaactgtgcatttattttcgaatgtcactaggtggtgtgaatctattcctttgttatggcctgtttgcattgattactttattccttgataccttgggttattataacttgactagttgagctttatatattggttcagctagatattagatatgattgcttagccatgcttagaaacattagcacactattgggataacttatgactcactattatttaatgatggcttaataatagttcacgatagtcaatcgtgattggttaattaattacttgccaactaaaacttgataatggtgggttgtgagcacatggttttgagagtcgcgctcatgacaattaaggaccggttcgcgagctactattgtgaaacattaaccgtgccaaccacaagccaacgtgggcaacggctttaccttttgtatagcatggttcattgcggagcaccagactgagaagtggcggagataagtccacgggggtcgctggggagtccaagccttgtttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtatagccgggtatggttgttcaggatggttgggcctgtgcagcatgggtgtgctgttcagtgttgattaaaatttctaattaattactctactgttttactactcttaactctttgctaaatgctgctttcgcaaatgagactatattgtgccatcctttggtatccttgtgcatttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttatatattaaattgtcagtttgtgtagctcggctgattcctggatgagaattttacgcacaaataagttcaaaaattactagtgaatttccgggcgtgacacacacataaagtactattcatgttctatcgtttaataacaataaaaatactaatcttaaaaaaaaatcaaataagacgaacggtcaaacgttaaacatgaatagtgtaaagctgtatttatttgggatggaggaagtataaattataaggcctatattttttacacagtcttcaacgacatactttgaccattaatttatttcatattatatcatcaacaactataaagttaatattacatgaaagtattttaaaatgcaatcttattattaacatatgtaatacttgttgtagatattgattattagtcaaaagtcaccgattttgattttttttaaataaggacgctttataattcgaaacggatagagtagtaggatattttacatccaattattttattttacagtggggtattatttagttgagtatgtttcttttttctcatacaccttagagaaaacggaggaaaagggaaggctgggctgctccgtgaaaaggaaagatttggttgcttaccagattctctattgtatagctcggctcgttttctaattccagcctctcgtagagtgaggtcgatactcgtagagtaggcagctgcttcaattttatccaactcacatgtaactcttttagtaacttatgaatacaataagtaaattgtaataatgctcggcacaccaacttcacatcatattaaataacttaagcttcctttcacacatgtattccctcctttctaaattgatcatcatataatggaattcaaaatttctcaaattaattattatataaccgcatggacacatatttcatcagaatacaattaatgtagcatggaaaaatatacgcatgctaagttgtgattggcattgtgttttaatcgatgcatacattatgggagaatgtgtgcatgatgtcttaattgatatgatttaaataattattgggtcctgtttagaagattagcccagggctaatgtttagtcatgaattggtaggctaaacattagtctagggtagtatgtttggatccatgggctaattcaaggctaaaaggtggagacagagggagagagagaactgctttttatggtccccacataaaattagccccattagcaccccttggaggggctaatgttttaaggggggctaattcactttagcctcaaattagcccacctgtttggatcattgagggctaattcaggagtaaaaggtgggggctaataattagcccatagaaccaaacagggccttggtcttgtctcttggtgcataatatatagtataataatcaatttgggaaggagagagtagttcactccctctgcactcatcacttttctcgcaaagccaatgctcatcgtccgctctcactttgtctctcctttcctcttctctcctctctcatacagcttaccactgctcagggacggagctacattgaagagtggcggtgcccaggaacctgatcaataattttttttaattttttttaaaattatagttcatctatttttatcatatatgtaccccttcaatctaaactcagacgctcatatcagactaagctcagcctaaaatagagtaaagcaagtgagtgttatttcttcccatttcgttctagctccacccttactgtagctgaaatggtttctcctatggttagtctaggttgtactactgttgcactcgctagtagcagcgctgcagcagcagcaaattcgagttcctttctttgttttttatctttgttttcttccttccttggcataggccggtttagctgagtgcgtcgtgtattaaaactctattttttcaatttattgacatacaatctagcagcagcagcaggcatcgagatgggcgcagcggtgaatgccccctgaaacggaatggaagccgcggacaagacgacgacgaggcatcggagcaagagccgggccgatgttgtgggattcggtcccgccagcgtacgaccaaccccggccgctccgcgcccgcgcgacccgcacgtgagagcaccgcgcccgcgcgcgcaccaccacgcgctggaaatgctcgccgtccgtctctacgctaggcagcctcgcccacacgcacacagccaaagccaagacgcccatccatgtggtgtggcgcagcgagctgaactgctgaagtggtagtggtggtgtggtccatcgatcgatctgtgcagcagcagcataagctgcttggtggtgcgctcccctctgcgcggcggacccgccatcgttgatcaacatcaactggggcgcgatgctatctatcatcaaacaaagcccgggccattgtttgtcatcatcgatggatcgtgtggggatattgcatcagagctaagcaaacacagacaatgaatggtccagtggggaggtaaagagatttatcctggcgatcgatggtcgggtactggtgtctggtgcagtagtggtttttgcaactttgcatgcagtactccacttgcattgggagggtattaaggattggtgtacggcatcaccccacgcgtgcttttccacgcttttccaggacaaagattttgatgagcagggacgaaaggtcaccacaccagttcaccacaagcctacactacacactagtactacatgtctacatgtaagaacgaaccgtctccatttttcatctttttgttttcgtttttgctattttacctagtacgatatattttttaggtttttgcctttcaatttttcacctttacatcaagattcgtgttcctatacagagcacttttatatacttggttatagagcacttaaacttagttacaaagtacttcctccgtcctaaaatgtagacattttttaggttggcacgggtattaaaaaagtatgtgagaatgattggagaatgtgtatgattagttgaaaagaaaaggaatgtgaatgagaatggttgtgattggttgataggaggaggtaggtggaaaaatagcttcattttgggacaagacactgtgttagaaatagctatattttaggacggatgtagtacttacattgagctacaatgaatcaaaattagattttacaactgtttttgtttctagatttatgatttttgacatattcatcatattctctttttttaacgaatcggcgaaccgccaatttcatggaatacatgagtaaaattgtacaggcacaagacgcaagaataaaaaaaatgtgcaggctcaaggcctttggtcgaaatgcttcgcgcccgccaaggttcatgtttttttatcgcttcctccttaattttggctgttaggctagtcgtcaagagctctttttgctggaaaaccctgcggttccttttgttccaaatctcctaggcgaccagcagtattaatgttcgaaggagccttcggtgcttcgctagtccacgcagtagcctcccatcactcagagcaagtataatagtaggctataagccagctaaatgctaaggtggaggagaaaaaagaggagaaagaggagaagcgggctataaaattacagccggtttggacactctttttatccaccacggagatcagataaagaggcgtgtcggtgatatgggcccgggggtatcaggtttagagggaggaggccgcccctcgatgccacgtggccctcccccgaggggagtcaggcccgaggtggggtggcggccactccttccccaaagactagtcggaggaggctgccccccaatgccacgtggccctccccacaggggagtcaggcccgaggtagggcggtggccactccttcccagaaactggatggaggaggctgccctccaatgccacgtggccctcccgcgaggggggtcgggcccgaggtagggcggcggccactccctgaccgagactagagggagaaggccgccccaggtgccacgtggctcccctcccgaggggggatcgggcccgaggtcgggcgccggtcaccccctcccgtgactaggggtcgggctcccccgaccccctctctaggtcaccacgtatggtgggttaggtgtccgcctccaggggcccacctacccgcatttatggcgtcccgagcggtcgcgccacgccgcatgtaatacggtgtgcagtgcacccaaccggtctgtgaccagtcgaatgactgatgggacccaagatgtcaggcgcaccatcgcgtgtgtcaggcgacgtgtagcccgacatatcccatcaaataatgatggtgagaggttctcatcctcttatcccagccggagtcggtcctcccgctttggtcaaagcaaggctcctgtttcccggtgtaataggagcccagaagtcttcacccattaaatggtgactgacaggggcaccccccgtgtcaggcggcaagatttgacaggacccatcatcaagacgacgtgtgcttggcttcccaagtcaagagacaagacatgcatttaatgcaaagattataatacttatccaccggagctaggttaggttgttgggcccatatggtaaccccttgaggtataaaaggaggtccaggcctagtggtggaggggggacttccgagcgaactggcgtttgggtctcataaccccaagcactggtgttctacattcaatcaatcatgcacaggagtagggtattacgcctcatagcggcccgaacctgtataaacctcttttatctcatcgtcttggaggggcctaaccccctcaagatcacacagctccgctcaccaagccctcgaatctcacccgctgcccccggccgaactcacaaaggggggcctcacggttccctggtggaggagttcattctccgacatctggcgcgccaggtagggggcgcgttcgtgatttttgaggttttttcgagcgccggcgtggtgagtgtcacaccgccgctacgggggaaggcgcagcatcctctggagtgtcgcgccaccccaggcaggggggcaaggccccccacatccccaccgggtaagcttggctaccaggtctttgtggcgagtcttcggaatgtccgagggcccccaaagctccagccctacctcaccgagaagtacgatgatggcgccgacccctccaagtccctccagatctgcatggcgatcatagaggcggcgaggggtggcgaccgggtcatggcgaacgtcttccccatggccctcaggggccaagtgcggggttggcccatgaacctgctgccgcctcggttcactcctaggaggactcttgcagttttgagctccgggtgccgtcgaagcccgggaccccctgtgctggctcttctttagcgactggctttggtcctgccggctggctacggtgtccggcctggctcaactgatcgtcctttcaagcttcaagtattttcaatttttcaattcattagcttgaaatcttatatttgtttccccccattctattctcatggccctgcgacgcccgcgtgttgcgcatttgtttgctccctcggtggtaagagcccaacctctctcccatctacatgaacgattcttcgctaagtgtgggggctaagttttctagccttcagttgagccccgagtgccgtcgatgcccgagaccccttgtgctggctcttccgtagcggctggctttggtcccgccggctagctacagtacccggcctggctcaactgtggatggggattgctggctctagagttttcggctctcacactcatgcgaaagtaatcgtccatgtagaaggaaaagagattggaagcaggccaccgaaaggaaagagcaaacagaatgtgtagcgtggggacacaggctcgtgggaacctgacctcgtttgctaagtggtcacaggcttcccaagatggttcggaacccatggtggggggtcctcttcgagctaaaggtttgtgtttgcttcattcatacaagcaattctttgctataagtgtgggggctacgattcctagctctatcctagccctgcgtcgagctctgggtaccgtcgatgcccggggccccctgtgctagctcttccgtagcggctggctttggccccgtcagctggttacgacgctcagcttcacttgatcacaggcgaagattgttggctatagaaagttcagtcctcacactcgcgcgaagataatcgtttgcatagaattattattgcttatatttatctctcgcctatctcttcctcacggtcccacggtacctatgtgtcacgcgccggcttgcctcccttggtaacaaaaagtttgtattcgcttcatccattcaaacgattctttgcttaaagtgcgggggctacgatttctagctctatcctagccctgcgtcgagctctgggtaccgtcgacgcacggggccccctgtgctagctcttccgtagcggctggctttggccccgtcggctggttacgacgctcagcttcacttgatcgcaggcgaagattgttggctatagaaagttcagtcctcacactcgcacgaagataatcgtttgcatagaattattattgcttatatttatctctcgcctatctcttcctcacggtcccgcggtacctatgtgtcgcgcgccggcttgcctcccttggtaacaaaaagtttgtattcgcttcatccattcaaacgattctttgcttaaagtgcgggggctacgattcctagctctatcctagccctgtgtcgagctctgggtaccgtcgacgcctggggccccctatgctagctcttccgtagcagctggctttggccctgccggctggctacggcgcccagcttagcttgatcgcgagtgaagattgctggttagggaaagttcagtcctcacactcgcgaaaataatcgtttgaatagatgaagtagaacatgaacagagattaacaaatggcaggagcaagcgaggtacgcggcgtaaagacacgggcccaagagaatctaacaacgtttgctgaatatatacagaaaataagttcacagcctaaggtacgggctagcgaatcgccctcaggctagggcgaaaaaggcgcatgggtcctagtgccagcaaagaaagaataagagatcgggcccacatgtcatttgactaacagagtggcgtcaaccctgaccacctaggaaaagttttggtcagggctaacgccgggggctactgtcggtgatatgggcccggggtatcaggtttagagggaggaggctgccccccgatgccacgtagccctcccccgaggggagtcaggcccgaggtggggtggcggccactccttccccaaagactagttggaggaggctgccctccgatgccacgtggccctcccccgaggggagtcaggcccgaggtagggcggcgaccactccttcccagagactggatggaggaggctgccctccaatgccacgtggtactcccccgaggggggtcgggcccgaggtagggcggcggccactccctggccgagactagagggagaaggccgccccaggcgccacgtggctccccccccccccgaggggggatcaggcccgaggtcgggcgtcggccgccccctcccatgactaggggtctgttgaagaaaaaatcgaacacaccggcctgggagatctgcttagctcctgtgcaggtccaaagattaatgagatgcgggcgtgccagtcagtttaatcctgcaactgacaagatttgcaaannnnnnnnnnnnnnnnnnnnnnnnnnnnnnnnnnnnnn

SEQ ID NO: 23520 - DNA, 14647 bp, Oryza sativa
gatatagtagaacaagtattgatccgaaggttaaagcacccatcggctagaggtccgatgtcatgaaatccacaagattagattaaacaatgaaacctttgttgccatcggctaaatccaacttatatgtatatgcaatccttatgagccgatgcaacgtccagataactcaccggctgaaaccccgatgaatcccttattggcaatcaataagcatgctagagattatggttctaagcacgacttagtagatcaaacttaactaatgcaacactaagtatgaaaagaaacacaatatctagacaatcaagtcgttgactgattttcagggtggtaaatgcctaggctaatctaatatagcaacgcgatttagccgataccggcagaaaccctaaagcgagagacagccgatagagctaaattgatatgctaagactagattaacagagacatgataaataggtaggcaaatatatcatccaaaccagagcaatccaagaggtcgaatatactgatgcagccttgaacgacgccgatgtagatgagacaattgcctggaccgacggaacattggacttatcccttcgccggagatcgaagacgatgcagccctgcgttgggtgccaagttctgccggaacgtaaaaaacaaaagtagaagtaaaaagggtggcgatgcgccgaattatattgatcgtagcgataaactacatagaccccgggtgtacatatttatacccatgggttgatacaagtccttgtcggataagaaagtacatagaccccgagtatacatatttatacccatgggttgatacaagtccttgtcggacaagaaagaaactttcctaaagataaaaggaaaagataaaatccttataggacactaaacacactttcctaaagataaaaggaaactaacaaactattcctaattaatagataacttgccatgccgcattctctttgaactcggtttcttatggataagcttcctttagtagatcaatttccttaaccgaatatagcaagaatccgacaactgacgacttgacaactctcatcggctaatctcaggacttcgaagccgatgctgactctaagccgatgactactccgggcttaccaaatttcactgttaacagggtcgggctcccccgaccccctctctaggtcaccacgtacggtgggttaggtgtctgcctccaggtgcccacctacccgcatttatggcatcccaagcggtcgcgccacgccgcatttaatgcggtatgcagtgcactcaaccggtctgtgaccgatcgaatgaatgatgggacccaagatgtcaggcgcaccatcgcgtgtgtcaggcgacgtgcagcccgacatatcccatcaaataatgatggtgagaggttctcatcctcttatcccagccggagtcggtcctcccgctctggtcaatgcaaggctcccgtttcccggtgtaataggagctcagaagtcttcacccattaaatggtgactgacaggggcacccccgtgtcaggcggcaagatttaacaggctccatcatcaagatgacgtgtgcttagcttcccaagtcaagagacaagacatgcatttaatgcaaatattataatacttctccaccggagctaggttaggttgttagacccatgtggtaaccccttgatgtataaaaggaggtccaggcctagtggtggagggggggacttccgagcgaactggcgcttgggtctcgcaaccccaagcactggtgttctacattcaatcaatcatgcacaggagtagggtattacgcttcatagcggcccgaacctgtataaatattttttgtctcatcgtcttggaggggcctaaccccatcaagatcacacagctccgctcaccaagccctcaaatctcacccgctgcctccagccgaactcacaaaggggacctcacggttcactggtggaggagttcattctctgacaaggcgtttttttttcccctcctcctcgccctctctctttattaacgtggccccatgtaaacccggctctttaatccccccgcagcgaaatcaaagcgtcggtacccagtacataatacctccacggtactcgtactcgtactccccaactcatgtggcaaacaaacgtaatcttctcatcccaccgacggatcgatcgatccatctctaccaaatgcgccccgcgcgtacgaacctatcgatcggtgtacgacgtacgcgcattccgcgaataatccacccctgcccctgcccctgccctgcccctgcctgtcacgctacgatatttaacgtggctgttggcctccgtttgacaaccacgcacgctgcgcacgcattcgttcgtgcgttcgttcgttcgttcgcacgcattgatgcgcggtccggatcccgacgccgctggcacgcgcgaggacatgcccccgtgcagctgctgctgacctcgatcgctcgcgcccggttttttctcccccctctttataacccactgaaagccgagtattattccaatgcagcagcagcagcaatcataaaatcgcagagaaaacgagagagagagagagagagaccattcttcttcttccacggcctcgctactctcatgagcaaggatgaggagggtgtggaggaggagcagcagcagcagcagcaacggcccaatgccatcgttgggatcgcaggagtcgccggcgacactgggatggccggccggtgagctgaatccaagataggatatagggaggatcgatatataggcgaaaaaatatggaggggagttttggtgatggtgatggtggtggtgggttttcggtcgacggccggcgctgcaatgcggcatacaagggaaagccaggcattttttttgctgttccaagtactacctttcctttagctttcctctccatggaagaaaaaagaaacggttgcattattcatgtgttttctctgttgttaattaactcttgaggttgattaattacttcggtttttttagctaggcaagttaactagtagtagtttctgctacagatggtcaatgaagatcatgctaagacgacagtcacactgtatatctgcattgattccttccttctagattgttatgcattttcagatctctctctctctctctaaccaatacgtagctattggaagaattaatgtatgtccaattcatctcatcatctgtgtttgttgttgttgttgttgttgttcgaatccctgcttttgcacagtcactactactgtttcttttcggtgtcggtaagcactcagagtgctagtatgttcgtctgacagaaagttaattaattaacgcacagagaaggagataatttacagagatcatggacagttccggtcagattttgcggtgctgcatttagattcatcatggttcatggatcaattgtccttgaaagaaccattaatgtagcaaaaatatgtggtagtactgccatatattctggtacttgtgttccaatctgtctttgctttcttttttgtcattggatttttgaggtgcctttagcgtgcagccttcgctcttgactattgcaccccggtaccacgtaccattgatgttcagttgggagaagttcatgatttggtggtagttgacgaatgctactacaattctcgagtgtaattatatatttgtatcgtactttctattattgcacccttttgatgcaattctttttctttccaagttccaacctaatggtacttgttgattttgattatatattcattctagtgcatgagtatctaggcgcctaggcctggacacaattctgctgtgttcttctgtactgcttgctgaatgttgcctgctctccaaaattttctgaatcctttccattagagtggtttctttaactgcatactcgagtaatacattgtacgaatacgcgtatatattcaatttagttgcattttttttctaataatgaaggattgaaggtatataactacttttggtctctacaccaggattacaatttaatctcaaggctacaccaaaatagcatcacttgatctaatcatagttagggggtaaaaaccatatatcttgctgtgagcctgtgagcatttggagccttatcccacgtggtatattgtaccgtgaacagaatctaactctttggcaatcaacgaattcatgataatgacatgagagaaaaagctccgaattgaaatttgaaagggatgccctagctctagtgtcggtacggtgctttgtacatgcaggggtcattgccatccttcataaatcatatatttatggctcctttaaaacacagaaataagaaaaaaaacttcatccaataagactgttgttatagaaagtcagaatataaataaaaaggatgaaatggtattaagaggtctagtggacccacaactaaaaagacactctttgggacaaatctaaaacctataaacccctctttttaggacggagggagtataggattgcatgtataaatataaaacatagatgaaaaatgtaggaaaaatatactccctccgtactcgtaaaagaagttgttttggacagcgacacggtctccaaaatacaactttaacttcttgtttctataaaaatatttattgaaaagtgatatatgtatacttttatgaaagtatttttcaagacaaatctattcatataatttttatattttcaaactcaacaacttgagagttattcatgatttatattcctatggtttgatttaaacattgtcctaaatgacttcctttacgagtacggagggagtaagatagattgtttagaacaaatatgaacttagtaaaacacaagaatcataatgtcgttggtcaatttatcctcaaattatggttctttagagctttcattattttatttagcttggacttagctaataaatgaaaacaaaaaaatagggcttggtagatgttcgaattcatatggaatctctagcaaaggaaaatttccctctacctttcctatgcccaaatccttcattccaaacaagcgaatagtgccaaatacaatacaaattgaaatcatccatatttcctacaaaattcctacaatccgaaggagccctcaatgtggcccttaacatgagggttggatctcatgagaacttttctcaggtctatctctctcccaaaatcctatactttttctatggagcatccaacaacaagttacacacaatttctgcattctaaaactcctatggatcaactagctagtatgccacgtcttcctacatttttcctgtttctgtatttttgaattcatacgctccaaaggaaccctaaagaaaacctaatttccttccaaatgaagcatgcaaattcttaaatagtactaccaaattttatatttaggacatgcttttagagccatgtatacaattttaggtctcctttgaatttcagaaatttaatttggacgatttcaatccttgggatttttttctataaggtcattctttttttttcaattttcagatcgtccttttgcacgagagaatatgattgacaaaatcctaaaagtttattttatatacctccattccgtacggaatttttcatatcataaccccaatgcactctctcactctctctgctcttacgaatttttccttactattgaaaataaactaattctaaagaaaatcatgtgctccatatatatagctccaaatattatttatgcgtgttggagtcctatagatcaagttggaaatggcgttctactcgtacatttatccctttcttatgcgtttttaacatacttgtgtttgtttcaaagagcctctatagaccaataagaaacttcttttttactgtgaccgtgaagcttagagcaggtataatagcagactataaaccagctgcaaatatattttaagaagataaatgagatgagagaagagaagcgggctacagatttgtagctagttgtagcacggactccaagacgcagtgtgtatgacagatgggaccaggtattaatagtgtagtatgtaactattgtgtgaatgagctattagattggctatagatgaattggagctagtagttaactatactattaaacttgctcttatgtccaatacgggtgaggatcatctatcataacatcagcatcattacagtcattggtatgtgggtcactacctcctattatcacacatatcagtatatataatgatggtgtcattatgaagcaatataggctgtgtttagttcgtgtgtcaaaatttttttaagtatacagatacacacatgaagtattaaacgtatactaataacaaaacaaattacagattccgtctgtcaactgcgagacgaatttattaagcctaattaatccgtcattagtaaatatttactgtgcatcacattatcaaatcatgacgtaattaggcttaaaagatttataacacgatttatatgcaaactatacaattgttttttatctacatttaatgctccatgcatgtgtctaatgacaaaaatgttaaaagtttaaagaaaaaaattgaaatctaaacacggccataatccaatactcccatggccaatggctgcacgctttggcattggtaggaaaccttcaggcccaaccaaagaggcatttgaccaaaccgtccggaattcagtggcctcgggatccgttctttttcccgagcatgcgtgcggcacagcgaaattagctactcccagcaacaaagatggatcgttactccaacttgatatggtttagctaattagctagctttacacagcatcatactatcatactatactattactactataatcgtcaccattgatttctttaatcaagctatctaatcctatgtgccccctgtgttgttgagctgctggttttgactttgttggcaccgagatatatgtcatgagaattggtgtccgagacttgaatggttggtagctttgacgctagcttttaggatagatactcctatgatatcagtaaaaaaaacacatacacaaaatgaaatattaacagtgtttggatcgttcagatagctagctagcccttgaatacttcggttgtatgcatctcagctgcttcattatttcttaatccatcatgtattattctagtatctcgtggtgttctgtgtcagatgggcctcgttaattatagcttagcactgttgtttcaaaaatctgcggcttgcttcgcgcaacacattgactttctgcctgcatctgtaggcgtaagatctccttggtttgatgatccatgcgtggccatgttaatttgggactgatagggatccgtgcttttgtcagactgtcagtgtgcagcgttgatcatgagttagtacacctaatatgttcatcttcatcgatatctcaaacatcaattaagaataaactgaaatggccatacctctattaagagtctgtatcttatcatgccttgttaatcttgactgtctcataatcagccaaccaccttttatattagcgaccgacggcgaagaagaaaggtgatcaccctaacaactagctagctactcaccattttttgaaaaaaaaaacaaagaaaaaagaagaaagagaagaagatgtacgccattatttcgctccggtcaataacccgtaaaaaagcgtgacaatggaataaaagttaggttttatttttagacttgtacatgctgttgaggatttaaaggcaaagactaaagaagacaataaaaaacacatagaataatttaaatttaaacgttggctatggcttactttattaaaaaaaactaaacttagaagagaaatgtgatcccttctaatacaacaaatctcttcatctatttaaatttatggtagaggagtcacgcctctttaacattgatttttttttttggatagtgtgagtaatgcgctaggtacacgtacaccagtacagttagtacagcaacgtacagtgtgcgtctctggaggcgtatacgtatccggtttgatgagggcatggcccatgctagatcgccttggctttccatatcaaaggacacagggtttttactcgaatcggcacaacggtgacaccgtgacagaatgcaacccaagaagcagctgcttgacgactgtaaaaaaacggaagatctgattctttttttcacctgtcgtacgtacgatcgacaggcaaacggaaccgacaaatctgacatccaaaggaacatatatactcccatcttatcgcgtcctggctagtaaaggggtacggatctcattccagggaggcgagaagatcctcttcttccgtgctgattgtcaccagcttgtgattcgtgagtacctatgatttgctgtacatgtgtagtaattggtgtatacgggcatacggcatacggcattgaggagtgaggaccatgtttttcaccgtgtacgtaactagtgcatgtaatcctgtttatgcttcacggcttacactttgtgcagcaaacaagaaaatgttgtacacgaacagagcagaatttatccaggacagggactaccgtggccctgtgcctgtctgcaagtaaaatccgatcatccagagttccagactgcttgcaaatctggactagaaggagagggcatcattcacagggtgatatggacatatgggacaagggcatgcaggccgaagggaactctcacaatggcacaaggaatgtttcgaaccaactgtgtacaaacattcacaccaaataaaaataaatgagatcacatgaatcaaaatccaagaaaaagagcgtacgtggattgaaccacatacacttttgaatcagaatagtgcatcaacctgcctactcaaaataactccaggtacaggttttattttatattttttttaatcgaacaaaacaatcaggcagacaatgtacatcgcgagagcgggctggttacgatcgctttgctttgatcacaaagcgaggccttccttccgaaatgagattctgctacacctgtgcaccgcgccgcttttcacaggcccatcgaccgttttcacgggcttttcggcgtcaattatcgcggtggtattttgtttggagtcgattgccttttgttcctttctgctctccagaacagattcaagcccctaaaatgtgcacaacacagatatggattggcataaagaaaccgaaattacctgaatggaggacaaacatctgcatattaattgtgtattaccttcactgcctttctttcagactgagccaactctgtgagcttgagtttttcattagcttcctgtggaatggagagcatagaaggatcattacagcacaatgagcagtatgagccaaaagaaaagcgaactatccaagataaggcatccttagaccttgcatgcaatcctgaacctttataaatgatatctactcacctgaaaaaacttggcatttattccatcttttagacctccagctatttggcagaggtaccatacaccagcattagttgcatcctgtcggtaaacacaagaggttaggcaaaaggaaaaaatcagcacgttaaatattgatgggtatgtttagccacctgtttattatcaagcaactcgatcttcccttcctgataatgtcaaaggagaacataaaggtcaggataaccaaagaagtgttctgacacaggttcatgctcaagggttataaactaataaaactcaccaatccagcaaccatctgttggattgctgcaatatcaaatccaatttgagacagatcatctttgacatcattcacctgtgcatagagaacagaatcatgtcttttgcataacattgggaagaacaaaacttttctgctttcgagaagaaaatgaaaaatgctgtaaaatttatctttccatagatgagtacttgcagatttacagtagctatttttaagaaggtatattttaatgcaactaaagaccattcattgatgacaaatatcattatgcttatgcttgcgcttgtatatattcttggcttcatgatgttgttttatggtttatgggcaagatcgatcacttggaatatgctgtcaatgattatagtaaaagccaacaattccaccatatttcaatgcatatcctataatagccatgtcaagtgcttcctggctttatcgagggcacagtttttagcttgaaacaatattggcatgacaaagaaaatcctgatccaccttttcagatgcgactacacaaatcaaactaataagagttatgcacctcaggtagaaacacaatttaataataaagttatcagatgctaattagacttgatgtaatgaaaaaaatgaaacaataattattgctccagagaaaaaaaaaaaggaacttcaaaaatttccatgtgtaaaaagttgaagggctagcagcatcacaaatcaacaaacctcgtttctaataattttggagacctccacttgctcatccattttcccatctaaattttccaggcgctgacttagatgcctttttgttgcctgaaattaattgaatttagaaaacactagtcagcatatgcgaaggaaaactacttcaaatatgtaacgattcagcatgtaaagcatacagctaaagctgaagacacttgatccaattgcttcgacatactctcaacagctttggtcatgttgcgtttggtaacaaacatgacatccgataaggacaatccctgcaggaagatactataatgtaagaaaagtttaacacatacagttcatcattgtactagtaatttagtctacaaacaccattaggacaagacagatttgatggttttacttaaatactagggcctagggatcatgaaaagagtctctcaacccgaaactgtgattcttgatagaatatttggtcacagaatcagagaggtgttattacatgactaagaaagcaatttaatcccccgcccaaaaaaaaaagaatgtggtttattcatgatgtctcaaaatacatacaagggtgccaaatgccaattatatatcaaagttggatacttggatccacatagaaccactgggactgcatggaaatactttacagggagacttaggtagcatagttcttaagacatataactacaagaaacaaggtaaacaagcaaatggggaacatcatattactctcttcattcagttactaatttattgaaggctgtaagtataataaaaggaaaaggatagtaaggagtgtttgtggagaaagaaagcaaggaagaaaaatcagaatataaaagctgatagatcaaagtggcattgtatattcctgattttaccttccaccacatatagcagtaacccattgctccaactgcagctgcaggcagtatgtaggaggataaactgcctgcaaaagggatgcaaatgctagtgaataaacaacacggataagaaaaagatacatgtcacatggggacaagtagctagtgagatatgttcatgaatgttgtgagaaacagctgaatgtaccagcattcctatcccatttgtcattacattgctattattgaccaatcaacatgattcatactgtaatcgctgaagcatttcagcttcatgaattactcaatattgaattagagaatagagattgacactctttaacgagttttagcaaaaatatgactattgaccactttttcaccaaggggtggtagccttgtagaggagctgatacaagccaataattgtctatctaaaccttaagattgacaaataatctaagtaaaaagatgtaacaaaagctttatatggatagactctttgcatgactgctagaagagtgaaactgaaaacagaacgaggagaggatcaaacaagaacaaacctccagagtcggagttgccactcaatatggtaataggccttgatatagtcaaatctctaacttcttgtgctaaatttcgaatctgcagtcaagcgccagcacacaaataataaaaacaacaaactgcagtggtttttactgaaactggcaactttattgaaattgaagtctgcattgtaacttccattcaactgttgattctatgaaaaatatgaaacgatgcatacctgagattgaagaagggcgatgtcataggcactcgaaccttctccttggtttacacctttcataagctcctaaaaacagggaaaaaaccatctacttcaataaacatctgcgattttatgagttactacaaattatagatgaagaacgcatcatcatagccattgggtgattaacttaggcatgacattccaattggtgcatcgaaatgattcgacattgaaattaagcgacaaaaagttatgcccatgtgcacgcccaacgtttgatcggtgaaatgtagctgtaatgcatttgataaattggagtcccacaaacagatatataaatcacaacatcgcttgaaacacacacgggcaacactgacgcgcctatattagcgtattggcaacttacgatcgataacgcgaagcaatcaacagaattagatgcccagaatccaactactctactcaagaaacatcaggcaatccaccgacctgaagctccgccaacacgtcagatagccggccattccgcagcacgatcgagctcgtcaaccctgcagctcgacgccggccaaaaaccaccgcatcaggatcagaacacagcggggcgatccgcatctcgaatcgatgctagaaaatatagtagagcgggaggaggaggaggaggaggaggagggggaggttgcggtgacgagacctgcgccgacgaggatgaggaccttggaggtggcgaaccccgtctgcatcgccatcccctcccgccgctcctgcctccggggctccccccgtctcttcctcgcgtccggcggcggggtcggtggcgaggtcgtcggcgaccgcggggaggagagagagagagagagaggaggggagattggcgaagcttcgggaaggggaaagctgacggcgaaggcggaggaacgtggtgactgacatgtggaccccaccgctctcgggcccacctgtcagtgaccacgtcagaggggtgcgcggacaactgggcgagtggtggggttggacccggcttcgcttctgtcgatggtttggcgagcccgacccgagccggtttacacgtggacggaccggatttacccattggggtatttgaacggggatagcgcatgccacgctgtgctctagaatgccaagtcagtgcacgtaccacggcattactgcgtgaggcctgagcgtggatttttttgttatgtcttgaacctttttatttttaattaaaaaaacaattgaaaaaacttattttaaaaatttgaatcttttagctacgcatactgtcatgccggtctgcctaatgttccatcgttatttggtcacgccggcctaacggatgtgacaatgttatttggcctcgtcaccctgactaacgtgataagataaaactatcacgcccgttgtggtgacgtgtcgatgttatattgccacgttggatggaatggcgtggtcaaaagatccatattttgaagtaagctttggaatggttggatgaaaatttggatattcatgacatgcttttcaaactactaaacggtatgttttgtgtaaaaaaaattttatatgaaagttattctaaaatatcagataaatatattttttaaatttgtaatacttaattaaactcaattaattatacgttaatacaatctcgttttgtataaacacttaagcttcgtcttaatctgtatgagtttcaaaaatcaccttagcaatcaaatgtttgaacacatacacggagtattaaatataaacgaaaaagtttagatcctctagcaaaatttttcgccatgtcacatcaaatatttaaacacatgcacggagtattaaatataaacgaaaaaaactaattacacagattgcgtataaaattgcgagacgaatcttttaagcctaattgctccataatctgacaatgtggtgctacagtaaacatttgctaatgacggattaattaggcttaataaatttgtcttgcagtttacaggctaaatctgtaatttattttattattagtctatgtttaatctataactaatataaatattcgaatttttccggtcgtcacactggtttttcgtcccgcttcgtcgccccccctcccccaaaatcccaatccgaatccaatcaaaccccggaaaaaaataacaatcacaatcggagttcaatcacacaaatcatgatgcatgtacacatatatatccaaaccaaaaccaaaaattagatcaagggggtcaccaccgccgtcgccattgccgtcgcagagacggctggccgccggcggcttccctcctgctagatccggtggaggggagagcgccgccaccgccggtccctcccgttagatccgccggcggtggcggcggagggcgctctccggtggtaggggagagggccgccgccgtcgtcggtggtgggagaggactccgccgcccgcgctgctcgcgggagaaggggcgccatcgccgccgctcgcggggcacctcttctcccgctagatccgccgccggtggtgggggagggtgccccccactcccctgtggggggtgggcgcgccgcccctg

SEQ ID NO: 23521 - DNA, 5597 bp, Oryza sativa
gctcgggaggaagggcgccgccgcggaccgccgccgctcacgggggaaggggtgccgccaccgctcgggggcacggaggggagggcggcgaagtgaaatgggagggaggggagggaaatgggctagggttttggcggctgagagggagggggttttgtttccccgatatcgacgctcggccgtccgatcaaaaccctagaaatcggacggccggtgtcatccgggccgaaatcggcccaagagggatcgagagtgaggccacttttctggctcaagcccaggttgcggcttggggaggggaagtgagcccacgcgtgcgcaaaaggccgtgggccgaccggtaagggccgaaaataagtctattttaggtccctcgggccgaaaaaaagagagaataagttcatgtttagtgctcattttttcagaagcattacaattatagttatttctcacacttactttacttgtaaatttatttaattatacacatatacctacttaaaaatatcaaatatttcagcgaatttgtattttaattaattgcatatttttctgatatgtacgcttcccgttgcaacgcacgggcacttttgctaaaccaaacaacacttttggttaatatacacactccgtaatcacccggtgcaacgtacggacacttttgctagtactttaaatatgtgttcatatatccaatatgacacactaaaaatttacaccctgcatctaaacacagcctcaatcatgaaatattgaattcctatttttcaagaggatatacgcggcatgagcccatggacaggcatttaccgccgctgttccccgcctagccacgtctctgccacgtcaccacggccactccccggggaagacgaccgttcaaacccgccgcgactacccgacggcggcgcccatgccgccgccttctccctcacgccactcccactccggccaccgcctccacctcctcctccccaatccctagcctctctcgcctcgccggcgccggcgtcgccatggcggcagccgccgcccctctccccaccctccccctcctcctcctcctcctcaccttcctctccgccgcctccgcgtcgccgcacatctccgccgtcatctcccagtcgggcctcgacttcgtcaaggacctcctcgtgtcccgcgccgcggaggccatcgtgcccctggaggtgcccgacatcgagaggtccgtgagcatcccggtcatcggcaccgtggacatggtcgcctccggcatcgtcctccacggcgtggcggtcgacgactccaccgtcgccgtcggggacgacgggatcgtggtggccgcgtcgctgtccagcgttaatcttactatggggtggagctactcctatagcgcctgggtcgtcacgatctctgacagcggtaatgcctcgattcaggtatgggtcgcggtattcatgcgttcaattgttgttgtttttttcacagttcgagagatgatgctagattggagggggacttccatgattgacaagttaatgttcaaaattagtggtttagtgtctgaatttgcgcttattggcatgtatggaatgaaacatgtatgtaaagtagaatccagcacgttatgaaattgagtagctttgaagacactttcaaatctagttctttagttggtacatgagtaatttacattgataggcacaatagctggttacttgttgcacggtgcatattggggtgacatgtgggctgcctattaggagcagctggcatttgtgcttaggatttacttcaagatgatcttaactttttctctagatcattttagctcaatggagtttacaattctaagcacctaaatagcagcattgcagcaggcaagcaacatttcaataacatagatatcctatatgctcctcagttaatttgttggaattataagctgcttcttttttaaaaagtaaaaacgtctcagttgtgtttttgaaagtttacaccgaaacaatgtcacctatggcacttacaccttatttacctgtattatttgagtactagacacccttgacatgtatatatacgaaggtacaaaatgtattcatgattccttttccgctaaggttgatggaatggatgttgggatttccatggggatgaagaatcaaaatgggtctctcaagctgttcgttacagaatgtggctgtaatatgaagagcttggacatatcactgaacggaggagcatcttggttttatcaggggtacgtgcttcacaattttacatatgcaaaaacttgtcaaattaactgaggttgctctgtaaattgcttgtttggtcgttagatcagagggcgctcatcccttgctcagtccctgaaaatgagataacataggcttttgatatctgctctgtcaacaagccctggttcagtccctgcttcctccagcccttatcctgaaagaggatactttttcttccccactcatcttattaagcctttttctttgccggcttagcttccgtgcccagatagactttgactatactataaaagagagctagatgatctgttatcaagtgagaagaaaggctggtccagaaccaagcgaacaagggcttgtactgtcggaggttccaatggttccattcttgatctgatttctcgctatcttattcggtggcacaatacaaaacaaaatatgactcctataattgcccgatgtgggtagccatgcccattctaattctatttttctgtacatcagcaatatatataggaaacatggtttatatctgtggttagaatatcatgcaattttttttgtcaaaataattgccctatatattcctgaatgctgttgatatttatctgaccccacatggattgatattattcctcttaccttttctaggtttgtagatggtttcagtaatcatatcagatcatcagtagaaaatgcaattacgaagaaaataatggagggtgcatcaaagcttgactcattccttggaagccttccaaagaaaatcgatgttgatagcatcgctgctatgaatgtgacatttgttagtgatccactcttcaagagttcctctgtggagtttgatatcgatggactgttcattccatctgataaaactgcagtttcaagacacatgcattttagaggtgtaaaatatgtaccacctcttggtagctcttcaaaaatgctatggatttcattggatgaagatgttttcaactctgtttcagctctctatttcaaggtatatcagaattcataagaaagtggttgttatcatggttaaaggattaaagccttactgcagatgtgtaaagttgaaggattatctgaacttgcttttgtcaaaagatatatatatatatatatatatatatatatatatatatatatatatatatatatatatatatatatatatatatatatatattacacaaaagaaagatatatattttgttgattgtgtccgtctagagtagctaacttgaacacgtgttcatgtttgaatggaaacaattattccctccgtcccagaatataagcatttttagagttggacatggttactaagaaagtaggtagaagtgaatggtggagggtggagggttgtgattggttaagtagtggtagtaggtgggaaaaatgaatggtggggagttgtgattggttgggaagagaatgttggtggagaagttgttatattttaggacaaatcttgagggctaaaagttgttatattttgggacggagggagtaacaaatatgctaatagctgtaaaaatatatattctaattgatatgatacttggattgttcaggctggttcactacaacgtatggtggataaaattcctgatcagctcttcctgaatactgctagttggaggtttttgattccaaggttatatcagaagtaccccaatgatgatatgctgctgaatatttcagctacttcacctccttccgtgaggattaatgtgggtaggattgatgccgcagttgacttagatgtcacagttaatgttttggattttgatgagatagttccagtggcgtgcatatcagtggtgagatttttctaataatttcctttcctgatttcatttgatttcattgctagttgcttgacttatggaaagtaaacatattgaaatgtaacagtattgcaccatctggcagcacttgtatactgtccgtgttgtctttgaccttcagcatttcatattttctcccactgagaattttagaaatgaaatctatggcacattgagttgtgttcatgttttctttttttgtttcatccgttgatttacaattggacttccattatacataaacatttctacacgaggaaacacgtgcaatttccacctctttgataccgttgtcgcatattgtttccacagtcagttactgtctctggagctgcagtggtttctgggaacaatcttgctggaagagtcgagttagattatttctcattcaccttgaagtggagcaaagttggcaaacttcataccttcatagttcaggtattttggcctgtattatacgatttaatgacattccacagtttgtaatttatgatggtgtaatagaaaagaggtgagcttgggaatctccatcctatatttatggatatgcctaatttccaagagggactctgaggggctaactaagacatgcgttatcctattggaaagaaaaaagtaatttcggttgaaaatgccttcttcataaagttcttttacctagtatagcggaaaggcctaatttctgaatgaagttgttaattgtggagctgcacatgtattttattatcattggtgaacatttgtttcttaacttctgaatgtctaattgattctaatttttgtattggcagagtgtgatgcagatcttgttgaaaaaattgtttgtgccctatgtgaattcatatctcaaaagaggcttcccattgcctatcatcaaggggttctccatcagcgatgcatacatcctcacttcccagtcaagaataattgttagctctgatgttgccttcatcggaggtcatactccctatttaagccaatgaaagcatctggcaagaagtaggcttgttgctcaatcagcaaagcatcagaaatcgccatgtcccatggaacgtgtagtgctacttcctcaacatgttagcattatttcgttctgctgtataatgttcttttgtaaataaccgtaggagttgtacatatgtaaatctaggaaccatagaactgtagaaataggctgctgctatactggagaaatggtgggttggttgtgatgtacccacaattcttccaaatgaactggcaatatacttgtacacgttctgtcaaaaaaaaaaatgtacactccactgtatagtgttcagttctgtaatctatgctgaatttgctgtatttaaccataatctggaaatgtatcatcgttccagtatcaattcctgacttcttgtattggtaagatataaattatcactgcaatctgcctcactgaacctgtaaacacaaactgatctctctttattttcagtgtaggtgaatttgacattttacactatcaaaa

SEQ ID NO: 23522 - DNA, 15462 bp, Oryza sativa
aatatgcttcactgtcagtttttccatttgctgctctaacagaatcacaacataaatgcagccatatccacctcagttttgttattttgattgttcagggtggtctcccaatgtacatagcaactcgtggcctctataatttgaagccacccgttgtatttgtaccaccatgtatcaaggatgatgttgaggatctacttcaaatccatcgtagaatgagtcaagtcgaccttaaagtggaattggttgcgcttgatttgggtttgagctcgtttcacctcttctttctgtgtttctctctccttgtttatttctaatgtttctacgattgcattcaggggagacatttgaaatacgtaatgaccttgttgccagaccatttgagactcaccatgctatacccagccaggtataactccctaggtcaatttaagtatagttagcaagccaaaagttctagttctcacctttcttggacaatttagtgcttaataactatttcgccccttgtgcgggttgtgtacattcacagggttatgtcatctactctgttcggagaaagttgaaaaaacagtatgctcacttgaagggtaatcaaataatgaaaatgaagcaatcaggcgctgaggtcagctagcaatctgttctatataagaaatatattctgcactgttactcactgccttcttttctgtcagattacagatactatactatatccagaagttgcctttacaggtgacacaaagtctgattttattcttgacccacgaaatgcagatgccctgagagcaaaagtccttataactgaggtattggctttagattttagtttccttgattattgccctttctcccaagcctgtcaaaagtatttgttccagctgtatgtaatcagtcacatttagagatgtaatcattctcatgggacatgtcaaagtcagcaaaaagggtgtgaagtataatactccctccatcccataatataaggcgcgcacgaatttcaagattcaacctttaaaacatttgaccaacacttaatataatatgaaaatgaattttgtttgttaaagattacatcattagattgagatctaaatttactttcatgtggttataattttgttgctacaaatcttatagtatatgagaaattataagctaaagattagttttggagaccgtgccaacattgaccacaccttatattatgggattgggagagtagtataatacagctatagtcttgaaatatcagagaacagtaaaaggcagtctaagtaaaaccaccctattatattgatttgtcacatcttcagactgtaaaataacaaaagaacttcctttttatttgatcagagggtccatcaaatctgaaacatgacaaaataatttcaaatgtcctccctattgaatgctttggcaccaacattatttgaccttttcacaggcaaccttcctagatgaccaaattgatgttgatcatgctcgggagcatggccacatgcatctctctgaggtaaatgatgatgcacttgtcactttctccctgccatgctatgattctaatgagctttgggacaattctgatagttaaatgagatgtctgtataaagtattactgcattaatgcaaatctggtatgtcgtctacagataatggagcactcccaatggtttagaaacaaagccattgtactgacacatttctcaaatcgatatagtcttgaggtatgtaatcactaacctataaatcattgggaatccagtgtttcctaaaaataatagttgcggattctagactaatctgacccaaatgattattttgtaggatattagacaagctgtttccaaactacagtcaaagttatcttcaaaggttgttgcactgacggaaggcttcaaatctgactatagatagtgtatagaagtaggtcagctgtgcttctcacccttacttgctgagaataacttgagttacttacactaggaattggccattcatgaggaaaaagggacagaattaataggtttgtgctgtttggcttttgtatgtggcatttatatctcctatctttctatattagaaaataaagtttatatagcattataactaaatgattattgtgatggaaaaatctatattatacatgccaaaggtgattcagtaacatacataacattttcttgacactctccagcttccagaataagaaaaggttagctaaaatctctctctttctgctgtttttttattccccccgcccccccttgtactatctctctcatgtacatattatattttaatatatcacagtaggagcctattctgctgtttaaccgtctaaaaaaaagaataagaaaaggtgtaaaaagctgggtattacaatacgttggagaatctgaaggccaaataaactgaaatcatgaaacgcatacatctgcatgaaatccaataagttgtaaaatatcgtacagtttcatccttgaaagcaacaagcaggcatacacttctattactgtgtactgcgtaccatgagtacgttctcttgaaaaatagataagttacgagtttgttctgaagtgtcgtacagtataatccttgagaagcaacaagcacccaagcaggcacacactaatattactgcataacatgagtatcttctttggaatagatcaaccaatgagtttgttctttgaagcttcttttcttgtattcttttttgctaggtacatgagagcagtggcagtgctgctagtatctggttttagcataacggattttccttgcatcaatgtcttgttcacttacatgttcaacagattcgtcatcagtggagcaactttcaggatcttcgcgtgcgggaatgatgaatatgtcagattcatcaggtaatctgaagctaactctcctcatgctgttttggctcctaatagagattctatcgatggagaagctgtcccggatgttaggagaattattttcataagaacaatccgggttaattgggcaaacctttggagagtgcctccgaggtgatggggctccaattgcctccccctgaaagctctgaggagaatacaagatgtcttgaagagtgttttgccttatttctgccttgactgttctggtcttgttatgctgctgctcctcttgaaggcatctgggcttcattctgttgaatagtgctttaacatggcaacagctctgtgagcccatcttttccctctcttctttggtgatgaacgatagtgtcatggcaaatgcgcttatatatgtccatgctccgtattgtgttgggcaagtaaaataatctgttttgcatatactaggttgtgtcaaaccttgttcatgtcaaagtaggacgaattatggtgattgaatcaaggaacgtaaaggagagatagaacacttattttggattaggtttggggaagtcattgatgtttccaaactaacttgaaagatactattcatcttgtgatattattgttgtcactagttggggatgtcaaacatgataagcctgcttacacttaggatttggtacagacattagcggagtatatgatgatgaacttactgaatcctgacaaaaatatgtggatggtactagaatgcaactaggtaactttgtctatactactagtagctatttaggctcggcgcatgctcgagagaaggtgagatcgcgcactagtgcgcggctgcactccaagactagtgatatactatactctactctactcgagtagctagccagcgcagcgcagtggtgcacgcaccatcacggcgcacccgatccacaattaacctacccctcgcgctcgcagccacatatcatgcgcacgcacgcgcaagcgccggctgatccgatccgatccgatcccaccaggcgaccactacctcaatacttccattctaacattttctatatttatattaatgataataaatctaaatagatatatatgtctagattcattaatatcaatataaatatagtaaatgctagaatgacttacgttgtaaaacagaaagagtagtatactccagccaactactaactctaaatcatctatagtctatctaataactaatttatactagttaattacaaatatataatacaccatgataattggtcctacatatcatatatatatatatatatacacacatatatatacacatacattttaaagttcgtgctacagcgatgtatatctataacccgtttttcttctctcctctctcttatctccttcacgtatgtttatactgctcttattacctccggtcaccggcacgtacggacgtgacgacgtcgcacgcgcgcgcttataaatgcagccatacatagtgcgatcgtttcgtggccagagagagagagagggggagagagagagagagcagagcttgaactgaccggccggtgcagtacaaataaaaattatacgagcaatcatgtggttgctgccgctgatctgcttcgtcttggccttgctgctcgccgccggcgccagcggtggtggtggtgccgcggctggaggaggaaatggcggcggcggcgagcggcgtggggtatacgtggtgtacttgggcgccgtgccaccgcggacctcgcccaacatcctccagcagacccatctccgcctcatcggcgccgtgctcaaaaggtccatcgtaaaataaattaatttttaactctcttcctgttggtgctaatgtctctcaagttgcactagctagcagtagcatgcatgtcagtcaataagaaggtactcgctcagtttgccgatttgtagcatggcattaaatatattctctccgttttatattagaagatgttttaatttttcaaagttaaatttctttatatattagaagatgttttattttttaaagttaaatttctttacgtttggtcaagtttacggaaaaatgtaacaagttctacgatactgtgttagttccattcaatctaaatactgattttttaaaaaaaaatcacgatagacatacacacgccactacatacgcagcaccgcactcacaccctcacaaatggacccccccctaacatatgctctaagagatagaaaccaacggcacatccttgatctaacaaaaatcctgttaaaaagcacatgcagaccatcgacatatcccttatctcactaaaattctattaaaagtctacatgcatgtgcataatattcgtgggcaccagaatttgaaccctggttagtagaatcatacactcacgactccgctaccacaccactagtgtttttccaaatattgaatatagtacgattgtatagtataaaaactatttatatgtttttcttgatcaaacatatatgatttgacttaaaaaaacaaagcatcttataatgtgaaatagaggtagcagttttctaaaaaaaaactccatataaattaaaataagcagacattgttacgttaatttaaaaacccgtgtacacttctctcactttgctacagtgttgcacttcttgttaatttaacattgtctttctctttaactattttcaatggttgaagattattttaatcttactatcgttatatggcttaattatggtgaaataaaatgtgagaatttacttggatattttttatatgacttcttctatattttcaaaagcaaataaatttaaaaaccgactaaaacacggataacgtatcaaagtaccgacaaatttattttcaattttgataatagaaaaaataaagataaagataaagaagtagatatggagatagagaattttcgtcaaacggttctgaattttatgcccaaagatattgggatgcatattattggtaaaaggaaacctcagtagcacaaagtgatcaccaacgcaacacgtgtgttgcgtgtgtcacgtcacgtcgacgtcattgtgccacacgttagtaaccgtgtcatgtgtgcactacgcgaacagggggcagccagtggagagcgtggtggtgcagcagtacaagtacgccttctccggcttcgccgcgcggctgtcagcggcggaggccgccgcgctccgccggaagcccggcgtcgtctccgtcttcgccgaccctgtctaccacctccacaccaccaggtcatgggacttcctccagcagcagacgacggccgccgtcgacgtcaagactggcggctccggccaccggcggcggcgctcgccccgcgcccgcgccgccgcagcatcagcgtggacgtcgtcgtccccgacggccgacaccatcatcggcctcctcgactccggcgtctggcccgagtccccgagcttcgacgacgccggctttggccctgtccccgccaggtggaagggcgtctgcatggccggcgatgacttcaactcctccagctgcaaccggtgagtcgccgacgcctatgccagagaaatttgattttctttttcttagttaaaacttttgtgtttaattaagtttataaaaaaatagcaacatttatgatacaaaattagtttcataatttgacgtatattttgatacaatgttggttttacattgaaaatttactacttctactccctctgttttaggttatgactttggtcaaaattaaactactctaattttgactaattttatagaaaaaatagtaatatttttaactcaagacagatatattatgtaaatttattcaattatagatttaacgaaattatactggtattgtaaatattatacttttttctataaagatagtcaaatttagagtagtttgattttgaccaaagtcaaaacattttctaatctgaaacggaagtagtataatttggtcacttaaaaaaattaactaagaaaaaagtcattacaaatgacttgtaatatgaaacggagagtatatatcctgatgtttcccgggcggcgcatgcaggaagctgataggagcaaggtactacgatgtcggcggcgaggcgaagcggcagtcagcacggagcagcgggagctcgccgcgggacgaggccgggcacgggacgcacacctcgtcgacggcggccgggaacgcggtcaccggtgcgtcgtactacggcctcgcggcggggacggccaagggcgggtcggcgtcgtcgagggtggccatgtaccgcgtctgctccggggaggggtgcgccgggtcggccatcctcgccgggttcgacgacgccgtcgccgacggcgtcgacgtcatctccgtctccctcggcgcgtcgccctacttccgcccggacttctccgacgaccccatcgccatcggctcgttccacgccgtggccaagggcatcatggtcgtctgctccgccggcaacgcagggccggacgccgccaccgtcgtgaacgcggcgccgtggatccttaccgtcgcggcgagcacgatcgaccgctacttccaatcggacgtcgtgctcggcggcaacaacaccgctgtcaaggtatatatcacaaaattaaatatatctggacatgttctttttcccagattcgttgtattagaaaaaatctcatctatttctaatatctcatccgtctaaaatccttgtgggagcactctcttgtgatcttaactaccccatttttatggaatctgtagggtggagctataaacttctccaacttgaacaaatcaccaaaatatccattgatcaccggtgaatcagccaagtccagctcagtttctgataccgagtcagcaaggtacgtactacaaggcaagcttagtaacgaaacaaaattaaattaacagaaagtttcagcagaatctgagtaagtagtttcatgcccaaaaatcaaatcataaccacaaaataatttgtagtcactgtgagccggggacgctggatgcgagcaagataaaagggaagatcgtgctgtgtcaccactcgcggaacagcgacacgcccaagacggagaaggtcggggagctcaagagcgccggcgcggttggcgccgtcctcgtcgacgaccttgagaaggccgtcgccaccgcctacatcgacttccctgtcacggagatcacctccaacgccgccgccgacattcacaagtatatctcctccaccaggtactatacgtagtccttcacactatagcgattatatactacctccgttttttaatatatggcatcgttaactttttaacaatcatttaatcattcacctttatttttttttcaaatagaaaaatatttaagttatatttataaaacatttggtaataaatcaagttacattacaatattctctctctcctataatataagcatatattcttagagttgaacacaactattaagaaaatagatataactaaataggattaggctacgattagatgagaagtgaaggtatgtgagaaaattaaatggtagaggattgtaattggttgagaagaaaatgctggtatataagttattatattttgagacaaattctaaatgttaaaagttgttatatttttaggacagagggagtaaatgataattacattattttttaataaaatgaatggttaaatatatcttaaaatatcaatggtgttatatattaaaaaaatggatgaagtataccctaattagtggcagaattaattaagctcgatcgatctcatcacatcactctctcttccgtgcatggtgatcaattaaactgcaaagtgagcctgtcgtgaccatcacgccgacgatcaccgtgacggagtacaagccggcgccggtggtcgcctacttctcctcgagaggcccgtcgccgcagacgcccaacatcctcaagccggacgtggcggcgccgggggtgaacatcctggcgtcatggatcccgacgtcgacgctcccggccggcgaggagaagccgtcgcagttcaacctcgtgtcggggacgtccatggcctgcccgcacgtggccggggcggcggccgccgtcagggcgtggaacccggcgtggagccctgcggcgatccggtcggcgatcatgacgacggcggcccagctgaacaacgacggggcgggcgtgacgaccgactcggggtcgccggcgacgccgtacgaccacggcgcgggccaggtgaacccggccgccgcgctgacgccgggctggtgtacgagctcggcgaggagcactacctccagttcctctgcgactacggctacgacgcgtcccagatcaagctggtcgccgcctccctccccggcggcttcagatgcggcgccggcggcaacgccagcgacagcaaggacctcatctccggcctcaactacccgtcgatcgccgtcacggggctcggcaagcccgtcggcaccaggacggtgagccgcgtcgtcaccaacgtcggcgcgcagcatgaggcgacatacacagtcgccgtcgcggcaccggccggcctggacgtgaaggtggtgcccggcaagctggagttcactaagagcgtgaagaagctgggtttccaggtgtccttctccggcaagaacgccgcggcggcggccaaaggggacctgtttgggtcaataacgtggtcggatggaaagcatacagttcgtagcccattcgttgtcaccatctgagagtgagatcacacacatcagtgtgcaagagagagcacttgtgtatttctaatgaaatatgggactgtctagatgacatatgacagaaaaacatctcacaaatcatacaaattctagaccgttggaccattttaagatttctgatttcgtgtgtaatatttctatccctaacccccttcccccctcatcattccagcaccgccgccacctctcgcgagctcgtgcgcgtgcgatgccttcgccgtcccgccccacactccgccagtacccagcctcgtcggctggcaggaaggggtcaacgatgcaggtgagccccccctccccccaccccgaccaacctccttcccctctacctctcttccccaaccgacggcctaagtgctcctgccccgccatctaaaacttgagaagtgaagccacgccacatatttcttttgtcggcaaccacagatttcacaaatggagacttccctattgtttgatcgttgaagtgtctaacgggtctagctgtgtttcagagcttatttggtggctccacaaactagatttttttataacgaaaataagagtaaattttagaaaattatagatactttggtcaaattaccttaaaactacagatttaataataaaattatcacaaaactatagattttcggtttaaatccttagcaccaatgttacgtttgggttataaatattcaagttttgcgatcaaattgacattaaacatgtagttttgtgataagtttgttactaaatttgtagttttgcaatattccaacttaaatatgtagttatgtgataaatttagggttaaatatgtagttttgtgatacatcatgttaaatttgtagttttctgataatttggctaaagtaattgtagttttatgagatttactctaaaaataatttacatatccgacttagtatagcataagttataagtttgtatagaacttaaaaatttcgactaacatggcgaggctgagtcagcgtgtgacatgtcacccccacatgtcaaggacctgtcttattggtttccccgctcttccccatctttccagggcggccacacgccgaggagaagggcagcggtcagtggttgggggccgacgaccgacgggaaaggagttgtgcacgcggcggcaccgagctcgagcggccgcctcatctcctctcttcgcttacgactgtgaccacgccctaccccaataactcccctacactgctcaaatagccaccttgtgaggacgccaagaggctcaagataaagattgagacgacgacaatagcaatgcgcacgcatgagagagaagagatggaggagctagaggagaggaggcaactggttctccgttgctctcctagactatcagttgtgcattaggagagattgaaaagaagatgatggagaagacgggacaaagagaatgttttccatcctcggtctatgttggcaatacgatgaaagtggcaaaacatggtaatataactctaaacgtgatatatagagattaaccactttggcaaatagctatataaacatttgataattttggggtaaaaaaaactttcaaatataactatagtgtaaatgagatgtaattatattttttaactatttataatgtaacttatacgtaactcgcatataactaattaaaaccaaccatatttccagatggctagagatggaactttgcaacttgctggtcgagggtttgattcccttttgttttctcctggaacgaatgtcgccggtcataaaattgaaagttttggaagataaaaactgatttgtttttttcctttttgttttggaagataaatccgacggaaacaaaattaaaagttttgaaagataaaggttgtcattggttggccaattgcaaatgatacgccaaacaacattttaacgataaaaaataatttatgattaaaacttttaccaatgtattcttaatgactttaacaccaacgttagaaaaaaaagtaagataacaacatcaaaattaacttgaaaaataatttttagttatgacattagcatatacaactttgtctaaaaaataaatcctaactacgaatctgaataaatgcgtgtcaaggttcgtagttaggattgagttttttatgagacggaaggctagaaggggtacgttttagggggaaaagacgtggcccaaacactttggaggtttttttagcaactacagaggaagcctatgcagatgtgtgggcaatttatttattgttcataaaaagaatactaaaagaaatcatatcttgctatattcattataagagccctagattaatatataatgtttaaagaaaaaaatatttaaatagatcaaagatatgcactaaatgaaaatggctatcatattctaacagaaatcactttgtcttagttatatgtaaacacataagtgtttttttattaggtagatttaaacccagtcacattttgttaagaaagcagctgggttaccaggcgttcatgataggccagatcgttgctatgatggttcatacatgttcatgaacttaatgtttttctcgcttattgaatgtagttttgtgtgctgacttttttctcacaaatgagttgtttgttcataagtataattttcaacgtttgcatgttctctgtaaaattatatgtttaacactcatactaaatccttatattgtttgttgcgcgcatccacttaattgtagggcttgttcattttgctaccattttcaaccttaccttttgttttttgcaaaattacccaaaaagtggctacatttagttgttgtcaaattttagtaagtacatatgaaattttgccaaaatttggcaaccttgccaaaattttgataaccttatctaaatttagcaatgctaaaacttggtaaagttaaaaatgatagcaaagtgaataagccttagtacaaactcttagtacaaactaagagtgaaaggtcaaaaggtataggtttcttcactgtcccaacatcattggtgtttactcatcttggtgtattattgttagatgcatgccttttaaattgtggggtagtgaaatgcttgaaagttgaaacgtgaaagcgtcactcatacgcatgcatactgctattctggcgatttaccagttactagaatatcctgcatagttaatcaataaaaaccattgttttatgtggaatcctatatgcttatatagttcatccccactaagtgtaattaatgttatttctctcttctatcattaagtcacgtcactccaattatttttagccattggatgatagatctatggttcaaattgtcttctttcttctctcttttcgggaatacgcaaggagcgcatttttttcattaagagaaataaaagttatttacaatgataaaaggaaaacaagcaggggaccaatacaggatactatgaaaaactataggaatatctcgcgctaaatttggctaccacgacctcgtaaaggccaaacagcggggatcccgtgattagccgacttccaaagcatggcctcctctgccattgctttcgccacttcggtccaagacctttgttgttgattgaagattcggttgttctgttccttccaaattatccaagtcaccagtgtcacgacttcacgatagtgtcacgaccagtgtctcttctttcttctctcataacaccaagtaatctcaattatttttaggcctcaaaattcataagtaccattttgttttatttttaatattcatatttcatcttatttgtacatattgtgcaacttaatttcccgcaacaacgtgacagagtatttatctagttcatattacgaatcagatcgaaattatgatttagcccaaatggtattatactattattgatctttacttgtacttttcacaggcatctactcgaccaaatgtcacatcggatgtttggacgctaatttagagtattaaacatagactaataaaaaaactaatttcataaataagagctaatccgcgagatgatttttttaagcctaattaatccataattatcaaaagtttactgtagcatcacattgtcaaaatcatgacgtaattagactcaaaagattcgtctcgcgaattagtccaagcttatgaaatgggttttgtaattagtgtatgtttaatactccaaattagtgtccaaatatccgatgtgacatggacttggaacaagtcgctggaaatagcaaaactgaacatcttctgtatcaacctgaaattacgcagtatttgtacttcagtactgctagaggcaagatcaacaaagaaagccatgggagttgtggaagcggcagcggcagaggcagcaacattgatgctacagagctgcttgtagttgtagggttgtattacatcacgaggtcatgactcatgtcaaatgaataattgggatcaggataaagatccaatgcagtcataacagagactgcaactttgccagtagaaactcttttccatccttggatcaagacaataacgactgaaaccgacgctacagtgtagttttaaacattatctgctacagttctagctacagcctacaggagaaaccttggtactgtcttttgtgaacagtattcaggaagatttcttttttttttttttttgagttgattcaggaaggtttcggatatcactttctatagccactgcaggtgatcccaattcatctaacacatctcacctcatcttcaaatcaaacacatgctaaacaactttaagtggtaaagttgtatgtagtttgtacacatgtagtaagatcaccgtgggaagctcgacgatagcaaaaaatcccgctccatgttgtatagcttgctagtagtgtcggtattgctcagttgaggtggtagacagtgcagctcagctgaaagcccttgcaaaatgtcaccgcctaacagcctttccagccttatctccacttgcctcattgttggcctctcttcccccttcaatcttaggcatgccgatgctagcgccgcgacttctttcacattttccatgccctccgaaattacctgagggtctaatatctcgtagatgttgtcctgtaccattagcaaattaaaaagtgcaattaggctgacattatctgatgattcaaaaacagtaggcttcttccttgtgagcatctccacgagtatgacaccaaaactgtacacatcactcttatcggtcaatctacttgtttgatagtattcaggatcaagatatccaaatgtgccttggatcactgttgtcacaccaccttgatcaaccggaatgcctcgagaggctccaaagtccgaaacttttgctgttaagcgaccatcaagcaatatgttagcagacttaacatccctatgaattattgatactgaagcggatgaatgtaagtaggctaaagcgcttgcagcttcaagagcaatcctcaatctatttttccatgacaacaatgtagggccttcaacatggagatggtcggaaagagtgccgttcgatatgaactcgtagaccagtagtggaacctgtgtttcaaggcaacatccgaataaccgcacaacattccgatggttgatctgcgaaagaatgacaacttcgtttatgaaatcatcgatctccttacgaaccgtaatattcgatttcttgatggcaacgacacgtctgtctggcaaggtgcctttgtagacagtgccatggccgccgctgccgagctttctcatctcgtcgaatcgatttgttgccttttcgagctcttccaaggtaaacaccatcctttcagcaatcaccttatcaacaagttgcagcagcagtaaaccccggttctgcttgaagaatac

SEQ ID NO: 23523 - DNA, 1584 bp, Oryza sativa
acttaacatccttatgaattaatgatactaaacggatgatgtaagtaggtaaagcgcttgcagctcaagagcaatcctcaatctatttttccatgacaacaatgtagggctttccaacatggagatggtcggaaaagagtgccgttcgatatgaactcgtagaccagtagtggaacctgtgtttcaaggcaacatccgaataaccgcacaacattccgatggttgatctgcgaaagaatgacaacttcgtttatgaaatcatcgatctccttacgaaccgtaatattcgatttcttgatggcaacgacacgtctgtctggcaaggtgcctttgtagacagtgccatggccgccgctgccgagctttctcatctcgtcgaatcgatttgttgccttttcgagctcttccaaggtaaacaccatcctttcagcaatcaccttatcaacaagttgcagcagcagtaaaccccggttctgcttgaagaatacggctctcagtttcttggccctccgtgccttgatcatgttcgtcattgccatgcctatcacgaacacggatggaattcctatgccgatggttcctcctatcgccacaaggagagctgccagcagaagatacggtcaaatttctgaaccctgtttgtgcaaggatttgcagagaagattgcaaggataaatttaagttatgaaatgaagagaaatttctatgtactcgttggttcacatcctccttcgttcatagcatcaccgtgcgtcccacccggacacatgcacgaaaacgatcctggcttgtttgtgcattcaccgtagcagggatattcttctggcagagcgcactcgtcgatatctgaaagggagaatttagaaaaattttgtaccattctgttctaaattccactaatcatttgaactatggttggtaagccatagaaaaatatactaaacgaacaaaaataatttataaataaaactattaatagcggtttaaaattttaacggcaaaagattgactataataagaaaactaaaatcaactttaaaattaggttttaaattttagccgcggctcataatctagcaagcaaacgatgagaggctatacttatgcaacttcaagtgtaaatgactaatccgttaaacacacttataagctaaaatattaggaaatgatttaatatcaaactaaatagaagggtgaggcatcgaacccagaacagctagcccaccaccttgtgaagctaatcagaagaccctcagttgtttctccacttacatggttacacccttatactccctccatccctaaatgtttgacgccgttgactttttgaaatatgtttgatcgttcgtcttattcaaaaaaattaagcaattattaattttttcctaccatttgactcattgttaaatatacttttatgtatatatatagttttacatatttcacaaaagtttttaaataagatgaacggttaaacatgttttaaaaagtcaacggcatcaaacatttagggaagtagggagtaacaaattaccttgacatccatttgcaacgtacggattgccttggtacccgttgttgcac

SEQ ID NO: 23524 - DNA, 7639 bp, Oryza sativa
  unsure (1)..(7639): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctagatgggccgatgtggcgtagtcggtcgcttattggacccagcccactaatcaagccataaaaagtctttcctaccttttttagggaaggaataagtacactgaagatccctcaacttgtcattgagttacaaaatcgtcatccattcacaaaaccggatatatgacgtcatccattcacaaaaccggatatatgacatctctcaacttacaaaaaccgttcaatctagctcctttagtggttttgaccctggttttatcctacgtgtcagctgagtcagcgtggaacccacgtaggacccatatgtcaagatgcccacgtcatcaccctctctctcactcctcttctctgggcaaccgggaaagccggccggcgaggcgggagaggaggcggtggctgctgcaacgcggctgaaggcgagggcggcggccggtcgcgaatggtgtcgacagcgatgtgtggccgccggcgacgaagcggccccgcacgggcgggcgccgcggcgttggccacggaggtggaggcggggaagggcgccgcggcggtggccgcggaggtggagccgtggaggcggggtcgagcaccgtggagctggactcggagccccggcctgctctcgcgccgcatcctccctttctcagcgtcgggagcgtcgtcgtcgtcgtcgggcggcttgtctgggcaagccggccggcgctgctagggaggaggccgctggggcgaggcgggaaaaggggcggcggcggcgtctacggcgctgtgtcgcagccagcggcgaaacggccccgcgccggcgggcgccacggcgttgggcgacgaggagaacggcggagcaggcgagcaaggcgggcagcgacctcgctctcgcgtgcggcgtcggcgtcgtcttcatcctccgcagcgagctcccaggcgacgaggctgctcatcacccggaggcgctcggcgtcgccgcgacgaggctgctcatcaccctatcagcgcacatggggcacaccatcgccgagaggctctgcaagacgcagggccagccgaggagcgccggcttgtcgccgcgggctggggatgagagccaacgccagcggaggaggcgtacgaggggcggagggccgcgctgctgcgggcggtggtcgtgggcgcgacatgtgaaaggattttttagctcgccattaaggaataaagtaagaaacgcgtactctctatataaaatgagtacgttcaccgacgtgaaaggaatttttagctcgtcattaagagcttaagaaagttacttggaattctttggtttgttgacaatcacgattcatgacaaaagaagattgagagcctacgggtgcacgccagcgcgctgctctcactgtcgtcacccgcgtggccacgtcgatggcaccgacgtcgtcgtcgacgccggcgggcagcagggcgctggcggcggagggggtgttcgagtgcaagacgtgcaacaagtcgttcccgtcgctccaggggctgggcgggcaccggacaagccacacgcggctgcaggcgaagctgctgagcgaccccgccgccgcagcggccgagagggacagggcacgcatccacgagtgcgccgcgtgcgcggggtcgagttctccatggggcaggcgctcggcggccacatgcgccggcacaggggcgagacgggcacgacgaccgtcgtgctcacggccgccgacgtcgacgactcgggcggcgccaccgtgccgcagccgccggaggccatgctggacctgaactacccgccgccagtggcagttcctccctcgccggccgctgcccgcgcccgccgctcggccgcgcccatctgctctctgccagccgcctgtggtccgtggagaggggaggagagagaggaagagagatggtgaggggagggaggaagaggctgacatgtgggacccacgtgggtcccacgctgattgggctgccacgtcagacaaaactagagtcaaagtttacactggttttataaattggggtacgtgttgtatcgggacgattttgtaactcggtgacaagttgagggacctccggtgtactttttccttaggggaatgcctaaggtctaagccattgctaaaggctaatcttcgatgtcatcaaattaaagcccatgggccatggatataggaggacttttggcccactcggccagcttccgctgcggccctgcctgcctgcctcttgaaccgcgtggcgccgccgccgccgccgggattcacaaaaccaacggagcatacggactagaatcttcgccgctcgccgccgcggggaccaatggagcgcgcagtgcgggagctgtgggcggagtcgcgggacctgctgggcctccactccccggacgacgccgccgccgccgacgccgcgatgccccgcgccgagatgcccccgacgccgctcgcgtttctccgcgaccacgtctcgccggggcgccctctcctcgtgtcctccgccgccaccagccactggccggccgcctcgctgtggccgaccgactcctacctcaccgacgcgctccgctccaccgccgtctcgctccacctcacccccgacggccgcgccgacgccctcgccccgcacccgcgcccgagccaccccggcgccaagtgcttcgcctccgcgcacgtccgccaggtcgacttccccaccgccgtgcgcctcatccggagctccgatccggcctccggcctggtggcctacgcgcagcagcaggacgactgcctgcgcggggagtacgccgccgtcgccggcgacgtggacgcgcacgtgccctgggccagcgacgcgctcggctgcctccccgaggccgtcaacctctggatcggcagcgcctgctcccagacctccttccacaaggaccactacgacaacatctacgtcgtcgtctccggcgagaagcacttcctcctcttgccccccaccgagcaccaccgcctctacgtccgcgactaccccgccgcccactacgccgcggaagatgaagcggagctgaggcttaagctggagctggaggagcccgagaggatcgtgccatggagcagcgttgacccctacccgccgtcgccggaggaggcggccgcgcaggcgtcatccttcccgctctacttcgaggggccgaggccgatccgctgcacggtgcgcgccggcgagatgctctacttgccgagcatgtggtttcaccatgtgagccagagccccgggccgaacgggctcaccattgcagtgaactactggtatgacatgcagtttgacattaagtatgcctacttcaacttcttgaggtcattggagatcgatggtagttcgtcgaaaaagacggatgctttggaagacgatctcgaggagacgaatgattgaattgaaatttttgcggtaattctggatctatgcagaatataacttgattcaattgttgtgacttgtgagcattgtcagtttaatgttttggaggcagaggtcagggcatagatcttgataacctgtgtttatgttgtaccaattttcagggccaaatggcttatcaggtttgatttagtttcagagtcaacatattgatgtcaactttaaaattttttattcagatataggaaggtgaattttgtctaagatttactctccactagtcatgcttacattatgcaggtctgagaaatggccatcttatgtgaattatgcatgttttagtgccagatggatcagatgttgacagaatgaatatcaagcaattacatcttctgaatctgtgagtgttgtgtccggtatcataaacttgatgccaactctagattgcaaatacatactatattcatctttactcctatttatgagaactagtttaatttcaattcctagacatggtcttttgtttacctgttgttgtgataacatattgtcatccttattactgaacaagtgaacatgcaatgctttctattactcaacaatcagataattcactgtgcaatttccagaactgttagttttattcccaaatgtaggatttcacgagcattccgcacaacatttccatttgttcagctagcttgtgtgatatgtaaagtacagtattacaacctcctggtttctgccgtgtgccaataataactagcaaatgaaatagctcaatccagaataagaatgcaatgacaaaattataaatagtagacatgtaaaaaaaaatattgctgcaaaactgttgtgcttcaggctgccttggccagctccctgtccacagccaccttgaggaagctgccttcctccaccaccatctgaacaggcaggaacccgagcccattggcgacggcgagcatcacctccttcatctcggcccggaactcctccaagtccaccgtgccattgccgtcgtggtcgaaccgcgcatacaagccacggtacatctccacgagttcatcggagctcatggcggcctcatcaacaccgaaatgcttctcaaggaccctgaggctcatgagctcctttgccatctccgagtaggagaggaggccgtcacggttggtgtcgagggcggcgaaccggccatcgacggaggagttgaaggcgccctcgtcctcgacgaagctcctgatggtcttgccgtcaaggatttctacactcatgttgccggctctacaaaatgtggcggtctcagagatgtttttggtgtgtagcagatgagtgctacaaaatgtggttgtatcagagatgtttgtgtctttgttctagtactttggtttgagcaaatgttgagcttgtaacttctacttatatagagaggcgtagcagctggttttggagccactatgaccggcaacatggtatggggcatttccagtgcaatgttcccaacccctactgccttcggcgttgttgatgattttacactttcaaatggaagattcggctgtgtacttgtgtgctacgccatgatttgcctctaaaccaatggatgtgttagcacctggtttcattaaaagcggcaaaaatgatggacgacgatgccttaagaagtcggtggttagatgcaccggtaaagcctagcccactggtattgacgcccgcgttttctgttggactcgtgaccacaagagtcaatcccggttggactctgctggattctgatagtgtttgcttgccagttttcaattggaatgtctagattctaccatgtcggctgataattatagattaacccttttttaaaatagtttatctagatttactagtccgattaacaggttgctcaatgcttcatacgtagttggccgcaatttcgtcattgcaaacagttcatcacattggcagatgtggcaacgagttaaataaccagatcaaccagaacagcatgaataaaagggaggagattaaaaatttactactagtaacgataacttcttcattcagagtgatgatagagggttcaacatcccagtcgcagcttcgcagggttacaacttctttaaacaacaacccagagctctcaagcgtactaagtaccacaactacttctagactacggacataacatggtagctgggcatacgaagttccaagagattaacaactacggagtacttctaaactggacataacatggtagctgcgcacacggagatccaagagattgattcagctggtgaacactttccagtgcctcacgctatcgaaagcgagttgatgaacttcttcttcaacctcagctgaaaaagaataatagaaatgggaacaaatcagacattccgagtttccgaccaaagttgaacaaacactgtaattgtacggcttgctctgcatttgtgaggggaaaaaaactgtacagcgtgtattgcaaccgatgcagaacacagtaatcactagaataaacacaattcaaaggcaaaccactgaactgaattggtgttcagactgatgcgactctatccaaatttccaaatccgtgacaagcgcacacggaggcaaccaatgacgatttcaaatttccaatacaaagtacaggagtatgacaactatctaagacaaattcatctccagcattcagaccaaagcaaagccaagaacatgaacaatggtgtgttcacatacgaagaggaactttagaaatgctcacctccttgctgtggccacacttcttcttgcggcagtggtgagacctgatgggaaggcgtgcatagcacctgcatcaggagatggaacagggttgaaatcaaatcagttcatgttagccgcggatgcaaagctagtatcatctggaatcaaggtgcgggcgggcgggggcgtgcgtaagttcgtacttgcggcagaccttcttcttctctctgtacttgagcgcaagagcccggagggtgggctcctggatggtgtagccgcccctgctgccgccgcggaggcggagcaccaggtgcagcgtcgactccttctggatgttgtagtcggccagggtgcggccgtcatccagctgcttcccggcgaagatgaggcgctgctggtccggcgggatacctgtacgggttgtgcagagatggatacagttcatcagcttaaacagcagagagattcgaccatgcgcacacacggattcaacaatttccagcttagcagagcgtgatatgaaattaacactaccggaggatcaaatcaatacagcatgtaaaaggatacagaacgttttaggaatcgattcaagtagttcgaatcagattataaaacaacatacttttttgcttattgtaacaagaaaacaggggaccttttagatctagttaaccgtgcagtatagcgtgacagttataaaaaaaatcgcctccagagaaattggaaaggaactattcaatcggaaggttttgggtttttatacgcttttcaagatggatctactctgttacagatctaaaaaaatggtagaaaagcagcaacattggatgggcgatactactagagttcacgcattttgctcagtattccactaaacccacaaaaacttgcaactgctatacatccgaccctattgttcgaccctgtccgaccctgccgtatctgctaatcaatttactccaacgagccagctgctctccatgtgggccagagcaaggagcaggtaagtactggtcggatgctaagtcgtacataccagtcggacgtttaacaattccctatatccacagcgcataaactccactaaacccacagatttgcacacaaacacagtaacatatcagcatatcgagcacaccaaacaaagcagcaatccgaccctattgttcgaccctgtccgaccctgccgtatctgctaatcaatttactccaacgagccagctgctctccatgtgggccagagcaaggagcaggtaagtactggtcggatgctaagtcgtacataccagtcggacgtttaacaattccctatat

SEQ ID NO: 23525 - DNA, 1375 bp, Oryza sativa
tctactctgtgacagatctaaaaaaatggtagaaaagcagcaacattggatgggcgatactactagagttcacgcattttgctcagtattccactaaacccacaaaaacttgcaactgctatacatccgaccctattgttcgaccctgtccgaccctgccgtatctgctaatcaatttactccaacgagccagctgctctccatgtgggccagagcaaggagcaggtaagtactggtcggatgctaagtcgtacataccagtcggacgtttaacaattccctatatccacagcgcataaactccactaaacccacagatttgcacacaaacacagtaacatatcagcatatcgagcacaccaaacaaagcagcaatccgaccctattgttcgaccctgtccgaccctgccgtatctgctaatcaatttactccaacgagccagctgctctccatgtgggccagagcaaggagcaggtaagtactggtcggatgctaagtcgtacataccagtcggacgtttaacaattccctatatccacagcgcataaactccactaaacccacagatttgcacacaaacacagtaacatatcagcatatcgagcacaccaaacaaagcagcaatcaatgcaggtcagcgagaatggggagggctaggaatggagagacggcgagtcggcgaccatggccggtgcgagcataccttccttgtcctggatcttggccttgacgttgtcgatggtgtcgctgctctccacctccagcgtgatcgtcttccccgtcagcgtcttcacgaagatctgcatcttgccgccgtcgaacgatctccccgcgctctcgccgatcggtggagtggtggtggtggtggtggagtggtgcgccgcgccgcagtcgtggtcacccgctcttatatatgggcgaggaaacgcagccgccacgaaagcgaaatatcccataaaaataaatagaaaaagaaaaggaaaataggaaacgcagccgctacgaaacctataaatgtcgtaagaaaaaaaaaagatgaaaaagaaaagagagaggaggaaacgcaaccgccacgaaaccgaaccacaggattgacacgtggcacgagtacgggcccatggagagctacaggtttctggctattgggctggtccgtgtatatggcccaagcagacacggcttaaattgtggaattttttttatttatacatttttttattaaaatatttacaaaaataattttttgtttcgaaaatttacaaatttaattgcctgccgcctttaagaagggcgatttttaaaaatcgccctctcaaagggcggcaagggacctaaataaaaaatttttatttgtgatcaaacccttccccccgg

SEQ ID NO: 23526 - DNA, 11989 bp, Oryza sativa
tctgagattttttaaaatgtgttttatattttgtaacgaatatttggatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcaaaacaacaaattatttttgtaaatattttaataaaaaaaagtataaataaaaaaaattcttaaattgtgcagtaaaattctaaaagaaaatttggaaaattgatttagtcacggagttcaacttgtgaattcaccgtttatattactgatgtaatccaaaatcccaaaactggtatttcatttcctcacgtagacatccgtacaagatcaactatcttcttttatgctaggcaaaataataataataaaagactagtgatttgagaataacatgaaaaaactaatgcattattacaccgtgtatccttccgtgtatatataagtaattaagtatcaatgaaattactcaatagagtggccttctagttatctaaaaagaataatgaatcacaacaaaatcgtggaagtgtaaaatatgaaactccttttttgctctgtaattagttcagtttaggcagctgctccggcgagctccctgtcgacggccaccttgagaaagctgccttcctcgacgaccatctgcaccggcaagaaccctagcccgttggcgacggcgagcaacacctccttcatctccgcccggaactcctccaggtcgacgccgccgctgccgtcgcggtcgaaccgcgcgaacagcccgcggtacagcgccgcgagctcgtcggcgcccatggcggcctcgtcttcgtcggcgccgaagtgcttctccagcacgcggaggctcatcagctccccggccatctcggcgtaggagagcacgccgtcgcggttggcgtcgagcgcggcgaagcggccgtcgaccgaggagttgaaggcgccctcgtcctccacgaagctccgcaccgtcttgccgtcgaggatctccacgctcatggtggcggatgctaattaaactggagtagcactggatgtgtagagaagctcagagtaagtgagactcggtttgcttggagtggagtggctaatttgagtggagatcgatgcttgcgagtgctgtttatataggggagagtttactaatggaattgatcgagtggtacgctagctgccaattgccgaccggcttcagcttggcgcgtggtggtctagtggatgcgtgggacgggccaatgggttttggtcttttggagagagtcgtatgctatgggcatgagacacatgacttgcctggaaagcaaccaatgttataggcgaacgactgcgtcggtattgacgtgcactgatctgtgtagataccgggaatcaggagtcggtcacggttgggatctggatgacttagtagaaattctggtgatctttgccaggatttctgtggattgattagccgaattttgaacatgattcccttagtaagtacggagtaggcgtggcgtggctgttgcaactagcggaatcgagttctaatagctacttggatcggttttatgtatgtttcttaaaaggaattgatacattaaacaaggaattgatacattatttttgaaaaaaaaacacacgcacaaaatagagcgacattacgctttgatatataaattcaagtttacatccttgggaaaaaaaaaacaaccacaccacatcaatgttttatgtttacagtaatagctaatagtactataataatcttgttttgcctgccgaaattctcaaacgaacatatgttgtgaactagccttacagaaaagaataacaggggaaacactatgtcaaacgttcatggtgaggcaaaaaaaataacaggggaagcatttatggcaaacgttcatggtgtttagtgccctagcgccacgccgccatcaatagaaacgggaagcactcgtggggttgccagcaaaacaaacggcggaagcattatttgtgtactggagtcatagattattttttttatcactaggaacttactgagattaataatctatcattgatgacctcagttaattcgaatgtgttgaattatatttagtgagattagtcatttgccattgatgaccttggttaatttgaatgtgttgacttttgtgagatcgggcaagttatcttggccaaagttggaaatttcggtcatttcagacctctccaatacattattattttggctgaaattttctaactttttatttttttcgtaaattttggtaatatttgttcaaatacaactaaattttattcaaaatttcaaaaatttcagaaattttggtgaggtctgatcaaatcagctaaaccacgaaaggtttattcctgatcttcgcatctgctagtcttcgctgggattatatatgtgagtttggaacatgcccactccttccgtttcctattatattatatataagaggttctaaatcaaacttctctaactagtttctcgtaacattcatgcaaaagaaaggaaattaagcaaccgtaaacgaaattaggtgtctcgcagtaggggcgtatatagagatttgaacaagtaaaaacttcaaaccaaatctcaaaaacagaaaagtaggggcgtatatagagatttgaacagtaaaaacttctaaccaaatctcacaaacagaaatagcataagcagccaggctaacatttatgaagactctttgactcaactgatgctaacatatgagctaataactgaataggaagactcttcgactcaactgatgcatgacaactcttttattcagttggcagtcttggatataaacctcttctttggccttatctgaaaattcagatggaagaaaacaacattaggtcagccgtacaaccaacgtacggcaatgtatacaaatcgaaaaaaataacatgtacaaatagtggatggattttatatctattatataaaaaaaattcgtttcatattataaaactttatagcattgtccatattcatatagatgttatatgtctagattcgttaacatacatatgaatatagacaatgctaaaaaagacttataatataaaacggagggagtaacacgaatccgtgtacatgactgatgcaaccaaacgaccaattttgaaaacaaactatctaaaaacgttaaaacatttctttgacgacaaaactaagtaaaaggaccacttcacctggttggtgtggccacacttcttcttgcggcagttggtagacctggcgggaaggcgtgcgtagcacctgcggttaggaacttaattaggatgcatcgtggaacaggaatacacgtacgaattaagcgttaaaattcaaagctgagatctttgttagtaagcattccgtaaagtttctttttttaaaaaaaaaattatatagcattagtcaaacaggatcaagatgagttcgtacttgcggcagaccatcttcttctcgttgtacttgagcgccaggagcaggaggctgggctcctggatggtgtagccgcccctgctgccgccgcggaggcggagcaccaggtgcagcgtcgactccttctggatgttgtagtcggccagggtgcggccatcctccagctgcttccccgcgaagatgaggcgctgctggtccggagggatacctatatatacaacagtgaaagagatatgaatgaattttagctagtcgaatgggctcggaagttaatattaatccatgaaaacaagaaaaaagagtctttaattacagttatgcagcaatgtcatcgatgaaggcactccctatcaagagataaaagatactagcatatctttttaaactactaagacagaatagaaacatgtacacagcgaagacgaactataagcagatggctagattggatttgttgctccgtgcttactgcgactaaacacacgcatgcttagacctatgtaatgtaatggaaaagtacaaggcttcctttttggttatcaaatcgatctaatctacaactacaatattgaacaatttcggcagtatcaacccaccacgcatctagtgcaaaacacatgatttctactgtctagacgcacaagagcacgacgtacgaaacaaaggatgagtcactaaattaacgggacgagcaatgccagcaaatgtacggcgtacgtacgtgcagtcgatcatcgcgagacgacatcaagacatcaacgattaaacaagatgaacatgcaaacgaagaagctagggatatcatcttgatatcgtgttatattaccttccttgtcctggatcttggccttgacgttgtcgatggtgtcgctgctctccacctccagcgtgatcgacttccccgtcagcgtcttcacgaagatctgcatcttgcctctctctctctctatatgcgtcgaacgatctctctctcgtgtagatttgggtaataacttgcagaaacgctgcctttatataagggaggaggagacgcggccgctacgaaacctgtattaataatatcgcaactactaataaaattcggaaacagaaaggagataaatcgcacgattcggaaacgggagcggcatttgcgctacgtgagttcgtggccactacggaattgatgagatcgtgtcatgggctctctcgtctgcctacggcccagatcagcccacgaagagttagaggcccaaatattttattgttcctgacgtggcgctcagaatccaaagcctggcagctagcatgggttcaaaatttcggatcgaacccagatacgacattatttcgaccgatttttttttcattttttttgtaaatttgataatattttgtttaatttaatcaaattttgttcaaaaattcatataatttcgaaccgaaatttctgaaatttcgatatttcgggcaccctggtccaaatgaccaaaccgaaagatgaaaccctggtatctagtagacacacacaagctttcaaaccgattctcttgatcaaaactggttttttatatcatattatctttgtctatctcaaagagcacagttacacaagtaacaatgaaatatagctcaacagaggctatcaaataacaatgatcaatattgtgaacacaagatatatcaattaaaatcgtagctgtgtgaaaatttaaatgctcgccggttcaggtatattaatttaagcagctttggccagctccctgtcgacggccaccttgagaaagctgccttcctcgacgaccatctgcaccggcaggaacccgaggccattggcgacggcgagcagcatctccttcatctcggcccggaactcctccaggtccaccgcgccattgccgtcgcggtcgaacctcgcgaacaggccacggtacagctccacgagctcgtcggcgcccatggcggcctcgtcgtcgacgccgaagtgcttctccagcacgcggaggctcatcagctccccggccatctcggtgtaggagaggaggccgtcgcggttggcgtcgagcgcggcgaagcggccgtcgaccgaggagttgaaggcgccctcgtcctccacgaagctccggaccgtcttgccgtcgaggatctccacactcatgatggcgatgattctttagctaagcagcagaggaagtttttggttggctttggttgatgaatcatagtgaagctggtgaatggaatttataggtgctcgatcttcagcgaaaaagtacgcggacgtagcagctggttttgcaagtcggcgatggtgagctaccaccatactagtccactactatggcgtgcgtgaccaatttattcagtaccaagcggatcggtgactttgccggtgctatgggcgaagtcagtacagtgtagtggagggagccaaccgatgcttccgttggttggttggctccgggccggcggtttgcgaatttgcgacggttgtggcggcaaaatgggcaacacgtacgggacgaggatatcgcgcagaatatgcggagtgggcagccagacgcgcatgaatgatttcgtcggcccgaaactgtgggcttagtggcttgtatgtggagatgataccccaacggacaaggccgcgccggcgcacccaatgtcggcaaagttcgatgagagcggtctgctcttatatggattctaatcacccgggtaattaaaatagtttccccggtttacttagggtatgttcaatggtagagacaagtatggtctcttaaacaatataagattatttagagaccatatctttataatagttgagtcgataaaggctttaatcattaactcaaaaaatatttcatttgttaatattctttccatttttttaccctcatgcaaccatatttccatattatagtgattaagagtcgttgttaagctgttgtcatgcataacaacgatgttttgtctctcctatttctctttcttccatatcaataagtattcctaattagcaacgctaagagaccactattaacaaccattgtacatgcccttacttagagggtcttttgaaacaaaagaattttggaggaattttgcagggtttaattcgtggaatgtttataaacatgtttgttcggagtaaaggaatagtcatttcaaaatcctaggattttctcaaatcataaggattttgaaagtttttcaacataagatccaacctcttgaaaaatttacattgtatcatctaattcttatacttttcatacgttactctgtatctataaatctcttctaattcttgcatttttcatacgttattttgtgtaattcctgtatttttcatacgactccatccaaacagtttttcctatagtttttctaagcttttccatccaacaggatttgagatacgacacttgaatctgttttttcttcttctattttgtgtgttgaaaatcctgtttttcaaatgagcactgattgtttactgtttactttttagtgccctggtcatgtttgtcactttggtattttcttattggtaaagaatcttgactatgctggcacagtgcgtcctgtcgcaacctcatgtcaagtgaaaaagacaagatctaagggtttacctgtcgagcaaaacatttgaaatctctcctatgaacagtaggaataaaaaaaaagagtaatatgaaaagcataaaattctgacagagatataagtgtaaaacggaggattccaaacacggtaatagttgtttgattggaccgtatgaaaaacacagaaatcggatgagagagatagattcaaaggaatttttccaagaggtttaacattttgctaagtttcctccaaaatctacatgtaatgatctattctataggaattttatacgatttggaaaactctaatcctttgaatcaaaaggccaaataggaaaattcctataggatttctatcctatgaaatttctccataaattctttaattcaaagggaccttactatgtgataaattgccacaagcctggacaagtttggtaaccgcttctatgggttgttcgcgatgccaacaccgaatacctcgacgcgctcctaccgaaggagttcgaggtcggtggggagggcatcgttgtcaatacctttttttaatagtgaataaaaatctcacctctatatctaaaggagaaaatatatacggctatttcatcaatacacaggtgccccagctggatgtcctttgccaccttacaaccgacacgtttgtgacgcactacgggtggaacttggtgcaaaaggggatcattacaggtatgcccatgctctactggccgctgtatgtggagctgacgattaacaaggtgctcaaggttgactacatgggcatcgacgtggagatggagggatggctggtagggctggtgattcctgaggaggtgaaggtgaaggtcagactgatcatagagtccgagcattgaaagcaagcttagagagcacgttgaggcgcacagagatgatcatgtagaacccacggcctcgaaggatggcggttcgttattgtgccacgtttgcgcaactcatattcgagttagacaacgcacgagaataaaaaatggtaggagtatgaaatttactaacggtaattactattttttattatatattgatttcttttgtgcggataattaaatataatgtcttagaaaatggactgccactctaatatatacggctttgataggttaagttatggcttatcgatcaaccataaaacataaaccaaaaaattataatggtttgtggattattattatatttttattcttagtagtttaaaagaaatgcatcatatcaaatagcctacgatgaaatacctaaaattgagtttaaaattttaaattttagttacatctcataagtcaacgaacagataatgagacattatattattaatcttactagcatgcgtagaatattctcaaatatgtcttttaagaggattagtatgttgaatatgctagagagtacacattttctctctgatttacgagtctaatgactgattcttgaaaaaagttgtttctataagccgtatcaaataaacacctaggccattcaaaggaagcgctaaggccatggcgagagggccacccacccatttgcaaaaatcaattttatcgatagaaaaaatcgataatgtagtagtgtcagcacaactgtagtattaaattaaaggagtgtgagcgtcatcaatgattcagtgttaactactccatttctagaaaacgatgttcatttgagtccagatcaatcttcctgatacgttgttttcaagtatcgacgtacgtgaggtgggtgtgtccaaattacgagtatataaataagatttattctagctccacatggctagttagtattgttgtttgagccgtatattttctgtcgacaaatatccaattatattgtaatttaaataactaataatgatataacttaaaaaaatctcttggtaacacgttgcttccacaaaatgaagatcgtgggatcgaatcctcccacgtacgtgcacgttgtagtagatattttcctttctctgcttacataaatctcgaagtaaatttaattgttcaaaattatataaaagctacgtacaagttatatcctacttacgtgtaaattgaaattacattgtaatttacatttgatgattgtttcgagagaatttgtggaaacttgaaacctactccctccgttctataaaaactcaactgtattggatgtgatacacctaatactatgaatgtgaacatatatttatctaaattcgttgtactaacatatgtcgcatacagttctgatttgttttattcgacgaagggagtaaataacaagagggtaagcaggaagaagttcctccgagtgctactcgtacgaagaacagagagaactcgagaggtttcattcagtgccgaagctagctattccactccggtgcgtttgcgatgaagaagacggtggttctctaccccggcctcgccgtcggccacttcaaccccatgatggtgctcgccgacgtcttcctggaccacggctacgccgtcgccgtcgcgctcatcaacccgtcggtcaaggacgacgacgccgccttcaccgccgccgtcgcccgcgccgtctcctccaagagctcggccaccgtctccttccacatgctcccgcgcatcccggaccctccctcgctcgccttcgacgacgacaagttcttcaccaactacttcgacctcgtgcgccgctacgacgagcacctccacgacttcctctgctccgtgcagggcctccacgccgtggtcgtcgacgcgtcgtgcggtttcgccattcaagccgtgaggaagctcggggttccggcctacgagctctacccctgcgacgccggcgccctcgccgtgaacatccagatcccttcgcttcttgctgggttcaagaaactgggaggaggagaagaaggcagcgctcccctcgagttgttgggcgtgccacccatgtcggcttctcacgtgacggacttgttcgggcgctcgttgagcgagctgatcagcaaggatcccgaggccaccacggtggccgcgggagcgcgcgtcatggcggagttcgacggaatcctgattaacacgttcgtgtcgttggaggagcgtgcgctgcgagctctcgccgacccacgttgctgccccgacggcgtggtgctcccgccggtttacgccgtggggccactggttgacaaggccgccgccggcgccggtgacgagaccagccggcggcacgagtccctcgtgtggctcgacgggcagcccgaccgcagcatcgtgttcctctgcttcgggagcatcggcgggaaccacgcggagcaacagctgcgggagatcgccgccggcctggacaagtccggccaccgcttcctgtgggtggttcgtcgggcacccagcaccgaacacctcgacgcgctcctaccggaggggttcttggcaagaaccagcggccgcggcctcgtcgtcaacacctgggtgccccagccgagcgtcctccgccaccgcgccaccgccgcgttcgtgacgcactgcgggtggaactcggtgctggaggggatcaccgcgggcgtgccgatgctctgctggccaatgtacgcggagcagaggatcaacaaggtgctcatggtggacgacatgggcgtcggcgtggagatggagggatggctggaagggtgggtgaccgccgaggaggtggaggcgaaggtgaggctggtcgtgcagtccgagcatggaaggaagcttagagagcgtgtcgaggcgcacagagatggcgcagccatggcctggaaagatggcggctcgtcgcgtgtcgcgttcgcccgactcatgaccgagttggacaatgcacaacgatgaaaatggtagtagtgcataatttctcaaccgtacgtactgattttttatattgattgtattattcctatattttgaaatatcgataatcgaaatgaaaatgttagatgggttttcatctatcgatgtactgattttatccgaattttttaaataaataaccgtcaatggagacagcccatccaaatgtaataaaacttagatgtaatccttatgtgttagtattagtttttaagcaatgtcatggtcattaagtatctaaattattttctttttactttcaatcctcactaatagttgcatatgaggcaaaattccttaacatgaagttcgcttttcacaagtgtgcaacgtatccgaggttctattccgatattttgcaatgtttcgatagttgataaggttttgctagctttacggttttcaagaaaacatttgttgcccaatcagaactactcggattgtatcaatattttacctttcagttctatttgaataaaagggcatccgggaatataaataccagaagacaagacctacaaggcaagcctaatacgagcgaagagagatctagagccacctccaaattcaccgagtcgattctcaagaaactagacaacagctaaccatcaaccaccatgtccaagttttaagttgatatactagcaaattggattagatttccatcctatttgtacctgtgagatattgatatataatggtaacatcaactccgatcaataagagtaggactattacccatcatcaaaaggtctgaacctatatacaaatcattgtctcccttgctctctttatagcatccaacctctacgtcctccagacaaaccgtataggtatggatcctgtgattagaatataatccatcgacataattatatgtattgttctttcacattttgttaaattaaaaatcaggtagctagggggccggggcacatgataaaaa

SEQ ID NO: 23527 - DNA, 6838 bp, Oryza sativa
  unsure (1)..(6838): unsure at all n locations
ggaaatgagttcaccgagccccggatatgctcccgccgcctcgaatcgaaccctcgttgaccaccggcgattcccctcttttgccgccgccaacggtcaccgccgcaatccgccgccgtcggacctcctccgtcgcatccgagccatgggatcgtcccctctcgtccgcctctttgtcccggtgtgctcccccatgaccgaagaccgtcgatccgtgctccggtgagacccccgccgcccgccgtccatctcggccggcctccttcttcctcctctcgccggcctgcgtggcatgccatggaggtgccacgtcagcgccacctcagcaaagaccgagtcaaggcgggtccgctctctcctccctctcggtgcgctcagtccacggagagcctagcggctgcgcgttggctcgccgccctttggtccacccggtgcaccaaaccatgcgccactccgaccctaaccctagccccccgcgccacgtgcacgctccgcaccatgcgctgtgtcgaccgacacatgggccccacccggaacccgcgaggtggaccgcgtccacccggccggtctcccccctcctcccgaaccctaatgggcccgcaccggcccagtagctcggccgagccgcgcgcctttccttgggccgcgcctaagccgcccgaggaagtccaattcgcatccctccttcctttccttttccaaaggaattgataaatcctttttcccttttccataaatcaattctctattccaagattccataaatcatttcctttggtcccgcacatcagcgaatgccaataatattcttgagaatattatttctataaattccaataaatcatttctcgtccagaaaatccatttaaacttccaaaattcatatctctcgatccatagcttcgtttgactccgttcaacttccagtaattccgtaaaattaagatctatctaatggcactattagttagtctaaatagggtcattcttttgatcttttgtttaggtttttgattgtttgcgtatagttgcggttgcggattttcatcaatcaaggatttctcgaagattcgttaagcttcgtgaagaccttgagcaaggcaagtcaccctttgatcaattgctcctataattgaaaaatcaatatattttgtttgcaacttgcattattagaatcactcctataacatgcttggcctcggtttgcatgtcaaaccgacggacctacccagtagtcgcactaattcctgtaggttgtactaccctgattccttgtcactccacccttgtggtacctcggtatccgtgctctctgagcgcgtataccaaatatcccacatacaccgttgattgtcgaaaatttgggaaatgggtttgagaagccttgaaaacccgacatgtggcgtcggtgggtttgaaaataaaatgaactgcgaaaactctcgatgcgggggttgtgcctggcactgtcccgtattcgcatataaggaccgattcctgtgggaaactcatcgaacataatcaaagtgcaaccataaggtggaatgggacaccctggctaagtaactagtcagttcagggaaacctcgcatgccaatagttgggaacgccggggcggggtcggttggagccaaaccgggtttctggtaaggcaaggaagagaagcttgccagattaccgatcgaggtggttggagtttgatttgtgaaaactaaaatggcctatatttatgtgaggatttgatccttctatgtggcatgaggtatccctgggtcggcttgggaatggctttgttgcgaacctccgataccgacgggtgttcggaataagttcgtatcttgtgggtaaagtgtacccctctacagaggttaactaactgttcgaacagccgtgcccacggtcatgggcggatgtgaggtggttcccgttgtgtagatttgtttgcctgtgctttgtgaaaagttattgtggtgtgggaatcgtaaccagaatcagcctatgaggcagatggatgacctgagtggtcagaaacgaatttgtgtgattcgggatgtctacgggcatcatagactaggcttcccgagtggaagcggattgttgtgctgctgggcagctggactctgggagttcgagaaaatgaaaaaggctctgggagccgcttaatcaagtgaaatggctctgggagccgagaagtaatgatctgacccgggaggtcggtacattaccatttgagttgttgacccgggaggtcggtacattaccatttgagttattgaaaagcatctcttaagtcgaatcgagacgcaagtctcctttcgacccaaacttaaaaataaataaatcacttagtgatttcaaaatgctttcaaataaaagatttgcaaaacaaccttgcctctcttccaagcttgcattaaacacccaaattcccgtgacttgctgagtacgaaagtaatcacccttgctctatataaatatatatatagttcctctgccttgaagtgaagatgaagtgaagtgaagattagggtttcgtcctagttcccagccgtcgcctgtggtgtttgggtgttagttcgttggttccgccgctgctgctgttattggtgtttcctcgtctgcgtcgtcggttgcattctcgggctgttatgagttgcaacctaagttaaggtaaataagtcctctatttattttaaggattgcaatgattcatatttgtcaccgtgagtaccagcgctatgtcctgggactggtactgagatcgcggtttcgtaggaagcggttcgcgccgtttttcctacgacgcgctccggtcaggtgccgttgcacggcggtgccagatcggggtgtgacactaagcttcatatgcgatggatgtcatgtttatgcaaagagtcaagtatattgtcgggtggatgtgtcacattcatctaaaatcacttatattatgggacggagcaagtataaaaatactagtaactgctaaagctcagctataattggttaagttatggcttatcgatcagtcctagaaaaataaacgaatatagtcaagtattcgattaactaaacccttaaaatctaaaaataacttaaaaagttaaattttgcgcccaataagtcaacaagcatagatgacgagatgttatgctagtcaagttattaaggttgtgctcggtactggaagttgggaactaatgcctcctacacgcaatggagctacttagcacatgatcaattaactattagctactcagcaatcatcacacacaacggagtattcgtttagaaatggattaatatgactatttaaagcaactttcgtaaagaattttttttttaaaaaacacaacgtttagtagtttgaaaagcgtacatgcggaaaataagagggatgagttggaaaagctaagggcctatttagtttgcgaaaaggaaatttttggatgtcacatcggacgtttgatcggatgtcagaaggggttttcggacatgaatgaaaaaactaatttcataactcgcctggaaaccgcgagatgaattttttgagcctaattaatccataattagcacatgtgggttactgtagcacttatggctaatcatgggctaattaggctcaaaagattcgtctcgcgatttccaccctaactgtgcaattagttttaaaatttatctatatttaatactctatgcatatgtccaaagattcgatgtgatgtttttggaactaaacagggcctaacaaaataactcagcctaccagtacgttgaaatattttcaaaaatgttttacagaggactgttgttttgaatatgactacaagatcacacaattttctctgtgttttatgactttaataacgactggttcttgaaaaattgtactcagtttctataagccgtatcaagcaaacaaccaaggccattcaaagcggctgcatccgcgattgatggagattgatggagattcagtgtcaataattacttctagaaagttatgttcattacagtccaaatctttccagttgggaataaacatgacgtacctgagatagatgtgtgcagattattaaaataaaatttaatctagctccacattaatgtcccgtttggcacagctccagctcccaactccaacttacctggagctggagttgtgctaaacagttcggattcatcaaaacggggagcggagcggtgtggatcgctccaaaaaattacactagcatggtggagcggcaaaaacgcaactccacaacttcactctcaactggttccagcgctacccattatttttcaaagaaattacacgcagaatgccaccgcactaccccttcgttccccatccgcatcgagccgagttgcgcatccccgtggtcaagcgcatcgcctcttctccgcaaggccgcgaagagagaaggggaagggaggactaaggcggcggcggcagtagcagtgacggcacacggtgcacggcagcggtggtggcggctgcctcctctctcgcggctagggcgccgagtagaggtttgggcggcgttgggcagaggttagggcgacgcacgacggttgggcttggcggctgagaactcacggcggcacttggcagcgggagtggctccccacagcgaggaggcgcacggcaggagctataatatggcggcggggtagcagatttggtgcaagaagaaggtaaccccaaaccctagactccctccctcaaatctggttcttttttggggggattgattacctagatgttggttaaaatttctcccgatctgtgtgtctattattgcttgatttttagtttttatacttcaaccatattctcactgcacttagatttctagaaagatttggtcagaaaaaaatatactctattgttgaaacttgctgcaaatgcagcgtttggcactcaagttattactgtttttacagtgcacccatgtccatctctacacgctttgctcaaatcgaagttgtggtaaaatatgtgtttggtagcatttacaagatccctgcttaatatagttgtttgtcatttgtagataacattgcagcaggtaggcatttgaccaatggtaaattgttcaatctttcaggcaagcggaggccatggggaaaagttatttagatcatgctcaaggagaaagcaaagcttcaggattatgttgttttgtatgaatcattgaacattatggtcccgttcgtttctaaaaaaaaaagttggatagaaatttagatattgctgaaacaaaagttgaacattatggtaccccacatctatttcgtgtcattgctaaaactccatttatatgacttgccaaataaaactaaatataactgtagcgttagcacggacaaattactagttaatcctaagccaacagtgaaaaaacacaagggtagtattgtctatctaccccctatcctctctttcaggatttctggagctgagcaagttagccaaacacttttagaccacctatagctcccagtggagctagcttctagtggagttggagtttgaagttaattaggagttgggagctggagctctaccaaacagggcctaaatttgtttagtcgtatattttagacaaggaatacaagggcctatctccacatctttccatagagtgatagatcttaggctactgtttttttattattatcttttatccgtaggatcttgcatgaagatttatgttacttgagattcaacttgtagctacactcaattatagagtacttatatttgattattaaacatttaaacttagttatagagcacatacactcagttacaatacactaaaattaggttttacaattgtgtttgtctctagacttatgatttttgacatggttgtccttctgtttttgttattaaaatggtttgtattcattggttgaaaattatgtaatatttcaagcttcaaatctatcgaaaaatcaattggtagtcactttttttattacagtacatctacatagtttatacgtaactacgatgtaacatgtatataactttaaaattatgtgatacattgtgaagatgtcggattaaactccctcgcgtatgcatacgctatgatttgcttctttttttcgcttatacaaatctcaaagcaaaatctaacggtttaaaattatatataaaactacccccgtttcatattacaagttgctttgacttttttcttagtcaaatattttttatgttcaccaattttatagaaaaatgtagcattatttttcgagaaattcctcgaagtgagaccagagtgagaagagttttccaaaaaccatagagactagctagtctcaaaacaaaagagttttttttacaagagcggggctgggaaagtaaagaaagtcaagcccgatgattccgtgggaagggacggatttcaaattcctttttccttcctgtttacgccatctccacccaatccttgaagatatgaagctcccgactagaaggatcaggaacaacggctatttcctccaaaaatattggcagtagccgaaatgactggaaacccaggtagcggtccggaaagggcaaaatgtcaaggtgagtagtgaaaacaaaacaaatatattattaaaatatattcaatgttagatgaaataaaactaatttggaattatacatgttgctaacattttctataaacttgattaaacctgaaaaaacttaatagaaaaagtcaaagcgataaataacaataaacggagatcagagtacatgcgatgcaagttatattatnnnnnnnnnnnnnnnnnnnnnnnnnnnnnnnnnnnnnnnnnnnnnnnnnnnnnnnnn

SEQ ID NO: 23528 - DNA, 13059 bp, Oryza sativa
gaataaaaataaaaataaatccgaaattagcaaaagaaaataaaagaagagttcaagtaggaataaaattaaaaaatagctaaaattctaaattaaaaaaagcaatactgaaagaagaatccatataagaacccaatacgggattacttaaaattttgaataaaaaataaaataatatccaaaattagaaaaatgaaaagagagttcaagtaggaatacgattttgaaacaaccgaaattgaaaataaaaacattaaaataacataatacagtattaactatttttttaaaaaaatctaaaattagaaaaagaaaaaaaaagatttcaattaggaatacaatttataaataactaatatctattatattattaaaacagctttgaaaggaggcaccacgttcactgtgggtgctagaaattccacaattaatcagagaaaaagaaaagaaaaaaaaagaaaatgagagtccaagtagaagtacaatttaaaatagctgaaattcggaattaaaaataagaaatattgaaataagtttccatataagaatctaatacgacattaatcaaaattaaaaacaaaaataatataaaatccaaaattagaaaaggaaatgagagtccaagtaggaatacaatttaaaaatagctgaaattcggaattaaaaataagtaataataaaagaagagtccatataataacccaatacgagattaattaaaattcgaaataaaaataaataattccgaaattagcaaaagaaaataaaagaagagttcatgaaggaatacaatttaaaattagctgaaattcagaattaaaaataagcaatattgaaagaagaatccatataagaacccaatacgagattaattaaaattgacaataaaaataaaataatatctaaaattagaaaaaattaaaagaaaattcaagtagaaatacaattttaaaacaactaaaattgaaaataaaaaataaaaacattaaaagaacacaatacgatattaactattttataaaaaaaattctgaaattcgaaaaagaaaaataagatttcaattaggaatacaatttataaataactaaaatttgtgataaaaataaagattattgaaagaaaagagcatctaaaacacatgacgagataaattaagaaacatgcctataaaggagtagagtggtggcggttgatacgagatataaaaattgttaataaaacaccaaatagaatcctaatgacaattaaaaggagggacgtcaggcatgccgtgaagcaaacaagtaagacggttgctgggacttctagaaagtaaaaaaaaccccattgataatcatattcaatttttaaaatctcaatgacaataaaaagaagaagcagcgggcggggtatataagagtatagttgcagagccgccgatggttgacgggacttctagaaaataaaaaatgaattggcggcggacgggctgtagaggggcatagtggcatcgtttgatgggacttctaaaagttataaaaaatgaaactacaagtccaatttttaaaggtttggaacttcctaaaagtaaaaaagaaccaatgataatcatattcgattttaaaatctcaatgacaataaaaaagggaggcagcgggcgagccgtagaggagtacaatggtaaagccgcagacggtttggcgggacttttagaaagtaaaaatgaacccaaacaataattatgttcgatttttaaaatctcaatgacaataaagagaagagacagtggacgggccgtagaggagtataatggcaacgtttgacgggacatttcgaaattataaaaatgaaacccaatgtgacaataaactctaaaaactataaaatccaatttttaaaggttccaaaaaaaatgaatagaaataatggtagatcgagcaagcaaataaagaaggagatgacataaggggtagcaattggtgtgacttttaaaaagtatataattagaaacatgaggatgataaggtttcgtctttcaaagtcttaagacaatcagataactatttaataaattttaagtaaaaatcatactaaaaaatatatgattttgtttgggtgctagccacgcaattgcgcaggccacctagctagtttgtgataaaaataaagactattgaaagaaaagaacatctaaaacacatgatgagataaattaagtaacaggcctataaaggtgtagagtggtggcagttgatatgacatataaaaatttttaataaaacaccaaatagaatcctaatgacgattaaaaggagagacgtcaggcaggccgtgaagcaaacaagtaaggcggttaccgggacttcaaaaagtaaaaaaaaaaaccccattgatattcatattcgatttttaaaatctcaatgacaataaaaagaagaagcagcgggcggggtatataagagtatagttgcagagccgccgacggttgacgggacttttagaaaataaaaaatgaattccaacgatagttatgttcaatttttagaatcacaatgacaataaagagtaggcggcggacgggctatagaggggcgtagtggcatcgtttgatgggacttttaaaaattgtaaaaaatgaaactacaagtctaatttttaaaggttcggaacttccaaaaagtaaaaaaaaaacccaataataatcatgttcgattttaaaatcacaacgacaataaagaagggaggcagcgggcgagccgtagaggagtacaatggcaaagccgctgacggtttggcaggacttctagaaagtacaaatgaacccaaacgataattatgtttgatttttaaaatctcaatgacaataaagagaagaaatagtggacatgccgtagaggagtataatggcaacgtttgatgggacatctaaaaattataaaaataaaacccaacgtgacaataaactctaaaaactataaaatctaatttttaaaggtttaaagaagaatgaatagaaatagtggtagatcgagtaagcaaataaagaagaagatgacataagaggtagcaactggtgtgacttttaaaaactatataattagaaagacgagaatgataaggtttggtctttcaaagtcttaaaacaatgggatagctatttaataaattttaagtaaaatcatatttaaaaaatatatgattttgtttgggtgctagccgcgtaattgcgtgggccgcccaactagttatactgtatacgttcgataatttttgaaagaaaatttgctgaagcctgaaaacctacataatgaggatatcaggatgcactttctctcatagtcatatttcatcagttcctcgtaagaacagagaactcgagaggttgcgcttcagtgccgcgaagaaaggacgagctattccaccctcccggtcggtgcgtttgcgatgaagaagacggtggttctctaccccggcctcgccgtcggccacctgaaccccatgatggagctcgccgacgtcttcctggaccacggctacgccgtcgccgtggcgctcatcgacccgtcggtcatggagaacgaagccaacctcgccgccgccgtcgcccgcgccgtctcctccaagagctccaccatctccttccacacgctcccgggcatcccggaccctccctcgctcgccttcaacgatcagttcttcaagaactacttcgacctcgtgcgacgccacaacgagcacctccacgacttcctccgctccgtgcggggcctccatgccgtggtcatcgacgcatcgtgcgcccatgcccatgaagccgcgaggaagctgggagtccctgtcttgatgttctacccgtccaacgccggccacctcgccgttaacttgcaggctcctctgcttgttgacgggttcaagaagcatctgggaggagatagtactagtcctgtcgagttcttgggtgttcgacccatgtcggcttctcacttggctggcctttttgggccgattagcgaggtgaacaaggatttcgaggccatgatttttgccggtgcgcgcatgaaggcggagttcgacggaatcctgatcaacacgtccgtgtcgctggaggagcgggcgctgcgagctctcgccgacccgcgctgctgccccgacggcgtggtaatcccgccggtgtacgccgtggggccactggtcgacaaagccgccgccgccgccggtgatgagagcagccgacatcagtgcctcgtgtggctcgactgacaacccgaccgcagcgtcatgttcctctgcttcgggagcatcgccgacgcatgtgaacagtccgaccagcagctgaaggagatcgccgccggcctggacaagtccggccaccgcttcctgtgggtggttcgggcaaccagcacccaacacctcgacgcgctcctaccggaggtgttcttcgcaagaaccagcggccgcggcctcgtcgtcaacagctgggtgccccagccgagcatcctccgccaccgcgccaccgccgcgttcgtgacgcactgcgggtggaactcggtgctagaggggatcaccgcgggggtgccgatgctctgctggccgctgtacgcggagcagaggatgaacaaggtgctcatggtggaggacatgggcgtcggcgtggagatggagggatggctggaagggctggtgaccgccgaggaggtggagacgaaggtgaggctggtcatggagtccgagcatggaaggaaggttagagagcgtgtcgaggcgcacagagatggcgtggccatggcctggaaagatggtggctcgtcgcgtgtcgcgtttgcccgtctcatgtctgaattactcaacgtgtaaggttgaaaatagtatggaatttcccaattgtatcttactactccgttcaaaaatataataatttttcacaagaatcttgatatgcagctgtttagatttatagctagtaatttttatattttgaaacccagaaattcttatattttgacaaggaggaaatactattttcgttttttaatcagttgtcgtgttccgattatttataataatgaaatagaaataaaaatggtacaggatttttcaagtgttctatcgatgtaccgttttcatctgaaatatcaaaacgatacatagtatagctcaacaaatgcaagaagtaagaacaataagaagcaatccaaaatcgtaaatggacatgtgaaaattaatttgctcgccggttgaggtatatttcaagccgctttggccagctctctgtcgacagcaaccttgagaaagctgccttcctcgaccaccatctgcacgggcaggaacccgaggccattggcgacagcgagcaacacctccttcatctccgcccggaactcctccaggtcgacggcgccactgccatcgcggtcgaaccgcaagaacaagccgtggtacagctccacgagctcgtcggcgcccatggcggcctcgtcgacgccgaagtgcttgtccagcacgcggaggctcatgagctcgttggccatctcggcgtaggagaggaggccgtcgcggttggtgtcgagcgcggcgaagcggccgtcgacggaggagttgaaggcgccctcgtcctccacgaagctcaggaccgtcttgccgtcgaggatctccacactcatgatggcgatgattctttggaagtataatataacttaattatcagaggaatgtttgttttcggttggttttgtttggcgaaagtgtgaagcgggtgaatgcaatttataggtgagtgtgctacgtagcagtggaatttttgcaagtcggcgcataacatagcgtgtctgaccatgtgagcaaaggtacaagtaagtaccaaacagatcggtgactttgcagacggcgggcgaagtgcagtgaatcagtgatgcggatccaagccaaacgatgatgcggctctgggccggtggtttgcgatggttgatagctgcaaaatgggcagaacggggcgaggagagcagaggattcacgcggaatatgcggagtgggcagccgcgcatgaatcttctcggttggaaaccgtgggtctttgacgtgtgggtgtgggtgtgtgggtgtgggaactaggagggcccatggatcggtgcacccaggcacccatgtcgtcgtgctgtttattcccgtgggcaacgcatacccagtcggccccagtgcacctctttagccgtacaacaatgagtgcgtgtagtgtgtgcttgtgctgttactgtatgatgccattggtcacgtcactttggtcttttcatagtattattgtgctaatctgctggccgctggctagctgtcatcgtttaaaaaatgaaaaaaattcctcaaacgcaaacataaacttctacattgtgtaaaagagcctgcacaaaagttttgttttttcaaaactgttagttggtcaatcaattgcccaaccatatactataaatgtagtgaagggtgttttaagtgttttattttaaattatccaattcaatgacgaatgaagaaacagttgatacagtcaacatcgtattataaagaaagcaaagtggatgataaattgttgaattagagaaaaagcaaactcgtagcaaagtggatgatagggagttggcgagtagatacagcggaggagaatgcacctaagagcaagtttaatagtatagtcaactactggatccaaattatttgtagttaatttaataaccaattcatacactattagtacatggtcccacccgtcataaatacattttgtcttggagcctatgctgcctgtagttggctacaaatttgtagcccgctgctcatctctctcttctttcgtctcctcgatatgtgtttatagctggcatatagctttctattgtacctactctaaatcgattagcaaggagggagtagggcacgagctaccccgccagctctgctgtcacaccccaatccggcaccaccgtacaacggcacctaataggagcgtgtcgtaggaaaaacggcgcgaaccgcttcctacaaaaccgcgatctcggtaccagtcccaggatatagtgctggtatccacggtgacaaatatgaatcattgcaaatccttaaaataaatagaggacttatttaccttaacttaggttacagctcaggacagcctgagaatacaaccgaagacacagacgaggaaacaccagcaacagcagcagcagcggaaccaacggtctaacacccaacaccacaggcgacgactgggaaccaggacgaaaccctattcttcaattcacttcatcttcagcttcaggatggaggaactatatatatttatatagagcaagggtgagtactttcgtactcagcaagtcacgggaacttaggtgtttaatgcaagcttggaagagaggcaagattgttttgcaaatcctttgtttgaaatcatttttgaaatcactaagtgatttatttctttttaagtttgggtcgaaaagagacttgcgtctcaaatcgacttaagagatgcttttcaacaactcaaatggtaatgtaccgacctcccgggtcagatcattacttatcggcttccagagccatttcacttgattaggcggctcccagagcctttttcatttttgcagactcccagagtccagctgcccagcagctaagcaatccgcttccactcgggaagcctagtctatgatgcccgcagacatcccgaatcacacagattcgtttctgaccactcaggtcatccatctgccacataggctgattctggttacgattcccaatccacaacaacttttcacaaagcacaggcaaacaaatctacgcaacgggaaccacctcacatctacccatgaccgtgggcacggctgttcgaacagttagttagcctctgcagaggggtacactttacccacaagatacgaacttactccagacactggccggtgtaagaggttcgcgacaaagcctttcccaagccgacccaggaatacctcatgccacatagaaggatcaaatcctcacgtaaacataggccattttaggcgttcacaaattatctccaaccaccttgatcggtaagtgagcaagcttcttgtccttgccttaccaagaacccggtttgtccgaccccgccccggcgttcccaactattggcatgcgaggtttccctgaaccgactagttacttagccagggtgtcccattccaccttgtgattgcactttgattatgctcgatgagtttcccataggaatcggtccttatatgcgaatacgggacagcgccacgtaggcacggctcccgcatcgcgagttttcacaattcattttattttcaaacacaccgacaccacatgtcgggttttgaaggcttcacaaacccatttcctaagttttcgacaatcaacggtgtatgtgggatatttggtacacgcgctcagagagcacggataccgaagtaccacaagggtggagcgacaaggaatcagggtagtacaacctacaggagttagtgcgactactgggtaggtccatcggtttggcacgcaaaccgaggccaagcaaattaagtgtgtgattctaataatgcaagttgcaaacaaaataataatgattttccaattataggagcaattggtcaaagggtgacttgccttgctcaaggtcttcacgaagcttcacgaatctttgagaaaacctgcgattggcggaaatccggtaaccgcaactatacgcaaacaatcgaaaacctagacaaaagaccaagaaaaagaccctatttaggctaaataatagtgccattaaatagatctcaattttacggaattattagaagtggaacggagtcaatcggaggagcggttgagaagatatggattctctaaggattaaggaatttctgtctaaaggaaaaaggatttaataatttattaaaccctttttggaaagaaattggagggatatgatttagacttcctcgggcggcttgggtgcggcccgagaggagaggcacggctcggccgaactaatgggccggccggcccggagaggcggcccaagaggcgcggggagagtgggggagagagagggccggtgggctgagtccaccttgcggggtcccgagtggggcccgcttgtcagtggcgcggctcaccgtgggagcggcgcatgagggtggcactagggtttcgggtgagcgcggttcacgcgcgtgcaccggatggaccagagatgcggcgggcccacgcgcagccggttggcgcactgtggaccgcgcgcgcaagggtggggaaggaggagccgcctgactggctcggttcggtcaaagccgaggtggcgcgaacgtggcgcctacgtggcagccacgcgggccgaagggaggagaaaaaacgggagcccaagatggacggcggacggcggcagttgcaccgggacaccatgcgacggcgagggcacgggggagcacattggaacgacaaggaggacaagagagagtgagccaacggctcagatttgccggagggtagccggcgacggcgaatcgcggtggcggcaaccggcggcgagcaaagggggaaacgacgacgagacgacgagggttcgattcaaagggatgggagcatctccggggctcaagggtttcgtttctgggttcggatggggtggggaggcgccgtggaggtccggcgacgagaggcggcctccgggagcgggcgccgacggcggcaaggccatggcgagcggtggcggggcttggagcggcgcctacgaaccactggaaggctaactgtcacaccccaatctggtaccgccgtacaacggcacctgacaggagcgtgtcgtagggaaaacggcgcgaaccgcttcctacgaaaccgcgatctcggtaccagtcctaggacatagtgctggtacccactgtgacaaatatgaatcatagcaatccttaaaataaatagaggacttatttaccttaacttaggttgtagctcagaacagcctgagaatacaaccgacgacgcggacgaggaaacaccaacagcagcagcagcagtagcagaaccaacgaactaacacccaacaccacaggcgacggctgggaaccaggacgaaaccctaatcttcgcttcacttcatcttttcttcaagacggaggaactatatatatatatttatatagagcaagggtgagtactttcgtactcagcaagccagggaaacttaggtggttaatgcaggcttcaagggaaggctgttatttgcaaacaattttgttttcaagttttcaacaatctaagtgtgtgctttccacaaccagagcgagacaagtctcagcttggtcgggaggtgagaagtaacaaatttatttatcaagatttgcacaactcccagagttggcttcaaatctggtttttcccaaaccaaaccaattttccaaacttcccgataatagtggtccccaaacgaccaatcacttccagggacacccggtcccactgtcccccggacagctaaatgcttcccaagcattaggtttcccaaaccttaacaccttttcataaaacagggtaaaacaaaaactatgctaaggaatcacctcacatccgcccatgaccgtgggcacggctattcgaacagtttgttaacctctgcagagggggtacactttacccacacgacattactaacccgaatcacccagcccgtgtagaacggccacgtctggtgacctaagggctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccccgattagcaatttactcagccaggggcgtcccattccacccgtgtgatcgcactattgtatgctcggatgtaattccaaaggaatcggtccttagatgcgaccgcacaagtattccgcccaggaatggccttgtgtcgcgagttttatttttaaaactcattttctttcacaaggcaccgacccaggcgtcgggttttccaaagcttttgcaaaccaagttttacccaagaagttactcagattttaagtttgaaggcaaccgtcgatactcgcacagagtgcacgaatatcgaggcgcaactagatggttacaagggaacatgatataacaattaacaatggaaggatcagatgcaacaagttgggtagacccaccggtctgcctttcagacggggcaaacaaattaagtgtaatcctatcaatgcataatattttgcaagcaatataattaagttcaaatataggctcaatatgttcaagggtggcttgccttgctcagggtcttcacgaagcttcatgaatcttcaagatatccacgatcgacgaaaatccggtaaccgcaactatgcgcaaacagacaaaaacctaaacaagagaccaagaaaaagaccctatttagactaaataatagtgccattaaatagatctcgattttacggaaatactggaagtagaacggggtcaatcggacgattggaccgagagatacgaattttggaagtttaattagaatttctggcgaaggaagatatttgtggaacaaggggagattgattcatgaaatttatagaaataatattctcaagaatattattgaccgtctctgacgtgcgggaccaaaggaaatgatttataaggaaaatgattcatgaaattttggaatagagaattgatttatgggatcaagggaaaaagatttattaacccacggaataagataaaatgatttactgaatttatagaagagagaaatatttgtggaatattggaaagacattctcaagattatctttgactcattgacgagtggggccaataagaaggtgagagagagagagaggagcaattggagggagcaattgcggacttttagctcttcggtgtgtgagcaccggactcggaagagggagtaaaagtaaacttcctttgttttgttaggccgaggaggaaggctggccaatgggccaagcccacgagccaggggagagagggggagggggacggctgaccggctgactgggcaggggcgggcccggtcaacgccacgtgggcagccacgtcggatggggagagaaaagggaggggcgggaatggcatcggacggctcacggcgcgcggcggaatccggcgaacttcggcgagccgaagcgagtgacgaacaccggtggctagaggaggtcaaggcgaaccgattccacggctcggattggggagacgacgcgtgacgacggccggcggcggcggcgaagctcgccgggatgccgacgtggatgcgcgatgggaagggatgcggctcgcgcgctcgggctcagtggacgcggtatggggttgcggcgcacacgcggtgacgcgggacccgatggtcgccgggctgtggctcgcggcggcgccttgcggcggcgggaggggcggcacggcgcgggagcgaggaggaaggtcggcggccagggggaggggttggggaggtcgaggggggcccgaggaaggtggcggcgccgggaatcaaggagaggagggaggccgacggcaggggaggcacagcggaagtggccgagcgcggcagcggcggatcgggcgacgcgacgcgagggcgagaggggaggccggcggctgaaacagcggcttggggaggtagagagggaactcaagaacggcggtggctagaggagtcgccgagagggaggccaacggcggctctcgattgcgcacggcagcggaaacagagcacgcgcgacgcgagctacgcgagtgctgggacagcggaaaaagggaggtggggagctcaccgacgggaggtaatggcgtcggcggtgagttgaggatgggaaggccgatggcggcgcatggacgagcagcggcgcacggcgacgaacgcgatgccgaggcggcatcgcgttacggcgggcgtgccggggaagggaacggaggcgtgcggtggcgccct

SEQ ID NO: 23529 - DNA, 852 bp, Oryza sativa
ggggtttatagagacggagtgggagcggcaaggtcggttcgaggttggccgcggttttctcggcgctcggctggtgttcatgggcgccgcgagaacgagctacggcgaggatgcaaagggtggtggaggcggtggatcgtgtggtggaaatcgaaccgcgagcacgggaggattggcgcggggcgagcgggtgcggtcaaggtgggggcggcgaggcgctgcagcggcgtcagcggctctgccttttgaacaagaagccaaggagtggaggcagggagtgtcacgcccagaaattcccgaatagaatttcaagcagaatgtgcattaaaatccccgtccaggaccagccggggtacacaaacgacaatgttgacattcagatccacgtcttacaaacatcataaaagtcttacataaatgcagcggaaaaacgaaagacaacaggagctaagccttgactagaactgcagtgggaacaccactccacaggcatcctcgacggcacggacgaagcctactcctcagagacacctccatctgacacatactcgaactctggggttgggaaaaatagagcaagactgagtactacccactgtactcagcaagtcataccggaataggggtatgatgcagggaatcatcaaagaagagctgaagtggttcatttgcataaagcgagcatttataaacagaagtacaccggagcatcggaggaatcggaatctagcgacatacaagcaaacattgcaaacaggctataagactactgaaacagggaacaaaaccatttttaatggattctacacatttttcttgatttactgagacttgaatgggcttaaacggagc

SEQ ID NO: 23530 - DNA, 510 bp, Oryza sativa
acgaaaggcaagttggcaccacgcttcgtggggccatacaaaatcctggaacgaaggggggaagttgcttatcagctagaacttccatccaatatgatcggcatccatgacgtgttccacgtgtcccaattaaagaagtgcttaagggtacctgaagaacaggctgattcggaacacattgatatccaggaggacctaacatacgtggagaagccggttcgcatacttgataccagtgaaaggagaaccagaaacaaggtcacccgattttgccgagttcagtggagtcatcattcagaagaggaagcaacctgggaaagggaagatgagttgaaagccgcccatccgcacctcttcaccagctcctccgaatctcggggccgagattccgtttaaggggggtaggtttgtcacaccccgaagttctcctcccaagccaaatttaatttgtaaacaaccccaagaaaatgcaggtgcaaatcaagagaaaaccctaagaaagtaatgcaa

SEQ ID NO: 23531 - DNA, 677 bp, Oryza sativa
cttgtgaaaagcgaacttcatgttaaggaattttgcctcatatgcaactattagtgaggattgaaagtaaaaagaaaataatttagatacttaatgaccatgacattgcttaaaaactaatactaacacataaggattacatctaagttttattacatttggatgggctgtctccattgacggttatttatttaaaaaattcggataaaatcagtacatcgatagatgaaaacccatctaacattttcatttcgattatcgatatttcaaaatataggaataatacaatcaatataaaaaatcagtacgtacggttgagaaattatgcactactaccattttcatcgttgtgcattgtccaactcggtcatgagtcgggcgaacgcgacacgcgacgagccgccatctttccaggccatggctgcgccatctctgtgcgcctcgacacgctctctaagcttccttccatgctcggactccacgaccagcctcaccttcgcctccacctcctcggcggtcacccacccttccagccatccctccatctccacgccgacgcccatgtcgtccaccatgagcaccttgttgatcctctgctccgcgtacattggccagcagagcatcggcacgcccgcggtgatcccctccagcaccgagtttccacccgcagtgcgtca

SEQ ID NO: 23532 - DNA, 267 bp, Oryza sativa
tttgctaaatgctgctttcgcaaatgagactatattgtgccatcctttggtatccttgtgcatttgcatatttcctgtgtggcttgttaagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgtt

SEQ ID NO: 23533 - DNA, 750 bp, Oryza sativa
  unsure (1)..(750): unsure at all n locations
nnnnnnnnnnnnnnnnnnnnnnnnnnnnnnnnnnnnnnnnnnnnnnnnnnnnnnnnnnnaaacctcagtagcacaaagtgatcaccaacgcaacacgtgtgttgcgtgtgtcacgtcacgtcgacgtcattgtgccacacgttagtaaccgtgtcatgtgtgcactacgcgaacagggggcagccagtggagagcgtggtggtgcagcagtacaagtacgccttctccggcttcgccgcgcggctgtcagcggcggaggccgccgcgctccgccggaagcccggcgtcgtctccgtcttcgccgaccctgtctaccacctccacaccaccaggtcatgggacttcctccagcagcagacgacggccgccgtcgacgtcaagactggcggctccgcccaccgccgccgccgctcgccccgcgcccgcgccgccgcagcatcagcgtcgacgtcgtcgtccccgacggccgacaccatcatcggcctcctcgactccggcgtctggcccgagtccccgagcttcgacgacgccggctttggccctgtccccgccaggtggaagggcgtctgcatggccggcgatgacttcaactcctccagctgcaaccggtgagtcgccgacgcctatgccagagaaatttgattttctttttcttagttaaaacttttggggttaattaagtttataaaaaaatagccacatttatgatacaaaaataggtttaataatttgacgtatattttgatacaa

SEQ ID NO: 23534 - DNA, 808 bp, Oryza sativa
  unsure (1)..(808): unsure at all n locations
nnnnnnnnnnnnnnnnnnnnnnnnnnnnnnnnnnnnnnnnnnnnnnnnnnnnnnnnnnnnnncaaattttgttcaaaaattcatataatttcgaaccgaaatttctgaaatttcgatatttcgggcaccctggtccaaatgaccaaaccgaaagatgaaaccctggtatctagtagacacacacaagctttcaaaccgattctcttgatcaaaactggtttttatatcatattatctttgtctatctcaaagagcacagttacacaagtaacaatgaaatatagctcaacagaggctatcaaataacaatgatcaatattgtgaacacaagatatatcaattaaaatcgtagctgtgtgaaaatttaaatgctcgccggttcaggtatattaatttaagcagctttggccagctccctgtcgacggccaccttgagaaagctgccttcctcgacgaccatctgcaccggcaggaacccgaggccattggcgacggcgagcagcatctccttcatctcggcccggaactcctccaggtccaccgcgccattgccgtcgcggtcgaacctcgcgaacaggccacggtacagctccacgagctcgtcggcgcccatggcggcctcgtcgtcgacgccgaagtgcttctccagcacgcggaggctcatcagctccccggccatctcggtgtaggagaggaggccgtcgcggttggcgtcgagcgcggcgaagcggccgtcgaccgaggagttgaaggcgccctcgtcctccacgaagctccggaccgtcttgccgtcgaggatctccacact

SEQ ID NO: 23535 - DNA, 672 bp, Oryza sativa
ggtttccgatgtgattttggagccacttttataacaagtatgtccatacttattatactatgttttgtcacatccaattctaggtttgtttttttacagaagaagtaggcacttactttatatctaaaatttgtagtactatagtatgtaatatccaatattaattttatttatttcgatacggaggaaatattattcagttctgttttttcaatcggtgaacccaatagacccttaacataccgcacttgactttgacgtgcattacgacctaatttgattttgaattttcgaatatgattttttataagtaattttaggtagattaacaagcaacgaaaatgaacgaaaattactaagtaaaccactgaaatcaatctgaaataaaattttaaaacttatatgaagatttgcctagcaacaccttagtttgatgctgatggcattaaacgggtatgcagatgcccatgctccagagtccagagggctattagtgcgtttaatttccatacctctctgttcgtgcgaatatgatagttgtggtgtagatatttttaaataatgaaataggcgtcatgtgtagtgtagagatatggcatatgtgaaaaatgtgtcaagccctgctcttggaagtataatcctaatcaataaaaacagaaacttgcccgactg

SEQ ID NO: 23536 - DNA, 5701 bp, Oryza sativa
atatatatatatatatatatatatatatatatatatatataaaccatgcatatatatgtttcaatacatatatatgcatacatatatatatgtatatatatatatatattatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaatgacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgaataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcataggaaatttgaacttccgcctaagtctttctctccatttgccgcggaccaaatgacggaaccgataccaagccctacatggagtttaaagctatgattcgtagtagcaattaacataacaagattttcttaattaacaaaggaactatgcggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacaggaatgaaatttggtatgtaggaagacagtaaattactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgtaaaagggagtatattattttctatggtctacttatatacaaggacctaattaattaaaggagacgtatagtaagaaatctaactgaacgatatacttacaaaatccagcaattcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgcctttttcgatggtgcgaactctagcaattgatccgtaggtagaccgggtcagtaataaattgttctatcgtcatttctttaccggtcaccaacggctcgatctcctggtttggttgctctccaagctgagggactggtttggactttccagaagatgctttcttcagcgttcgctcatagtctgatagctgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccctgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggaggagtcgatgctggagcctgcggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctagaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgaagtcatcaacgggacaggtcgattcgtcctgtgtttgcatggcgtccatgctctgtgatcctacctgccccgttgaggcgcagctgctacggtttcctgacgggctcaccattgcaggaaggaatggtggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctctagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaaatctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatacatatatatacatatatatacatatatatacatatatatatatatatatatatatatatatatatattgcatttcacgttaacgttcgtcctcgttcgttcgctcgttcacgttccctagctcgttcacgttcgttcgctcgttctcattcacgttcgttcgcttgttctcattcacgttcgttccctcgttctcgcttgtcttcgttcgatcgttctcgttctcgctctcgttcgttcgatcgttctcgttctcgttcacgttgtcgcggcaacgtatgttgacgtgttcgttctcgctctcgttcgttcgatcgttctcgttctcgttcgttaacggcggtgtggcggcatcggggcggcggttggcgcggcggcgtggtgacggcggcggcggcgtggcgttgtggggccgtggcggcagcggcgtggcgtggcggcggtggcgtggcgtggcgtggcggcggcggcgtggcgaagtcggcggcggcgtggtgacggcggcggcggcgtggcgttggcatgcggcggcggcgttgcgcggcgtcgaaggcggcggcgtggcgcgtcgtcgtcgtggcgcggcgtctcgtggcgggcggcgcgacggagagagatcgagatcggagagatcgagatgcatgaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacatttaagtgttggtgaagaagacgagaaagcaccgggaatatatatacccctagatctttactcccgg

SEQ ID NO: 23537 - DNA, 1754 bp, Oryza sativa
aatatctttagtcccggttgttctcaacaaccgggagtaaatatcttttcccgctatttcgaaattctttttaaacccggttagggttaagaaccgggactaaaaattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatagataatcaatacatccaaaatagtttacatcgtgtacacaataattacggcacgtactttctcctcactattgttccctccttgtgatcgctgcgagagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccatgcggggaaagtatcaatgtgatgccgtgtaatccatgcatcggacttaccgatgttcctggcgcgaactagagccaagtgctcctcgatgtaaggagctaccaatgaagagttttgcagaacagtgaaatgggct

SEQ ID NO: 23538 - DNA, 892 bp, Oryza sativa
aaactgttgtgaaatatgtaaaactatatgtatatgtaaaagtatatttaataatgaatcaaatgatatggaaagcattaatatttatttaaatttttcaaataagacgaatggtaaaacaagtttaaaaaagtcaacggcgtcagaagaagggagtaggaacttgtattaattaaccaatatagtgcggatcagttccaacgataggtttaccaatggagaaattttacggttattaaaagacaccaaaataattaagtgtaattaaattcgaaattgcggtaccgctcgtcgtcgccttaagatagtaaaattactaaaattaatggaggtcaggagcttgttaaccgtgaacctgcagactcgatcaaaccaggtacagattggattgcgcttgatgattgttttacatatataagtaagccgtgccattagcactgtatttacaaagactaatcgaaaatgtaatagtaactacgaacaattttgatagttcagtgttagatagttacagtgttacacccttttcctgatggaactttgttaggcagccacaatataatctagaataaacaacaggagggataattataaaggtagtactgggcagaaaaaaatgcacatatatatatatatatatatatatatatatatatatatatatatatatgtatgtattattagaaaaaaaatggcatagatatagatacataagaaataagtgaattacaccagctggcgcagtggcacattcggaaaaaacatgaaagaatgagggaaattaagcaaagaataaagctaggtcgtcacttattaattccaggaaatggccaatggcattttctagtgcttcgaccttcagcaaaatatcccatcagtagctaaatcgtgc

SEQ ID NO: 23539 - DNA, 22660 bp, Oryza sativa
atgcaactgactagggtagatcctagtaagaaccattatggaggaacgaaacatcccctgtgaaatcatacatctcaagagtgatctcacctgcaaccaagtctaagcatacaacaaaccaacaattcaagcaggagtcagtacaaataaattgtactggcaagcaccaagcaagcctaatactctacatgcatggcatattcaaagtaaagcttacaatggatatttttagcataaagcatattttgtttgaaagaccattttcaaattcagatttcctttcaattaaatttcagtaagcttacacttagcaaatgggcatcaaagtaggtgttaatcacatataacatagctccttattaccttccatggcagcaaggacataatccacaaatcacatcacattttgaagtttaaattcagcttttggaagaataaaacacaagtctatactcatgacatattcacatgccgctcatgactgcgagcatggctaatcgattagttttaactctgtagagtacgtacactttacccacatgatgcgaaataataattatgcaaaagcatggtacgcgatacataagtacccgatttataactcacaacaaagcccttcaaaaattcatgatatagccttacacctacacgatacgtgttccttcatcctagtcatactagaaatatgacctagaaccgttaagtggcgggcccatgccttaaacttaatgctgtggtgacagacacgacgggaacccaccacgtggcactataccgttgtattggacacgcttagtcatctaaactaccacatcggggtaaataggaagctcctctgaattattcgaactcatacacactggcctaccaagatgtaaggctaaaccataaataatttactaagcttgggctatctcatactagcacatgtggttgtactgtatacgaaatgaactgacattgagtgaagtccttaggtcggtctaggcacactctccccctatcagcacacaactaatcaccatatgtataccacatgaggcccaaacctaaaatccacattttccaatattttatttaacaaatatcacattttatcatttctgtcaagaccataaattagatcattttatatacataattgagcccaaatggtaagtaaacccaacactaagcatgactaagcattttcatagacatgtgacctcaaacatcaaacttaatgtgacaaaatgaattgttcctaaggctaggaataatggttaaggtcttttgtggagtttaggtgataatgcaagttaaggagttgatctaacaaattttacaaagttttaatggattagtgtacaatcgacatgcacattttgcaattcttttcaaaaacctccaaatcataggttcaatgtgatcaaagaggggaggtggcttgccttgctctactacaaagtaggtctcctcgtgattcaactgcgaatcatctaaacatacatatgcaaaatcaaaattataaacatacacattaaaatccaacatgctctaaaaagaatgcttttcatagattaagtgtgttctgtgttaaattgatttttagtgaaagaattttcattttaacagtttccattcaaaacttacaaatttttaaagtgtcttcatgttaaatatagacctacatgcatttcggatttttgagacataaatcttcatgattttgttaagtctaacatttttatatgcagagcataaaaatatgattccaacaaaatttagtttgtaaattttagagttagaatgaattttctactaatttctaaagttttaccatttttcagttgatgagaaactagttttgcattttctctatttttctcaaatcattatctctctcgggtccaccggtcagtgactatacttttgcgcataagtccctggttctcgggaaatagatccagcagaccctgagcacgtgttccaggattttattcaaaacggtacttgagttttaagttatttactcgttagtacacaaccccacatgtaagtgtctaaatgattttcttaaacaccctggaagttttaaaagattgcaaggttaggcccttgctcttgacggagcagaggggcagctctcccgcgagcttccccacattgccggcggcgaacggcggcgattcagttcgagctcccaaaacaaaaagtgtagaggacaaccgtacgaacctatcggtagctttcttgcaagatttggtgctctatagcggctgttaaggtgttagaggtggcggctagcttttttgtatggtaaggactctagggactactaggaagctcaccaagcaacgcgaggtcttggcgatggagagctggtcgggcggcggcgcagcggcttcggtatcgtcggcgatgcaccttcgggcttgatctgttcaaagcgattttagatggcacaagatagctctaggcttaaaagaatgcgccgaagctcaccagagaaggaggaaaaaggaaaatggcgtcggcggccagagttgcggatgaaaaaggggatctcccgccgaggtccaactcagatcgattcctttgggattcttgatccactactaaaaaaatgatttttcatggcgtttggaaaatatttttcatggcggctaagtgaaaaaccgccagcgcagaaaatcgcgggggtcgggggtcacgggccgccagcggaaacacaacttcgctagcggtcgccttaagccggccgccaacgaatatatggtattttcactggcggccctcttaacttgacgccagcgaaaatcgtcattttcgctggcggtaggttaagaaaaccgccagcaaaaatagcctatttttgctagcggagttgttaccattttcgctggcggataatggagagcgcaagataaaaaatcaagccattaagaaatcaccgcgcgcatccacctacccgtccttatcctctctcctcctccctcctccctccatatctagccctctcttccttcctagtccctccaaatccaacacctcctccctcggatccacaggcggcagcactcgcgagcgatcggaggagagggcggcggcgagcttggggcgcgggcggcatgctcgggcgtgggcgatagcgctcgggtgcgggcgacgcaggagagtgcggcggcgagctcggggcgtgggtggcgaggtcgggcgtgggcggcggcgctcgggcacgggtgacggaggagaggacggcacgaggtcaggcgtaggcggcccgggcggcggcgctcggcgacagggaggcgcgaggcaccggatccggcgacggggaggtgcgaggcggcggatccggcgacggaaaggcgcgaggcggtggatccggcgacagggaggcgtgaggcgacatatccacaggtctctctcccccactcctcactcctccccattccccgccgccaccaccccctctccctctctcaaatctagcgttgcgtggctttgcagcggcggtggcgaggcggagaaggtggaggtcgccgaggctcggcagcagggtcgtcgaggcggtagaggtcgccggggctcggcagcactgcagcagcgtcgtcgaggcggaggcggttgaggccgacggggctcggtagtggcgacggtgatggtggatgggacttcaaggatgacgacgccggcgacggcggttctctgtatttgtgatgcttgtaatatttgtgatgatatttgtgaagcattgtatttggattgatgcttggtgttcaaattttttgttaaatgtgtggatattttttatgcttgaatgcttgggagaatggaaatttttagctgtaaatttttcatgtaaatttatgtgtggatggagttctgatggaggtagacggagcagtgttttttttaatatagttttgcttttcaaatttccgcctcttcgctggcggctagggcagctgcatggttttgatttttgctggcggttggtggaagacaacagccagcaaaaatggatctttgctggcggttggctaaagacgaccgccagcgaaaattcattttcgctaacggtcgataaccgccagcgaagatcttgatcttcactggcctttgctttgtggcggctctaaattccgccagcaaaaacctaaaatggccgccacgaaaaatggttttcgtagtagtgatcaatggaggttgatgaagctcgtggcgaagtggttcagcttgtcgcgaaccgtggtaagccgggcaacgaacaatggtgatgcggcggtgtccaaagcgcggcggcgtcccaagttgacgcggtcgcgttcccagagattggctgcaccaaatgaggcgttcttggtggtgttagagagggtgttgagagtagacaagggcgagagagagagagagtgatggtccggtggtcgggtaatatatggtgtcgccggcagaggaaaggaggaggagcgcacgttgccggcgtccatgctcacgcgcgtggcgtgagtgttctggccgtgggcccgtgtggagaacgttgtgaggctgacaataaggtcccaccatgcagccctggcccacatggcagtgatttgcgtgagagagggaaaagagatctaggtttttgaccaagtctgggactgtggtgaaattccaactttgggctcgatttaaaattagttccaggcagaatttgggttagtgaccagtggcaaagttgtaaaacaatgtttactctacaggttggatcaagtcttacagcctaggagtccaaggtcgaattttggcaaggtgtcaatgtgtgctccagagaatctgtcaaaatcctgtgtttggagagttgcttggtccatctaatgacttgataaatcgaactaaaatttacatttgttttctaaggttagttagaagtttacatagattttccccagatttttgagttgttacaaatatttttcttaagctcattagttttacttaagaataaatatgctcctataatgcatatgcaaaacatctcaaaatgcaaaagcaattaaacataaaatttttaggcaaaaattttattcattttacttcatccatcatttccatgttttccatacatccaaacttgtggtatgtgacagttcgtttacaccctattgacattttcttttttttatttcatacagatattatttttagttcaaatttatgatatgataaataatgacaacattacaccctatgtgtcaatttttttaaaagaaaaatttatctataaggaagtaagattggtatatattctcattgtttattaataaatggattttatgggacatgaggctacggtaaattcatgggcttgtatactacaatatatttccattatgtgatagatgattcatttggaaacgttttatatatagtgtgtgaggctctacgcaaccattaagaatacgatttgatgggtaattaaatataactgtacatgcaacattgtttttggattgtaatgtattgtgaatgcttctttgatttaaatattttctataacagtctgtttggttgaagggagtttctaggagggattgggagtttaaagggatgaggctattaactgttttgtttggttaggggacatggcaattttggtgggatggggatggggaattgaggaatgaattctctccttttcaatacctgggtaggggcaggtaattgggagggaattcctcttttacttcgcctaaacaaatctcagccatccgttttcattaatgatctaatctccaactaaactccctatcaatttccaccacctctaccaaacaagagactgggatgaaaaatcaaattcccatcttaatctcaccatcaatttcctcgtgtaaactcccaatccccttccctcaagttgccaaacaagccgtaatatttatggaaagctagttttatgggctatcaaccccaacataaaacatggtctaaaatcttcaagagatcttgaatccctttcaactcacacaaggatgaaacattttgagcactagtacttgaccaattatatgcatgtgatatccctcttaatagtacggcaacgtattctgtgcactcaggcacttcggtgcactcgtgcactcgctcgatctacaccctcgaatctcgatctgaaggatgtgatcgaagaaagacatttttgcataaaaccctttgtgctatgctgctcgtggggtgaagtctggaagggagaagaaagaataaaacgaggggttgtgtgtagatcgaaaacctcatccggtcctccatctccgctcggcgtcaatggaggctcgaatccgcccggcaaaaccacagtcgacggagtggaaaatcaagtttaagcctcccgttttcctttttcaatactcctctctaatcctaccatttaattaatctctctttctatctcctggctgtagatttcgttgcatcggctgcagcataagcgactccattcattgtactcgctaatttcttgtgctctttgcctttttgaggtccgtcgacggcagcagcactgatggcgtaatcgctagccatgcaaactagctgatgctacaaagcacaaagagaggcaaattttcaaagctgtagtcgttgatttaagattgctcgtgtataaattgtgtatatcttgatgtatacaccttagattgtcttgtttctcccattgagatgtgattgctcgagtgtagactcttggcattcgacatcattgtcatttttgttccttttatatgtggctgatgcatgtcaactaaacacaaaagcttttgtttttgcctctgtggagcatgagtttcctagagtatttgagccgcagctgacgccgcgtggtgagggaggactctgagaagatttttgagccgccgtcgtcacttcgtcaccacacggagaagaaggattgggatgttttagatctggggtgaagcctggaatcctggacgggagaagaaagaacaaaacgaggggtcatgtgctaacttagcaagcgcggggggttttatgaaaacatatctttctttgatcacacccatcagattgtgatttgaggttctagattaagcgagtgcatgagtttacaggatacgttgtacggcatcctaaactcaaatgtaaaaagaaaagttatatcagcaggaatacattcacaccattttctttcttcacttagagggttaccaacgtcaagattatttgatcatggggaaaatctcatcttcttgatctttaacatttcattttctatttctcaaatgattgatacatgcaacattgtttctggaatgtaatgtattgtgaatgcttctctgatttaaatattttctataaaatttcttattaaatgttaggaattgtgagatcgaaaccaatcactctgtatttgttttagctagcctttacttggtatgaattaattagaattaaattacataatgctttttgtaaagcccacaatgcatatccgatccaactaccataaaattttaaaaagagaccctagaaagtctttatgttccaacgaccaaataaattattttaatttttttgcattctagtatatatattgtttgttcctatttaatacaccctacggctaaaaagttaaggcaaagctaagcacattgtgccttctcccactctgtatatgcattattcttaactccctgagtttggtctacgtactatatatctaccgacttctattgcattccgtcacgcatatttgcgcaagaaaatatttgggttccaaattataaaaaagttaattacaatttgttccagaagtaaatctaatggttgaaaataattggtcaaatatttttactttttttctttgaaatttctaaggttttttttctaattttttagacatggtgacttatgagtgctttacatcatgttttttttgtaattattattattgattgacatgtaaaggataggggctatgttcaagtgatgtattttatttttttaataacgacaagtatggttaatatggatcttgaattatttgtttaattataaataaaacaacagttaaaaaattaaaatcatatataactttttaaattataattatttagctatctaattattggttggtttatattatgttgttatttaaaaatagaaaaattacagaggaggaaattggacaggagaggagatatgtgtatgtacttatggcaaagggagagtttgggagtttttgttcttttagatagatccaattaatgggttgttaatgccaaaatttggtatgcccgaagtcatcatcggcctagagtcagtatcggcttcagagtcttagaatcggccgatgggagttgtgaaatcgccagcagttgtgttcttggtagagtcggatcaattaaaggaaatttatctagagagtccgagtttaaggaggatacggcatggcaagtatatctattaattaggataagtttgttagttccttttatctttaggaaagtgtgtttagtgtcctctaaggactttatgttttccttttatctttaggagagtttctttcttgtcctacaaggactagtatctccccatgggtataaatatgtaccctggggtcattgtaagatatctctctcgatcaatataactactctcggcgcatcgccaccctctttcgtgaggtttttacttatcatccggcagaatttggcacctgacgcggggctgcatcggttcagttcgatctccggcgaaggggtaagttctacgttccgccgctggcgctggcgaatctaccggctatgttggtgttgttcaaggctgcatcgcttcgatctcttggatcgctctggtttggttgatatatttgcctacctgatatctcaattctatctctaattgcattgtgtttagagacgcatcggtttagctgggactgtctcagttaggtccgatcttctgtcttagccgatatatctttacaatcacaatggtgttctaaatagattttttatatccatcacattagacagatctatcggctcatcgggtattagattatcatatacaatctcgtgctgtatcggttagattcgacctactagattgttcttgataatataaatcttgttaagccgataggttcatgctagtgttttatcggggtgctagccgataagttagatttagccgatgacaacaaatactttattgatttatctaatattgtggattttatgacatcggacctccagccgatgtatgctttaaccttcggatcaatacttgttctattatatcatattgttagccgattggtttctactggattatattgctataatattgttatttttcatcatcagtcgatcgcctttatatcattatttacattggacatatagtcgattgctgaaaaccctatcgctatcagctagtatcggcatcggctggaattgctccatcggcttgtcagccgatcagcttattggtctactatttgcatatcttatccgttgcagggtcaaactgactggcacgcccgcatctcgttaacctttggacctgcactggagctaagcagatctgccaggccagtgtgtttttttttttgcatcaacacgggttcatcggtctaaattatctttatttatacataaatataatattaacaaacaaagtaatgtatttcttttaccacttaattattttaatcttattaattaattctttgtgtttcatattattctaatataagctacgtgttgttaatcgggtgtttaaaaatctatatgatatccccttaaaaatatgtctcaagtgaccaattaatagctagtccaaagcaataatttttttacttgttaaatatatatagttatgatttgggccttcaattatatgacaaaatctaatatagtacgtggataaaaaatagctataagattcagataagatagttatgatataataatatgtttgtgtctaatacatctatactagttgcccgcttgcaatcctaatggtgaaatcatcctctttcatctcatccgtccatccaccatttcatttaatcttatccgtccatatgccatctcatcccactccaccgatgccaatgatttcggcaacccgggcgcgatgactcccgccatccccacgcgcgcgctactcactccctccggccgtcccagcacgattactccgcccccgtgctcctcctcactcctctcctccttgctctacgcctcctcgccgctgacaccgctgagcgctccgcgcgcccccgtagctccctacacactgccttccccacctccgctgtgccgccctccccatgacaccacttcccgctccgccccatgcgccggacgagaccacgccacggcgccggcccccacgaccgccgccgccgccgtagcagcagcgtcggactacgcgcactacccgaggctctcgccggaggacgttgccccgcctacccctgcaccctaccacgccgcggccgcccttctcgggcaatccctacgtctcctcccccgccggcggcgtcgcacccgcctccaagagtgcgttccagcagccaaatctgccctccgttgttgccaggattacttgcggtttttttatagctgtttcggatttccatttttgcagatacaatggatacggtgaagaatgttcttggcaagatggggaagaggttaggagaggcggctcgcaagacggagtccctcaacgcccgggactacccccgacggttccccctactgctggagccactgcggcgctcgaccagggacgccggactagcgccgacgggccactgtagcgccgagccaccaccgcggtcccacgttctgcctattcgcgcacgccacgctggtccgagtttgtccccgcctgcaccaagtttgtccaacgttccgccaaacattcttcgagatgcttgggaactagtgatttggggactacttcaagatggaggcatctcactcaggtattgaatcgttctagattccctgtttattcccattctcatgcaattgcggccgtgctgtgcgaatctaatgttgcttctaatttggactggaatcatggttggttgggttggcgagttgcagatttcaaggctgttcagtgaggaaaactgaggggtagatctgttgatgatttggggatataatggtgtagcccctgattttttgttacaacatgacagaaattcagtattattggatggattcacgcaatgcgctgcaatttgtgcagaaaaggcagtttttttgttgtgtatgatagatcaagtttattggatcagcttctcttcggaactccccattcgagttgttgtgttttggtatgtgggaagtatatacgcgattttgctccaagtttgtcttgatagaatttatctgcgctggcacacttgattcggcacaaagtaactttcttgctttcccatccccattagtcctatttttatttgtcaaatttttgccctgctaccatttttgctttactgactcatgcatccacaggtccacaacactgtgcctccgccgacaccgcagccagatcgaccagtcaagcatccactgtgccgatgtaatccccagtcaagccagattgatgggcagatccgatgcaccggccagaagaacgggctgctcagttgtaggtgagttaaactttgccatcttcctttgactcctcaattaccttcttggtttgctaggtgctccatgaaatcccgattagcaaatttgttgttttgtctaccaggattggtttcgcccaaaactgaagtgaaaagaatttgttggtgaaaaaagaagttcagaatcacaggttatgtctcttgattgcaagacaaactgattaactgtgcttgcaagggtgtttgtagaaacggcttaaccactatttcttcccaatcctggtaacaagcaacagacacaaggtaataacctttggtgccagatgctgcatcacactcctgagtgagcagcaaatgtttgacaaaatgcttcttaggtactgttactactcttgcatgctatttgattctttttttccaggcccagttggcagctaaactagtattgtttacaagtcaaagatatatatattgcagagaagatctttggtatgtgtttggccttttatgttaagcgataaatgacatgcaaaacataaatttcaggtttgtcattactcaaatacccattgactgtatgcgttgtttcaagttgcagaaccataccattgtcctttacagtatatctaatcatactttttttttgtccattcatactccatacaaactattctcaattctcaactaccaatgtcttcatatggatgatcttcagttgatgatcttgctaatttaagtgtcgtgacattatcaggctctaaggaaggacatggcgatctgcgagagcagcattgatattatcaaggtaacagcggccagtgtagtgccggttaatcttgtatgaatacagtctttatatatgcacactgccgatgtagtactatgtctctatgcatgcttgtaacaatgcctaaaagaccagggagaggctatgcagagggattggggaatggggactgccaattttctacattgataagtttagtgtttcccctggaagggatatggcagggatattcacaaagtgcagaatacgtgattcagttggagaaaggcaacacatgaggaagatggtttgcataataaattatcttaggttaaactaatgtttttttctgatctggtgttttgtaccctcataaccatctagctgttgtaattcatcaagtacccatgttaaagtggttgtaccctatagcaacctagcagggctttacattttgttctgtgcaaaagttggcatggagtaagaaacagggttatgtttacaattttcaaataaattattccttaccaaggcattcccttcagttttgttgcccacatggcacatagggaacagttagaaattgtaagaaattttatactgaacatgaggaaattgtatttctcttaagtttgtctgatgggtatattgctcaatcaaaggggctgatcaaaaaaccaaaatagcagtcacactttgatgcatgaatattactaccttcgtttttaaatatataatattattgacttgtaggacatgatgcttgactgataatttttttaaaaagctatgtatatttgtgacttgtttcattaccattaaagatacttcaagcgcaacctatatttttcctgaaaagtatttcattgcaagatttgggaggatttcgtaggtactaaatagcaaaaaagaaaaaaaagctatgctatgttatgttattcaaacatataaaagtgaaagtatattgattatttacatgtgcgtcctatcttttgattatatgccactgtgaatttgattttcgaaagaatgtaattttaatataggtcacgacgtgtattgcacgtgcacaattttaaaaaaatattgccttaaaaagtcaatattgttctatctttgtatatacattgccaatatcaatagaagagagagggaaccgaatggatggagggaccgataagggacgtggcccacgtaggtctttcaattttttaataacaaaaataaatctaatgggtccaccatgtttaaaggtaaatcaatggttgtattacgtggtaatttaggagcgtttgtaagagtgccacgtgacggtttatgagtatttataagatgtttaatggacttttattatataagagatatacgactgggcaattaaagcctcttgcactactgcagaaaacacaacaacattgcacgagttcaccccaaccattgacggatcacgataggtgtggccgtcgttgccgagcttgccatggttacgacactacagctctaacttcacaaaactcggccttgactcaacagtatcacatccctgtatatggctgccaccaccaaagcttgctgcatttcatcattgctaagtaatctaccgtcaaggcgaggtgcaatgccacgtatacgaaacaacacaatggaccatataatataataaagttcaaacacgttatttttcatagttttacattatatataatatatacatgctttacaaatatttgcgaaaatatatattccccgtaggttgaggcgtgccaccgtaccgatggcgcatggccgacctaaggggtggtggcacagaaccaacgcatgtgaccgcgtcgctcccgcacggcacccgcatgccatcgcggcaatgcaacatgtaggcagtcggttctgcatgaccgatccgcggaatcatgttggtccagcatgaccaatccgctggaccgagtggtttcgcgcgactgattcgcgggaccgcccctcccgtcggtttctttcttttgagttgcaccgatggcacggcccaaacccgcacgaatgtatatttccgccaatattttaaaaacaacccgaaatattatgtgtatttttcataattagctggaagctctgacttcacttgctccaccgtcccatagcttatgttctttaaaaaaaaagataattgatccataggccatatcactctcggcccaatgcctctcctgccatatttgctcttctcctgatcattcgcctgcgtgttgggctaattcgttctggaaatattcctcctgagaaaggggttaatgactacctattggcatatacgtacaacttcttttttccaaatgcgcaaacaccttttctacgcactatgtttttgtttttgtgagtgcaaacttttttttcctgaaacataaaggctcatcaccctataagtaaatttgggtcagtatattttgaaatttacgaagtcaccacaagtgcctcagtatcgatgggtacatcatgtaccactgaaaaatagttagcaataaatacaagcatatatatcaaatttgtgactttaatttgagtgggtaagtttcaccggcaatctaactattttagggtgtgtttggttcacggtcaaggttggataggatatggcgattcatattttactcgatatggcgatccagttttttgtttggtagagtgaatatggcgatccagttttttgtttggtagagtgaatatggcgattcagttttttgtttggttgtaggaatgaagatggatttggtgatcttttttttggttaagaggagtaggatggatgagtggttgcaatcacctcatcattagaggtggtgagtatacccccttcaaattcaccaaacccaaacattatcaatctactgcaaaataaaaaatctaaagagaaataaaaaaatcacaaagaaataaaagggaaaaaggagaaaacagaaaaaaggaaaaaaaatcacaaatcttctcgccgcctcgctcctctcgtcagccgccacccgcctcgaccgccgcctcgctcctcttgccggccgccgccccgctcctctcactggccgccgcctcaccttctccagatccggttgcttctctcgccgctccgcctcgtcgctcgccaaccgccgcaacgctcgtctccttccccacctctcgccgccccgcctcgtctccttccccaccagccgccaccccgtcttcttccccaccggccgccgcgccatctcctttcccaccggccgctgccccgtttctcccagatccagccatcgtcatcgtctccatccccaccggtcatcgccatggtgcaccggccgctgccgctgtcgtgcacttcccgctgccgccgccgccgtgtaccgggcgctgcctcacttgcgtcgtcgtcgaggtctcgtggtgaggggtgacgcgacccatgttggtcgctcgccccgctcgcccgggcgcccgggcggttgcatccggccaaatcggccggatccccccgatccagcatctaagaggaatattcctcttcgggccactctatcccatcccccgcccaccaaccaaacatccacaaaaaatgggccgccatgtcctatccacccaaatcactccatccaaacacacccttacctatgctcacttcaccacctaacttaaaggtggaggcacatcgatagatccgcgatagtgtattatagctagccaatcttgtagattaataaataatttatgcttagtaagctacaccttgataatttaaaaaacataattaaaacaaataatatgaaatatgtggcattgttggattggatgcactaaagaataagtaaaaaaaaggaagaaaggagtacaacttagggcctgtttaaatcacttggcaagctttttcaccctatcacatcgaatgtttgacacatgcataaagtattaaataaaaaaaactaattatatagattgcgtgtaaattcgagacaaatcttttaagcctaattgctccatgacttgacaatgtggtgctacaataagcatttgctaatgacgaattaattaggcttaataaattcgtctcgcagtttacaagcagaatctgtaatttgttttattattagataatatttaatacttcaaatgtatgtctgtatattcaatgtgacacggtaaaaattttcactcttagatctaaacacagccctagtgtttgtagactccattacatgtccaaaacatgcatgtgtcttccatgtgaccaacaaagatacatgacacttggcagagttaacaagcatgacgggatacgtcatatgtcgcatcctaacttaaaaggatgaccatgttaggtgacaaagataggaaaggatgaattaattagtactagaaaaatttgttagatgccgtgctgatcgaggatacagtacacatgatcgacttggactgatgagcaagcaggtgcatttctctcgtgcgtcgtctgtgctttgacacagcgaacgaccaagagttaaaatggattaagttagactgcatagtctcaattaattccaaacgcgcctttcagtatgagagataaccttttctgctttcccggtagcatatacaggttgctagttaaattgaatttcaccagactttttagttctgaaaaagtatatggctgatcgtgccatctccgcgaagagaagaattttacaaaatgcatgccatcgcgatcatcctcagtctttactcaaaggaagttgagacatgctattcacgaaaaatatatactcatttaatttcgtttcaaaatatactaacctaaaactgaataagacacatcctattataacgaattcgaagaaagacttgcgtagattcattgtactataacatgtcttcaaatctaggttgtgatattttgggatatagggaggagatcaatatacaataattatcaacgaggttatatggtaaaataagggcatggaagggttgaaagtgcatctaggcccctaatgattttggtgattaattataatgcgattagagaggactaacatttttatgtaagcaaatgtgaaggttgttatgtcctcaatgagttagcgtaatgcatatcccgccgaatacgttgatgtgatgtgatgcggcaaatgagcaaatggtatggtgtacgttttcgttttcttgagttattaggaaagccgcactattaagagggatgatgcattgacttacgaggagtgatcaaagtgctcaaaaccttttttaaaaaagtgtttctcctcagtttggtgtgttctggattttttcggagttttccgaaactcattttcggactttccgaaaacacatagaaccagattttcgcttctggaaattttcgaatatgtccgaaaggatacagaagagtggcgcacggttctgatgatttttggatatgtccgaaaattttcggaaatatccgaaaaatttcggggtcttcatatatcaccccgtggacttccttctctctcctttccacttcttttccccacgggttgcctccctcctccctccccaccggcgactccccggcgatctcctcctctccggcgacctcccgcgacacccctcctctccatcctcgagggagcacgtttggggcactttttgggccctacattgttgatcttcaccatgttcttcccgtgttcttcgcgttcttgaggtatttgtcctacaatcaaatccctagattcctcaagttttctcttgcgatttcctttggtggagatgttcccctagtgccataggccctgcatattcaatttcacaagtttttgttggcggatttgtgcggcatctgagttatagggttcggccggaatttttcggacttgtccgaaaatttttggatatatccgaaaattcctggccgacccttatcacttcggatttgcatgtttcttgctctcaatcacttgtttcttatctctttggcttccatacctgattccttgtatctctattgtttgaaggatgcctctccgcaagcaaacctcccacaagtccaagcgcccgagggatcgctcttccactccatcttctcatgatgattcagacagtgattggtccggtggagaggatgcggttcctcaggttgcgcgggtggctcggcggtctactcatgctcatgatggtggtggtgatggtgagggctcttctcgtcaaccgcaaacgccgccgcaccaacccaatgtccccattgggcctctccgcattcatacccccgagagggatccggcggtgattcaccaagtgtatgattggcggcgcaagtctgaggttgttgctcgtcgtcgggacgaggatctgtaacatcctggcctagggtttaataggattaatagaatactcatatcaacaagttacaacttctttttcggaagccaatctccgaagaactccagggttaagcgtgcttggcctggagcaatttaggatgggtgaccgaccgggaaattcttctcaggtgcacacgagtgaggacaaagtgtgcagaaaagacatgtgttggcttgtgagggcagtctatgacctatgaaagctatcagatgtaagcgggcccggcctgggagaggcgggacgttacaaaacccgcgtggtcccaggtgggacccgcttgtcggcgacccggcccaccggctctctctctcccctccccgcccccgcgcgcgccttgggccgccttcttgggccggccggcccattaagctcggccgagccgccccattctcttgggccgcgccctagccgcccgagggaagtctaatttccctccctccttcttttcttttcttttctttttcaaaaaggatttaaataaatccttttcctttagaccaaaaatccaataatcttagaaattcaatatcttcccaaccgtaagtccgtttgactccgtacaacttccaaaatttcctcaaatctcgagatctatctgatggcacgcttagaggtcattaatagggctttattttcgccgtttgttgagttgtcccgtttcgcgtgtagtttcggagcccgaagacccgcagtgcgaggatttcgaggatcaagctcaagatctcgagcaaggcaagccacctttgaacatcttgagcctatatttgaactaagttatatttcttgcaaaatattatgcattgctaggattgcacttaatatgtttgccccatctacgaggcagatcggtgagcatacctaacttgttgcatttgatccttccattgttaattgttatatcatgtttccttgtaaccacctggtcacgcctcgatattcgtgcactctgtgcgagtatcgacggtcgccttcaaacttaaaatatgataaacatcttgggtaaaacttggtttacaaaacgattggaaaacccgacgcctgggtcggtgtcttgtgaaagaaaatgagttttaaaaataaaactcgcgacacaaggccattcctgggcggaatgcttgtgcggtcgcatttaaggaccgattccttcggaattacatccgagcatataatagtgcaaccacatgggtggaataggacactcctggctgagtaattagctaatcaggggagccttgatgccgagagacaagtggattcgccggggtggtgtcggggaggacccctgggcttcctagcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccttctgcagaggttattaaaactgttcgaatagccgtgctcacggtcatgggcggatgtgaggtgattcctagcgtagttttgtttgactactgccttgtgaaatttgctgttgtggaatgggtttgatgtttggaaaatctgcgactgatgggatcagccaggcccgggtggccgtttgaaagctgttggccgggtgccaatcttgatcgattcaaaatactgaaacattgcacatactccgaccggacgagacgcactgtctcatccgtgtcgtttgagaagcactcacttagttgtttcagaaaagagtttaaataaaatcaattgcaaaaacaacagcctttctttgaagcctgcattaaacacttatttcccatggcttgctgagtactcccgtactcacccttgctctatataaataatccccccagttgttgaagaagatgaagcggatcccgctgacgaggagttcttctaggagcaagccggctacgatgagttttagggtttcggcctagttcccaagtgcctgtgatgtttggtccaagtcctggcttccgttccccttttgtaatgcagttgtgagctcgggatctgtccgtagcccaacatgactgtactcctactctataataaagagacctctggtgctgtgatattctgtcttcctgtgataccagcactgtttcctgggactggtatcgattaacaggttaatttggagcgtcacgggctagttccggtcgggactagttcagggcgtgacaggatccgcgctcccttcgccgcaccgccacggatccgcggttttggactctctttcaacaagacttttatgagtctgtaattaagtccaaagctcatcccactgttcccatgcaatggatcaattgggaggagttgcaggcacacaacgatccggtgatcaactctgtgattgccaattgtgatctcatgggtatccgctccttcatgacattgcagcaaaattggtgcaacgagatcattgctcagttttatgccaccgtatactttgatcgctatcgtgccatgcactggatgactcaggggtcctggtactctgtttcttatcagcagttggctgagatctggggcttccgtcttcgttctttgctaaaccttgatgaccttcataatcttcaaattcctgccaacacagacttgcttccccgttacactcgaaatgatccaaatgtggtgttgggcaaggtcgacggcctcaagctatactttgcctatttgaaccggatgtttcgccggtcttttgtgcctaacgatggtgatgctagcagcatgaaccatctctctaggaccatgcttctccggtttgatcctcctcctcatcgcttccatgtctatcactttgtgtgggaggagatccgcatggcttcaattcagtacaagaaggggttggtctatgcccctcacattatgcggatgatcgagactgtgactcagctccagtttcgccatgatgtgactcattctcagcttcacttgcgccttcttaaggccccccgctcctcagctactcgggacgtaccctcctcttctactcagccgcctcctgctcctgagcgccctgcctctgtggctcgtcgtgagccatctcccttattccgcattttgcggagtctttttggtctttgctccgcggaggccaaaaagaaccgccgattgcggaattcggcgaagaagacggctcgtgatgtcaagttcctaaaggcacggtattatgaggaccaccacattgatatccctccttctcctctgggtttcgaggccgagcccgatgagccagaggatgaagagattgaggatccttttgccgggttgccttccgacttcgacttctttggatatggccatggctatggctaacctcctccaccacctctcgaggaccctcctcaggcgcccttcgcttgagtcgtcagctcattgtcctctctttttggtgtcttgatgccaaagggggagaatatctatcatggctttagtttatctatcttgtccttagcgtcgagcactgttggtttttatctgtatgagacttttgtgttttttatgttaagtttaaagctttgtaagactattgtttaattatgaatgcttgtgatgtaatggatctttttatcttttaaagtggtgcaatgccttaccctctttatatggtgcttgtgatgagatgtaattattcctttgcatgcgatgtgttggatgtaatgagcatatgtgatatatttgttctcttgtgagcttcaatgtggatgcaataatttagggggagctctctacttgcttttatgcacactcttagggggagcttccactaaaactttgtaccaaaaaccttaaattatattcattctctcttgtgttctaatc

SEQ ID NO: 23540 - DNA, 3220 bp, Oryza sativa
ggggagatttaaagtgcatctaggcccctaatgatgttggtgattaattacaatgcaattagagaggactaacatttttatgtaagcaaatgtgaaggttgttatgtcctcaatgagttagcgtaatgcatatcccgccgaatacgttgatgtgatgtgatgcggcaaatgagcaaatggtatgttgtacgttttcgttttcttgagttattaggaaagccgcactattaagagggatgatgcattgacttacgaggagtgatcaaagtgctgaaaatcttttttaaaaaagtgtttctcctcagtttggtgtgttctggattttttcggagttttccaaaactcattttcggactttccgaaaacacacagaaccagattttcgcttctggaaattttcggatatgtccgaaagtgattttcggactttccgaaaaagactgcgaaggaaaaagtggttctgtatattttcggacttgtccgaaactgattttcggatttttcgaaaatcattagtagagtcaatttcgcttctgtatatttttggacttgtccgaaagttattttcggacttttccgagaacatccagaacgatgttgttggtactggaaattttcggacttgtccgaaaagttttcggaatgtccgaaaaatccttcgttgactttgctgttggtgctgggctggaattttcggacatgtccgaaaatctttcggaatatctaaaaatctcaattattgtacataacgggcagaatctgggctgtggctataaatagccccctcccctcacttgtgagggctgctggttccattcgaatcatttgtgcccttggcttgctctctctctagcacttttgagccttgctttcttgtttcccctctcacccgtgttcgatttggatttggtgtgtgtgtgagagttgtggattcgagtttgtgtgagtgcttgttgttgacttcgtgaagatttgtgagcacttgcatcatctacgggagttatttgcttcatttgttactcttggaggttgaggactcctaggcggctaggtgtcgctcccgagccaccgatctacttgtggttggccgggagaagtttgtgaaggtcggatctcacctccgaaagggaagagatacccttagtggaaggaggagtgcttactgcaacctcttgaggaaagggttagctaagacccggctcttagtgagctcctcaatggagagtagaatcccctcaaggattcgaacttcgggaacaacctcgtgagcttcatctttggtgactttacttcctccctctccactagctttgcttgtttgagccgctataggtctagttgctgtttgtgctagcatattcttgttgtaggcaactagatctaggatttactttgctgtttgtgctgactccgaaaattttcggatatatccgaaaatttcggaaatatccgaaaattactgcttccgcttttagttgttttttgaattagcctattcaccccccctaggcctaattgacacttgtacatgtgtcgtcccatgtacaggtatggctaagtctgtgcccattgcggtgcgtttgtaccatcttagatattcttttgtgccaggaaattgttttaaaccctcgagggaatattgtcttattttctaaagaccatccaaatagttatgaaattcttttgaaaaaaaaataacaacagtaatgcaatgtaaatatcacttcagaaaattttaggttcaaattcaactcatatattgagatataagaaaaaggacaactttggcagatcgataatagtggtactatttatattcgaatttatctcttctttttcagtgtttaggttgaatttgaaattgaattttggtggagttctagacgtcacttactctacaagtctacattgtcaagaaaaaaaatatttttttataattatttgcattgaatttataaaaaataaaaggtgtatgagggatattcactctccattcccttttatgccttaattatttatcgtacatttctctttttacacgatttgtatataaatatgatataggttgaatttatcgatcattttcacctcatatgtattttaaagttgtgttcgtgaatatacgataagggattctgacgctaaggccacgtgatgatgacggagtgacaattggacgaatgcagcgacggtggtggaaggagtgaaggtcattacgatggtggagggatgaacaatgatggatcaaagtagtgtttagcaacgttgcaaaattatcttatctgctgggaccaccattaatgacaccttgctgccgtgccatcgcattggctgcctaattacggttgcttaatttcatccaaatcggatccatcgctcacatagcttgggatttgggaactggagttggggccaacatatggtcatatgcccatccacatacagttgcaaacatatgctctctgatttcctgcctggtacgcgtctacaagacaagcttgtgcgtgggtacacaaaaacaagatgctgcttaccattgtacggaacggaggtttatgacaggtaaacgtcgcgtgagtgagaggacatggagctaatccctgacgttaacacatttgattactactccatattacttttactgttttaaaatataaagcttttaagttttctaaggtagctttaaaataaagttttgaatatcagtagatttactccctccgttttaaaatgtttgacaccgttgactttttagtatgtgtttgaccattcgtcttattcaaaaaatctaagtaattatttattcttttcatattatttgattcattgttaaatatactttctatatacatctagttttacatatttaacaattttttttgaataagacgaacggtaaaacatgtgctaaaaagtcaacggtgtcaaatattttaaaacggagggagtattttactatgaacgtctataaatttggtatgacatgaaaagtacatttaaatatgaatgtaacaatgtcacatggcgctacacatataaattattgagtaaagtacacagccagtccttaaaattggagtaatgtgtcatttagatccatgatcttaaaaaatcaacattagggtccacgatcttgtttaaatgactcattgaggtcctggagctctgatcgggttgactggcttacgtggccatccaaagtggcagaatattccccccc

SEQ ID NO: 23541 - DNA, 42762 bp, Oryza sativa
ccccccccccccccccccccgcgcccggcggccgcccacattttggctttccccgcttccaatccaacccttatcccccaaatcttcttcttctaccacgagcccagctgccccccccccccaagtggaagccctcacctactcacatagctaggagtactccgagagagggcggcgacaacaacgctggcgccacagatgacgccgagtcggggttcgtttcaatttcaaccaaatttcaacttttccatcacatcgtttcaatttcaaccaaatttcaactttcaacttttccatcacatcgtttcaatttcaaccaaatttccaattttgacgtgaactaaacacagccaacttttccatcacatcgtttcaatttcaaccaaatttccaattttaacgtgaactaaacacagccaattttaatattaaatcacccgttctacagtacttctgaccgtcctctctgctacacgtactggcctgctgtattgattatctcctctggaattttaaggaatttgattatctcaattttcaaactgaggaattttaaggaattttgtgaaactaatttaattatgtagaaattcctgtattgatatccgacaagagctgagagcacacatatatatttaatattaaatctagggaacatgatatatactggtaaatatttgttatagtaacctataaatgtttgttcacaccagctaatatatcatttcaataaagtaggaacatgtattaatctataaaaaaaccccaaaaatagtggtgagtagtgaatgtgtgtcaccacccagtacccaccatcactgccatgtgggtcttccaaacaataaggtacatggaagtttgcctcttctccaacctcaagccatcgaacagagaaaatttctttagaagctgggtaaaaatgatgacaaataatattaccaaaagattttacaatgagaataatgccaatagacaatagaatgtcacagacacggtaataaaaatgacggtaggcacataataaataatttaattacactagctagcagtggcacatccgaaaaaccaacatgaaataaaaggaaaataagagaggaaaagaaaaggcaagcagaaagctagctcatcactttattccagaaacggtacagtgtagtgactcgctagcgctccttcctcgggtgaaataatgtcgtcggtgcctcaaccgtgcagccagcaaatgctcggtctccagcgatcgccgtcactggtttgtcgctggtggcatgtgcggcggcttgtgcttgttcggcggtgctataggtttcggtccaggcttaggttcaggtttcagtttaggctttggttctgggtatggtttaggctctggctttggttcgggcttaggctttggttcaggttcaggcatcggatgtggttttggctccgggtgtggcttgggctctagctttgggtcaggtttaggctttggttttggtcctgggtgtggaatgggcttcggcttcggcaccggtttaggttccggttttggctttggatatggtttaggctctggttttggttcaggctttggctcgggcttcggttcaggctctggctttggctctggttttggttcaggtttaagcttaggctcaggctctgggtgtggctttggctcaggcttcgggtgtagcttaagctcgggtttcggctcaggctttggttctgggtgtggtttgggctccggctttggttccggttttggttcagggtgtggcactggctttggtttgggctccggtttcggttctgggtgtggcttaggctctggcttcggctcgggtttgggccccggttttggctctggctttggctttgggtatggctttggttctggttctggttttggttcaggtttatgctcaggttttggttctggctttggctccggtttgggctttggcttcggctctgggtatggctttggttctggttttggttcaggcttaggctcaggtttaggttctggattaggttttggttctggctttagctccggtttcgtctctggcttcggctctgggtatggctttggctccggcttaggttctggctttggctccggttttgattcatgcttaggatgaggctttggctttggcttcggcttcggctccagctctggcggcttctcgtacatcgcacggccctgcttgctcatgaagcgggcgccatggccgagtccctggccagctgccgccgcttcatcaactaaagcgctcgccaccgccaatgccccaagcaggagcacggcggcagtgaggcaaggagagcgcctagccatggctggcaagctaagctcctcctcttcgcttatcttcttctccctctctcacttctgctgttgtacgtaactgaactgtgagcttgtgccagtggatggaaggattgctggggttttatagcccgggaaagccaaacaatgcaagcaggtgtggtcacatgtctccatggcaccctgcttttgtgatctctagctgcttgccagatctcacctagtatcatgcctgcctcccttccaaatctgactattttactcttcttcactttttactaactgctaaccctactttttcctaattaatcagcacctgttctgattaatcaatcggttacttgttactttaatgtatgactagacaattagtcttttgttggaacacatgaattttatacagctttggttagaaactgaagtagtagtaattggtacgaaaagcaagtaaaattgtttgagtcatattcagcagcggagcccgcacggcaaacaaacaggggaaatggaacaagtgcgtaaaatagcttaggctaggtgcagcagaagctagcattgcaggagcaggagatggacggacggatcgatcgtcaatggacatcgccggtggtgggtcgccggaaggacagcagccagaaacattaacgtgggtgaaagtgtccggccctcgcggccattgggcctgttctgcggctgcgtcgtagccgacaccaacagtgccgtgcgcacacgacgcagccgtagccatgccgaacaggcccatattatcttgagaattgcatcgaactgaacacattagattttttatacactatattaacatcgacactgagtaatttaaatgataaatatgatcaattacggaccgatccagcgttgtttttgaaaagatgctaccgtccgttttcagctctaagactacccgccagacagaatctcccacggcttctcctctcaagaaaaagagtattggtccacaggccatacccactctcggcccaatgtctctcctttctcttctcctccatgttgggcttacgcggctgcgtgaatgtttgcaggccatgcatgcaaatcagccgacaaataaataaattcagcatgtcattggtggtacgctatcttttcttgaaatattcctctttaggcctcgtttaaccccataaaaaatgattgaagtagatttaagggattctacaccataacaggtacggtgcacaattaaccctttccaaatctccctcaatcgtcctgagtggggcacgtaggcgttcaaataaacacgtccacacactcacccatatatgatatatatgaacgtgtacacaccttatttgctataagcacctttgaaaactagatcaacatatcttgatatttataaaacaaccgtaagcacgttgttggtgatggacgccgtctattactgaaaaaataattagtcataaatatgtgtaactgtgtcaagtctatgacttaaatttttagtagacatgttacaccaccattaacctaaccagttgagttattctcatttcgctgcctaacttaaaagatggagccgcgcgttgataaatccacgatagtacgctatagatagccactctagtatatttattaataaattatgcatgaagtaagctacccctaataatttaaaagagatatataattaaaataaattgagatgaaatatgtggctttgttgggttggatgcaccaaaaaataagtaagaaaaaggaagaaaggagtacaacctagtgttggtagactccattacgcgtccaaagcatgcatgtgtctgccatgttatcaacaaagacacacatgacacttggcagagttaacacggcatgatgggatatgtcacatatggcatccgattccagaagagaaaaaaaagatggtagtgttaggtgacaaagatggggaaagaacgaattaataattaggaaaaactgtagatgccttgcagatcgaggatacagtacacatgatcatcgacttggactgatgagcagcagcagctggtgtgcatttctctcgtgcctctcgtctgtgtttgagagcgagcgaccaacagttaaaaatggattaagttagactgtactgtctcaattaattcaaaacgcgcgtttgatcagtatgggagaacctttatctgctttcccggtagtatatatagctaggttgctagttaaagtgaatttcaccagacttttctttttagataatatttcacctgactttttagttctgaaaaggtatatggctgatcgtgccatctcagcgaagagaagaattttggaaaatgcatatgccatcgcgatcatcctcaatctttactatcatacccttattccgcgcttttcctcgaaggaagttgagatatattattcacgaaaaatatatactcctttcatcctaaaatatagtaacactcattcatacgtgaatggcaaacctgaagtattgacaccgttgtttgtgtgttcctaaccaggaaagtgtggagctgacttgaagaggacggcacggtagagggtagagccttcttaatgatgcgccctatgaccatagtatatgagaaggcgaccgacataattataatatgtggtaaggaataaatagaggacggcatcacatgaacgagtaataaactaggaaataaccaaggtagagacggaagcacccattggaagggtgagaggtgagtggccaagctatgagctcatgacaccccatacctagagaccgggtctatcatattaatcaacagccaaccattaactcatcgaatcaatcaagtattttcactactacgggaaactaaaccggtcggttgagaaccttgcataggtgccggttttcataactggtacatagtagacgacacagacgagagaaatcaaaggtgtcagttttgaaaatggcacctttgaggtcccaagaataaaaaacaaaagaaactcgatgcatcggctcaaatcccaatcacccataagatttccatctaagaacaaaatcacagaattaagaacaaaatcaacattcatgaacaaacatctaagaacacaatcacagtatcaagaacaaaatgagcgtccatgaacacacacaaagaagataccatcgttgctgttgttgtcgggcgggccgcccctgtgccgctcttcctccttgtcatggtggccagatccagctgtcgttgagctctaggcggctggatctggcggtctctacctccaagcgagagaaaccaccgccatcccagcgacggtgaggggaggaggagttgcagctccgaagaggcgaggagaggggaggagagggaagcaccagagccagaggggtggcgccccataggaggctagatggccggctgctgaagagggaggtgaatagagcgggcaagagagagggaggtgaagggcgagagagtggataaggacatgctccccctccctttgcactaaaaaactggtaccaatagtattggtgtcgacttttctctagaacccacacctatagttgcttaaaagtgtcgactctatatttttttttggttccatgaaggtgggaaaagcgtcaatttatgctagttttaaattgggaagaaagtttgaaatacacccttgattattgggtgagtacaaattaacccccctaaacttgaaaatcagacatccttgaccctcaactatcaataccagatgaattatcccctaactcaattcggcgtgattttggtttcacgttgttgtcccatcagcaaatcttttttttaaatcagtggggcccacatatcaatctctcaccctctctctatccctcacctatctatctctctatactctatctctctgtctctctctttcaaatatcctctctctcttctccctccctcaccttcatctctctttatcaaggacagcggcgggcggagctcaggacggcggacaggactggcggaaggcggagcttgggacaagcagcggcacctctagctctccgtcaccgagaggcagcggcagaggcggagctcgggacgacggaggggacgggcggaaggcagagcttgggacaagcggtggcacctctatctatccatcattgagaagcagtggcggagggggagcacgggaacagtggcgggcggagctcggggcgagaagagctcgagacggcggaggggacgggtggcaggtgaagcttgggacaagcggcggcaccccccccatctctgtcaccgagaggcagcagcggaggcggagctcgagactgccgaggatggtgagcggcagaggcggccatctttcttttccctccccttctatcaattggtttggacgacgagaaacggagttggcgctgcatagtggggcatgtcacgccctgaagtttcccacttttcttgctttaaaattttgttaaataaatcgcccgaagaaattgtttaaattaacctagagctaattccttaattaatgaatgcaattaataattggaattggcattgtgggatttttcttgggtcccacatgtcgtaatatattaacaggttttttagtagaattcttagagccctataaataattttaaccatttaaaattcataaaccgcaataaagtatgacaggaaaatccttttttttcttttcctcctttttccctcttgttgggccatcggcccaacctctccccgcgccgccctccttgctgggccggcctaagcctccccctcctctctaggacaccgacaggtggggcccacctgtcggtcgtccctaacctcccaccgcccacgcctcggcagcaatcgccgctgccgtccacgctgctgctccgcgccccgcgctcacgcccacgtcgccgcccacctcttccacctctcccgctctcgcatgcgcccgaaaatggatgggattcgatttcgaatcccacccccctctctctttcctcccccacgttaccggccaaatagggggccaccccggctgtttccgcccctcccgcgcccatcaaatcactcccccaagcctcctctcccgtttctctcactcgccacgccctcccatgcttcttacaccgtcgcgccgtcacaccaagctccgccgcccgccaacgcactccggccacgcgtcgccgctgctagcgccatcgccacaccgcgcaaccaccgccaccagctttgccatcgcgcgagccacctcggccgccactcggttgccgcaaatcgccccggagctccgattccctcgcgccgccggtgagctcgccattgtctccatctccgattgtttcgtctcgccgtgccgcggctcctcccttcaccctaaccccttcaccgccttttcctaggtcgcaccgctcccgtgcgccgttttccaaagcgccgccgccgctcatcccctccgctcaccactatcactcgccgtcatctctccgcacaccggccaccccacggtgaggaatcccctctcctccttcttttcctctctcccatgagcgccgccgctcctccacgcgtgcgtcgtcgtcttcggccgccgccgccaccttttcgcgccgtccgccgccgcctcccgctccgccggtcgccaccgtcagtggctgtgcaccgccaccgctccccatggccagccggccagttttgaggccgagcagaaccagacagccgccgccgtgccgtccgatcggcctcggggccgatctggaccgtcgttcccgtggaccggcggtggccacccgcatggtcctagtccacggtagaccagcgccctttgagccgctgacatgcggggcccgcttgccggcgccggaccccctcgctgacgtcagccctgggtttattgtgcaataaaattaattaaggatttttctttattagtaaaaacacagattatcttctaaaattcataagtaattcatccgagctccgtttaagtccattcaagtctcagtaaattcataaaaatccctagaattcattaaaaatggttttgtttcctgtttcagtagtcttatagcatgttttgctagtgtgctttgtttgtcgcataggtttcggtcgtttcgtcgatccacggttccacgaagacgttgctgtggtctcatcagtgcgagggcaaggcaagtcatgcattacaattgatcatattgtacccaatttacaaatatcctgcatttctattaaatgttgcattcttttacaatatcatgtgggatgggtcctattactcagccattttttgtttacactatgccattgataacttgggtatcaaaatgactagatgttggtttaggaaatgcttagcattgcttagtttaactagtgcacaaatggggatcacattattacatagactttgactattagcatagctttggattggttccaccgtaatgttgttagttaattaaaatacactgaatggtgggctatgggtgcgtggttttgctggtcgcacccatggcaattaaggaccggttcacgggaaaccctggaagacttgccatgcttaccacaagtgggaatgggtaactgcttgacttgtagtatagctcgaccatttcctaggcaccggtgacaagggtgggcgtgatggagttgggtcagctggggtgtccggttgtccagctgctggattcaccgcggcgcatgaggggactgcccactgcctgttgagggttgggggtgaaaccttagcgtggtgtggatggttaggggagggttatgcgaagggtcttgtcacgatttccccctttgcactatcatggtgatacttcggggcatggcgacatgtgtggaatcgtgtcttgtgggtacagttgtacacctctggccagagtaaaactattcgaatagccgtgcccgtggttatgggcgatcaaccagattcaccgtggttagtcttaccccgagtttagcttagtgaactggtgtagttcaggtggttggttgggcatgtcgcaacgtggtgtagcgttggacagtgattggttaatatggactaattactgcaattgttttactgctttcaactactgtttttaaatgcctgctttatgaaaatgaacctttagcctcctttggatatatcctgcatcatacctcctcttccagtatgacttgctgagtacagtgggtagtactcagtcttgctctcttttcccacacaccagagcggaagttcttcccagttggagatgtctcagaaaggttggtttcattgctgccgttaaggatgcctgtggagtggagtcgcccgctacagaagtcaagttttcaagcttagctcgttttatcttttccgctgcatttgtaatctcttgtatttttgtaatcctggatagaggttttaatacatattcagcttagaaattctgattcgtgaatttctgggcgtgacagggcatcgagcggcggaggcggctcctcctcggcctctgccggcacacgcctcctccacgaccacctcgtgagcttgctgccaccgtctcctacactcggggatgctcacagccagcggcgcacggctcgtcctcggcttccgtcggcgcatggggctcctcctccggtccgtggcgtacaactcatctgtggcatctgagaggagagcggcgagcggcggagagagagagaggtgagagaggataaagatagagagaagagagatatgacatttgggcccatcgtttttttaataaaagaattgctaactggacaaccacgtaggaccataaccgcttgcaaagttgctcagcttggtacttcatctcatattgacagttgagggtaaaagatatctggttctcgggtttacggggataattcgtactcacccaatagtttaggggtgcaattcggatttttcccaaccgtatctatgagtcgtcttctattaaggattttgtagcagtgtttaggcatgaggcatcttattgtcttgtcttcgtgactaggctcgttgtcttaggtactcatcggttgcccatattccataaaaatccaaaacagcttattagccaataaaattaagttattgataaaacttttatatatgtattcttaacgaattaaaagctaatgctgaaaaaactaacttgaaaatattttaaaatcaactccaaaattaaatttaagaattcaaaatttaacttcgttttgacttattagggtaaccaacgggctcttacgtttattcgacaattcatttttgtcgttaactcactcaacgcacgtggatgcaccacgacactaattaactataattagttaattagccaacatgcatgcgtcgtgacatgagcaggctcggctaagtctttgcccagagtggtgtgatggtataatcttggatattttttttaccaagccgttttaaaccctcgagaatatatctcctcgtttttcttaaaaagtatttaaatatttatagaaaatttttgaaacaaattgataacggtggtggaaggactgagggtcgttatgatagtggatatggatgggcagaaaaaaaaaaccgaaccgaaataatcatatcgaactaaccgagaccaaaaaatttggtctgcattttcactaaccgaatttagatcggttaattctgtctttggcgtcggttaaccaaattgatcgaaatatatcattggccaaataatacagatgacatctcagcccactaagcccaataccacctcatccggaggcaaccaactccctgctgcaccaccacaagatcttttcatccccaatccccaccttatgcgcatctccgaagactgcaaattcccccaccgtgcggtgctgccattgacgacctgtgactgcgatgtgctgcccctgctgccgccgcatctcgcctctcaccccaaaaccaacaacccctgccaccgccgccacatctcggcgccctctgatgcatgccggccagccacacctcgtggaggccgtgcgcgggagctagagacctcgccgacatcggccatgagcaaagagatgggagccgcagtaacaacaacggcaggaggcgatgggatggatgggatcttggtccctggagccatctagaacaattgatggcagagatcgatggggagtatcgatttgcttctttttttttctttttcttcagaatcccatcgatctgctttttttttctcagaatcgtgctcgatttgctagtggcatcaaatagtagtgcatcatctgtgtgtttcctttaattcattgatcatgtacagattacttgccattcttttttgttgttcgaacttttgtaacggttagttcggtctatgaccgagaccgaaccgaactaaccaaagaccgaagtgctcggtcgttaaagaccgaattttcaaaaagaccgaggaaccgaaccgaatctctcggttagaccgtgttgtcgaaacgacaactatatacgtcgaaggatgtggttactcaacagtggttgggaaaatgaagtgtactaaattttgaattttccttgggatccccccattagatagccctaggggactatttatagccccattacaggtccttactaccagggtttaggttgtacaggaaaatttacatgattacccttacaaaaggggcatttacaggggtacataatgttataggggctcatgggcccctgatgggccgtctggcgatcgccggcctgatgggctggaaaggcttcctcagccctcgcgggggcgaacttgtcaaggcgaagtcatcctccttcggcagacagtcttcgccttgcacccttcgcctgagacgcctctggcctggcgctactcttcgccttgcaccgctcttgctccatagccttcgccatgggtttcggcaggtttggtcgaagagcctcatgccatccgccaacaagcccctcacgggcaagggtgagactggagcttcggccgagaccgtgcaaaccatgtggtatggtatgcggcgccccctttcgaccgatgctcctgccgaaacctacattattcctgcgaatgaagtttgttatttgtgcggctggtattattttgccgcgcttcgcctcgtgcgattgatggttatatatattcttttttcctgggccgaacggaatagtattgggccttcctatctttaggctttttactgtgccgctcggttgatgggaatttaccgtttcgcctacccttgcgacacgtggcgctttattactggtgggtaggcgaacggtcgcctgggcgggctatatattcctgctgctctttccttttcaccgccacacttgccattttaccgcgcgcgctctctttctccgtctcttcccttcacagcatctttcgacccctcaggcgttttgccgaaactcttttttcgccaccgaaaacgcaccgttcgccatggccccacgtacgccaaaccctacttcggcgaaagggccagatcccggccgagtcgatgacgacagcactgcctttctgggggtctctcttgtggacgacgtcgagctggcgaagctggtgagctccggagcgttggttaaggggcaggcttttgctccagggaaaaccgtggtgccgaaacctgtcgacaatcggacggtggtgttcgccatattttttgaggcagggctacggtttccctgcaacgtgttgttgccagagatccttcgcctcttctaggtggaacttccgcagctgagcccgtcggcgcttgttcggatcgccatctttgactgggtgtgccggacttccaggtttgagcccaacgctgagctctttggcgccatatttttcgccaccgtgaactcgaagacggtgattaccccggctggaacgaaaaaaacagtgttcgggagcgtgaacttcaacgttcgccccgagcggtccgatctctggccggtgaacgctgccatgtcgaagtgggaccgccattggatggcaaggtggttctaccacaccatccccttcgaggctagttctgaatcagcgaaagcccttcgatgccggcgcagggcgattgcgccgaaccggagacccaagatcgctgtggacggcgccatggaggcgcggtttgttctactgcggaaggtttgctcccgccttagctgccgtgacttggtggaggaattttgtatgcttcgtatttttcccctctcccagtcatggcaagtcgcggttgaacaaggcgaagaggtcgacggtttgccgaacctgatacttcctgagggggcgaacggtaagactgttcttttgctatatattgttgtgctttgttatttcgccttatttgacttttgacatagcttcacattctacttttacagtgttgaccctcgaccaggccgaagccgaagcccgcaggatgatcggcgatgtttcggtcgtcgagtatagtcaactgttaacgcgtcaagcggctgggcgggcgaaccgggtttacaatggcgaactgcctccccgggcgaatccccaaaaggccgacgacgaggcagggccttcgcgaaagcggatgcgtggacaagtgaagcttgcccccaagaagcgaagggttcctgcttcgtctgactccgacgccgacgacgaggatgatgccgaagaacgtgacggggaggaggaaggagaggaagaggaggaggtggaggctgtggctgataaggccgcgggtgaggcggtcgaagaccgcgccgacacccccgggtacactcctaccccaagtcctggtcacaacgaaaccagggtggagtcgaacagctcccccctttgtcggaaggatttggaaggggtgaaggccctagttgcgttctcttcgggcgcggcggcgaagggaggtcctgtcaaaaaggtggctaaaaagaaagggctcgtcgatgtcactcgcgtttttagcgatgacgagtcctccgacgggactccgacttcgcccgctggtcgcagcgtggatctttcagccgcccccattcctccacttggcgccgctggagtggacggtagtaccgccgcttaggcttcggcttctgcggaaaggattgtgatggccgcggcgaaagtattcggcagtcctccgcatcagccggttgactcgccgctgatggaggcgaagggaaagagagcggtcgctgagacatccacttcggaatattcgctcccagtaccccgcttcgcccttggcgacttcgagacgcgagcggacctccttccttttgtggagggggtaagcaatcttgtactgcccgccagcgccctgagcttgttcaccgaactgaatgagttcgacgaggggtgctctgctataaaaagcctagctgttcgggtacgtttcccccccgattttatctttactcttcctctatcttgtttttacaattgacacttgttctcttcgccgctcgtattctgcgcccagatcctcgcggctcactgctcaacggagcgaaccgtgcgagctcgacttgatgggttcaaaagccatcttcgggccaaggatgacgaactaggccgcaaaaatttagagatggaggcccttgcaaacacccttaaggaggcgaaggccgaaaacaagcggctccaatcgaaactagagaaagggaaggaagctagggccgaagtcgatcgcttaaaggccgaactagagaaagagaaggcccacaccgccgtgctcatagattattataacctcaccgagccgaagatggaggctcttcggcaggaggttcgcaaggccaaagcaagcgctgtagaggagtcgcggcggttttcgcaggaaatggtgaaaaccaccgagtccgcgcggacagcgtgccaaacgcttcgccttgcccttactgatatgggcgcgaaggtgcggggtgtcccctccgaagatgcctcagccttcgacttctccgaatggacctaacaggctggtggttcggtttcagactacgccaccgcatacggcgattgctgtgcacgcgtgtcagcggcctttaccatgggcctcctgcagcagttcggctacgagcacatcgccgagttccccaagtacgcgaagggggattgggaaatcagtgggcaagacatttcacctgcacttcgtgcgtggcgaaaacaattttggcagaaggacggccgctccgccgctaaggcgcgccttttggagcagctggcgaaagcggaggcggcggacatttgtgaagaggagggcgcggcggccggagggggtggaggcgatgcccaggatcacccagaggtgtgaggccctccgcccttctcttagattttcatagttttcttttggtgttcgctagatgtggcgaaccattgtatattcggcaaactgccgctaaaccttaaaaaaggcttttttgcatacttggactgtatgataattttaaccactttttaatgatcaaagtctttggcatattattatttcgctcattttgcattatgccaaaccttccccttctttcgcctattcttaccatgcaagatgtgttttgccttttctacactgtctaccagggggtctgccgaaaatcatgcattcgacccccttctgggagctggagaagtcaaaacgagaaatttgtggcattaaagggtttgccgaaggtgcgatgtccatttcggcctgtttatcgcgaaatggaaaaaaacggtcgcagctataaagttttcaaggttgccaactggctgcgggcgcaccccgggcgaaccttagaagattacgatcttgttcattcaagacgtttggaggatatggctcgcttttggcgaaaccatcagaagactaaacgccaggaatcgatctttcagcgtcgttacagtttagtctgtgtttcgccccctactcctcttaaggttgtgtataatattagtagtgatgacgaacctaattcgtccgaccattccttagggagggataatgattactggggcgaaaatgtaatttacttgtaaaatgaattgtattgggttgtaaaccttgtattcttcgattattttttcgaagctaataaagaacgtgctttatttccttttcgctatttttcgcatcgtcacactttgtgcttttgttaggtcggaacatgccggcccctttgcatatagtagcgaaataggtgtagtgacttcttttcgtcgttcgttttcgatctgtagcgttctgtgtcgagagaaacgcttttgcttttatgctgatcggtcgtaacgtcgttcggctatttattttccgagacaagctgttgcggtttcaacgttcggcgagcaatgcttcggccgattcgtttcgcccccctggtctttttcgctgatcaggcgtttgtcttggggtttttccacaaattatcaatcacacgaaaagaaataaaaagaaggcggaggacacaaagattttatactggttcgggcctccatggtggataatagccctacatccagtttttttttctttttctcttctcttttttcctttttttttcttgccgaaaggcttatatagtgccgaaaggcttacatgacagtatgtacatttttacaagttggcgatttgggtgccacccattctagacataaaagcgcttgagggaggcggcgttccaggaatggtcgaactcctcgccttcgagtgtcgctaggcgaaaagatcccgtcctggacttgtgtttgataatgtatggtccttcccactttgattcaagcttgccaaccgctaatgggttcgcctttttccttaggacaagatgaccaggcatcagctccgtgggtcggacttttttgttgtaagttgccgaagtgcttgtggcgtacttgtgcatgtgctcgagcgcttcgacccttacagcttccaagagttcgagcgatacctcgcgcccctcttcgcccccggagaacataacccttggtgagttagcccctagctccgctgggatcattgcatcatcgccataaagaagcataaatgggctaaacttggttggtcttatgggggtcgtccgaagggcccaaagaaccgataacaattcttctggccatttgcctttcgccgccccctcaagtcttttctttagtgcttctaagatcttgccatttgtacgttcggccgccccatttgactgtgggtgcgcgaccgacgcgaacctgatttctaggttaagcgcttcgcacatttctctgaacttatcagagtcaaactgcttgccgttgtcagtaatgaactcttttggcaccccgaaatggcaaataatatttttccatacaaacttctgtactgctgccgaagtgattgccccaaggggttcggcttcgatccatcgagagaaatatcccccagctacaattacgaattaatacccgtttcgcccccccgggaatggcccaataatgtccagtccccatctgccgaagggccatattggtgcaatgggctgcagatcatactggggcgcggcttggcttcggccatgacgctggcaactttcgcacttcttgatttgctcaacacagactttcatcacagtgggccaataaagtccttgtctaaatactttggaggccattgttcttgcagcctggtgcgcgccacatagcccttggtgtatttcctttgccatttcttcgccttcggcaaaagagatgcaacaaactaagggttgaagtaccccggagcggtaaagctgacccgagaccatcttatacttcgtggctctgagttgcaaacgcttcgcttctgcttcgtctaccggaagccagccagtttcaaggtgtttcacaaatggggttcgccagtcatatgagtcttcgcccagtttctcttggtcgattgtcatgacttccgagctgtccatgggcacacttggagcatgtaggacttcgaaaaagatgccaagcgaatgcgggccaccacaagcagcggatttcaccaaggcgtctgcttcatcgttttggtctctaggcaagtgttcgaccgttatgccggtgaagcatttttccatggaccgaacagcctccagatacctcttcattcccttttcttttgcctcgaaggatttgtcaacatggcctgctaccaacttggagtcagttcgaattagcaggcgccggactcccagtgctttcgcctttcttaggcccaggagaacggcttcatattctgctgcattgttggttgtgttgaactgtaatctcgctgcgtaccgaatcggcacaccattcggcaaaaagaggactgccgcaacgcctgcccccttgtgcgaccacgaaccgtcagagcacatcacccagaactggtcatcgggctcgggctcgggggcaagtactggtgtccattcagctacgaagtcagctagcacttgagacttgatagcagagcgtgcaacaaaatgcaagtcgaacggggatagctctgccgcccacttgctgagccggccagtgacttccttgcctcggagtatttcgcccaaggggtactgtgatgggactatgctttgtgggcctggaagtagtgcttaagcttgcgcgaagccattactagagcgtaagcaagcttttccatttcaatgtaccttgtcttcgctccttgcagtgcttcggagacgaagtagaccggtttctgtccggactctgtttcttggacgagtgcagcactgactgccaccggtgaagctgccaagtataacagcagttcgcttcctgggggtgggcttatcagagctggcgggctttgcaagtattgctttagctcgtcgaatgctgcttggcactctggtgtccaattaaactttcccgcgccccggagggtcttgaagaagggcaaacctctttcggccgcctttgagaggaatcgactgagtgctgcaattcggcctgtaagcttttgtacttcatgtacgcttgacggaggcttcatttgctggatggcatcgattttctcgggattcgcctcgatgcccctttcggaaacaaggaaacccaacaacttgcctgcgcggacgccaaaaacgcacttcaccggattcagctttatgcctgccgcgcgcaagctgtcgaacgtctcttgcaggtcgaacgcatggtcgaaagccttgcggctttttacgacgatgttgtcgacgtaagcttgtacgtttcgcccaagctgcttgccaaggaccttgtacaccagcctggcgaaggttcctcctgcgttccttaagccgaaaggcatcctgaggtgacaaaatgtgccgaatggagtgatgaaggatgttttggggatgtcgagcgggttcatgtggatctggtggtaaccggaatatgcatccaggaaactcatgagctcgtgtccagctgttgaatccacgagctggtcgattcgcggcaaggggaaatcgtctttcggacatgccttgttcaggtctgtgaaatcgacacacatgcgccatttgccatttgacttccgcaccagcactggattcgccaaccactccggatggtcaatctcttgaataacccccgcccagagtaatttttgtacttcggtcttcgccgcttcttggtgatcggcaaacatcttgcgcaactttttctttcttggcttaatatttggcttgactgctaagtgatgcatgatgagatccgccgggacgccccccacctcgttagggctccaggcgaagatatcgatgttctttttgagcacctctagcatgctctcaacttcttcttcgcctatgtggcccccccagtgatacgagctttgtggggtcggcatcgtcaatctgcacttttgttatcttgccgtgaggggtgggcttcggcgtgtgcttgggccgctcatgcggttcggtctcaacattgtgcactgctctgttgattatggctagatcgcgttttgaagcggccgaaggctgaagccccttgactactatcacccctgttgggccaggcatcttgagcttgagataattatggtgggaaatggcttcgaacttgttcagggttgcacggccgaagatggcgttgtagttgtatgggatgtcgacgacgtcgaacagtatttgctcttcgcgcctgttttctcctaagccgaaagctatcagcaaaagtgcttggccaagaacttgcactgcctctccgccgaacccccggagcgacgttggtgccggtgcaagagcttgggttggcaagcccatcttagcatatgcttcggcgaagatcacgtcggccgaactccccctatcgaccaggattcgtcggacttcaaaaccggctatctcagctgagattaccagtggatcttgatgcgggaataggactccttcgtcgtcttctggcccaaaagagatcagctggttcacgtactgtggcgccccctcacccgccgaagtgatgttgtggaccatacggatctgcatcttcctccgccgtttcgacaacaggcttggcggatcagctcttgtaatcacttggattacccttcgttgtgtatcttggcgttgttcggctgggggtatttgctcctgaactgcttcacggggtgcttcgacagttgttccttgctgcggccttgggtcttgcgcgttgccacgttgcctaatgtttcggcattgctccgtggtgtgcgaagagcattcgtgaaaagcgcagtagaggtcttttcggaccttcttgcgggctggctgctgatggttgcttgcttgctgggcgtcgaactccttgcgtagggcttgcacttcttcgacagccatcacagccttgcccgcccgatctgttctgaactttctccaagtcatgggggcttggccttgccttggcggctgtccctggatcgccggctaagactggcgaacagagaagggaggtggatcggcaatttgaacttgtgcttgagcttgagcagcggcgacggaggctttatcgtactcagcttgtatagcttgccgtcgcttagaatcctcctcgccccttgcgaacccgtcaatgatgcgaagtaggtgctcgagcgtctgcggctccttgttggcgatttttcttgttagttcgccctcaagcagaccggccgaagcggcgtttataaccgacgcctcggttatgtcttgaacttggcaccgggcttgcgagaagcgacgcatgtactcccttatcgactctcccggcctttggcgaatgccaagaaggtgttgctgcgtcttcggctcctcataggtgcctcaaaagttaaggacaaaaacatcgcgcaattgctcccatgagtaaatgctattggctggtaaattgaaataccaagaacgggcgatgccgtctagagcgagatgtattaccttcgccttggtattttcgtcaccatgagccgcttcgatcgctgactcgtagatggagaggaactccttcgggtcagtttcgcccgaataatgtgggacaggtgggaacttgaactggggcgggattggacgagtcttgattcccccactcagcggcagccccttttcgcctcccgccctgtttaccgcaccttgctgcgggtacggtatggcaaagggcgaaatcacggcttgtgcgtggagttgggccgcggcattcgactacccggctccaactggtggtacttgctgggccaccatggatgggtcaaagattggctgcgacgacatcatggcagcttggattggtgcttggtttgttccgaagcctagggttggaacttgctgccgaacggttgtcacctgagcagtgttgccgaagtcgaactactgtcctttactccacggcgaaggtcccgagcttggctgaatcggtggcaaccaattaggtgcaccttgacttgtattccccaccgggtgagccgatggggttgtacttgaaatgtagtggggttggttgagttgctgaaggaaagcttagagttgcgcctgcagagtcgaagccccttccgtcactgtttgtgtcacttggccaggtggttgatgctgctcggcgaagtacaccggcggctgtgcggctagtggtggagagggctgggtcaccacttgcggccggacttgaggtggggcatagcctgccgaatactgaaggattggagccgacgttgccttggtccgccttgtcgcctcgtatgcttgttgttgttcttacatttggcaaagcatgtcttggagccgtgtcatgttctgccgcatggcttccatgtcggcttcggcttgcacttcggggtccaggctgatttgggcctgtacaacggcgagcgcaatcggcgccgccggctgtgatggggcggcttgaggcaccaccagttggtttgtcgaaaggttccccgccctggtctggagtgcccttgccgccgcagccgccttcgccacatcggccgtgttcggcacttgcactgaggttgcgggggccgaagacagttgtgatggcgcgggggccgaaggcggctgtgatggcgcttgtccttctccatcttcggccacggacgccgaaggctctgctccttcctcggcggccatgtctggtccgtcgtcgctctccttccgcctgacggccttctccttcacgaccctcttcggtggcactcgctctcagtggtttcgctcggagtccccatggacggcgccagctgttgtcgaaacgacaactgcatacgtcgaaggacgtggttactcaacagcggttgggaaaatgaagtgtactaaattttgaattttccttgggatccccccattacatggccctaggggactatttatagccccattacaggtccttactaccagggtttaggttatacaggggaatttacatgattacccttacaaaagaggcatttacaggggtacataatgttataggtgctcatgggcccctgatgggccgtctggcgatcgccggcctgatgggccggaaaggcttcctcggccctcgcgggggcgaacttatcaaggcgaagtcatcctccttcggcagacagtcttcgccttgcacccttcgcctgagacgcctctggcctggcgctactcttcgccttgcgccgctcttgctccatagccttcgccataggtttcggcaggtttggtcgaagagcctcatgccatccgccaacagaccgaatgcccacccctaatggtggaggatgagcaaatggtggattaaagtacagtttaacaacgttctaaaattatctcagctcatgggataagaaagtaatgttggttggttttatcggctaataccggttagctagggaaggggtaaaatcctaccagatttcctttcctaacaggaaagaaacgaaacaataaacgaagggacaagagataaacgttaccgtgattggtgataacaaattttgagtcttatccggatcgaccccgagtctcaccagtgcaaataaaaagaaatgaaggcattgaggagaggtgacgactaattctctacgtgtaaattctgaagccctaaaaaagagcccgattgatctcaaacagtggaaagggtttatagtgcaaaccactcctgtgcaggtgaatcaagaaggacaacagaagaatcaaaagaaattagcaaaacttcaattcatctggtcagtaattatctcaattccgtatttagaattgatgatcatgtcttaagctaaaaaatagatcttgagtaaataatttcaacaagtaaacgccaccattaatgatacctctattttctaaaaaaaaaacccattaatgatacctcttgctgctctgccatcgcattggtcgcctaattacggttgcttaatttcatccaaatccgatccatcgctctcgatcgatgctgcctgctgaagatcatagcttgggatttgggaattgaagttggggcctacatatggtcatatgcccatccacgtacagttgcaaacatgctcctctgatttcctgccgggtccgtgtcacgcgtctacaggacaagcttgtgttgtgtgtggagtacacaaggacgtacaagatgctgtttatcattgtacggaacggaggtttatggcaggtaaacgtcgcgtgagtgacaggacatggagctaattcctgacgttaacagagttgattactatactacttcattttactttaactgttttaaaatataaggctcgtaagttttttaaggtagctttaacataaagttttgaatattaatatatttcttttactatcaacggctatataaatttggtatcatatgaaaaatacatttaaatgaatgtaataatgtcacatggtgcaaaacatataaattatttttataatacagcaaatgcacatgtacacacaacaccaccctcgcacaccctcgtgaacccatcttttaacacacggttaaagagacagaaaccaaccatacattcttaatttcactaaatttctattaaaacagtgtattcttgatttcataaaattcttataatcacccgtgctccctaatacatataaattattagttcaattattaattaaagtttgtaaattttgattttttttaataaaaaaacatgtggatgtcttttgcggtgggactagagtagtacagtagtgctccttcggctcctgaatggtcatttcttttttttgactcttgtgaatactctctgctgcattagcctgctgtatgattatctcctctgcagtctgcagtgtgcaccaatggcgagctggtcagtcatttacaacattggctgggtgtttcccttcaaacttcaaatttttccgttatttaaaatttttttgaaaaaatttaaaaacataagtcacgagtaaagtactattcatgttttatcatatcataacaaacaaaaaatattaattataaaaaaattttaaataagacggatgattaaaattggacgtgaaaacttatggttagactgaaatgggacagagggagtactagcaggagacagtggcaacgatgtgtttaccaatggggaaattatggtaccccgcactttgtcggtgtattctactagtaactaatagtagaatagtaaaatcaacaaaaatcaatgcaggtcatgagttaaaccgtgaacctgcagagggcagactggaacaaaccaggtacagattggattacccatgatgcttattttacgtactaatgcctccctctcaaaaataaattcattttctatcgatccaacgtatatcaatataaaaccaaaataactagaaaatccccactttatcaaatccaaatttaattatgtttctttatctaccctgatacatttatcatatacttttacaaactctgatgtactgattgcttgaaaaaagatattattttgagataaatgggagggaccaaagacttatgtagagatggagggaggagaagagagcccgtaccattttcactgtatttatgaagggcgctaattcaaaatgtaatatttaggataaacagttttgatattttagtgttggatagtactctctccgttttacaatgtaagtcattctaccatttcccacattcatattaatgttaatgaatctacacatatataatctagaagaaactcaacaggagcagtattaaacagaactggacagcatagaagatgcacacacatatatattattatttatatacactactaagtagaaaagaatgccacagacacggtaataaaaatggcagtagatacataagaaataatttaattacactagctagcagtggcacatctgaaaaaacaacgtgaaataaaagggaaaaaaagcaagcagaaagctagctcatcactttattccagaaacggtacagtgtagtgactcgctcgctcctccctctggcgaaataatgtcgtcaatgcctcaatcgtgcagcagcaagtgctcggtctccggtgatcgccgtcactggtcggtcgctggcggtatgtgcggcggcttgtgcttcttcggaggtgcttcaggttttggctcaggcttaggcttaggtttcggttcaggctttggctctgggtatggtttaggctccggttttggttcgggcttaggctctggtttaggttcaggcttcggctctggttttggctccggctgtggcttgggctctggctttggttctgggtgtggtttgggttctggtttgggatccggtttaggctctggatatggtttgggctctggttttggttcaggctttggctcaggcttcggttcaggctctggttttggctctggttttggttcaggttttggctctggctttggttctggcttgggctcaggcttaggctcaggcttagggtgtggcttgggctcaggctttggctttggctctggctttggctctggttttggttcaggttttggctccggctttggttctggctttggctcaggcttaggctcaggctttggttcaggcttaggcttaggctcagggtatggcttgggctcaggctttggctttggctctggctttggctttggttttggttcaggttttggctccggctttggttctggctttggctcaggcttaggctcaggctttggttcaggctcagggtgtggcttgggctcaggcttaggttcaggcttaggctcaggctctgggtgtggcttaggctcaggtttcggatcaggctttggttctgggtgtggtttgggctctggctttggtttgggctccggttttggttccggcttcggttccggttttggctctggcttcggctctgggtacggctttggttctggttttggttctggcttaggctcaggtttaggctccggctcaggttttggctctggcttcggctccggttttggctctgggtatggtttaggttcaggcttaggctcaggttttggttctggctttggttccggtttaggctcaggctcaggtactggttttggctccggctgtggcttgggctcaggttttggcgtgggtttaggatgaggctttggctttggtttcggctcaggctccgacacttctcgtatgtcacacgaccctgcttgctcatgaagcgggcgccatggccgagcccccggccagcagccgccgcttcatcaatgaaggcgctcgccaccgccaacgccccaagcaggagcatggcgacggcgaggcaaggagagcgcctcgccatggctggctagctaagctcctcctcttcccttgtcttcttctccctctctcacttctgctgttgtacgtggtagaactgaactgtgagcttctgtgatcttgtgccaatggatggaagggtggctggggttttatagcccgggaaagccaggcatctgtggtcacgtgtctccatggcccccagcttttgtggtctcgagctgcttgccagctctcacccagtatcctgcctggctgcttcccctttccaaatctgactttttttttttacccttcttcactttttaccaactgctaaccctactttttgctaattaatcaacacctgtgctgattaatcaatcgattatactttgctatacttcaatgtgtgactgggcaactagagctttcttggaagttggaaaaacatgaatatttcagacaacttttgttagaaacggaaataccagtagtagaagtaattcgtacgaaaaccaagagtaaaattcttgagccatcatggcaatggcgattggcggagcccgcaaggcaaacagtgtaaatagatgcagcagaagctaagcattgcaatttgcaagagcaggagatgaatggcagcaatggcgactgaacagcaagaaggggacagcagccagaaacacacattaacgtgggtgaaagcgtcccatattcccttgaaaattgcatccaactcaacacattactagattacccgcgtttcacgttgcattcgatctctctgtctctgctacaacgtcgctctctcgccgatctctcaatatacacggggtagctagctaggagctaaccggctgctgtgttcagaccggccactgtgtttaattgccgtgatgcttcaacgaagttgacgaaactggcacggggttggaaggatttgaaagctaaatttgtggtagatttgtaagacagatgggtagatagatagattatgatcgctatcgatctgcgaggtcgagtaaactgaacttaatttgctgatttttcaattctttgacgccctcggctctgcgacgacagataattcaaggtcccgtacgtcaagctattttactggtttctagtttctagaaatattactggtcctggtctgttgaaaacttgaagtacacgtacatatcaacatatgtacacggtacacctgtattgctgatgattttgttgctgtatgtgccgaccttctggaatactaccttcatttattgaattaaccaacggtcatacttcctccgtttcacaattccatatacatattgatgttaatgaatctagatatatatatatatctatctagattcattaatatcaatatgaatgtgggaaatgctagaataatttacattgtgaaatggagggagtatattattgataagggtaatatggattttaccttgagagcatgtacacgtaagggcgaacatctacacaacgtccaatgtacgagtttggtcgtcattaaaactagcaaggtaactagcctgtgtatttacgcgggtatgtatcgtagtttgtatttgaaagacttgtaagtactatttctccacaaattttcttcatgcacactgcttaaataagtttttcaaactattagtttgctctaaactataatcgtcttcattacctagaaagaaggtagacttagattatttagagaacatgtcaattaagtgtaaattaaaagtaagatattttttaattaaatgtttaggtgctctcttttttaacaatttaaaaaactattatttctaataaatgtgttttatttgtacatgcaagcctgccttctaattggttcatattgacggttacatatgaattactaaatatagaggatatatcctagaccttgttttcctatgatatgcatgatctacggtgtgtgtgcgttttcaaaaaaaaaaagctagtcagcatgagttctgtaattaaaatttaggagtaacaaatataacattaagcccactatataatgctaccttaatgtagcttatatatgcaataatgtgtggagaaactcataattccacggtacaggataagtggaagtccgtatcatatctaagcattatttaaaaatggttatggcaattaaaagccaatggttgttccaatttaagtcaaaagtaagaatcatttcttacgaatttaatagatttttctccgaatggctcaagctagtccctattgccagattgtaatttatgttttattttataccaattttaagttcaaaatataggcattacgaaacttaaattgttggtttatttatgaatagagcaacaattcgattaaaaatcagatgtgcagcttaaaatcatggtcgttttaatgttattgattgtttctcttttagtttgataagtacatagagggggagaagaatggatggtggagagcctaagtcgagaggagaggagaggagaggagagggggtgggcagtgctgtgtgtattcgaggggaagggcaaggtagaggggaaattgtttttctcattttactaaatggtttaaagtgaaaaccgatgataatatggtttttttcacaaaatttcaaagactttttataatttttatgacgtgacatatggcaacaaaagatttttctaaaagtatacctaatggttagaaataattgatctatcgatttgattagaaaccaatagtcacatgttaatttcctcataatttctgagagattttataattttttagacgcaacacatggtgacttagagagttatagaggatgtagattgatttaatatgatgtactatttattgtcaatttttttatagtgattcattgctgttgttatttggtcgccacacaacgaatagaacttgatgttccaaaaacatatgtaaatttttattcaatacaatttgagcaatattcatcttgaaatttttatttaattataaaacaacagttcaaaacaaactaaaaattgaatataacttaagaactattatcatttagcattgcattcattgattatttttatattaacatgttagttaaaaagtaggagaggaagggatatcctgatgggagaggccacatgcgcatataatggaggatggggaacatacaatagtggtatggaacgagtgaggatgagagtttgttttctttaagaatacaatggttagtaagatctaatgttataaaataatacgtccatcacattaggtgaaatttgctaaaattctattacaattatatatgttttgtgcttttgtacaaactgattgtgttttagttcctattaattactttactaactgaaattagcattaacaactctattgattgattaagatctatccttttttttttacttctgtgttcctacaatatattcagtgtagatattaaaaatatgaggacacaaaagtataaacgtagttttcatgaaaaatctgataatattattgtgacttatcataatttaagaatggggagagcaatttttaagaacaacaatcacagttttgcttattttaatgttatatagttgtagatataatttaattattatgaagttatgtacgatagtaaattctacattattagttttttcatatgttttttaatagcatgaaaaataaaaaaaacccaaaaatgacatattccttttgacggttgaaatagggtaaatatgggtctttaaatgtaagtttgttttcataatttttttaatggcatgtaaaataaaagagtaaattgcacccacaatgcaacaacttggcaggtgggtgcgatatagtgcaagaaattgagaattgaacgtctgagtacaacaacttgacaagtgggtgtgttctaatacaagaatataataatttattattttggtgtatcaacttggctaagcatatgctaggtgagttttttttaatcatatggatattaccttataatattgaatttaatttttaagaattatacagcacataatagtataatttacatccaattaccattaagaattttttgttgtcttcaccttctcaaatatcaaccgaaatataataatttttatatccaatttaattggctttcagttattagttattaggataaaaatataaatatacttttacaaatatgtgctagtatattgtcaaaattagtacttaaaaattgaatttatataaaaaatactccgaataattaagttgccgcataaccttttaatttattgtatcaaaatcatacctaccttgcaaattattgcatttatacgatcactgataaagttcttatactaaattgcacctacatgccaagttgttgcactagaacactcatttctcaagttattgcatcaaattgtacccacatgtcaagttgatgcatcgtgaatgcaatttactcaaaataaaaactataaaccaaagtgacatatttatttaaaagttaaaatatagtaaatatatataggtctttaaatgtaaattttgtcataaataatctatcaaaatatgagttacctttatgatttacatgttatagctatttaatttttttattagaaatcatgtttcctaattaatgtagcatcaatataggggagagaaacagaaagatgggcgaggtgtgtatgtccattacatattcatccacacacgggtcggccggggttgggccgtgggggttaggaggtggctatttatttttctaatcaaacataatttaaatggttaaaagtaatgggtccatcaaattaaatgaaagctaatggtttagattatttttaagaagttctctaatttattagagtgtcatgtggcatattggaaacgtttacgggggtgtcacgtgacgtcttaggaggttttataggatgtttgatgaatttttactatataatagatagatagattcataggtacaatgaaaattgattgtttttccggggagtgaagatctgcatatgaaaattaatttttgctgtgagtgtggacctgtatgtgaaaatcgattacagtcgatccacacgtgaaaattgattttgggacaatttccctacaattaacatatgttagtgcaccataatattattatgcaatagtagatgttaaaaaccaaagtcaactcttgtctctcctcccccttttaatttgtctcccattatcaaaatgttactagctagctgacagcattatgcatgggccatcatattattgattgttccaaatacccagatgcgtacgtttttttaatggaaaaatctatactccacgtactaaattattttgtactagcactagtactaatgtgctacgccgtaactacatctacatttaatttctatatgtagcagcaaactcatgtaattaggtgtgtttagttcgaaaaagaaaatttttgagtgccacatcgaatgtttgatcgaataggggaagtggttttcggatacgaataaaaaaactaatttcataactcatctggaaaccgcgagacaaatcttttgagcataattaatccatcattagtatatgtgggttactgtagcacttatatatggctaactattgactaattaggctcaaaagattcgtctcacgatttctcccctaactgtgcaattagtttttttataattttatatttaatactctatacatgtgttcaaagattcgatatgatattttttgaaaaaaaaaatttgagaactgaaccagaccttaacatcccgtgggtgtaaaattcaggctgcttggatgccaagtcgatcgagcagcagcgtaggctccaaaactgcgcatgagtactattttttttaacaaatatgtgctcggcagaacataatttcgagcgcatatcaggaattccaaggaggagaaaacttctactatctccatcttaaaatgtacttcctccgtctcaaaaaaaaaacttaacatcatactacgacgtgacacatatatcacatcctaatattatattgtttttttagcacggagaaagttactatcagtataggatgtgatattacatggtgctacgaattggtgcagggcagcagcagagggttggattgacgcaccgacgcgagcggccgatatcatctgtgctgcacggggtcgtacacgcactgaacgacacgactactagtggaccaccggactgcctgcatgccgcgccgcgggctccactccaccagtagtccactgaatgcccacaggactaacagctagctagacactgcagtacttgtgagccaagccatgtgaagtgatgatcgatgtgaacggagatgcctatgccgatgggatcgacgtaagtgtagtatagggaggtgaaaacgggtcggattcggtcggatcccatctttcttatatcctaacccatattttataatcggaatcgggttggacacggatagtgccgaataaggatacaaactcagataatgtcgagcaaaaatacagaatgaacactatcggttacgaatatttattcggatatcaagtcgaagacaacaatcttatatatcacatagacaataaccatttaacaataccatatatccataatacaattatattaagctattaggatcttagaaaataaatagggtacaatacatcgtagtagaaccaatacatagtactaaaagttacctcacaaaaacataatacgggtaatatctgtataattatccgggtaatactcggaacttttactggataatccgtatccgtcggatactacgtttccgaacccgatctcgtatccgccaaaaaaggcccgtattcggacccgatatccgaaatttcgatccgaatttatcccgaaataatgtggccgggcgggcgggagggaaatacccgtcccgttttcacccctacgtagtacgtgcacaggcgcaacagtcatcggcaccgggtcgacctcaatgtttaggccctgtttagatccctagcaaaattttacaccctgtcacatcgaatgtttggacacatgcatgaagtattaaatataaacgaaaaaaataactaattacacagattgtgtgtaaattgcgagacgaatcttttaagtcgatttgataatatggtgctacagtaaacatttgttaatgacagattaattaggcttaataaattcgtctcgcggtttacaggcggaatctctaatttgttttgttattagactacgtttaatacttcaaatgtgtgttttaatatatccaatgtgacacgccaaaactttacacccctggatctggacacagccttagggtttaatttgtttggagattttttttcatagatgtagcttcttccaaaattaaagtcatccacaaacattctatttttccgttaaaatttaaaaagttgtagaacttataaaatgtattagaaaaccacagcctaaaaagcccaggccagcttcttcatagggtgtgtttagttcacaccaaaattaaaaatttggttgaaattggaacgatgtgacggaaaagttgaaagtttgagtgtgtgggaaagttttgatgtgatgaaaaagttaaaaatttaaagaaaaattttgaaactaaacacggtcatgatcgaagaagctgggtaccaaccaggcaatagaccttagctacatgggcacgggacgaggcgcggattgatggagaagctatagctagctagcccccacactacgtaccccacagccacgcgcgacggtcggccagccgatcgatcgcaacctatctgtctatctatctcgccaaaacgcgtgcgtgcactagtgcccgctctgcagcaattgcctcatgaaccctctccaagactcgaacgatccatccatcgttctatcgcaggcagatgagggtggatgtgtgtgcaggcaggccggggcgggtggagggtcaccgcgacgtacgtatggcgaccgcttccccgcggccgcgcgcgcacgcacggcggctggcgtgtgcatgcacaagagtccatccgtaggcctaccagccgggtacctaacatgcatgcatgtaatctagttacgttccgcgtatataacatattctaatactactacgaattatgacattcggattatagtattatggctgtgtacgtttagttcacgctaaaattgaaagtttggttgaaattagaacgatgcgacggaaaagttagaagtttgtgtgtgtagaaaagtttcgatgtgatggaaaaattaaaaatttgaagaaaaactttaaaactaaacacacaaacttctaatttttccatcgtaccattccaatttcaaccaaacttccaattttaacaacacaccctcagtacgtttagtacgtgctactcagataaggccaatgagagccgcacatagcgtgacatatgtgcgatatacatccgccaaccggatacgtataaagtctgaagttgatcgatggaaatatggaatcgacgtagggataagatagaggggtacagctagtgctgcaggcagaaaatcacaaccagagaaagggaagggaaagggttcatccaaaattttgtatttcatatgtttagtcatattcagttattcagttaggtactactgtttcatttattgtattacgactctctcgagctagcctaatatatatctcgacgacggttcgcattatataagaaattaaagacgattgaaaaaaaaaaggaattgagagctatgacaactagccaaatcttaagtgaaaacaaaacacaggaatccatgtagagataagtaagagtacaaatgcagtgagaaagttacaataagagagagatggttcagccaaaatttttgtctcgaattgcatatgtttagtcatattcaatcacacaatgttttattatatcacgactctctctagatagccaaaattggtggaggatagttgtgatcggttataagagatgagaaagttggagaaattaataagagatggctgagataaggggtatatatatagaagtggttatatattgggacataattataattaatgctaaatgtagttatattatgaaagggaggtgataagaaattaattaatggctcctttcaaacacaagattgcaaaaattacagaaataggaacaataaaggaattaagcatcatatatatatagctagccgaatctcacataaaaaaaacatgtatgagaatttggtaaagaggattttggttgctccagagaaaaatgtaaaagatgggctttcatcaaatgttttgggatcgatggaaaacaaatcatgtagtgattttggaacacattcctacaatacaaatgactttacagggaatattctcataggacttcaatccttcaaaattcatgaaaaaaattctcaagtggtgtttgataaattatatatattatatgcttacaacagagcatgtatatatgtaattactactagtttgccttgctttcgtttattgtgctccaaattatttaatttgtcatgcaatgcctagattacaagtggcacacattaatttccaccaagtcttgggaaacatatcatgtagattatcgtcattatatgtgttgctgatgtcggtgtatgggtggtggttattttttcttttttgccagaatttttttccctgttccctatgtattatggatttgaggttgaaattgtacccaacttaccaagttgatatactagaaggctcatttatcaagttcttgcaccagaactattaattttaaataataagtagtatttaaatgtatgttaagttggtacatagaccacattatgatttttttttaaaaaaaagaacatagtacaaacataggcgttcaaacgtgcatgcacccatccctataaacgcacgcatgcacaccctactcctatgagcacttctgaaagactgagccgatatatcttgagattgacaaagtcatcacggatgtcttgcttttcacaagtatgtcgcgtaccagcaaaagaataattagccgtgtgcacatgtggtgggttagttacaccgcaagaaacctaatcagttgtttctaaaaagaaagaaatataatcaaatgagttacgctcacttcgcacattatgttacatttgtactcaaaagtatagggagtatatattatcaataggttaattaaattatgtaccagaatcatttagtctattattttttaaaaaaaacaaatcctccctacatagtgcccaaaattaaatgcccgaaaatgagatatacatacacataggcatcaagctataaaaatggcacgtttttcctgcgaggtgtttcagggatttattaatatcatattggtgacagtttagcagacggtactgaataatctccccattaatcccccgatgcccccacacgtcactggtcggttactaggtgtcgccacaagtaaattaaagcgcaagatcgatcgagctcatctcttcagactagatccacaaattaaaggcgagaaagagggaaaaaaaagattagagattggatcgatggatggagagatggcatctgccagccagaggccatcgttgtcgctcgctttttcacgctgtgatgaggacaatcctgcaatacctccggctttttggcttgcaaacttcgcacaaatcttccatggcctccttccgcggacacggacagcgacctcccatccgctgccctctgcatgtgtacaattcattcgcgttgcgtttcttgccaatctggatctctctctttcacctgtattctctctcgatcttgttcttgttatacatgcgtttgcgtgtggcgaccggcgagtgatgattcgatcgagctgcttgtgagctacattttgttcctatatgctgttgttgttgccatgttactccagtttaattgatttaattaattgtgattctcttttgtgtatggctgccgctaattattctggcccacatctcagggtagctataggccacgtaatgatggaattgaggtgtagcaggattaaggaaaatcttgaaaagcaatattttacataagctgttacatttgtgataggattttttttttggttggtagcatatattgcaaatttatttatttatttgtagcaaggtgatcatcttagatagatgcagggcactggattaattgaatgtagccgtgtagattgtctttctttgagatatggttcgctatcagctgttcacacatagctcatgcgtcagtgtcaaattaagagtaatcactgtactagcataaatgaaaagaaagagcaacattttctgttacaatatagtcaattaattcgtcctacatgtactcttcccgccaattgcgagcagcggagtaaaatgttctgttggcaccatattcccctctcatcctcatttccttcaaattaagtcgctctcgcgaagtcattttacgtcaaaattttatatgaattttcaaataattaaattaattcatgtaaaaattcttcaaaactcttttagttcaaaggagaccccaattggtgtggattaactctaaagttagctgagttgaagagtccagcagtttagctttttgggtttttctttggttccgtcaatattctacctgaaagtattcgctcaaaaaaaatattctgccagaaattgtttacacacatatggtgcacattcatgatttttttcatcctagatttactgttaaaccctgataagactctgaaatgttcatatagttaatatgaagatgaagagatcaacctagctagtacatacacatctttcttttgactgtaaagattacaagcatcgtcatatattctctcgggaagttattccactattgaatatattgatctgttctaaaataaaaagattattccaccattgttctattagctggatacttctcggtacaaagactggatgattgatttctattatcgaaaaaattattatcctagcccacacaagggcttccaaatcgtaggaaaactggccctgaatccatgatgagatattcggacacgcaactaaaccaaatcctatatacttatctagttcatccccactaagtgtagttatcgctatttctctcttctctcaataagccacatcacctcaattatttttaaccattggatgatagatccatagttcaaattgtctcttctttcttctctaataacaccatgcaatctcaattatttataggctcaaaattcatatgtatatcaatttgttttaattttaataatcatatttcatcatatttgtacatattatgtaatttaatttcccgcagcaacgtggcggggtattcatctagttaaaaagaagaatcatgagtgagtaggtgcaaaatgtgcagcgaagaaaatagtcgcaaagctttaattagggtaaggttgctaaataatatttcagtgataaagacatggttggggaaatatcctctagaggatatcagtactaataaaggggcctaaaagagttccaacctaattaactaaaatgaagcacaataacgaacgaaataaattaattgctttcagaaacataattggatgaggtgtaccatctcgtctctatagaaggttcaaagtgtaccatcatcagggccatactttggattttggatgagatagagagaaagataatggacaaggaaaaaccacctgcaggctgcagttgccatggaaagttgtaaaccatagttattagttaaataaaaagaatcataatcacaaccagttcgcatgtaaaccatagtaaagaggaaaataataataggcatgtagttgcagtgaaaataatagcaaaatgttccatgttactgtcatactacctaggattttcgatgagttggagagagatgataaacaagaaaccatgacctgcagttgccatgtaataacctttataaaccatagtcaaataaattaaagaataacaagcccaaccagtgcatgtaaaccatagttaaagaaaagaacaatgagagagcgtgtaggtgcaaaaagtgcggtgaaaatagtagcaaaatgttcagggtcacaggtgacagagacagaggaccgaagagctgatacaacaaatgagagggataaaagacatctaatccaattagttgaggaagggaacgtatcgaaggaaacaaatcgctctggcagagacagcagtaccaatgcaaatagatggacgcgtgaaactgaacaaaaataataagaagaactcaacagctgctgggctggggcgtgcgtaatacatacgtcatgcatttcgtcacggcagttaaattttaactggcgtaaaacatatcagcttcataattttggaccacatatggatatggaagtgtctaaacgagttagctactcaagtgccggttaatttgtttgtgataaaactgtattcattgagacggatgaattggaatgtaacagtttcaaaacgatcattgaagatatgaagtgagcgtagttcctcatcacggaagaatctaaattttacactttacacggatattcacatttacggccacattcttttagtgataaaccatcatcaacaatacacttgtagtgattttttttaatcttaagatatgattgtctagttttttagaaatgctcgcaaagatggggtatatacatttataagtgagcactctattagataaaaaagggaccctagatgatgctcaatttgctcactaatactaggaaagaaagtactggtcaattggactgctccagagaaagtcctgtacgatttggtcacgcaaaggcttcgttcgacaatgctgattgtccgggccttttcaaattcagcctaactaggactgtttttggagcaatccaaatgatcagtgactttctttcctgttaaacaaaaaatgggtacggtttcgaaaagatctgaagttatgaaccgccctacgggaaacaacacactctaggatttcaagttttcaacccataattctagaattcgaatagggaatttcagttcataaggctcaggcagataggaagcaacgacattccgcactctgcaagtccgaaacataggaatacagctacaactttgcaacgttacggtaggtaatggcacggttgacgataagacaagaacaatttaaagttggcattcttcaaaccagaacatgccatgacaagtggatgcgatagttagcacctagagtactttttagcgaggatttaactcatgtcaacaatgtatcaaaaaaggatggcacaaaaatttatcattactatccatcaccaacagcgcgtcccactgtaactcaaaggagagcttcagccctgatgatagcaggttcagtcaaattgtactttatccagctgcgtaatcatctcctcaaactgcaaagtatgacaaagaaatgatacattatatagggtataaatgagaaaactacaagtgcatccaacgaaatgatgtcgcatgtgtgaccaagtaaacatggtaagctgtaaaaagatctacaggtaccttcaaaatctgtctcaaaaagtaatcaccatggttcttggttaacttggattcaacaacatgaataatgtcctgtgtggatacaaaaagatttggtgagtcaaatagaatagtcatttgtaataagtcacatcactccatttgtaaggtaacacgtctaaagttccatactaggaagtgtgggaaaaaaaaacacggacttcatgtcattcatgcagtatttcagccactgataatcattacactagtcaaattcataaccccaggtacagaaagttttgagttcaaaagcatacacaaggaatttatattttcactaaaagcacaaatcatggagataatatttcatgaacatgtaaaacaaaaattatattctccaagcatttaatcgccatcaggaaatctaaacaataatagcgcttgaagcgcagaaggtttcaaattaaaaagcacacacaaaaaagttatcataaaaacacaaagcaaggagataatgtttcaagaatacgttaaaatgaacactattttctccaagcatttagtcatcaacaggagatctaaacagtatgggtgagtctggttccctgtatgctggatgacctgtctggacacaccaagcctgcctcagatggactggtttccaacatagattttgatttgtttggtcagctgagtttatttggccagtctaccacagaaattgtttggtttcatgcatatgtcacttctctcatggaacatcttgagaggacactgcatataggcagctctttcttgactcaagcaaccaggccaataagaaatgattctggaacttgtttcctcatggccagtgctcccactactttttgcgcacagagg

SEQ ID NO: 23542 - DNA, 18181 bp, Oryza sativa
  unsure (1)..(18181): unsure at all n locations
tagaactgaacaaaaagaatatcactgatactgcattattggattatcagaatttagtagtaatgtctgagcaagtagatacccaaagcataggcgggatctaggggggtggcccnggaccacccaaaaaaaccctancccaatgcatattacatatgtgaaaagaaacttgtggaaaaagaaaaaaaaataactccattattaatatattgtgatgtacatttaatccatttatacttctaaccttgtcatatatatatatatatatatatatatatatatatatatatatatatatatatatatatatatatatatatatatatataacttggaccacccatataaaaatactagatacgccatggacccaaagatgtgcatttcaggtgtcacataagatgctaagtaaagatactcaaagtaactgacatgcaacttccgcaaattgtaatgttaatgcataacaagggaaatagtaaaatgaacctcaacgttcagctgctcaattgtcatttcaacaatataaggcagtaaggcacaaacaaacaataattcaaaaaaataaaactcctacatcacttgagatattacagacaatttgatacacctagaatgctttggtcctagcccaattaagggtgtagtatagtttcaaaaaaagcataaaaaagaccaccccaatctttactttaagtaatacctggttgtagtttgtgtatggctctcgtagaactggaggcgacgcagtaatgaacttggggcaggcataggaaaagagttcatcataaatagcatatgcctcatcatcatacctatgcatctttgtcattttgtccccatacttttccttcagctgagtgccaacgttttcatctatgagcttgtcctgtggacacaatgagaggcagatcgccaatagtgcatacatctgctcattcttcttaagtagctggtcatactggggggaattctggtggtattgcttacacttcaggatatacaacagaattttgttgaattcacgtataccatcaatatacctgaaatccatccagaaatatggtttatcagataaaagaagtcagacaggacaattcatgatggtgaactaactagtaacatgactccattcatccattaagcattaggttctcatatgggacagaatagcatgcttcacagtaaagtttttttttttttttgggttcacagtcaacaggactacctaaatgttggaaaatccaaatttttggtaaggttgcaataagcaataacaaattttggtaacaatccaaatgaacgaatactccgttagcattatcaatattaagtaggcaattttggcatcaaagagaaatgatcctaagtacttcatcagaggtaagtaggggaagtgtcgggctaagctcaaccttggattcttggaccattattaagtagagaacagcataagcactattgactacaaaaggactgcccagaaagcttttgccatattccataagatgaaatgatgttaaacggcaatgttacatttagttcacatacgcagagcttaaaagtaggagtaatatactatataataggaccacctgcaattatggtaaacataagcaatttatatatatatatatatatatatatataggacactcatatgggggcaccatggtttcaaatgcacaaaatcactcaaatttttcaaaattttcaaattgtgagtatatacctagttataagaattcgattcatacctatacctatcaacaaaacaactcaaatttaactttattcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttactatatatatatatatatatatatatatatatatatatatatatatatatatatatatatatatatatatatatattaaaagaagagttgaaagagtcattctgaagtgattgaagaggtaccaaaaaaagttcaattatatggcacagaaagtggaccatcactggttacccaaaggggtgagggtacgcattttatatcccatcagcagaaaacaagtatagcatgatgctagacaagtacacatacaagtatcaaaagaaggataatcattcatactgtaccatactgggtaggaaagtaaaagataacccagaatttatatagctgaaatatcactagatactccatcaaatccaaaatataggtcatacttgccttctcaactcttctctctaaatgagtcatgtgaacaagtctcaattgacttatttggttagagaaagcatatgatttttttcaacaacaaaactctagatgtagaacaataaacgatagataaagaaaatagaaataaagatgggaaacagagatgctcaggcaagttagcttaacgcatacctgcgcatcatgaggctggcaaacccatagtgataaatagtggaaatgtggcttccaatcacagtggtgtagacaccctgctggcttatatctattggagccaagcacttgagcccagtatggtaatccccaagaaggcaatgcaccctgagcagcccaatcatgctgtagtaccccagcatcttcaacacattgctcccgccctcatagtcatacccatcagttgccgtgaactgttcaagccctaccttctccctctccaggatctctccaatcattgacttctccaccagtgctttcaagtaattaagaaccccataaacactccatgcctgtaaaattataaacagattaattatgacagagctatcaacagaaaactcatacataaaacaaagctaagccatccagatccaggattcatcataccgagcacccaacctgaatctaactctgataaacgacctccacagcacatgtcattgaacaaacagtgaaataaatgaggctactgctaaataaactcgtaatggaaatttaatgtcaatgcaaatctcatagcacaagcaagagcaacctcttccgccttaattacaaatcacaaagaaaattgagactatcactaacatgtgcaatcaagaaccagctctattatattacttcataataaataccatagtccaaataaataacagaattaacaagcctacccttcattaggcaacaccagcataccaatggaaactcgtcgaatcgcaacacgattcctgatttactctgaacgatggactaataaaaactaagggagattcagattatagaggacctatgccactataccagtggaaactcatactgatttactctgaatgaacgatggatataataatagtaaaaacaaaagggagattgagatggtagatgagaggacctggtcgtactgcttgaggagggcgatctcctcgtgggtcttgttcttgagcttggcgcggtactggcagaagctctggaactggtagacgaactcgtcgaccatgtcccagagccactggttggggagctgcatgttgacgacgccctggaggacgacgctgaagagggagcagtagttgtcccacgactcggcgcgctgcgccggggtgaggccctggacgcgggcgtgggcgtggcggaaccagagctcccggtagaggaggaggaaaacgtggtcgccgtcgcagtgcgccgccacggcctccgccggcggccacggcgtgtcgcggaagtggcggtcggagaggcgggtgaacccgccctcgtacatctggtgcgtctcgtacacgttgcggtcgcggatgtggcggtagaggtgcgacacgaacgtcttcaccgagtccggcacgtagctcgggtcgtacgccgccatggcgccgcctcccccggggccggacgacggcggcgccgcgtcctccctgtcgcggtagaaggcggcggcggcggaggaggccatatggcgatctagggtttcgaggtttcggggggtttttgcgtgagctggtcgaggaatggtgatgaccaagcctatctcactatctggtcggcctgaaagtgggcccatccacctaatgggccggcccaatttcgaacgggccggtccaagcccaactcgagctggctaaatttagagatttagggttaaaacgataaggctccatcctcgctagttgtggcgagccccaaaaccaactcccaatccgcatctccctccgctgcgccggcgccgccgcccgccgccgccgtggcccggccgtcggctcgcctccgcctccatcctcgggcaccggacgtcgtccccgccgcccggaggccgacccctttgcctccttaggccttctgccctagttccggcggcctggctctaaattcggccgcagccggcgcaggtcgatcaccgcccgcgcgccattggaagcggaggtaatcccccgcccagctgccaagatgaattggctctttatttattgatatgtgctcccggctgccaagatgaaatgtttatttattgataaatttgatatgctgagttgggaatttttgtatgtgcttgtgcactggatcagttgatctgattgaaactaatgctgattttaggtggagaaaggaagctggcattggtgcgtgattgaaatgctgacctgattttttttagtacattgaggatgtgcgttctctgaactttttactgaaatgactgttgcatgaaaaatatgtgctacattctatttttgtacaacactctatagactgaacatatgccattttttgttataaattcaacagtagcgatggatggagacagttgttatgttaactcactggttgttaaaatcaactcgccagagtgggatgatggcaccatgatgggggctagtccacccgaggagcaacattcaacggtcgaagaagttgttgtcgtgagacgaaaccagaaaagaacaaagaatttcagcgggaaggaagacgaagggttggtttcggcatggttgaatgttagtaaggatgtagtccaaggcatcgaacaatctcgttgtgcatactggaagagaatttacgattacttccacgcaaacaaggacttcacctcagaccgttctcaaaattccctcatgcaccgctggtctactattcaagagaatgtgaccaagttcgagggttgtctaagccggattggggatagaaagcaaagctgggtttcaagtcaagataaggtttgctcatatgtccttaaaactagttcctcatttttcatatagtgactagacatttaatatgacattttgatatgtgcagattatgcatgcatgtgctctgtacaaggccgaagatgagaaccataggccatttcacatgatgcactgttggaatctcttgagaaaccagcaaaaatggattgataggtcgtctcagctgccatctcacaaaaaacagaagataaccaacaattcaagtctaggtatgtctactactactactgatgatactgcggctgctcctcctcctcctccaggatttgagttatcgaagactccagaaagtattaatgctcctccaagatgtgagttatctgagagaccagaaagtaggaatgctcctccaagatgtgagttatctgagagaccagaaaataggaagggggagaaagaaaaactacgacgaggtggagatgtggtctttgtggaggatttagatgatttgttggcaaagaagaaagaggcagatgtggagaaagagctcaagaaagatgagagatatatacaatcacatgccctagagcaagagaaggttgcactagaacaagcgaaggttgcaaacgagacaaaaaatcttgagatgaggagcaaagaattagaattgaagaccaaggagatagatttgaaaagaatgttagaagaagagaggattatgactatggatattagtgccatgtctgggctacaacaacaatattacaagagcttgcaggaggagatcgtcactcgacgatttaatagctcgggttgacctcgtatgtctattattgttgttacggactattatgttttgcgaaccatgttgaagtcgtatagagaattatggtaaacagcaaaccttgttaaattgttcggactgttatggaatgcataccttataggcttataccttatcaagttgtatggactgtcttggtgtgtgaagctttaggccctctttgtttaggcttagtcttattggcttagatttttaagtcagcttattggcttatatgatttataagccagtgaatttaatgtcctaagtttagtggtggagtcatacatctatctcagataagccaaaaaagcttctccaacctagcttttggcttaatagtgtaagagtggcttatagcttcaaaaaagccaaacgaaaaggctgcttgtaggggtggacaggaagctcgtggctcgttaactcgctcggctcgtgacaggctcggctcggctcggctcagctcgtttgaatttcctaacaagccgatctggcatttcagctcgttagagataacgagccagctcgagctggctcgcgagccttaacgagccagagcagatgaggcccaggcgcctagcccagcccaacagcccatcacccagcccatcaccttgtgaaaaccctagagtcaatccccttctggcttgtccccatcctcaatccccacccaagccaccgccggcctcatggctgccgctcgcccgcgcctatcctccccggcgccgacgccgccgtccccgcctctcctccccggcgccgacgccggcggccgtggacgccgccgcccgcgccgctccttcccgccgccgccgccggcgccgcccgcgcctctcctccccggcgccgacgcggacggccgtggacaccggcgcacgcgccgttcctccccggcaccgacactgccgtggacgccgacgctcgcgccgctccttcccggcgctgacgcatccagtcgtggacgccggcgaccgcgccggtcctccccggcgccgacaccgtcgtggacgccgctggcgcgccgctcctccccgggcccctcgtaggctcctacacttgttcgctttctctcttgtccccaaagctcacgagcctaacgagctggctcgagctttcaaacgagccgagctgagctgggtttctagagctagctcgttatcctaacgagccagaccgagccgagccgagccgagccagctcgacatccacccctagctgcttgtttgtttaggcttagactttttggcttataaattggcttataagcctaaacaaagaggaccttattatgtttgagcttaagttattttggtataaattaggacagttcaaatatgctactccccccgtcccacaatataagggattttgcccccatctagttgtcccacgatataagggattttagtgtactacttatcacatccatcaactccaatttaaatttttacctattttaaccctcatctacccactcacctataagcaaatactccctccgtcccacaatatatgggattttaaaaaagtttttgtttgcactgtttgattactcgtcttattcaaaaaattttggaattatttttttttgacttactttattatccaaaatactttaaacacaactttttgtcttttatatttgcacaaattttttaaataagatgactggtcaaacaatacaaacaaaaactcaaaatttcttatattatgggacggatggagtatcatttaataagggcattctagtattttcttgctatccttaaacttacataaaagggaataatactttatattatgggatggagggagtaacatggtactgaccacataaatatattattccaacaatatggactacattcctaatgcatttctccatgacattcacttcaagaaaattgaagtgttcccccccaaagttttcaacattgtggcaataatttatactgttgccaaagttttagttttttggagtaattagtacaatttgttgaacaatatagtgttgtattagtacaattttttggagtaattagtcttttttttttttggaaaaaagtactttatagttttgttccaacataaatgagttatggcaacaaaaagaaaaatggctaacctttgcaacattaaaaactctaattctacaattctgattttgtgccaaatagtttaacgtattggcgtattgccatgttatacaattattgtatttcacaaaaagaaaaaagaaaaatacaaggacatagtattattcaagtagtactgctatgatttcgtatcgatgtaatcaatttctttagcttttttatatccttttagccatgaatatcaatttattcttaatagggaaatcagttgcaggaacacacgggcagttggactcttgtagccaccagccaaaccaaccaacatcgccaccaaagcaagcgttgattccgcccttggtctctcgaccatcggctacagcggtagtggccccctgctgctaccattgtgacgtagtggacttgatatagcatcttatcttacaacttagtggtcactattttggatttggcgggtcactatagaatgatcttattttatataaccactaacccatatataacaaatgacaaatttcttagttgtttttgtgtcccaaaacattgtattattatgagttgtaacgtctaatgagtagaatagcatgtttggttcttaatttaattttagttagaacaacatcttcgaatgctactaaatatttacttatgctcataggttatatgtgtattgatctatcactaatttgtttctcagttgatttcttaatgtttttgaagttattattcaagatatgtacactcaaatatgtgtgataattaaatgcggctattggaatttagcatttgctatagcaccggttatccgcgatccgctacataggcaaccttacttctcttctccattcgaagtgagatctgtctcttctcgtcttcttgagttggatacttggatttgctttaccttaatactaaatcaatttcttttgtctcttttgtgtttgtgtgcgaacatggaggtacgatggcttcacactatatccttccttgttagttgggagtatagtcaactctaatgacccaaaggtaggcaactgcattcgctgtgttgcacttggagagccactagaggagagagtagaggatagtgtcatacccatacattgggttgttttttctagccattcttgaccaaggctgagtttagttccaaaatttttcttcaaacttctaactttttcatcacattaaaactttcgtacacacacaaacttccaacttttccatcacattgttccaatttcaaaccaaacttccaattttagcgtgaactaaacacaccccaaatactagataccagccattgagttcaattctagtggagacagaatgtgtcagggcccacatgtcagataaattatgtctttggtctacatattgaagagagctgatgagtttttttaatataggtgaggcttatgataatacctatggctaattcatacactgtagcaattccagcgattcttgtacacgataggccaatgttaatgttgggttctctcacgaattcactttgattaactagaaaaggaataagtttacttgaggttcctcacaattcgtcaagtctgaaattcatccctaaaccgaaaaacatgacagaatgcgtctctcaactcccaaaaccactgcaaataagctcccaggatggtttggactgcggtttcagctgacttgacacctacgttgatggtttgacttgatccttgtcccacgtgacattaaaaaaataaaaaattaaaatgaaatatatgggcctatttgtcaataaaataaaaacataaaaaatatagttggacccatacttcctcgacctcactgcttctctcctctctatctccttcccatccatggagctgcatctcgccgccctctgcttcccccgcctccacttcccctgcctactttcctaaggccacctccaccaccaccgcctctgctgcctcctcctcctcgttgtcgtcggcggcagaagccctcaagccttacatgcatctctcgcggctgatggaggagcagcccgttgtaaaccaccataggctgcgaaaggagctgggtcccgccgcgctctcctccctctgcacgggcatcgagacactagtcaccgaggggcggcaccacaaggcgcgtgatgtgtttcgcggggcctaggctagggtgccgttcatgtcgctttcgagttcaccggatagaaatggagcaaaattcacgagatttaattcgagatttctagggctttttttggggaaagaaggggagatcgagggaattccatattcaatcaattttgagggagagaaaacgcgtggctggatcgagcgaagcaggcggcgtcggtctcaggtgtgcacaggacttccattcggaggagcaagacaatgactagcagtggggctgaagctgtcagcgagatgggaaggatgagatagagaggagagagaatgggtgaggtggaggaagtggacacactatttttgtatgtttttatttgactaacatatgggcccatatatttatttaaatttttaaattttgattctaataccacattaacgctacatgggatgaggatcaagtcaaaccattcacatagacgctatgttagctaaaactgccgtttaaaccatcttgagaccttatttgtaatggttttccgagttgagagacagaccttatttcagttaagggatgaactgcaaactcggcgacaaattgagggacttgttccactagaaaatccagttcgagttcatcctttccccaggtttccagcctgttgcagctcagctatttggcccactccggcccatggacacgagggtttggaaacctgggtcgcaggccgcagctgtcttctggtagattggcctggtcactgcttgtgtattgtccggagcctgtcttgcttggtcaacaggacatgtcaggcaccgtggtctatgcaacgaaaatacattcaaaaatttcactgtaaactttgcataaggcagggcaaatacattttgatttaactgtttcttttttaaaaaatgtgtcaataatataaagtttaatcagaacaataacgtctatcgtgaacaacacacgaggtaacacttctaattaattaccattatagggttatcattctcaaccttcatcgacgatggttaagacagcttcttagcttaagagcgatatgaacttgacggcgacggccaccgcgttctgcgccgccagcgccgcgaacacgccggcctcgttggactccgcggagccgccgccggcgaggtcggagagcgaccgtatggcgatgaacggcgccccctgctgcgccgccaccagcgcgacggcggccgactccatgtcgatcggcgtcacgcccagcctggaccgcaggaactgcctgtacgccgcgttgtccacgaacacgctggcgctgcacccgcgctccacgcgcgccaccgccggcgcccgcgccaggcacgtcgccggcgacgtcgccgtcccggtgcggttgacgcagcgctccagcggcatcgcctccagcttctgggcgagctggtagtaccggccgtcgacggggacccagaactcgtggcggcgagactccggcgtgccgtccgccgggaacacctcctccggctggtaccacacgccgttcagcaggttgccgccgccgccgccggcgacgccgtagtcggagaagttgagcgccccgtacttcctcgtgtagtcgccattggactccagcgcgagctccttctccggcccatcgccgtaccgctgtgtccgaattaattaatgaacaccgatcaaatcaccaaaaccaatttgttcttgatttggatgaaatttgatgaaattaattaatcaatcattcacctgccagttccagagtccggtgtgcgcccagtagcgggggacggtgacgtcgccgatgtggaggtcggggtcggcgttgccggcgatgccgaagtggacgatgccctcgacgtcgaagagggtgaggaggagctgggtggtcacgccggagttgagctgcgttcgtatgaagccgcggcagttgatcaggttggcacaatggaattaataattaaggtaattgacacaatctactctatgatagttatgacgccgttaaattctatcatgtcttattaaaagttttatgtaaatatataagatataattcgtacttaaagtactttaagagataaaataatttacaataaaatacattataattacgtgaatttttttaataaaacaaatgataaaaattgataaaaaattagcagtgtcatctattaaaagacagaggtagtataagtatacggcttaattaggtaatgaaattaatgaaggtgtacaagtatttaccatgccgaggcctgtcatgacgatgatcaccttcttctctcctatcgatccgaagcgaaatctccttcctacatggaaagacatgtggttttggtgagaaaaatatttaaccgaacttgattgatgtcgttttttttttttctactacagaaagaacaacttgatgggtattggtttgggggtgctaatgggcctgagtttgaggcagcccagctggcagtcttggtttgggctataaattaagctcaagcctggtgcataattcaaaatcttggcaaaaaaaaggagagaaaatctgtaatgtggaaatttatgatccacttgaaattcttcaattcaaattgggattttgatgaaaatttaaaaataaaatttaattttcgtggattttgatgcaaatttgttcaaagtttaaataaaagtttaatttcgctggtctgtgtaatcttttgagtttaggttgaaggggcatttgcagctctgtgcgtgttagcatatatacagccatgctgcaggtgcgtcgactcatgtactactcgtagaaaaagatcgatactactactactaattgatggtgatgaaccactaattttattttgtaaatctggcgatcaatttattcatcaagattgtgagagagtcgcaaacaagcagttgtgactacttgcatttatatacgtacgtacacagcttatcataatctgtttgatcttcaagctggtcaatggtatgcgttcgtacacgccatgcatggcctaaacgagttgaaattaaacccgacgattagtagaggaaacgaagtagaagagtagtactgtagtagtaaaagcttagcaacttggccacatggctagctaggtaggtacacgtcgtcaacttctcatcttttgacatataaaagtctatacaaatactcctccgtctaaaaaaaagtcaaaccatgtatttccgtgtacaactttaactgtccgtcttaataaaatttttttataattcgtattttcattagtgttagatgataaaacatgattaatattttatgtgtggcttgtctttttaatttttttcatatttttttcaaataagacggacagtcaaacgttgggcacggaaattagggtttgtctttttttttttttggttgtagagagtaatctagatactgttgtaacgtgtttctttagttctaagttaacatatattttgaagtggatatactaattaacacatacttccttcgtctaaaaaataatttaaaactggatgtgacatcttagtataacgaatctaaacacatgtatgtttaaatttattgcattagaatatgtcatatccagtattatgctggtttttttttatgctacaagtattaatgattgagctgatcctgacgacgtcgcccacagtaatcaatcatttaaataatcctaccgtacgttacatgcatgtgtagcaagttgaatatggtagagaataaatcacaactgaccgatcgaatgaggggtgtttttttttccttaatgtatgtgttaattgtgcatgcgcaagtatgggatgactaatatacatgcacatccctatatgcatccattggtttggattaaataaacatacgtattcaacccatttttaacaatagtataatttttatttgccttgtaacttgcgtgttagatatatcttctcaaaaaattgaattgaaatattcaaagagaaattaatggtaaaatttttaaatatgttgactacacgtattattataaaacatcgttacttatttgtggagtattatcttcttgaaaattaaatatagtacgatctcaaatcccactggttctgactcatattgtataagcatatatatgcagcagtgatatcacgtgcaattcttttagtagtagttcatttgcagaagatttgtttgaacaacatggaattaattcgtaaagcgattgtttggaaaaggaaatgcgtgaagaaatctacaacacgtatgtccgcagaccgcagttttaatccaacataaaaaatcgtacatgctacgtgtttgttcgatatagagtacagaagagtcgttccctacacgattatccaatcaagaacaatacgacatacttttccgatgtgtttgttgtataattaggttgctctcgagagaactattgaaaagtctatgttttttcgcacaaccttcccaaaaccgtgaaatggtacgttatacgaaagttatttttttaaaaaatattaatctatatttttaagtttaaaataattaatactcaatttgtcatgtgttagctaatgactcatctcgttttacgtatgttctcaatattccactttcctctctcaaacacgacgttaattaaggtttatttatcagacattcgcatttggcaacctgttaattcttgcataaatatatggttctatctctcactttttaaacgaaatctgatcgggtgaaaaaatttacaggattatatatgagatattccgggacctataatatcgacatgtatatccgttttttatagtgaatgtttcagtctacctatgttttccattcctccaaacatcaagcggctaactgtggttctcaaaaaaaaaaaagaagcggctaactgtctaggtacaaacattcaggctcctgtgccagaatgatggtggtcatgcaagttttcaccaattttaagatggagatatatagtaataggattaagtgttgaataataatgtcttttcaccatatatatagtaatagggttaagtgttgatgcaactcaaacatctacaggtttcattcacgcaaatatttgagttgcaaactttttaattggttatagcttctaccaaaacaaacgctgagtttttgggggagtactcccaaaaaagcaagcatctacactaaaggaattacataatcaaacaagggtatggtaataccttcgtcccgataggtatgtctagattcctcaataggtatgttcagatttgtagtttacaatgtgtctaattttattttagttactatacattttgcgtaattccaagaaacagagtacaaattaattagtttatgcgtgtatgcgtacacgagtgtgtgcctataggcatgcatgcaagtgggtagtcccactatcaaaaaaaaaacccgcttgcatgctagtctatttttttttgcatgatatatagtacgaagaaaaaataaactagaagtgggataagcggggaaaaagcgcgcttgtccgcccctcttgtatccctatgtgcctactcatcgtttactaactaatgtaggcgtgatgtatatagttcgtatgtatacctgcgacgtcgaggtatggcagcttcttggccggcgagaaggccggcgagcggaggagcggctccatctcgaacccgttgggcaccaccacgcccaggtacgggccccgccggttcacttgccggacgccccgcgccgcgtccgccgccacggccgccgcctccgccgccacagcagcggccgccgccgcgaccaccaacagcaaagccagcgtcgtcgtcgtcttcgccggcgacgacgacgaccgagcagccatgtcgttaattaattaaccttgagctaatgaactaagctaataacgcgtatgcgtataacgtgacgaatcgaaatagctctagcaatcgatcatacaagtctcacacaagatgtgtgtgtgcgcgcgtgtgtgggaagaacgagatgaagagagacaggagaatggtagggtttatatatagagctaggaaacaggaagaggatttgatttgagtcagagctcaaaaagaacaatcgtgctggccatctccaattaaatactcctatttagcttccaggacaagattacatgaatggaatcaatgcaattacactaaaagaaataacagaggggtttctatagatatatatatccggtagcgtatcctgtgcacatgctcaccttggtgcactcatgcactcacgcgacatgggaccttcgatctccatcggacggatataagatgagagagtcttctttttacaaaataacccttcgattcatcttcttgtctcccgttcaacccctttccccaaatctatcccctctgtgaggcgtccatggcagctttgaatctctgaaaaataaaacaatgctcgacggagatggccgctagaaattaagattaatcaagattccagcatgcagccgtcaaatccttgctcaacgatatgtatgatctcaacctcaggatcttttgcatgatatatatggcatgccaaaatttcgaatcaaacaagaaattccgatcggatatgccatcgatgcacacatctgcaacccccgggcaaagactcatccattccatcccatgggcaagaactcttctctctacagagtcaggtacactgcgccgcagctgctccatcggccgaacaccatggccgtcgccctggacacgctcgcccgcgcatcgtccctctccaacaagctggacaaccacacgcaccttgaggcgtgacatgccactggccgcgccgccgcgctctggatgtgatatctctgtcgccaaacatggcttaatttgagccgccattgacgtcagatagagattttggggaatacatcttggtaaggacccaacacgggaagacaaaaggaatcaagggtctatttacaaatttacccgtgtatgtgcgggtggttttatgaaaaaacgtccctttgcattacatccgtccgatggagattgaaggtcccatgtcgcgtgagtgcacgaatgcaccaaggtgagtgggtacacaggatacgatgtctatatatccccaatcaacaaatatagaaaatacttcatccgtcctaatatatagtaatatagaacgtgtcattatgaatttaaacatgtatccatgtatctatatgaagatattgctgaaacgaaggtaataggaacgtaggatatatgttatagtatttgacatataggcctgcagcgttgtcaagtggcaatgcaattactatatgattcagcgctgagcaatatgaaccaattaaccagatggcccgtccacgtacgtaagcgtaactacagctaacgtgccagtttgattaacgattatatttgctgaccaatacattgtgcgggagagggcgcacgtttttgtacacacgtcaaaaatgggcgcatggttttagactgacttggaatagtatccatcatatcgcgtgctgcttgccacttgagatgtgtgtggtcatgaacttgactggactttaatttgcatggaccaaattaagctacagtacttgatcgagtacggaaaattaaggaaagcttcttatcttgttcttatttttttttcctttgagacaagagacttgtatccttacttgaacgagagtacaagacgaaatgggcaaggatccaacttgtattatttgattgagagtacacggcgaaatgggccttcaaagtttgcacgtggtgagagccgggtgcacgtggtatgtctgtgtgtgcactagccataggcttaaaacgagagggctgcagtgcgcagtattgt

SEQ ID NO: 23543 - DNA, 4576 bp, Oryza sativa
acacaatactgccgagggcccttatttaaatggttccgtaagttgggggacccgtcgtaccaggttttgcaacgaagggacgaaaattggactggacgacaaataaagggacccaaagtgaacttattcctttttggccatgaggggggaggtctattagctatatgggctggtctcctttcacctgccccaacctggccgattggaataagttcaccgaaggtccctcaacttaacagtgagattttttgtggtcccttaaccacaaaactagaaatgtgtatctcctaaactcacataaactgtgtactcaaggtcctattgcagtattattaacgaccaaatttggtaagatatgaatcaggttcggtattggaatcaaagtggattcggcaaagagttagattcgaagaacagagtatgcatcggctgaaatggaccggacagaggacagccgatacattcgacagccgatacagccgattccgatgaagatagttgtaaaactgcttctagaatcgatcaacgtgcttcacaaggattgccacgatggagaaaagctcttagaaaggcaattgtatcatccattaattaggatattttgaatagtttttttagagatatgtttgggcaaaagtctgccgtaaagacttatgtgtatcttagagtttgttagagataagagtcgtgtccggcaaggatatatcacgtatcttgggtataaatatgacccaaatccatgtaaacagcaacacacagttcaataacactttcggtgcatcgtcacccttttactttcgttctatttcgacgagttcttgctttcgggttgagttgcatcggtttcgatcttcaactagaggtaaacttgtcactatggcttgcattctcgtgattagtgcttccatctttatgacactctaatcttgtttatgttattcgtcgagttatcatatacactttataatctttattagttgtgttatataacttgcaatcgactggttttactgtcagaaagtagccaatagagttagatctcgttattaatctagattatatcgtgtatctaccatctcttaaagattttcattatcttgtttagatcttacagttatctttatgattaatgctacatcggttgagttcgatctattaagttctatctataattgtgatatctagcctgtttcatgatcatcaatagagatagtatcagagtttcagccgatcttacctgatttagctacttttatcttataaacttgactgttatgctagatctgccctttatattaagatcttattgcattaaagtatattaggctttctgtttgatacattttgcttgttttgatatcttaatatagagtggtatcggagtattagccgatacatattatatctatctgatcaggtatgctataaacgttcatatagtcataatcttaatgtacatttagacttaagtgatttatactgtctcgacatggcgtttgatctatcccaatcacttagtttaagtatacatcgagagaaagattatatatcgttaatatctatagccgatcaagtagatttagttttatattgctttgtttctcgttgccgatctaatgccaatatcatcggcttagtgattgatgatatgtcattagctcatagccgatcggctatcgtttatggatttaacctcgttttcttgtcttttattcttgttgattgtaggatcaaatcaattggcacgctcacgaacctaaaaacaagattttggacctacacaggagttaagcagatcttccagaccagcgtgtgtttttcgcatcaacaaatatatatgggtggtttcgctgacgtggaatcctaatcagaaaaaaaattaaaaaaagtacgtggagcccatatgtcagctgcacgttctcttttcttctccttagatctcttctctcttctctcttctcttcttcaacaagaaggtgggcatggaagcatgctcgggtcccgcgaagtgaagaaggccggaccagccgcagcgccggcggcgacttcaccatcgtcgtcgtttggcttgtggagttgctcttcccgctgccgacgctcatgtcctagctccgccgacgacgcgcggctcagctgccgcttgttgctgtcccagcgctggacagcctccgcgttcgcatgcgttggcgtggcaaaaggttcgcgctggtagggcttagacgatgaagccgcctaactgccggctttcttgtgtgcgtcccacctctcaacggcgtcagctcgaccaggcttgggatcagaggccggccacacgcggaaggaggcgtggaggatgatgaggcacggcgtcgggagcaacggcaacatctggctcctcggcggggtcaagagcaatgccggcaacatgcttgtcggtgcgtcaggcgccgcagcgccgggaaaaccgctgtcaccatgaccgccctcgcccatcgccgctccgcccgctgcccgcatccgcgctcgcccatcacggctccgcccgccgccggtctccctcactgaagaagagaagagagaaaagagaagagaaggaagaaaagagaatgtgcagctgacatgtaggccctacgtacttttttttattttttttttctaactaggataccacattagtgaaaccatccatatatactgccataggaccttgagtgcacggtttgtgtgagtttagaggtacacatttctgattttgtggttaagggatcttgaaaaatctcaatgttaagttgagggacctccggtgaacttattcttggccgattagccggaagcccgggacagcccaagccaagcaggccgacctgcaacccagcagtcacatggacatggccgaagccattaacttgaggcccagctaatcggcacaaggtggctaacgttcatactacccagctatctataacgtcctctgcatttttttctctttccaaacaaaatataactcccggcctatgtacatagacatatcctgtgcacataaattttgcatgcacatcaactaacaaatattatcgaaaattgtagaaaaaaaatgtgcatatgcttttaatagtaatacaccgatatgcaaagttttagcatcaaattcattatatattagctgtaaaaatattttctgataattttaaggttataaatttgtcaaaattttatatttttccctacgcatgatgaatttaaagataaggctctcatcttttggcccaatcaacatatgccaatgccaaaatttaaatttttgaactttattttgaagttgtttttttaatcatagtttcttttaaacattgtcatttaagtcgctatgagcataactgtaacagttttaatcacaaattatattttttcactaatacgacaaatggtgtgttttccacatatagccatcaaatgaggccataagattttacgcatagatgtaatactattaataatacatgtaaaataccttctagaaatttctttgatattttgatagttggtgtgcacagtgtgtacacgtgaaaccttatgtgcataggatacgatccatacttatgaacattagtattcaaaacctagtgaatgaagtcatgcactcataagtcataactctactatcatacccaatggtgcttctccagtattcctaaaaaaaatcaagaagacgtttcgtttgatttaaattattagtggattattgccacgaattatctacttgattatagggataaattaaatattttattaaataaatttaataaatagtttatggcaagtgttccaagtaataaatcaagcgaattttttttgcataacatattttttccaaagcgttggacaaataaataattaaaaagaacatcaactaaagtggtacaatcaattgcagaatatttgaaagaattagctagcagtctagcatgtttgctgctaattgagcatcaagtcatcaaccaatagaaattgggctgcacaattatctttggattaatagaatcaacctgctcacaacaaattgcaagctctgaactatcaagagctataggtagcagtaaattgctgaactgagcatcacgactcatggtcatggggagtttcagaatagagcacagaaaatttcttggcaatctagagacagtacaaaaaggtgatcacggcctgttatgttcttccatggattgcagcaacgttatttcaaattttaggcgttcaaaatcaacaattggcacagaatgttcagaactacgttcagagctctgaacattagcacaatattttagtgttttgagcatatacacattgcgctcttacctctgaatatttgcagctattttacccactggtttgcattgacacttcagtgacatgccgttctatttcaagaagcatggctacgtgagtacgtgtgcataggaacaagcaaattgaggatatgtacactggtggagaaaccatctttcgtcggtcggccgatttccacaatagtcccggatgcaataaaaaccggggctaaagatgatctttagtcccggttcaaaaggggggctgcagg

SEQ ID NO: 23544 - DNA, 1078 bp, Oryza sativa
cggttggtgctaccaaccgggactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgccgtaaaaggtttgcaacttcatcctccaatgttttttttgtcatactacatttgcacctatgttttgcacacttttttttgtctccaaaatttagttgtaagttgatgagagagaaaatgtgtgtggggaagaaagaatattaaaatttagttcatttgctaaacaaggtttttataaaatagttgaaaaggaaaactctagtgaaagttaatcttaaataatagaaaacaaattaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggttttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatattggatttgaaggaaatcaaacgggcgaggaggaaatagctgctgatggtaacgacgttgcggatgatcttggtcagatgttgcaggacgccagggaggactgcgaaagtgaaaa

SEQ ID NO: 23545 - DNA, 2133 bp, Oryza sativa
  unsure (1)..(2133): unsure at all n locations
agcgaaagtcatactcaaagtcaaaaccagaaccagaatccaagccagaagcaaaagcagaacgacagccagagtctaagcccgagccaaaacccgagtcagccccaaagaaggaaacgccttcgtcggcctacccatgatggagatccatggagatcgagggcatcttgcttgctgcacgatttagctactgatgagattattttgctgaaggtcggagcactaggaaatggccattggccatttctggaataaataagtgacgacctagctttattctttgctttatttccctcattctttcatgtttttttccggatgtgccactgcgccagctggtgtaattcacttatttcttatgtatctatatctatgccattttttttctaataatacatacatatatatatatatatatatatatatatatatatatatatatatatatgtgcatttttttctgcccagtactacctttataattatccctcctgttgtttattctagattatattgtggctgcctaacaaagttccatcaggaaaagggtgtaacactgtaactatctaacactgaactatcaaaattgttcgtagttactattacattttcgattagtctttgtaaatacagtgctaatggcacggcttacttatatatgtaaaacaatcatcaagcgcaatccaatctgtacctggtttgatcgagtctgcaggttcacggttaacaagctcctgacctccattaattntagtaattntactatcttaaggcgacgacgagcggtaccgcaatttcgaatntaattacacttaattattttggtgtcttttaataaccgtaaaatttctccattggtaaacctatcgttggaactgatccgcactatattggttaattaatacaagttcctactcccttcttctgacgccgtagacttgtttaaacttgttacacacattcgtcttattggaaaaattaaaataaatatgaaggctttccatatcattggattcattattaaatatacttttacatatacatatagtttacatattcacaacagtttttcaatgagatgaacagtcaaacatatttaaaaaatcaacggcgtcaaatatttagagacagagggggtacttcctcgaaaaattttatcagctggtgagaacaaatattatttgtcagtattataacaacatttggcttccctgatctaataatagctactacctttcctaaaaatatattaaacgaacctatgtgctatcagatcgtgtccaatatgaatgcaggaaactaaatttctacataaattattttcacaaattccttaaaaaatttccagtctctgattgggttgagctacgacttatttgctgtgaataacgaaaaaaatattatgggtaaacttttatctgtattattcatggttttagaagacaatattaattagaaaatggactacaataaaaaaaacccttaaaagccattgagcaaacaactagaatgcgagttccaaaagaaacctgtaggcctagagccttatcgtttttgccatacaacgaaaatgagtcattgctaaaatttaaattttaaaacattattttaaagctaattttagagtatatttaacgtagtgtatgttttacaatgtgttttaagttactaaggataagtataaatgtaaaaatttacatgcaaatcatttttttagttgtttataaactgattgacataagtaaccagctcttggtcaaccaggtgtgcctgctaattactgtagtaactccgtatggacagcattgtcatgagtttaccctctgcacaaacgagaaaatcaatacggtcagaactgtgcattcatgtaactgtgcatccatctttatgagtaatcagctctgttaacatcagtgattagctccaagtcctatcactcacgcgatgtttacctgccattaaccatgttccgtacaatggtaagggcaagtttaattaatactccctccgtcccacaaaggtggtcgctttaccctgttgaaattgtcccaaaaagcttgatgcctaaactgcctcgttagaaaagtactcgtacaaataaaacgcactgaagtgggtccatctaataccatc

SEQ ID NO: 23546 - DNA, 3898 bp, Oryza sativa
  unsure (1)..(3898): unsure at all n locations
ttgttctggatacacaagatgggtacaacgacgaccagttctcctcagaccaggagcttgtgcccgagactgagttccaggattgtggggaagtggaggagaagggtggtaggattcaagactatggcgaagtggaggagaagggtggggtttcaagattgtagggaaacagaggagaatgtcggtgggattcaagattgtagggaagtggagaagggtggtgtgatcagtggcagcagcagcatggtgcactcacatcatggagggatatggcctactgcccggagatgcgggcaacagcttcgagacaagtgatttgatcgtaaatccggccacttattagaagaaggcaagaatataatctatacgcaagatgggtttgatttggatgagtacgagttttggcctgatttggatatgaaggcaacgacttgatagtttattggttcaatgattttgtgcgcaagaaaatggtgcaagttggtgttgcactgcaggggaagggaggcgatgaaattggcgagctgatgagctgcgatgtggctcttggcatgggacgagctaactcctccgttaccacggtgtcctctttgtgcgggttcttgttagtcttgatgtactaataggaatccgcacaaaggagcaaccgtagtggagaaagaggaacactatcaaggttcatagataaactatgagatctttcatgttctttaaagttttcctagctattagagcatgttggcaccaagaagatgcaagaagaacaatatttattcagcaagataatgctagaacgcttgtccgaatcgatgatgaacagtttggtgttgcagtagctcaaatgggtcttgctattcgtctcgtgaatcaacctccaaatttccctgatatgaattggcttctttggctcacttcagtccttaacatctactcgggtctctacaaacatggaggagctagcaaagagagaatgttcataaggaatacaatgactacgatccaaacactcttaatagggtgttcgtgggagtacaaagctgctatatggaggtaatgaaaactagtagagggaataagtacaagatccctcacatgaacaaagagaagctagaggcacttagcattcttcttaaagcgctttgttgtgatcatctgaaagatcaagttctctaattttgtgttaggaggagttttggtgattaataacaatggttgttggaactaacctttgctataagtttgtgatgacagattatgttctggcctcaagcaaaaaaagaaggttgatggctcaaatgtgagaatcaagtgataggattgtggattaatgacaaaaaggatgatacctcacatattgggaatcaacaagagtcaaatgttgatgatgagaatacttgatgacatcccatcatgaggtgatggacatgttgaataatatacaccatggttcaagattgttagaaataaagatggtgtgagaagctagaagatggattttaccgatggatgagaattgaagtcaagaagttgaagatgcgaggtatgaagtgactacctatggcaagacggtgaagcgcaagcgatgctcagctgcgatggaccatgcagtagtgaggacaagcaaggggcttgacgccgacgaaccgaaactggtggtgaagagcgagtgaagactttgtcgtgatggaccatgcgagaccatttgaagccatggattatccgcatcaaccttttgagaaatgaaagatgaaatgtcaaagatcaagaagatgagattttcccaatgatcaaatgaccttgacgttggtaaccctccaagtgaagaaagaaaatggtgtgatggtattcctgctggtataactttcctttttacatttgagtttaggatgtcgtactattaagagggataccacatgcatataataggtcaagtactagtgctcaaaatgtttcatctttgtgtgaattgaaaacgtcaaccaaaattctaactccgggttgtttcacatgtcacaacaattacatcagcttcctttacaatttttttcaacatctcttgaagattttggaccatgttttatgttggggttgatagcccataaaactagctttccataaatattatagaaattatttaaatcacggaagcattcacaatacattacattccagaaacaattttgcatgtacagttctatttaattacccatcaaatcttattcacaatgggcgtagagcctcgcgaaacgtttccaaatgaattatctatcacataatggaaatatactgtagtatacacgcccataaatttaccgtagccttatgtcccataaaatccatttattaataaacattgagaatatataccaatcttacttccttatagataaaattttattttaaaaaaattgacacatagggtgtaatgtagtcattatttatcatatcataaatttgaactaaaaataatatttgtatgaaataaaaaaaagaaaaatgtcaatagagtgtaaacgaacaaattgtagaaaatcttataatttattagaatcactgtggttcttaattttcccttaaattgaggcaaccatacataaccattgcatcatttttaagtgaccacatattaatagacttccctctattctatgccatagcagttgattgatggttttaaatattatattccttactattaaatttgagtttaaaaactcaggtcgactaaatgtatttaaaaaatatatatcacacatattataggaagtgaggtctagaatatatctactctatttttgttgattcatatgtaagtacatacaactaattgtgtcaaatgtgaactantaaaaaaaaggaataaaacacatttattgagcataaccttttgagatttgtaaaataagagcccacacattcaattaaaaagaaaacaacaccttactttgtaatttagactganaagacctatgtcttcttaaatgatgaagaagaaataatgtatagataggtgcttatatagattaattaaatatttcatattataaactaacaaatatcttaaaagaaatatttaagcaatgattcatgaatgcccgcgcgaacgcgtgggctacctcttctagttaaaataacacgtaactaatgaattgattaatgaggagaggtgctgactgattagcagaaagtaattatggttaccagttagtgtaaagacaaattcgagaaaggaagcatgcatgcggaacactcgatgagaggttggcagaggcggcttgctagagaccgaccatatcgattgggtggccgggtgtcatggagtggagccacgtgacaacacctgcttgcctttcgccagcaatgaatcccccagccatccttccatccagttcccaggctataaatcccagccacccttccatccattgccacatcgctcagagaaacacgcacacaagaaacacaggagtgagggagaagaagataagggaagagagagcgagagagagagagagaggggggtagcaaagcaacttagctagctttgctagccatggcgaggagctctccttgcctcgccgtcgctgtgctcctccttggagtggtggtggcggcgattggagcctttgctgatgaagaagcggcgagcggttggggactagggcatggcgcccgtttcctcagcaagcgaggccgtgctgcgtatgagaagtcgtcggaaccagaggcaaaacctgcgtcgcagcaagaaccgaagtcggattcttactcgcaggcaaagcctgggccaaaagatgagcccaagccggaaccagaggcaatgtctgcgtcgcaaccggagtccaagccggcaacttactcggagtctaaacccgaatcaaaggcagagcctgaatca

SEQ ID NO: 23547 - DNA, 5989 bp, Oryza sativa
cattagctattttgtgtcaagtctcctgaatgtgtaacacatctgatcaccgccatcgagtggtttgacaggcacatctcgggctgaagttaactggcaggctaaaggcccagcaattaccaaatttggttgttaacaggtctcatatatctttctctcgcagcgtcgaatgccttattatgtttgatggaagaattgatttattctattcatccttcaaatataataaggggttcggagtacttccgacacgaaccaattgtagaaaatcttataatttattagaatcattgtggttcttaattttccctcaaattgacacaaccatacataaccattgcatcatttttaagtgaccacatatcaatagacttccctctattctatgccatagcagtacatagatggttttaaatattatattccttactattaaatttgagttttaacactcgggtcgacaaaatgtatttaaaaaatatatatcacacatattataggatgcgaggtctagaatatatctactctatttttattgattgatatgtaagtacatacaacaaattgtgtcaaatgtgaactaattaaaaaaaggaataaaacacatttattagcaataacctttttgagatttgttaaaataagagcccaacacattcaattaaaaagaaaaacaacaccttactttttaatttagacttaaaagacctatgtcttcttaaatgatgaagaagattaactttatagataggtgcttatatagattaattaaatatttcatattataaactaacaaaatatcttaaaagaaatatttaagcaatgattcatgaatgcccgcgcgaatgtgcgggctaccttcctagttaaaataacatgtaactaatgaattgattaatgaggagaggtgctgattgattagcggaaagtaattacggttaccagttagtgtaaaggcagatttgagaaaggaagcatgcatgcaggatactcgatgagaggttggcagaggcggcttgctagagaccgaccatatcgattggctggcccggtgtcatggagtggagccacgtgacaacacctgcttgcatttcgccagcaatgaatcccccagccatccttcgctccagttcctaggctataaatcccagccacccttccatccattggcacatcgctcagagaaacacacacacaaggcacacaggattgagggagaagaagataaggagagagagagagagagggggagggagggaggggtagcaaagcaacttagctagctttgccagccatggcgaggagctctccttgccttgccgtcgctgtgctcctccttggagtggtggtggcggcgattggagcctttgctgatgaaggggcggcgagcggttggggactagggcatggcgcccgtttcctcagcaggcgaggccgtgctgcgtatgagaagtcgtcggagccagaggcaaagcctgcgtcgcagcaggagccgaagtcggattcttactcgcaggcaaagcctgggccaaaagatgagcccaagccggagccagaggcaatgtctgcgtcgcagccggagtcgaagccggcaacttactcggagtctaagcccgaatcaaaggcagagcctgaatcaaaaccagagccaaaggcagagtccacgccacaaccagaagcaaagtcagagcctaagtctgagccaaagccaaagtccgagctatacgcagaaccaaaatcagagcccaagtccgagccacagtcagaaccaaatcccgagactaaggcggagccaaagtctgaacccaagtctgaacctaaatcagagcctaccccacagactgaaccaaaggcagaatcgcaaccagaaccaaagacagagccaaagtctgagtcgaaggctgaaccgaagccagagcgaaagtcatactcaaagtcaaaaccagaaccagaatccaagccagaagcaaaaacagaaccacagccagagtctaagcccgagccaaaacccgagtcagccccaaagaaggaaacgccttcgtcggcctacccatgatggagatccatggagatcgagggcatcttgcttgctgcacgatttagctactgatgagattattttgctgagggtcggagcactaggaaatggccattggccatttctggaataaataagtgacgacctagctttattctttgctttatttccctcattctttcatgtttttttccggatgtgccactgcgccagctggtgtaattcacttatttcttatgtatctatatctatgccattttttttctaataatacatacatatatatatatatatatatatgtgcatttttttctgcccagtactacctttataattatccctcctgttgtttattctagattatattgtggctgcctaacaaagttccatcaggaaaagggtgtaacactgtaactatctaacactgaactatcaaaattgttcgtagttactattacattttcgattagtctttgtaaatacagtgctaatggcacggcttacttatatatgtaaaacaatcatcaagcgcaatccaatctgtacctggtttgatcgagtctgcaggttcacggttaacaagctcctgacctccattaattttagtaattttactatcttaaggcgacgacgagcggtaccgcaatttcgaatttaattacacttaattattttggtgtcttttaataaccgtaaaatttctccattggtaaacctatcgttggaactgatccgcactatattggttaattaatacaagttcctactcccttcttctgacgccgttgacttttttaaacttgttttaccattcgtcttatttgaaaaatttaaataaatattaatgctttccatatcatttgattcattattaaatatacttttacatatacatatagttttacatatttcacaacagtttttcaatgagatgaacagtcaaacatatttaaaaaatcaacggcgtcaaatatttagagacagagggggtacttcctcgaaaaattttatcagctggtgagaacaaatattatttgtcagtattataacaacatttggcttccctgatctaataatagctactacctttcctaaaaatatattaaacgaacctatgtgctatcagatcgtgtccaatatgaattcaggaaactaaatttctacataaattattttcacaaattccttaaaaaattaccagtctctgattgggttgagctacgacttatttgatgtgaataacgaaaaaaatattatgggtaaacttttatctgtattattcatggttttagaagccaatattaattagaaaatggactacaatagaaaaaaacccttaaaagccattgagcaaacaacgagaatgcgagttccaaaagacacctgtaggccttgagccttatcatttttggcatacaacaaaaatgagttattgctaaaatttaaattttaaaacataattttaaagctaattttagagtatatttaacgttgtttcttttttcatttagttttaagttgctaagcataagtatacatgtaaaattttacatgcaaattatttttttagtcgtttataaactaattgacatatataagcagctcttggtcaaccaggtgtgcgtgcttattactgtagtaactccgtatcagtatcctgtatcctccaagcgttacattatcctctctcttgttttctcctcttccccatcatgttctgttcttcctccatgaagcttctcccacctaacaccacgccacaccaacccccatccagttccccacaagcaagccacatccagcgtgcgacaacatgtccaacggcggtggcggaaaccctctgggcgctggtgacgaaaaccctaggggcggcggtggtgaaaacactatgggtaccagtggcggaaaccctaggggctacggtggcagaggccctaggggttgcagtggtgaaagccctagaggctacagcaacagcaagcctacggggacggtggagggttgggttgcggcgcggtgatgacggcgaaggagggttgggttgtggcagcggcgataacaacgaaggcagtggagggttgggttctggtggcggcagcttaggcaagtgggtggcttgtggcggtgatgacggcggtgggtttgcaaagtgcctcctagatgcagtaagcaacaccgttgagacaagtagtactcgcgaccacttattggaagaaggcaagaattttgttttgaatacacaagatgggtacgacgacgaccagttctcctcggactaggagtttgtgcccaagactgagttccaggaatgtgggggagtggaggagaagggtgataggattcaagactgtggaaaagtggaggagaagggtggtgggattcatgattgtgaggggagaatgtcggtgagattcaagattgtagggaagtggagaagggtggtgtgatatgtggcaacagtagcatggtgcactcacatcatggggggatatggcctcctagccggaggtgcgggcaatagctttgaggcaagtggtttgatcataaatctggccactttttagaagaaggcaataatgtaatctatacacaggatgggtttgatttggatgagtacgagttctggtctgatttggatgatgaaggcgacgacttgatagttgattgcttcaatgattttgtgccctagaaaatggtgcactatggtgttgtacttgttggaaatttggtcatatttcggcatattttaatccaaaatgacaagataataaacatgacatttacaatggaatttgatccaatgatagttgtgaatgtaatcaacatgagcatgcttaacgtagaataagcatcaacaatcacataataacgcaatgttgacattgcgatgaacagtaaaacttctaattgaaataatgtaagaaggttagaccccaagaatggtcctccgctagagtttgaggcagtattgcctccgttggtgttgacgggaacctccttctccttgtctccagtgttgccgttgtctccagtgttcgacatattggtgaagacgaagtagacgttgactaacagtgagtgcgccttgcgctcccaagaaacctgatcgcccgcccgtccgtgcaaacgtcgcagcagtgcgtggtttcggaggcctattctcccaatgcgtgtgcacacactcgtcaggatgggattatcgtagcagcaatagccttggaaatggatgaaagtgtctcacttctacttaggcagatcaaatccattctcattttatatgaggaatggaagatgaagagtaagagtcatggaataagaagaaaaatagagtaactaattctcatcaattagccatgaaccatcctccactacacaaccatcaaccaaccatcaattaggagtaattgatgtaggttaccaatggaataggaagaggaatagagcaactaattgtcatcaactggccatgaaccatcctccactacacaaccatcaaccatgcatcaattaggagtaattgatataagttaccaattccctaatcaaatggattaattctcaaaactcctcatcccattgatatctcataagagaatgaatacacatgaattcctagcgtaatgagccttggaatttatttgatttaattgatttaaatggatcaattacccaattaaatctaacagtactactagggaagggaggcaatgaaattggcgagctgatgagctgcgatgtggctcttggcatgggacaagctaactcgaccgttaccaaggtgtcctcttcgtcagatgcttctttgtgcgggttcttgttagtcttcatgtactaataggaatccgcacaaaggagcagctgtaatggagaaagaggaatactattaaggttggtagagaaactatgagatctttcatgatctctaaagttcttccagctattagaccatgt

SEQ ID NO: 23548 - DNA, 17306 bp, Oryza sativa
  unsure (1)..(17306): unsure at all n locations
atatactagctaataccctctatccgatgccctcctggtacttcgagaagccacccctgactgtcgagttccttacgacagcctgtcatgaccatacaaccggtgctaaatacggaggaataccctccctagggaattaacttaggattatataccggcgcggaggaatacccgtactaagttgtcaccatcagcggcccacctcttatccgcaatatataactccaaatatagatatctcgtaatctagacaccacatctaaactaccagatactactctaatatcatcgtcatgacatagagtaattgcataagcaaacactatacccgtactaaagcatctcccagataagctagccgtatattcagtataacatgaacataatgtaaagtagttactcatatactcggaaagtatttcaataccataaatgtatttagaagagtattctaataaaagtacaaagcttacaaaagagaagagaaaagttactagagccatacccgaactcttccgaaggcttccggactcctgatttctactctattcctattccaccagctagatactactaaactaaacttgagagaaatgagagagctattgcttgatgtgtgtgtgtgaagtgagaaaaggaactccttttatagcttaactatgatggttgtgacggttggagtggtctgtaataccctccaaccgtcattggggcttcgtctcaaccgtccagccaagacctggatacaacggaggcgagggaggtcggccgaaccccctggttcggccaaacatagggccagcccaaccaacccatggtttggctggcggcctcctctgttgttctactccgaagacttgtgaattttggcccagtttgtcgtgtcaattcttagttcttggcccattcatacataagtctggttctcgacatcgtccgattgatttattgtctgagttgatgtcgattctcctccactttattgttattctcttcaaaaggttagtagacctaatactagtggaatattattattctaacatatttatgcattgcaagcatcaatagttctcctttattttggtaatattgacggtcaaaactgatcgataatgaccgtcaacaatattcgtctcgtgaatcaacctccaaattcccgatatgaatagtttaaaccttggcttcttcgcctcacttcagtccttaacatctactagggtctctacaaacatcaaggagctaagagagaatattcacaaggaatataatgactacaatccaaacactcttaatagagtgtttgtgacactacgaagctgctacatggacgtaatgaagactagtggagggaataagtagaagatccctcacatgaacaaagagaagctagaggcatgtagcattcttcctaaagcactttgttgtgatcatcaactctatgagagagccatacagcttatagttgactaattgtgcacttgtgtcatctgtgtgtctatgtaattgtggaaactaaatatataagttgtttggttgtattaatgtttcatccaaggttatattaacaagttgactattcatatgcacaatcacaaaaaaaagaattagtacaaattaagagatgcatggaatttcattaaaatgttttcataactatagtgctaaaagatgccaccaaaacagaaccacatgacgtataacatcataggatgaactatgcagctcattcattatgagttcatactttggactaataacaagttgtaggtagatcgcacataattcatgtcacataatcagcacactacttttttttggatggaaacactaggtgtaacctgggattagtagacaaagcatttccaacttgatgtcatcaatgggctcgtattcttcctcctatgaataaccccaaaggtctataccaccaaactgatcaccacctttttctttgtctctacgcatctcctcgccatgtatctcctcctcgttgggcatgaattggatagacacctcctcaacatatataaaaacaaactaaaactgaaagtaacaacaataaaatagcagtgggcagtacactctatgtccagtgcttgcacaacatcatttatttattacagttgatttttctctagcgtaacctggacatattcaagtttaaatgacccaaattttcatatcaacaattacatcagtctgaacgggttttctaatgtcaactttgtttttaccagcaccatgctgctcaatttaaatgaaatttttatttggctagataggtggttttgcttcattaactgtaggaaaaaatagaatcattagtgcttacttatattggggtggttatcttttgctttgtagcttaattaggtttgaacccataaccatatcttaaccttgaactagacacacagcattggcacatactgccaactggtatagtggtgtgggccattatggatcattgtaaatttcacagaaaggataagcaaaacatacttaaatgatgcgtctgtgaatgtcatttctaattaagcctcatgaaagaacaaaaagtgatacgattatctatggaaatctattataagaacataatgttacacttttgcatttatagtttaaattcaatattttcaaggacagtagatcttttaatatttgaaccttatagtttatttagaggggtatttctgacttgggacatggaagaatagaagcagcattctaaggtctttagatttttcccatttttcagtcaactaaatctctaattgattaactatcttaggccctgttcgtttcttctacgagcagaggataaaattttggatactcgtggtatgcttttcaaactgctaaacggtgtgtttcgtgtgaaaatctatagaaagtctctaaaatatcggattaatccaattttcaagtttgtaataattaaaacttaactaatcgcacgttattaccacctcgtttaccacctcgttttgcatgaaacacttaatctttatcttcatcttcatattcaggagattcaaacaccactttaatatgttcaaaaactagcattttataatccactacagcccaattttcaagtcaaaacttcatgattaaaagcatgcaccttgctttgctcgttgatatggaggactccaccctgatgtgcttgcttagtccagcaccgtgattggccattgtccctcgccgcaggtcacctctatgtgggtaagaagcatccaatgaagaggacgccttggtaatggtggagttggctcatcccataccaagagccacatcatagctcatcagctcgcaattttcaccgcctccctacccgtgcagtgcaaaaccatcgtgcaccattttcatgggcacaaaatcatcgaaccaatcaactatcaagtcaccgctttcatcatccaaatcaggctagaactcatactcatccaaatcaggcctatcctggatatccaagattatattcttgccttcttatactaagtgatcagatttacaatcaaaccacttgactcgaagctgctgcccacacctctgggtagcaggccatatccttccaagatgtgagtgcaccatgttgctgccgccacagatcacactacccttctcctccatttccctacaatcctgaatcccactaacattctcctccgtttccccacattcttgaattccaccacccttctccgccactttgccatagtcttaattctatcacccttctcctccacttccacacaatcctagaactcagtctcgggcacaaactcctggtccagggagaaccggtggtcgtcgacttcattattggaatcgggggtgaacttgaactggtcatcgtcagacccatcttatatatccagaacaaaattcttgccttcttccaataagtggtcgtatctacgcgatttccatatgcctcaacaacattgcttattgcgcatctaggaggcactttgcaacctgccgccatcgacatcgtcacaacccaaccttttgtgtatgtcaccgctaccaaaacccaacccttccccaccatcgtggccgctgctgccaccacatcccaatccaacgtcgtcgtgttcgccgcgaccgcaacccaaccctccgccacacccctaggcttgttgccactgtagcccctagggcctctgttcccgctgccctagggtttatgccgccgtcgcccctagggtttccgtcgccgccgcccatagggtttccactaccaccgctggacatgttgtcgcacgctggatgtggcttgcttgtggggaactggatgggggttggtgcggcatggtgatgggagggagaagtgatgcactgctacagaaaacattttcctggacgctgggcctgtttgtttccagatgggccgtaagtggcgccgtctggaaaaatcggacgactggcatcggactgtcgcccgcacgggaaaatagattatcccgtgcgggcgtcttaacccgaccgcaccggaaaatcctcattatcctgtgcggtcgacttaagtggaccgcactggaaaatacctctctctcttttccctctcacccatttcaaacttcacacactctctctttatttttcctttttattctctctctctgcctttactcctccccatccctctctctctgcctttactcgactcccctccccccctccctccccaccgagcggcgcggcggtgcggctgcggcggcggcggcgaagtgacagcgcgccgcctgagtggtggaccgcggagctcgcggccctctcgctggcatcctgaatgtcgacaccgtgcgccgcatcatcaccgccttcgtggagcgagactcggcatcttcgggcggcgcgaacggctggagccgaggcactacaaggcggtggtggcgcgatgcagacaatggcgaagaccatggacgaggtcgcggcagagatcgcgacggaggcagcaagtagcagcatgcatgcatgagcaaatgaagctacgcccaggaaatgcagtagcagcatgcatgcatgagcggctgcggcggggagcggcggctatgcgacgacagcgatgacgacgagagcggcggcgtgacgacggcgatgacgaccgtggcgcgacgacggcgacgacgacggcgactgctggcagaggcagagcggcggcggggggacaagcggctgcgcaaccaccatgcggatcggaatcgggatcgggatacggcggctgcgggatcgggatattttttgtttttttgggttttttttcttttgtttccgtgcggttggtataatttgaccgcacgggataatcgattgttccgtgcgattacgtcgcccgcacgcgaaaatgttgattttcgcagacacctgggtgtagacgggcgctacttctgtatagaaaaatagatttggaccgcacagaaaaatgaatcttgtagtagtacgcgatgggagaagagaaaatgagagaggataaggtagcgcttgggtggaaaattcgtatggagcagaaacattcgacggtgctagatggacccaatgtgtgttcttatttttacgagttcttttgctgatgggggagttcagagcgtgtcttcagggtaaagcgaccacgagggagagagtatgaaacttctctgacaacatctcgtgtacgataagctcctctgttgacgagtgacagatacccccttcgtttcacaatgtaagtcattctaacattttctacatttatatagttgttaatgaatgtagacgtttagattcattaccaactatatgaatgtgagaaatgctagaatgacttacattgtgaaacggaggaagtaccattaatcccggctggaaatcaagagagcatttgtgcaactgggcataggtacgcctaacttaaattcccaaatcttgagttgcagagttgagagcgatcgatgggatcaaatttggttgcagttagcagccgtaattaggcagccaatgcgatggtacaacaaggggaggccctaatgggcgatcaagcgatcatatccgcccccctcccctatactcgatacattcctccctcatctcccccctttctcctccccttattctcttcctactacagtacatcacaaaaaaaatttaaaaaaaataaaaaagttaaaaaatttatgtatagaaatactatatataaaaaatttgaattcaaattcaaatttgaatcgggtatgtaaacttttgacttataaactttgggtctataaagtttaggtgtataaactttagatgtatagaaatactatatatagaaaatatttgaatttaaattcaaatttgaatcggatataattcaaatttaaatttgaatcgggtatgtaaacttttgacttataaactttaggtctataaactttaggtgtataaactttagatgcataaaaatactatatatagaaaatatttgaattcaaattcaaatttgaatcagatataattcaaattctaatttgaattgggtatgtaaacttttgacttataaactttgggtctataaactttagatataaactttagatgtatagaaatactatatataaaaaatattgaattcaaattcaaatttgaatcggatatataaacttttggtctctaactttagatgtgtaactttgggtctctagatgtgtaaatttgaggtgtataaactttaggtgcataaatttactaaaataggaaagtaatgcggtgccaaaaaaaaaggaaaccagtggagagagggaggggggaggggaattgatcgctacccccatcctaggcgatcgatcgccgattaggatttccgacaacaaggtcgatcactacagtttagtcctacctgcagcggatttaatttggaaactactctatcctaatttaatcatccactaaatagaaaacaccaaaatatccatattattgcaaaattaatcatcatcgatcaatgtcctatatccaacagaaattaattcgcactttaaatgttgcatgggttaaaccaacataaattaatcttgattggctacatacatgcagaacattccatgatgaacatttactctctgcacaaataaagaaaaagatattttgtcagatgatattcattttgagaaaacctagataatgatcaaactaggatagatggtgtttttgtactgatgaaactattgatagataagtaactccacttgtccatgacagaactcgcacagtatagacggcatgcatgtagtctcgtagactcgtatacatgcaattgcaagcggacgacactagtatacatctcattcctttttaagcaatatatacttccttcttttctgtatttaacgttgttgactttttttttttgcttgcattgaactattaatcttatttaaacttctttcaaatatatatatatatatatacatatatatatatatatatatatatatatatatatatatatcatgtttaaagggcatgtaatgataatataaatcacaacaatgtaaatgataattatataattaattatgctataagacgaatgatcaaactcatataaaaaataagtggcatcaaacatttaaacataaaccgagggaatacaatatatacatctcagtgtgtttcttgagtgttctcagtggtctctatagtaccagtcacgggtggagaagtggtttactctcctaaaggtctctatagtaccagtcactggtggagaagtggtttacactcttaaagatagatatttttagtctcggttaaaataatcgggactaaagatgatctttcaccaaccgtaactaaagatggtaatgccaggtatctttaaggtgttaccaaccgggactagagttttttttcttttttttcattgttttttttgcttcttgcatctattggtttttgctcccaaattctcaaatctaattgaaatccccaaagtcccaaatcaaattaacatcacagatctaattgacattacagatccaattcataacatcctcaacaacaaaattattcacaaaaacataacaaaaatatacaatggagagggattcacaaaaacatcacgaaaaaaatctgccgccatcaatacctccgcagcccgcctcgtgcatcgcccgctgcccacatcgcccgccgccgcctaatgcctcccctcccatcacatccagtggaggagagggctctgccgctgcctcctctcccacaacggtcgtcgttgcctgccgcccccctcgtgcctcatgggcgcccgccgcccacatcgcccaccgccgcttgacggggctctgccgccgcctcccctcccacaacggtcaccgccgcctgccgcctcccctcctgctagatccggcggaggggacgccggatccgacggagggggcgcccgccacatcccctcccacaacagccgctgccgcccgccaccgccttgtgcgccgcagctgccacctccgagccgccgggccaccgccaactccgagcctcccatcgccgtcgccgggcgcgggggagggagaggcctcgagagatagagctgagagagggagagagagagagagagagagctgtgagaggaaagaaagtgcggtggaaggagagggagcgagagaaaatattgacgcatttggcgagagagagttcgggaatattatagacgcgcagttgatttttttagtcccagttgaacttaccaaccgggaggggtcctgacaccgcctgtcatgttttaaccaggactaaaatgatctttactcccggttgatgttaaaaaagtaccaccggcttttggaccgggactaatgatattctttagtctcaattccttattaaactgggactattatagattttggccaacccaccaaagatggtttctctagtagtgagtaaacattataacaacaagcagtttattgtcttttagaattttaattcaatggatacttagtttttttttttactcacatatcgcccgaccaaaaaatttgataatttagctttttttttctttgcccaattactttaattgacacttgtgaggataagatttgggaacatctgagtgaatgaaagtggatgatatcgaataattgaaaaggagtgttaaattatcaaatctctctccgccgaccagtcagtcaccaccccttcaaccgctgcagtccttctctcccatcttctcccttctgaccaacagcgaggttcatgaattgcagtatatgtcagccaccaattttctgtacccgcaatcgccacgcccaattcgttccaccatcgccgtacgttgtcatcatctctccgctgctgccgatctgctcatccccatcattaactgctgtcattgccttccccaatcgtccctttaaccaccgcccttgtctctcgtcgctcttgatcatctcctgctatatcccctgttcattctcactaccatcatatgatcctctggtcacctcttctttgatccttcttcccacaactgcagggagcatcaagaagaagactctacgctccgaagcgaaatctttcctaagtctgctccttggtttcctgattaagaacggacaacgccgccaacgtctcgagaaatttaggattataccatcacaaaaagaatgatttcactggaatatcattgcttcaaacgggttcgctacaatgccatcctaaactgtggtatgcgttctttttgttaatataaatgtttttgctttattttattttttttctccggaaccaaaatacccctgcctctatctctttctcccaggatatcgcacccgtcgccttccaagagccacgaccgccgtcgttgaccctccttctgtgtcggctccagggccagcgccggtgccgacccacacaaacaaatccagtgagtgccaaatgggcactgagttcagttatagataaatgggagaagctaacttgggggcaccactacttctttgccgtttagtccatggatgttggtactggtcatcgctgtttgggttgagcgggcggcggtggcgcgaatggagtgaaggatggcggcggtgcgggaggagggagaggaggtggagaaggtaggggagggaaggcaccggcgcctacaaggaggaaggggaaatggcggtcgcagcttgaggaagaatggggcggcggcacaaatttagtgagggacgttggaggcgcggggaggagggaggaaaagcgacggtgcgatatccagggagaaagagataggggtgttttggtcttagaaaaaaaataaaattgagcaaaaacatttctgtcaaccaaagagaacgaaaatggcattttggtgaacacctctcagtttaaaatggcattgtagcaaacccgtttgaagtgatggtatttcaacgaaaccactcttttttacaatctccggttgtctatggtacgctgtttaattaagaaggaaggaagctcgttccaaaaggttaaattgtagggttatgaaaatatagtagttctcatcttactatatggtgtccgaaagagacattacatttttttctaccatatattaccaatatatagtcacctcattaatcgaaattgaaggacaggaagaaaaacctttggttttcgcatatgaaccatatatagccttgccctctatttaatgtaataaactatatatgaaccagtggtggacacaactttaaaataaagatgtgacggagaacgaagatgttcactcgataagaacaatcaaacacaacgcatatcgtatttatagtttaatcgcataactgcctcgatcattgcttgcggcatgattgcgttgtgaagagacgaactaatctgttaggcgttacctaattttgatgatccatgactactataagggggtagggtaatcttggaggtgtggagcgacacgggtcgtagctggatcaatcgacccaccctgtataatgggtacgtagatccgccctgtatatatcattggcaaatgaaatctctcaacttcattttaggatgatggcattttgcgaaattcatctcttcggtgagatggcacgatcaatcatatgtactttttcagaactaaaaggtcaggtgtagttcactttaggtagctactcctacctagtatatgtaagttacacagaaagcagaaaaggttctatcctgaaacgcgtgtttgaaattaatttgagacactacagttcgatctaacccccatccaatttaactcttgttcgttcgctatcaaacacagacgaggcacgagagaattgaaatacacacctgctgctgctcattagtccaagtcgatgatcatatatgtctctaacgtctaaagtgcatcctcgatctgcacacggcatctacaaattttttttttcttagggcctgtttggcacagctccagctatacctcttctggagttgctccaccaaaaatagaagtagagctggatggagctctcttacaaaataaactagagaggtggagctgagtttagccagctccacaacctactccaaacccaactcctaaaggtaaatttaggagttggagctcaaccaaacatgtcttaattaatttgtcgatccttctcatctttttcacctaacaagaccgaccgccttaatttttctcgtctagaatcagatgcgatatttgacatatcccgtcatgctagctaaataacctggaggaccccatgattgttgggacgcgtacataatggcgtgtaacatcacttagcctattcggtttggaggagcttcacaggaattctgaagaaattgaactgtattatatgaaaatcctataaaatttctattttctgaaggagcccttatgttatatatactctttttagcttgtcgatcggacatccaacttcatacaacagtttcgaatgcatcgatctgttttatctttaccttttgtaattatgtatttatacaaaataatatactgaattaaatttcaattatcagaataataataaatttttatagtggttattgaaaaataaagttatatattttttcagtaatataagatttatttactgaagttattgaaaaaaaatatttttataatggttgttcaaacaagaggaagaaactatatttttcaatgattggccaaaacccaaaagtaaaggaagatgagatgagagagggcaaggaggaagaagagaaagggactgacagtgagccctcaacaagggtatttcactgtcatttctattttttctaaaagacttacatatgggtttacttttctctttttttttctgactgtagcccatttaatcaccatgtaggcacctcgtcaaatgaagatttgctaattaatgtcccacgcatgacaaaaccgcatcaagcttgaagagcaagatgaatcggttttgagggaggtaacataactttttctccttaatgaaaatattataataaggtttgaaatagggaagaataaaacaagcccgttaatgtggcctatgagcccaacaaacagtcaaatgcttacaagacaaaggaataagttcactttgactccctcaaatataactccaatctaattcaacaccccccccccaactattaaaaccaatacaatttgactcccttagtgattttggagggcgctttcactcgtggcgctttgaattggtccaacctactgagtcatcttatggggcccacccatcactgacccttatctttcttctcttccttctcttttctctcgtaactttcctctccggtggaaacaacagggcacgacggtgatgaggggaagccgtcgtcatgcacatcgctacatgagcttgaacagagacggtggtcaacaacagtggcaacgcgacgacggcctcccctctcaccgacgctagcaagcaggcatgcaaaggtgtcgcgccatgctagtcttctcttctcttctccagttcagcgggcaagcaaccctaaggagggaggcaaagatggcgtgcgtttcacatcccaggaagcgtattgctccctccaaatccaagaccacatcagagaacacctaccagccaccttcgccgctgccgctgcctgagacggagcatgaatatcgatcgccatgtccccgtctacaccgacagcaccttcgatctcttccactttggccacgcccacaccttcgagcaggccaagatgcagtccatcattttatcctcttctcttcctctacctctcttagacagatcaatactacataagtggatccataacttagagtgatccctaaattcgctcgattgtattcaatcgcgggcaccatggatgagcttggcaaaatcggccacgatgggcggcagcagaggggaggtggaggcggtggcgggaaggagggatgagcggcgcgaggaggtagtgcacgatgagacggagtagggtggccgtcggggttgcgacggcaacgtcgctggaggagcaggtctggcagctttccccatgcgcagttgagggtggcagcggaagggaggcgaaggcggtggcgggagggacggcggtgcaacgatggccttccctctcaccaccgccaccatccttactcgtgctccctcctaggggtgggcagaaaaataccaaaccgaaaagactgagaccgagaccgagaaattcggtcctaggcagttaaaggccgaattttgttcggtcaattcggttagtttcctcgggtaaccgaatagaccgaaaagaccgaattaacaaaaaaatgtctaaatgcaacctacaatccactaagttcaataggattaaactctaatgttcacatccctacttcttataggaatgcaacctaataagagtctttactcataattacttatgaattttttttgtgatttttgtattgaaatttccattatttctttgcatatatgaaaatgttgctgaatttcagtcaggaccgagactgaatttatcagtcctgatatttttgtgttgaaattcggtcttcacttttcaaagcccgaaaagaccgaagaccgagaccgaaattttcggtcagaccgaatatccacccctactccctcctccacgacggaggtgagcggaaggggaatgagggggcggcgtcacgatgatggcctcctctcgtcactatcgcgccctgcttcttccgtcggagacgaaagcgagtagaggaaagggaagacagagaagaaagataagggtcactggtaggtgggccccacaggaggactcatcaagttgaaccagtcaaagcaccgtatcagtgaaaccgacctccaaaaccgctgataaagtcaaattatactggttttaatagtttttagggtcaagatatccggtattacggtttagagatataaactaggttggaactatatttgagagagtcaaagtggactcattccgtagagaaaataaggcaggaaactcagtgggccgagagtcatatgggcttgcctccaggtgacaaataaacggaggacaagcaatgaagcaatggttgggagaaaggatgggaaaagcaacgggaggaaatgaaggacatttttttttgttaatttcaaccatactaaaattttgatgatataaaatttagcgaggtaataaactaacatagccttatcgataccatcctatcaaattttaatattttccgaagttttctctcacaaaaactccactaatatttggcaaagcttcaaaccaaacaattcaatgcttccaaaaattggtaatatcaaaatgtgctaaaattacgtagaatttgaccacgaaataaacaagctcaaaatcttgagtcaagtgtagatttctatgctgggcatggatgtactggtgctaaacattgttgcattgctacttaaccagatataaatagtggtaatggttttgagctttctataggctctatggccctttctctatgctagaattttggctcatgtgaattttatattctcatcaccaccagagtaattggcccaggccccaggaggttcttttctttggacatgctataacatatattttaaagagtaaattacacttatggtacaacaacttaatctgtgagcgcattccgatgcaacaacttaaaaattaaatatattggttcaatggcaagatcggtgcatctttgatccaaagggctccacataggaatattttccacgtcactcatccatctcagtaattttgcaaaagcgcctctctcttgttcacattttgtttcttttctcccaacaaatcagtcagcttgaggagttgaggtcgagggtgaggcaaagtggttgcctgcctgacgaatcatcaacgaagtgaggggcgagggagacttggcagtggccggcggaagtgtggctccaactagcaatgtcggcgtggtcaacatacgggtggtaataagccccaatattttagcctacaaaatgtgagggctaggcccaaaacaattggtctaagatttaatagatattttagctaaaactattttaagggctgagattagttatgaaagggcccaggctccctatcccattatcacccctagggcaacgtagtggtgttgcatggagcctacaagcggtcaggaggcgcatgggtggggactagcaggaggccggtggggaggtgccaagtagatagaagcgaccaggtcgctgcgtgcggcatgcctcggtgcctgctttgccaagctagagtccggactatcggagccgaggagctgatcgagtaggcaagctctgaatcttcttttgatttgtgaagtacacattggcccattgggcatgcttacaatataccagaactttacaatttcaattacgcttttagtcggtggcaggtctgtttaagggacaagtggatccttcttatctctcttcctctctctcagcaaacctttccgcttggtccagatgacctcatgttttagctagttggaggcattggtgggcggttcagtggtggcttcatgtctaggcttggcggcatcagatcctgcttagcggcggtcgatgcggtgctaggtctttggtttgtgcaggtattgctggtgtttgatagtggttctgttattttccctgattgtagcctttcaagactgcagtcttgtaattttttcctgctatatcgatttgaaacatcgcacttttttgtgatgttcgtttaaaaaattactctatttggatgattgagattcgcttgtttgtcagatctgaattacagtcagtactaacacacatgatattaatctagaacattacgtgtaaactactgaatttcacctaataatttttttttaagaattagtgttgtttgcctgcagggatcttatatagtgaaagcagcaggttttcttgcacgagaacgtgccttcagaaataaggaaaactagccaaatcctccaaggcatgttcccaagaaaattgacgtccgatatggtgccttctcaaaccaatttcttagattattcttcagataattaatcgaagaaagactctaacactaaccctaacagtgaacaatttatcatctaattaaaataatggaaaagatggtgttcgcgaaaaataaaataatagaaaatagttgaggcattcacaagtaatccttgccttgtgctgtggcctgagactggcacagtggcaggggcgttggtgtctcgcgacgagagggtcgagccaaagtagagatgcggggggccggagacgctgaatccaccggcggcgatggccagatgcgtaagtgcagaggctgccaactgccaagtatcagaggtcgcggacgacagacaaggagacgccgccaatggcagcggacgcgcgttggcgcacggcggctgaggggcagggcctccgtcgccgtcgcggtattgcccgccaccaaaaggacctacggttccctcttaatcggatctgatcggagacccctgctctaaaaaggaggaaacaaaaaaaaatcgacacacctgcagtatattgagtaacttaactttccaacaagttcctcttctagatcacttggttaagctggtaatgttgtgtgcgttaggttgagagctcgagtcctgttttttttgcattgttattttttctcttttaccccatctataaaatatcttataattcctccttttatactacgttgcttttattttttaaagaatatattatattcttccatagaaatgagacatccataagacgtctcaacatnnnnnnnnnnnnnnnnnnnnnnnnnnnnnnnnnnnnnnnnnnnnnnnnnnnnnnnnnnnnnnnnnnnnnnnnnnn

SEQ ID NO: 23549 - DNA, 592 bp, Oryza sativa
ttttccctctctcacccaaataactgccatgtggtccagggctgcttggtgggaccttattgtcagcctcacaactttttcacacgggccacgggctgaacactcacccaacgcgcgtgagcatggacgccggcaacgtgcgctcctcctcctttcctatgccggcgacaccatatattacccgaccaccggaccatcactctctctctctctcgcccttgtctactctcaacaccctctctaacaccaccaagaacgcctcatttggtgcagccaatctctgggaacgcgaccgcatcaacttgggacgccgccgcgctttggacaccgccgcatcaccattgttcgttgccgggctaccacggttcgcgacaagctgaaccacttcgccacgagcttcatcaacctccattgatcactactacgaaaaccatttttcgtggcggccattttaggttattgctggcggaaataagagccgcacaaagcaaaggccagtgaagatcaagatcttcgctggcggttatcgaccgttagcgacaatgaattataactggcggtcgtcattagccaaccgccagcaaagatccat

SEQ ID NO: 23550 - DNA, 506 bp, Oryza sativa
cctttccgaacactactttaagatctttaaccatagcaaacactgttttcccgctgcgatgtttaggcttcgtacggtggtccgccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacacttccttcttcccaactgtttaaggaatccctttttttttttccccccggacaaaccccccccaaaagggctttggtcttaggtacacgttgatgtcgttaccaggttgctaggggccttgaataataatcagcatcattatgtacttcctcttcatgcatagcc

SEQ ID NO: 23551 - DNA, 489 bp, Oryza sativa
ggcgccgcgcgcgcgcctttgtgcacgggcggcggtggagcagccagcgacacagtcacactagctgccgtgctgttgccgactcgccgccatgctcccattaattaggatggcgcgcgttggtgagctcgccaacgcaaagactcacaattaattatcgacatgatagtatcgctttttcttttgttcgtctgctcctgcacgcagggtccgggtggatgttttacttcgtggtcatcgtgcagacggccatcaacaccggcgttagcatcggcaccatcctgctcgccgccgattgcctcgaggtgcaaatcgttgcttcccataaccccctgaactctctgtctgatatgcatataagtttaagctcatactattgccaaatgctgttgtctatgattggtttattgttcggaacaaagttttcatctcgtctgtgtttggacaagctgtagtatatccaacaaattgggaatgcctggacatagt

SEQ ID NO: 23552 - DNA, 617 bp, Oryza sativa
atagccgagccctcggttatgggcaagccgagcaatgtacccaagttagtgttttaattcttaaaacttgctcaacaactaaaatgtggaatggttggcctgggttggcttgggacgagctgggacccagggtcgggttgccagttcggtctgaatcatcataggccttgggttaaggcaggttcgtgtgggttcacggccttgattaataacattgtgtaactctaggatcgtccttataaaatggctttgggcaactaagtgacttttaaatgctgtttactgcaaaacttaacccctatattattaccccttgtacccccttgcattaatcatgcatctgccggtgtggcttgctgagtactgtggttgtactcattcttgctcaatctttcccctcttcagtaagagaagcgttggagaagatgtcttaagtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgttgtatggtgtaccccggcttttcctgg

SEQ ID NO: 23553 - DNA, 645 bp, Oryza sativa
ggaaagaaatgtgtccctgcaatcaaagacgacctatatagtttagagtgtggagtgatataaagcaacagtatttattacacatgttacgtgcgcttaccccacgcttaacaaattcaccatctagaccaacagaagcgcgtagcaaatgaatgcacaagatctggaagaggatactaaatcaggtttagcaacatattgtacgacataattccacttatgttacaaaaaggtactttggttgtacctttgggaaatgagtgatagccagctgctttgttgcctgagaagatatcgaacatgtcatttcctccggggtaaatatatgcctgcaactgcaagtgccatagtcgacacaggtgtgtagtttgttaattttttcctgccaaagataacaatacagggtatcatatcaagcttagttaaacaactaagatacatcaaaagataaaactactacctcatcaacttcggatttaagagacaaatatttggcagcaacattgtgccaacaatgatcacaacgatagttgtcaagatgctccaacgccgtaaagtgctcactgcaatccaccaaactacatccattgatctaaatgtcacacgataagagaaacataagggaaacaagcattatgaatagcg

SEQ ID NO: 23554 - DNA, 4775 bp, Oryza sativa
atttggtaaaagatagagaagaggacacattaatcgtcacaacatacgagattaggagcatagttaacagctacaaaaataggggcataggtatctaccacagatgaacaatttctgcaagataatatgctgccaatagtcccatcaaagggaccaaataggttttgtttccatcgcttgcattcaggctggttaccttccctttgactatatactttggaaggaaacatggtgatgtctgccagagaactcctatttggtacataacaacgggaaaattcatccctcagtgaggtcaaaagatgatgaaaggcttccgaagcatcctatgagggttaaatagttctcatcatttaaggacatataatataaaagtaaaatttaaagagaagaaatatacaggattaaacatcatgcctgctctcttgtcaaattaaagtggccgacgtagaagctcaaagcatccattactctgtgtggactcagttcagtccttttgtctcgaactacgctcaagtctacaacatttaagtaaagttcataaactagtaaaagaaattttatgagtaaccaactaaatgaagttttacaagtatagaacttgaaactgggagcatcacaagttatattctttttaagaaaaataaaacaacagttaaaaagacatgctttttctttcatattgaaggaagaaaccgtgatgtgtgaagtggagcaagaacatcaaactgtgagctgcaagcaattcattttaccaaccaatgcaatgacatgatatgatgttcagcaatttatgtaaatagattcataaatgtcaacactgcatcagagtatacctgtaaaaacgaaccgtgtttacagtattacagtatgtaacgattccaccagaccaccactgctcggtaattcctgagaccactagggtcacaggaaccaacactttattttccactcaaattatgtattgcacagataattacagacaaatcaataaaaaagaacttaaaagttgctaagtactgattccacaccaactcccttccaaaggtgcattttagaaagagtaaacggtgtaccttttataagagaacttagagcaaaaataagaggcattttttcggacttttcctcaggtagcacatcctcacttccaagcaaattatctagagaggaaacaaacccgtcacagctagcaagtgcctgtcaaacaaacattttctctagtttagcattttagctccagctgatgacagtgctatacataaagagtaccatatgacggatcattcaatagagaacgacatatacctgcaggataacattaagaaagcaattgttgccaagatttttcaggcctccagtgtaataaagtctatctgagttcgaaagtaacttcttctgagaaactggtggtatcaccaagctgctatgcagcgccttgcacaacccagcaactcctattgccaggccaactgctgctgcaagactataatggggcagcccatcactgagagataccagtagattgccatgctcggattttcccatgactcgacttatcctgcccccaatgtccgttgcatgaaacaaaatcaaataccgggacacaggacacctaaagttgtttgcaccagggacttttgctttctatccaactacctcacacttgaataaatagatatataacctgcatccaatgtaatatttcagaacaatggctaaaaaataaacagtgattcatgacctatgtagataacaattaaacggactaggatcgattctggttagcaatttacttaccatcaaaccgatggttactattacaaaacacaaagcaaggaatagtaattttacccaaaataataaaaaaaaacatcaagatcaaactgcccagctacatgtttatgaaccagtataataccataatccgacaaaccagtggcggatctaaactttttgggagccatcaaactgttactaccattaaggttaaggcaaatttctagaacagaagctagggttaacgcgaattcgagaagaagtgcgtgggaagagagagagagagatgcggcggaagcagcagcacgaacgacggcgacaccgctcgctcggggatcggcgcaggcggggcgcggtggcggaggatgtgctcaccgggatggatgcggcgggagaagcagcagggcgaacgaacggcggcgccctgctccgctcgcggcgcgggatggatggggatcgccggaggcggttgcggcggcggtgcgggtgggctaaagggcaaactgacgaggaagtttatcagtattccgatccgtatccctactctcttcctattctacggatccctacccttctacgactccgatcagtattacgaaattttactgtcgcgtttctacaatcctacaaaatattactccctccgttcctaaatatttaacaccgtttactttttttcatcgtattataattattaattatttttctatcattgattcattgttaaatatacttttatatatacatatagctctacatattttaaaaaataagatgaatgatcaagcatgtttaaaaaagtcaacggcgtcaaatatttaaggacggagagagtatttagtataagatagattaaaaatagtatgaacaaatatgcttaagtttacataaaccaattaaatttatcggaatcaatttatatgctttaatttatataacatattatctattttatatcaaattttgtattttctaaaatctggtagtatctcgatcctatgatactatccggatcctatgacattataaatcagaaaacgattctacctggtatttcgatactgattacctttatcaggatacgcacaaaatggtaacagtaattagtaatttcgtctagcacatcctattcccaccctacctgaacaatggaaacctgaaaaatggaaaataatattaattagttttaatcgcattatccaaatggcttggatagacgagtcatgctagcacgatccacagccaaacggatcgtgtagttcctagtttgtcatgacacatgcacttgtcatgttggtacaccgggccgggtagcggcccaagcatggcttggcgacgagtcatactagcacgatccacaaccaaacggatcgtgtagttcctggtttgtcaactacacatgaattttcgggcgggcaaggaaagacccagcccaattgataacctactgctacaatcaacaaacaatcgttcctctcagaaagaaaaaacaagtgatgattgatcacaaaaggagacatgctacctagacagtcccaaaaaaaataatggctgatctccaaaaaaattcttgttacagtgaacaaataatggctgaactaaaaataagttcaaatggtggcatatggaccacataggcgtaccgaaacgcagacatggagtagacttcgaaatttgtaacaccaggtatttcagggtttccatgagtaaacatactcacgttaatggtatttgcaataagaaaaatatgaccttgcataattttcttaaccaaattgtatcagggaagataatcccctaaacctcaactatgtctgacaatcaatctctagcctttttctagcttttacaagtccaatttgtaaatcggttcatggaccgttttccaagtacatcaatccattttgctctgtaggggccgcgtcttcttttgatcttagaggtgtggaagcaagattcttgataatggaagcatacagatcaaaatcagctttgtacttgcagcagctagcctcaatccacttctctgcaaggcttgtggccacgctgtcttgactatccctctcatgctcttcgatcgccggccttatctcgtcgtacaggctgtcaatttcagcagcagcttcattcttcatttcctgacatttgatttggaaaaaaggtcattgcaaagcctaagctttcctagagcaatgttcaataaaaagggagttacagtagttctttacctcgcaatacaatatttcttcacgtgccacctctgatgctaaccgatcacagatacccacaacattcagttgcttgcgcataccacgtttagcttttccaccacgaagtgtgggtctacgtttcaccgcaaccaactctgtatggttgttgtcccggggcgcactttgattctggaggtttgcaactccacgcgttgagttttgcagagcatcttcagcacattgcgcaccatattcaattgatccattctgagtaaaatcaactcccattggaatagcattcaatggttcaatagtcattggtgtcaattcatttgagctcacattcaatggttcaacattcatcggtgtgaactcatttgaactcgcaatcgatggttcaacattcatcggtgtgaattcacttgaacttgcaataataggaatcccagtattttggattgtgttgttgttgccatcctgtgtatttggctcatcttttattaagatgtcctttggaatgctggtaggttcatcatcagcagaatcataaaggggaacattctcaacagaaaacctgcaatttaagatggaaagcatatgttaaccggtgctcagatttgttgtatccgtcgatatttcggcatttcaagaaattcaggctttgtttgaaatgacaggttgacccaggcaacacaaatctgcatatttttaaccaactaggatcttcttctatgatgataatgcaagacatgccagtaatatggatctgagagataataaagcaag

SEQ ID NO: 23555 - DNA, 1444 bp, Oryza sativa
gtcccatctgatcctaagttattatattttgggactgagggaataacagagaaaggtcactgctaagtaaaaccatccaattacagaagttaccacatataacttcctgggacattgaatagacaatattttattcagcagattggataggtaagtacaagcacaatcctacctgtcatcatcatcttcccacaggtatgtagcctcctaaaacatggcaaaaatgtagcattcattacataagcgatgggcattctaaaaggaatgtaaaaatgaaaataaacactgaaaatgtaaccaatttgtaactactcctatataaattaaccatttatgaagcgactgtgcatgtaacctgtacttcagcactcatggtaagagagaaatgcagaagaattatgccagcacatgtgcaagggaaagatcctacttataaaatggtgcttttcagggtacaagacatatcacacaacaactttttacctggaaaccacgtgatttagccccaagaaatccagaacagctgcagctccacaaaggcacctcaccattgcaccaccaaaccactcaaagttgtagtcataggatagttccgttccgattggaatatcttgtttcgcaaaaattcccactcttacttccccaagaacattccatttccttgtctcacagtttggttggctgcatgcttcaataacaagctatcagatttaatcattaaatgctagtaaatggaaaaaaactcgataatcaattatcaaataatgcatatgaaagaaacataatataggcagacatatatttgctacaagacataccacgaatggttgatgaatcttgccaggctccccttctttgttgcgtcgatagactcatcagcattcagatagataatataggcatccgttaaacctaacagggcacaaaaaacaaatgttatagctagccaaaattagggatggcaatggggacccgaaccccgatacccgataggtaaaaactctattagggtatgtaaacaggctaaattcatcacccatggggctgttatcggctagaaactgtcaccgttgggtgatgcggggacggggatgttccataggcacccggccccgaatccccgtgggtgactcgagtagtgtaggcatatgtacagtccataaaagttaaaagcccacttagtgcccaatttagaggtgctggtatataaagcaaaagaaaccctacactagaccagtcctcccttgtccccttctcagatccatcagcagccgccagtcgaggtcggcaagggcgccagccatcgcacctcctccaggccacagcagcgatatagcaccccgccgccgcataaggtgaccatgccgcgcgagctgttgttctgcctccaagtcgcttgctcatgcgggaaagcaagaggacgggcacttgctgcatccgaatg

SEQ ID NO: 23556 - DNA, 7503 bp, Oryza sativa
ttttctgctctgtcctgtttgtcgctgtttatttttctcattttgatggaagttggagctgattcttggcaacagaatcatgcaagtctggcaccatggtcatgttcataatctgagaaaatgatagatgtatgtcctcgtgctatttttgccgatctgttctacttctaccttcctactagagaaccttcttgttgatttatgcccacgagtttatcgggtgtgcgaccccgtgggtgccccgtgcacccggcgaggcttggggacgggagaaatacagccccgacaccggggacgggggcgggtgatttctaactgcacggggacggggacggggacgggggaccacaccccgccggggatggcccggttgccatccctagccaaaatgtaccaccatgctaacattgagggaagataaaatcaacagaccctggttttcatatgcttgagatctcctcttggcttccttccatgatattacttctccacaatattccataacaaatggtccagcctaaaaaccattaagaaaacaatgactcactaaagcatactcacttgaatatatttaacaacattagcagaccataaaatcaaggtaaattcagtcaccataatattctcatcagccaaaaggccccatccacgcccttcagtttttaccagccttgtcgcagcatattggcttttttgaaatcgctgccaacagagaaattgattaaaatacaaacataactaccagtgaaactgtaaagcactccagatgacattcggcctccctagcaaattggtaaaactatatattgaaaatgatagtgttcggtatctatagaaaattagtaaaactatatattagaaataatggtacatcatgtataagaaaccagattatattcaatctcacttgaaaaaaaatccttacagctaagagccagcacgactatattgaaaattgctgtacatctataataaactggattatattcaatcaagaagacaagaaagcaaaataaccgtgttacaccatttttttcccctcctgcctagtaactaggctcgagtgaactaaagtaatcatgtaagaacaaatgtatggatattcattcaatcaagatttggaacggttgcgctactacttgaacaagagaaacaccaacctggttcttgcagtatacaccgcaaaggcagtatccaggcgtacactccgtgctagtcaagacgttcaagcaccgatccccgcacgcgctgtccggatccagcagattatactggcactcacacacagctatgtcctcctctttctgcctcttgtgcctagcatcgcgcaccaaagtataaagattcgcattacatccaaaagcacaggacgcagccgttgtcccacatcgccgtgaaactcactcacctcctgtgcaagaaatcgttggtctcgatgtggatgtacggcggcggcggcggcggctccatgcgctcttcctcctgcaaaaccgaacagcccggggagctcaatcatacagaatcaggaatctctacgagcgagcgagcgagctcacagagaagttaccatcagagacgctagctcttggacggcggcgaggtatccggcgagaggggtagggaaatcgcggctgatagcctgggacaggagcccgcgcggcgcgtgagtggttcgaggagcggcggaggcggcgactggggaagtggtcgccggaggaaaggcgtcctccccggggctaccgaggggggcgtcgccggcgccggaggaggtgagctccgcggcggaggacttcgccggctggccggtggtcggaggaggaggaggaggaggagaggaaagacggattcggctgggtcggatcggcggcgctagcgcttggaagcgtagcgggctgcacacgtggacggccaggatgggagggagagatcaccgggtcctcgtgccgccgtcgtgttgggccgggccggaagcaacctggctggattgcctcttccgttttgcaaacggagcaaataatctcatctataaatggcaaaaggaaaaagtataccaaaggtccctcaacttgtcatcgaattacaaaatcgtccttcaactgtaaaaccggatgacgcatctccaaacttacaaaaccagtgcaaattagatctctcggcggttctaggcggttttgactcggttttatcctatgtggcagctgactcagcgtgggacccacgtgggcccccacgcgtcagcctcttcttccttcctctctccacctctcttcctctctcctcttttctccaatttccgggcggcgcgcgggggagcagctgcacgtgacgggcggcggccggcgggcgcaggcggcgtgggtagaggccgcgcgcaggcggcgagcggccgagaaggagctgggcggaggtgcacgagctcctcgccggactaacgctagaccggctccgccatgtccgccgcgaggaggtggcgcgcctcgtcggctcgctcagctggagtgccaccgacgccgagcacgtcgacgtcgacgccgcgctgatgggtgtcaccagcaacatcgtccctcgcatggtgatgggccggcggtggaccggcgacgacaacgacatggaggagatgcggagcgtggtcgccgagacggcggagctcaccggcgatctcgtgtaccaggacatcttcgcggcggggacgacaggcggagctcgacgcggtggtcggtgacctgcaggccgtggcgaaggagacgttgcggctgcacccgacgccggccgcgccccgctgctcccccgttggctgccgcccgccgcccacgtccgcccgcgcgccgctccatcgcccgccgcacgcgcgcggctcctccccacgccgccttcgcccgcctggagttaagtcaaccattaactttgtaccagttcaaatcagtggcaatcaccaaaccaaacagtgcgagcatgtgagctcgatcttaacaacaagcaagcagaactgtagcaggaaccaccagctgctgaggatccaaagcaaatggggatcatcagatcgattgctcatcggcgtactactggagatgatgggctccagggcaaccttgtcggcggttgccttgcaggatggatggattaaacgaaaaagtacaccgaaggtcgcccgccgcctgtgcccgcctgcgcgccgttccgccgcccgcgcgcggttccttcccacgccgcctgagcccgccggccgccgcaagttaagtcaagttgcgcccccgcgggcccggccgaaaatttgggaaaaagagaagagagaaagagaggtggagggagaggagggaagaagaggctgacggatggggcccacgtgggtctcacgctgagtcagctgccacataagataaaatcggagtcaaaatcaccgagggacctagtttgcactgttttgtaagttggggaatacgttatatctggttttgtagttgaaggacgattttgtaacatccatgacaagttgagggaccttcggtgtactttttccatggcaaaaggataatggaataagtctatttttggtccctcatctcttgctcgtgattaagttgcctccctcaaccgtaaaactgggtataatgtctcccccatcttaaaaaaaaaaggtgccaatcgactctttcggtggtttggaggttggtttgttgacgtggcatgatgaccacgattgatttgccgagtcagcatgtaaggcccacgtgtcatgactcctctattcccctacctcttctcttctctctcctctattttcattggcgaccgcgccacgcccgagatggagctctgacgagggttcaagatgctcgcagtgtcgcggcccaacccgtccgtggcggcctgtgagacctacctcaaccaccccgtccagctcaatgacctcagcccagaagccttctcagagatcccccatgccatggcgctcctcaacttcctccgcactgtgcgcaccgtcatgctctccgttgtcggcattgacctcagctcttgcaggaaccccacctggtcctctccctgtcgggcagcgccgatgacgaccccctgcccacaaccgaggtgctccaccgtgccatcctggagatgttggcatcagtcacggccatcgagcgatgcagaacgccggtgatcgcggcaatgaatggtgcttgcgttggcggcgaagggacgatggatgcgctggtggcacaatctatcgcaggagggctctggggagcgttgcccaagcgtgctcccatcgacagcaccgtgtttgtttttgcctaacatagatagacctggctctctctctcccatctccaatgtctccacctccctgaccagcacctcccctagatggccaccctccttcttgtcagcgcccccgcgacactcttcctccttcacccacccatcgtcaccgacaccaccatcaacccatgtagcctatccatgctctaggacttgcgccgctcgctgaccaatggcaatgccctcgccttagagtgggacctcaacatcgccgagccctacgccgcctgtccgcacatctcatgcgaccacaccagccgcatcaacaacatcgaccttcccgccgacaccaccgccatgcaatagctttagagccttagcctcaacgactgcaacctcaccggcgccatcacatacttcgtgcagaactcacggactggctggtgttggcgctcctaccattgagtgacgtcgtctggctccggctgagaacaaagagagatagagagagagggtaaaggggagaaaaggaatgactaacttgtaaggctactgtttatttttttctcactgatatgtgggtcccatgagcatcacgtaggacgaaaccgccattcaaacagcgaaggactcgatttacgccggtttaagggagcaagattggagatatgtaaactagactaattaaaaaaatgttaaccacaccgaaaaaaataagcatgtgttggagctcctaccgcggagtgacgccatttggcactggcttggcgagaacaaagagagagggtagagagcgatggtaaaggggagaaaggaatgactgccatgtgaggccgttttgtcttattttctctcactgacatgtggatcccatgagcatcacataggatgaaaacgccatccaaacagtcgactgacttgatttacgctggtttaaggaaggtgaaaaattgaccgggtgattcagagttcagaaatataaaattgattcattaaaaaaaatggtcgcgtaaacaaaaaaaaaggaggacatatgacatgtggatcccatgagcatcacgtaggatgaaaacgccatccaaatagtcgactgacttgatttacgccggtttaaggaaggtgaaaaattgaccgggtgattcagagttcagaaatataaaattgattcattaaaaaaaatggtcgcgtaaacaaaaaaaaaaaggaggacatatgctaggcgtatgtgtcatgcgtcttttgcccttgggcggtgacaatgattatttcctttgaccaatgtgaatattgcgagccgtgcactcagcacgtgcagccaccggactcggggtgtgcccgtcagcacgcttggttcggctgtcgcctgccatatgaggaggactaaacgttgttagctctccggtgtggtactaaacaacgtgcaccacctaagcacctttgtgtttagaaacccgcggagcggaataaattcctcgtggaaagacgagcgcacgtactgtattcacgtacgctttcggtgaacgtaccagttccgtcataatctcagcccatctccttcgtcacacaacgtatgactagtagaggttgtttggttgctagccaaaatttggttaatttaccataagtatggcaagtaggtttgatcaagttagtgtagtgtttggttctaatcataagttagttatgccaaactttcctttaacttgaccctacatttaatagacacaataatgtgtggcaaggaggctaagatgtggcttcatttttcttggccacaactttagcaacttagccacaaatgtctggctagcttaggcagttttacacaaccaaccaaacagccacatctgccgaacaaatggcagctaaactggtataggaattgtccaacaaagtcaacaactcgttgattttacaatttttttaagaaaatttaagaagtaccattgataagtgtctggttccaaaaaaaatgccatagacaaatacgagtttcatgaattactattgtacaagcaactttgtcccataaatgctaatgttgttataattccgttagcatctccccgttggcgttgggtagacggaagaataacgacaatgatatttctaggacaaaatcacttgtacgatggtattttataaaactcatatttatcgatggtatttcttagatttatgtgtatgtcaatggttggattttctcttccttttaccatcagcgacgctagctgtggacgtaggggtgggcagaaaaagaccgaaccaaaataaccaagactgaaaaattcggtcttatttactagatgaccgaatttttttcgatcaattcggtcatcacccttagttaaccgaatttcattgaaagcccatatcagcccaagaaagcaagctcaacactagtaaaaccctagctccctctctattgccttctcctcatccacccagctagcagccgccacgctctcccacccaactaggagagagcgcttatttcttttctttttcacctgagcgctcctttctttttctctcgcacatcgacgtcgtgttttgtcgtcggcgcctctgcaccgtcccagcgtctcctccttctcacaagtcacaccacgacgacctactcttgttgcgccaccttcagtcgacacccatgctgccggagcccggaggcctcaaacccccaactgccaagcccaagccgcgatcctccgtggctccaccccgggggcacatctgatggtgcctcctctaccccgccagcgacgagaggtgccgaagccgatctgggatgagtatatgataatgaagaaagccgatctgggatttttatgaattttcttcatgtgtatgtttttttatttgaaatttattgtggatttgtgcgattcttctgaatatttctgaaatttcggtctaaccaagaccgagaccaaatagttctatctttaatatttttcaagtccgaacggtcttgcgctttaaatgaccgaacataaaacagattgaaaaccgagatcgaattttcggtattactgaatgctcacccctagttggacgtggatagcgctgcgatttagcatgccgaggcaggtggaagacgagaaaaatccaacgtgcggtagcataattgtggctgatagatacgaattattttctttttttaaattttttaaaaatatttacagaaataatctatcgtcggaaaaatttataaaaatagatcctgctgccctagtgcagggcgggaag

SEQ ID NO: 23557 - DNA, 1534 bp, Oryza sativa
  unsure (1)..(1534): unsure at all n locations
ccacccattgccagggcggcaatgggcctccatgaaaaagccagcccgagaagggccattatcaacaaaggtggaaagaagcatttggccggttttttttcatctctgccttctttccagctgggcaaataagggcggtaaggaccaaagcgcaaaatgcgcacacggcgccgttgagccgccgtctgtcacgtcagcttgccaccttccactagggcggcagtgtctatttttgtaaatttttctgacgatagattatttctgtaaatattttaaaaaaatgaaaaatgaaaaaaattctgatagatacagacatacggccgtgttgagccgggccggaagtactgataggttttgcttgattgggcttccaagacaacgagctgatgggcctggacaagctccgtgtgggctgggactcgccggaagggagttcccaatggagtgtgttttcgctaggcaacctcaggaagggcttcgactctttcgtttccgggttacaaagcagctagctttggttggaaacgaaattctcgtgcctctgatagtgtttttttgccagatcggcacagtggtgaacatgatctagatagaggcggaaccttcttctctaggagatctttttagcacttaggttttttttcagctaaattcggaccctattctccccatcataacccgccatgattgttctaacgttaaagttgtattcaaacatttttcttctactataataacgtgcaaagctttttttaaaaaataatagaataaaacatcccggcctttgatcatcagagctatagccaattattacaaaagtaacacccaaacactgagtgtagttcaaatgaattaaacatacccaacaaaataaaatatcaaactaagataaggagagcacatttattcaagtctatttatgaatctccatctatagtttgcaaggagttgcatgaccgttgtctcaagcttacgacatgcaaccttcataagctctcgatcatcttcacacatttgcagctgtgcccaaaatcggagcaaatatgttgccctgaaaattacctgtatatatgagatagatagtgatttgtcaaaaaccatatcattcctagtcaaccacagagcccaacatatggcagaagctcctacaagtatgagtttactcttcttcttatctaccctcaaaagccaaccatcaaacatattagatatggtagtaggaaggtataaaccaagagagaactgtactgctctccaaacaaattttgcataatgacactctataaaaagatgttgaatagtctcatttttcataaaaaacaacattttaaactgtcattccaatttcgtcttgccaagttatccttggttagcacaacccctttaagcaagtaccacataaaaatcttaatcttaagtggcatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23558 - DNA, 687 bp, Oryza sativa
ttcctgcagccctgccgtaataatacttttaaagaaaatctatacatataattttttaaaagataactacatactccctccgtcccataatatagcaacccagtactataagatgtctcatccggtactaggttgctatattatgggacggagggagtattcaaaaggctattgatagcttaagttttaaaagtttaaacaaatattattttacattttaaatatttatgatcgaaggtagtatgttaaaagagatgtaagatatatcatatgtgcaatgagccaatgacccatatgtagctaggggtgggcgttcggtctacccaaaaatttcgatctcggtcttcggtttttcggtcacttcggtttttgaaaagtcaggaccgaatttcatccaaaaaatcaggaccgatgaattcggtctcagtctcggtcagaccgaatttggaggagccgaggcggagtatggagacgacgccggcgagatgtggaggcggagggcggaggtggcggcgcggcgcaatggatccggcggccggcggcccgcacgaccggcgaggcggcgtggaggcggagggcggagacgacgccggcgatgtggagacggagggcggaggtggcggtgcggcccgatggatccggcggccggcggcccacgcgaccggcaaggcgacgtggaagctgacg

SEQ ID NO: 23559 - DNA, 23987 bp, Oryza sativa
  unsure (1)..(23987): unsure at all n locations
gtatgccaaaaaggactacacctggcgaagcacccgcagatcgatgcgccgaacgtgcaggtgatcaagctcatgcagagcttcaagtccaaggagtacgtcaggaagcccttctcctggcagtactactactggtacctcaccaacgatggcattgagcacctgcgcaactaccttaacctgccatctgagattgtgcctgccacactcaagaagtctgccaggccacctggccgcccatttggttctggcccacctggcgaccgcccaaggtatacatattctcgtgatgctcccttcaagtgcatgcaatttggcatatactataatgtgcttagtgaacatggggcctgtgtcaccatttcaccatgatcatataacacttatatttctacaaatgattcaaatgggaaggagaaaattatggctataaatgtctgatattattcctgtattagatttatcgttaagaatctagcttgtagcttttgagatgggagtagtgagattctgtgggcagagcagtggagctttttagcatgtcagcacgtttgttgcataaaattgtccttcaagaaatatgttgctctcattttggtagaggtgttgatcgttttcatctgaccacagggcttctgctttagggtgaagcttgtaattttctgtgcattgttcataatgttcttgctttaggctgcagcttttgcttgtacagtgctttctaagcttgtgtataaataagataggattagaatgataaatgtattcaagatgtgttgatgtggtttggtttaagttaatctgttcatagtctttcctgatttaatggaggctgattctatactgttgattctctttgcgatgtatgtaggggcccgcctcgctttgaaggggacaggccaaggtttggtgacagagatgggtaccgtggtggtcctcgtggtgctcctggtgactttggtggtgagaagggtggagctcctgctgagttccagccatcctttagggtaatcaactactttccctacaagtgtttcattattgttctgttgtgtcatgtagcttatttgacttgttacgctgaatacaagacaagcaaaatccatttttgtactgcctatgatgaatttatatttggatttaccatcaacttaaaagttctagcagaattacttgtcttttttactcgtagttgtatgctacatccgagatgcctatatatttgatgttgttcgttcatgtcttcttggcctgaaaaaacgaactattgcagttccacataatgtttgggtgggatttagcgaggttcatatttttttttgtgtaaaagttttgaacaaccttgtgattttgcttgtcgaaggccctgtgcactatgcataccctgtttgttttaaacaagattttgtatttcctgttctgatatttagctaatatattgatagttcagttgatttgatgacatcaatgattttggcttatatttaccaccataaaattttgcagagctctggtggcagacctggctttggccgtggtggtggcggaggctttggcgctggcccgacctcttcctcgatggagtgaacttcccgtagtttggatatgatgttttccttcgcatgaggcgtttaattttgaaggacagttaaattatgtagcagtgatgtttgcaggatcgaccgctgttgacatatgctaaaaatatgctatcttgataccttccagtataatagtttttgcgaacgcttaagttcaatgttaatgcttttgacatattggcggaaattatcttttgcttctgaaaaaaagaattatgtgcatgtttgattgctggctgcgtgaaatagtgatatgatatctgtatgcaagtttttgatggaagtacgtgtttttgatgtgctcattcatcggagcttgcatgtcttgcgtacaatgagtacaaacaaattcttgatcgattacaatgtagacccaaccaatcaggtatccaaaactcttgcgaatgtttgatgtacaatgtaaagcgggatctaatctgtttctgggaggcagatgcaatctatgtacagcaaaatttgnggggaaaggatgcggtggtgatgcttggtgtttctgccatgttctctcaaaggctcaagagtagagcagccagcgtagatggcaccagtatgatgagctgctgccattgcaacgtcgccgtcggcggccgcagcaacgccgtggcgcccgatgtcgcgttaaagatgcctttgggcgtgccgccgtgccgagcggtcgtgcatgtaccattgccctgcacaagcaaacacgtttcaatcttttttttcaagtcagatttgaattatgatcattagtttagcaatgtgcagtgctggaattcaatcttgcattgcaacagaaatcttaacgaggtttctgcagcgaggcattacactgcaagcagagacgctcccacacccacagaccagtccgccgttggccctgtccgtggcttcagccgcaccacctcgatcacttctctgcattgttttcgcaaacaagtccagaattcaaagcctcttttaaaactagcacaagcagtttctaatccatattcatgatgcagtatcagaccttgtagaaatcgacggcgatgaaattggcccatctgtccgcggacaggtcatggcaggtggtgagcatgtcgagcagctccgccgagttgtccttgcaggccaccgggaaattcggtaggtccctgaagtagttcaccagcaccagcgacctcgagaggtcgttcatggcggccgactccgcgcggttcgggcacctccccttgatcatccccttcgtcccatctgcacccacacgcacacgcacacgcacaccatcgtcaaaggaaaacccaaaccgcaaaatcctccacgatcaaagtcacgtgactttatcagtgacacgtgggtcaatgagatcctgactccacgtgtcaatgacaaaatcattgtgacttcaaagtcaaaaaaaacatgatctcattggtgttacttaggatcagtttgacacagttacagctccacatctcctgaagctggagctcggtcaaatggtttcagcttcatctaaaataggagtggggctaagtagagtactctcataaaatagagaggtggagttgggtttacgaagcttcacaactctagtccatacctaacttctgaagctaaatttagaagtggaagatgtacgcccttacactggttttcgacgacgtagtgccactcgtaggggatgccctctgcggcctccttggcggacttggaggtgaagaggaggaggcggtggttgtcgcggaccatgtcgctgagccgcggccagtcgccgccgctcttgggcatccgccacgccgggaacacgtactttgtcaggccggaggcgttgaggacgcgggtgagccccatgggcgactccacgtagtcctccacgaacaccgtcaccacctccgacgggttccgtgccaagaaccgctcgatctcgcccagcacctccaccgccggcacctgctcgaattaaaacacattgatcagatcaaaagctctcgtgttcgtcagattcatcgggaattcagaggcgattgtacacgtaatcatgtgtgccttacgaatgcggtgaagttctggcaggcgccgccgaaggagtggcagagccagatgtcgttgcggaagtcgtacatgtccagcatcagtcctcgcacgccgttctgcacgcgtgacgtgttgatgaatagcgagaaaggcagaaagctttggcatgttaatctcatcgatttgatcgttgtttgacatgtgtaaattcagtgtaatcttgaatactctccctgatgtttgtgacggatcacggaatcaatgatgggttgattaaaatccgggtttaagtggctgtcagtgacagagggcgattgaaattgaaagtgggagagagacgggacgggcacgggacgggacggaacggcaagaatggaatggacgtgccacccgaccgtatccccctgcgccacaagggtacaaatcacgggggcacacgacgcgacgatgggaaattcggcaaggtggacagccatggaagaactgaccagcaatctgcgttggcgccacacacgcgggcgaacggcgaacctcccgtgtcgtcttccgtgcccccacgtacacgccccggtgcctttcacgcaagcggagacggcgccgcagcgtgcgcgcgcgcgcgaggccgtgcacgcgaacgcgccagggtgcgacatgggggttgtggcgcgccggactgacacctgttgcgtccgggggacacctgcccctgctgttgtggttgtggggtctaattattgggtttgtgtggggcccgcgcatccgacgtggcgcgcggcgtgtcaggaacgaacggccggaaacgaggacgacggcgaggaggattgggaagtgcgaacgaaaggaaaggacttacgttgagctggtcggtgatggtgtcctgctggttccaggccgtggcgatggccgtccccgtccgcgaccgcgtgccgagccgcgcgaacgagttgtgcgtcgtcaccacgcgtaccggttgaacggcaggtcccgcgcctgcacagcacacaaaccgccggaatttggatgcggtcagtcagcgccgccgcgcactcggagaggaagaaaccaaaccgcgacgtcaattacctaccttggtctgcgggtcgacgggggtgactgcgggtgcagncgcgggcggacgttgccgtcggccacgcacgtctcgcagtgcagcccggcgtcgcagttccggtccgccgcgcacgtctcccccacctgcaacgtacgcacacgtacaccctccattttaacccaccaattcccccctccaactaattaaacagcgcgcgtaccgcgtacgtaccttccgtgccgacacgaccagcagcagcgcggcggccgcgacggcgaacaggaggaccctcacacccggcgccggcgcctcctgccacttcgcagccatctcctcctcacccctctccctctgcgcgctctctgctcttgatgcgtatgatgcgcggttggtgctctcccagtgctgtagacgtcaagcaacggggcagcagccgcagcaagcagaatcaaggcaagtggcggaatatttgcccccctgtctctcaaggtattggatggccttgtcgttgtgttgtgtgtggctttgtatcgtaaatcgtaattcgtgggcggcgtcgccgtcacctgcttacgtacgcggcaatgcgggcgttcactcacgcacgcacacgcgccccccatccgcttcgtctttccgcctcgcgcaccttgtgacatggtgcgcgtttgaggaggaagagtgaggggggaccggtggtggtggtacggacgtcgaggcagagcagtgaccgtttcggtggtccggccggcctctgtcgtaggagctaacacggtttgaatttggcaaaaactgctggagaccacggcttgatttttttttgccattttctcgcgtgatgacacgttctttaaacaaaaataatttggctataattatgagccgtattaatataatgtggagagtttcatcggctaactaacgacgagttcagacagatcattcttggtggaataggtgatggagagagagaaatggtgccaatatacatgcacgcatctcgccgatgacaaaagacgacttctgtatgtactactggtagtatatgtatagtctttatctcgcagctgccaaaggcttgatctggtatatccgttatctgttgcaattcaaacgacatgtttccgacttaatttcagtagaccacttctgaatcccaacttttctgtgtccggaattgtccattcagaactgaacctgaacatgaagaaagacgtttgcgatacctgtctggttctagccttgtccacaaccgaaagaaaaagcctcgatcgtcagattctctctttcatgttcctgcaaaatatgcacaacaggtaccacactgaaattatgatgtgcctacacagggacaaaacacactcatactggcagagtcttgaaatatgtacacgaattgtctagtatttgaaacatgtggccatctcagccactcgagtggattatatttgtaggacgcagtgtacttaatctcccattcatcattcaaggagtcaattacggaattccttcagagacatagtcaattatcatacatatcaggaagttagttgctggctgatagctagaataatcattaatcatcaatctaatgaccaagtacatgcatcatgcatccacatcacaaacttctctttaaaaaaaaaagaagcatacatacaaacatgaaacatgcttgcggtggttagtccacttgggcgtagactaaaaacggtgttcatttttgcgtcagttatatgactatcttccaaatatacattgaccgtctgaatgtgcacacatgggtattagtgggtttggtactagttgttactcaagacaagctttaatactcaacacgttttagcaaaacacgcattttgtcaagtgaagactgaagatgatgaaggatgaagcaagcagaggttgaagaagccttaaaggcctaacaaaagcccagctttacatgatgaaagcccacataaaagagcatacaaaaatgtcaacttgtgggcttaccagctttacatagagacagcactggaggacctctggtgcaagttgcgtttggcaaaatgagagaaagctccagcctccagctagtagagaaatatactttggagtttggacaataccttgtggtgtggcgagagaaaagctggggagctcttcagagaggaaacagacatgtctctgcttgtgtggcacaacttttgaagttctctttctcggcatggcctttttgggggtatggtagcttatggcgaagctgcgtttgcccgtgagaaacttcccaggtagaaaacaacaatggcgccaggacaagtatagatgctagcaagtgatactgtctgcatgctgtttgctatacattattgtactaggattagacaagaagatgttagagtagagtggtcaaacaccaggcatactagtatcactgcgtgcattgacatgcatgtatgaatggatgtacctgtgctgccggtcctgtgaaacagaacaactgcagtcatctgtttgtgctacatgagccatgagtgttcacctaggattccccttaaactttgcagcagtaatgatgcaggagagctgatcagtgaccagttttcctgacatgtttttagtccgattaggttacgattgatgagtacttcctccccaagtccccatctcattttaaatctagccacgagtttctgtgtccaacaatagaacggagggagcacatggtaaatgtgtggtgttctttccctgtgtcagttcaacacccccctcctcccctccccccccccaaaaaaaaaccaaacaaaatttttcaaaaaaattatttttcttttgaactcgtctgaagattggtgcacaccctccgttccatttcatattacaagtcattttaattttttcttagtttattaaaaaatggtatatatctacaacaccaaattagttccattaaagttaacctataatatatttcaataatatgtttgttttatatgcttttctataaatttaatcaagcttaaaaaataactagaaaaatatgtctaaacgacttctaatatataatcagggtgtaacggttaccatgccatacgccgagcaggagccaggaggagcatatctgaccgaagcggagcagccaaagaaaaaccaacgcagagcaagagagctgcactgccgcgtacagtacgctgcagccagccagccaagccagccgcggcctgggcctcggagacggcgccgtgcgcgcgcgtcggcgtcgctccccgtattttgttcacttgttgtttggtcgcgcttgtccggtccacgccatctggcacattggcatgtgccaccctcaccctcacggcctcacccaccctatccgtggggcgtcgcgtcgcgcctccccttcgccctcgccctcgcggttctcgcgtacgcccgcgccacggccacgggagggaaaaccacccgtgagccggtgtgacgcagccgcgcgcgaggcgcgacgcgagtgtgcgtgaccccgacccggccgcgcgacgcgaggcgagggaaaagacaggagagaaaaggcgccgcgccgcgagagcccccgcgacccgcaaagcggaaaagcgcagcgcgcgcgcgcgcggcgagacatatcggcgtatcgcgttggcgtcgcggtgcagcgcagcggaggcgttggctttggcagtttggctaggctggcacccttcccgttcgtccaaattcctctcgccctccccgacaaaccaccctttttccaccaagcactccaagcatcccactccactctccgctccgccacctccttgcgctgctctcgctggtacggaggaggatgcggcgcaggctcctcgcgctgctgctggtggtggcggcgctcccgctgctcccggcggcgatcgcggcaggtgagctcttttgtactactttttaatggcggggctcctcctcttcttcccttcaccgtgtcacaggttcccttctctgggtcgccgccgccgccggaatcccgctgctggctcctctctctcatcgagcgatgatctccgcgactggagcggccttggctggtcgccgcggcggagctgttgcgacttgcgcaagtagcgccagcagccgcgcacgtcgctcgagaagcgatttttttttatatcttattttaattattattcaggcgtcgattccgcttctagtttcaaccattccccgcgatttttcgtcaccattctactccgattactgcattgtagaaccacatttttgtcatgcgagagttgattaattagagctttttttttttttggggggggggggaggggctgatttcaccggtggttattatccctcgccggagagcaatccctaaccacaaaatggcacgaacagcatgcatcgtcttcctgcttcctgcagcgttcgtcagccgatgccggtaaaggggactgtactactcgcaatgggggttgacgggttgtcacgccattgaattcccctcacctaatggggctcactcactcactgatgaacactgtacaatcagagtgtgggtggtggtggtggcttggctttgcatttcgttcgtgttccagggctcctccccacgctcgccgtaccatttggatttagctggccggtgaggaaggtcccgggtcctggcaatttggtagtgttattggatcacttattagatcggcttgatcgtgcagtcttacctgatgttcccttccgcatcacatgggttgttcttgacttcttgtgttgtgtgtgccgtgctaggctactggtgtacggtacggtgtagcagaatcggttgggttaatgaagtttttgatacactctccccccttgtatggaagtacaagtacgccacattctgctggtagttcttattaaatgtggggggtaaatggagatttgggaattgatggcaagtgatcaaatggaaggataatgtgctagtactggtcatgtgatctggtcctggcggtactgatttcatttcctgttaataagtaatgatcatgattgatggcgtagatagctagcattggctacctgcagagcattacatgttttgcacttcctgtgtaatattactggttttagtagatatgcagcagagtgatgaggctgaccttcagatgctattcaatttacgccaatagatgggtaatgtgctagtgctagtactggtcacgtggtccgttcgtggtggtaccgatttcattttttgctatacatatgatcgtgattgatggcattggtatagatttcgagcattggctatctgcattgcattacacattttgctgtttctgttaatgttcccgattttagtaaatatatatacagaatggtggggctgcatgttaactttgtggtatgtgttgtatactattgcatgatctttataatttctttgttgacatgcagagtgtccgttggatttgagttggccaaactatgaactgatggcttctgtatgctcggatgaaaatggacactcaaaatgttgccgttacatcaatgctattattgcggtctcgtctgccatgtatgcaaatacgacaggcattcttggggtcccagccgaaatttctgatgcttgcattggcaacatctctgacacattggtatcaaagggaattctgcctaccgccgcttcattttgtggccttgggatcaaaattcaagtttcctatcaatgtattgggatgactaccgtcctccagatgttacagtctccgaatttcagtgatgtcactaggagctgtgcaactctactttcagatgatgtcagttgcaagaggtgcttaaactctggtctgtcatacctccgccatcttgtgggagaacaagataatgtcacattgaatacctgccgtgatgctgcctttgttgcatttgcgagtcaagggaatatatctaccgttgatacggcgagttgcttttttagcgtccaggggcttagtgctcttcaaggtttgaattctgtacacaaattattttttatttgatgaccttgttaatacaaacaatatctttttctttaatagagagcttcacttcccatgttgactattcgtatctgttatagccttataggatataacctttttgacaatttgtagaggcaaaagcatttttcttctattatgtttctagtgcattccattgttccacgtgatctccagctcatgtgttctgttgacattgcttcggatcctgaggagcaatagtaataatgatatgccatttgacaacttgtagaagcatgggattttttttgtttcattagggctaatgaattacataagctccacatgatctccacaattgttctttgaaaagcttcatacatgcagcattgctgtgcatgtccatgctctcctaatatatgcaataataggtatattaatcagcacatgctactaaaattttcatttattagaatcaaccatcagcagaagctataatttcatatccttattgatgataatatgtgtggcgaaaatcttgtcatattaatgttaaatcttgtatttgttggtaagatgatacattccacctaaaatatgatatgttatcttctgttatcagttttttcatttacaatacaacataatatgtttgtgtagaaataagttaggtcattaggtctagtagaagtgaagtggaccatttgcttgttattcttcgattcatctttctcaaggtttgagtccacaatgttttaataagtgatgtatctatgatgcagtgaatatctccgtgccatccccagctggactaattgcaccgaatattgctcccagtccacttgcaatgcaaattcctggggagcatgttactggagtgctatccaagcatcatcgtagttacaagcttgcactattccctgcaattggggctttggttacaggattagcagttatactaatgatagtattgattttactcatccgtaaaaagagtagagaattagagaagattgaaggaactaaccctcttgatgcgtggagttcctgtttgaagaagggccaagaaggtaatcatttcatgagctatagctgtactgacattcatacatgaatatttattcatttattatatggctggatggtttctgtgtgttcatgatgctatattgcacaccaggtctgttattttagggctaacttcacatgaaatttcttaaagcgtaatggctttgcattcctattctcctgtggctgtggatatgtgcaatagcagtaaaactgatttattagtgtggggtttacaacttaggaattcatatggttaatttgaatttgatgaactaacatttgacaacttgcattacaactagaatcagttctaagacccatccaatttatctgcttaacatgatattttttcaggttcttccaccattttcgacagatttacttacagacaaatgaagaaggcaacaagaaactttggcactgtgttgggaggaggtgaaaagggcacaatattcaaagggaaactgagtgatggttctgtggttgctataagacgcatagaaagctcgccaaaacaaggtcagctggaattttgcaaagaaatggaacttcttgggcggctgcaccatcgtcatcttgttggacttaaaggcttttgtctaacaagatttgagaggtagagtatgttatacatatttttgggtatctagaaatccatggttctttacagtttcttattatccaggttccaggtgtatgaatacatggaaaatggaagccttaaggatcaccttcattgtaatattttattttcactcccaatcgttagtctcacactgcataatctggtgaattgtgtgcataaaagcaattttctctttgcagcgtcaggtaaacgtcttctaccatggaaaaacaggatccaaattgccattgatgttgcaaatgctttggtaagtcctggaatctggattctgtattagctcaagtagtacatatttcgtagactttttttttgtaccaaagcaacaattgaatacttggtgttaggcctattaacctgctaaaaacttgtttcgcaaaagaaaacctgcttaaaacacttacgttacttaagtacgttatttaaatgctgacgaataactgctacaaccaaatattttgctcgcaggagtaccttcatttttattgtgatcctccattgtgccatggggacataaagcctagcaatgtcctattggacagaaactatcttgccaaggtacttgacgtgaaactttcctacagtgagaacaattaatccctactctgctggcagcagatacttgtttttgaattaacagggctgatcaagatactaatggctggttcattttccatagcttgccgtttctggtcttgtacaatgctcaaatggtgatagtaccaccatcagttccaccctagtgaacgtgaagatcccggcaactcctggtaagtccaacatctgcctttttggtgtattcttcacctttgtcagcatcatttccaacaaatcaaacacacaatacatgtttgacatgacaatggttcaatttgaaaacacactttcatcaaaagtagtggagcatgaacttaaagttggataaaattttggatactcgtggcacgcttttcaaactgctaaacggtatgttttgtatgctctaaagtatcaaattaatatatttttcaagtttgttataattaaaacccaatcaataatatattaatatcatttcgtattacgtaaaacacttaatcttcgtcttcgaaaaaaaagaagaccaccttagaagcgatttgaaatttgatagcaatagttttgtgtggtgcaggctacgtggacccttgctacgtggtgaaccaggtggtgacgccgaagagcgacgtgtacagctacggcgtgctgctgctggagctggtgacggggaagcccgtggcgcagggcgacgacgatggcaacggcgacagcagcagcaggagcagcagcaagaacctcgtggaatggtcgcgcgagctgatcggcacggactaccggctgcacgagctggtcgacccggcggtggccgacgcgttcgacctggacgagctgcaggtgatggccgatgtgatccactggtgcacccaccgggacggcgccgcgcggccgtcgatgaagcaggtgctccgcatcctgtacgagcgcctggacccgctctccggcggcctcgcccgcgccgtcgccggcgaggaagggtactactacggcggctggcagagcgggcggaaggggaaggagggcgcggagatgctggccggcggcggcggcgacggtggtcggtgcctgccgtcgtcgtcgagcacgtccaggtcgtactgcagccgcagcgtgctgcttgagtgcaactcgccggaggaggcgccgccccagtcgtcgccgcgcggcttgccgtgacaccgtgacacgccatctttttgtcggttgcatcgacagattttgcaggacacaacgtacagtgaacagtcgaaacactgactgaactgaaagagagattttttttttcgtttttttttttttggtgagagtgagtgatgcagctgtggctgtccagcgagggaatgcacacagcacacacagggatccaccgatccagacattcagtgagatgatgaaactgatgaggcaggggggggcccaggtggcggagtgaaagaaggccgggcacgcgtgatgaagagggcgatgtttgttcagttccctagatggagttggtggttgttccaccttcattgttcagtcagcattgaagagcgtactacgtcgggaacatgggccattcaattcgtgcatggaggatggatcccttcacttgccttccctagctgcagcctgcagcagctagcagctcgagtggtacgcccatctcgcgcgcgggtggtccatccaccggtggcgcgcggcgccgacgccgacgccgacgccgtgggcgcgcgcgctgcgctgcgctcggagtggcattggcacagcacgcaggaggcagggcaggccagatcgatcccaccacggccgcgtgcgacagtagcagcagccgtgccatgggcagggtaacgtgacgcccagtgacaatcaccgtcaaaaacagggcagggggcagcaagccgacggccggcataggcagtttgctgaccgtgactgcagaggcgtacctggaggctggaggagccaactgatgatggtactaaggtggtgtttggttggagggactaaagtggggttaaactttagtccctctcaggacttatgtttttatgagagggactaaatttagtccctagtttccaaacaccccctaaagagactgggtttttatttttatttgttcgatcgcgtttgtgtgaatgtgtgatcagatcgaactttaaaaggaaaaaaaaaaggagctcccgtttgccggtgatgtgtcaatgtcgcgtgactcgattacaggagttgaaaaatagaagctttacgggaagcgaaaaatgtgtgtgtgtgtggggggggggggggggggttgaatcagtcatgaacttgtgtctttcatactagtcgtattttttggccaaagcggccctgccatttgtttagctgatgcggcctcgataaggaggagggtttgaacacggtcatttgttttagggatcggggcggtgttctcgcatcggtagccaccagccagggcttccaagtcaatgctgctgtcacggctcacgatggattcattccatgggtttcgatcaatttcttttcatgcgatttgcacgcatcaggcatcaacccaatcacctgctcctcctttaaaaaaaattatataatcaacttctactatgggcccgtttagctccctaaattttttttccaaaaacatcacatcgaatctttagatatatgcatgaagcattaaatatagataaaaagaaaaactaattacacagttatgggggaaatcgcgagacgaatcttttaaacataattagagcacccgcaatggtaaagtaagttgctctctataacacacgtacatctcaacaatagactagattaatagtaaacctccttaatagtatgtctacatgggtatctatagctctctaatccattgcctcgtttttctctatagactatctccaggttagtagatagttttgctctctctcttcatttaatatcttccaagtaggaaaatatgctgacatggatctcttgtagagagcatatagataaccattgcaggtgcccttagtccatgattagccataagtgctacagtaacccacatgtactaatgacggcttaattagtctcaaaagattcgtctcacggtttccaggcaagttctgaaattagttttttcattcgtgtccgaaaaccccttccgacatccggtcaaacgtctgatatgacaactaaaaattttcttttccccaattaaacacaccctatgtttcatgcaacctcatcagcccaagtatgttttgtctgtcaatttaaagagaatcatatttaaattcatagcaagaaattgtttttcctaaaaacgtagggtgtaaactacctgtatcgtttcgtttgtcttgagttgtaaaaggtgcaacagcagcaagcagcaggagggacactagtactacggctgctgctttgtagtaacaatagtacactattaaaccattacccgcagtatactgagtactgacacggttatttgcatcaatcaactgtgacctcggttctcattaagcaacgagcaagttggcgcaaggagacaagcagaggaatgggcacatcagataggataatcgagtagatagatcattaataaagaatcaatcaggagcgtttaagggttccaaatccgggagcattcttaattagagcaagttcagtagtatagcaaaatactagctccaatttatctataactaatctaatagctcattaatacaatagttatatactacactattaatacctggtctcatctgttatacacacattgtatcttgaagtccgtgctacagttggctacaaatctgcagtccgttgttcttctctctcctaagagcgagtttaatagtatagccaactactagatccaattcatctatagccaatctaacagctcatctatataatagttacatagtacactattgatacctggtcccacctgtcatacacacactgtgtcttgaagtccgtgctacagctggctacaaatatgtagcccgctgctcttctctctccttatttttctctttaaaatatgtttgcagctggcttatagcctgctattgtatatgctcttatttatctttttaaaatatgtttgcaactggtttatagcctgctattgtacctgctattgtggcaacagctgaaggcatggaccgtaaacaattgcagtaagcaacctgcacatgggcagggattaggcgttgcccattctccggtttcacgtctcacacgccactgttgccattttcacttgctagcagcctagcactactatacttgagtctgaactatcttcatttgcttcactgctagtactacggttctaccggagatgcatcaaataacattgatgtatcatgaccattgatatatgatcctactcttgagcaggacaacaaaactgagatccacagtttccctttgaactattctcttgtgaaattcttgcgctccaaaccgggcaacaaatttaattcttcttcgaaagtaatattaatgctaattatcatctacgatatcttactactccccctgtccaaaaatataaatatttttaatacagtgctaagtcaaactttttaaattttgactattaatagcaaaaaattaaaaaagattaatcgtgtaaatttggtgttactatatttatcattaaacgaactatcataatatacaactttttgtatttaatacattttccttttgtaaatattgttggtcaaaatagtatctcggagaccatgtccaagtccaaaaatgcttatattttgcgacggagggagtataatgatatttggatggaaagaaagcgcttcgtaggtagcaaattactctccccgattagaaatatttgatgtgtagtgcaagattcgttcgtacttgtaaaagtttaaaacttttaaaaggttcagacaatattcggttaaaaatattcaaaccctgcaaagtttaaaacatttaaaagattcggacaagacttaagattttaaaaaggtttaatcaaatcttgtcctaagcgtctcaagtaccaaattacgcgaacacatgcagagcttaagtaccaaattacgcgaacacatgcagagttggtttcggtacaacattgaccgaaaatcattggtttaaccagtctttgataaattggtgggagcggttttttttataagaaaatggaaaaaagctactttccttcctccgttccagaatgtaagagtttctagcattacctgaattcacaaaaatataaataaatctagactcatatagaaaatctatacattgattaatgcataaatctagtagaaaaggaacggagggagtattgcacgtaccggcaatttttctttcagaaaacctacaccacggcatcccgtggagacgggatcccctcctcctacctcactcctctcccccaaatcatctggatcccctcctcctacctcactctcctcccccaaatcagacggcactgtagcctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcacttgaagcatgtgtggtggagagaagaggggaaacacgcgcgcgctcgctcgcctcgcctggctgggcaggcggcgcgcgtgcacgacgtacgcgtcgaatggtccgaaaaattggctcctcacccttgtgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtacagatcgtgcgggcgccctgatcaagcgacccttctctatataaaccgacctgccgtcttcacgcaacacacgtgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgttcgttcgtgacggctcgccttcctcttcgctcgcgtgtttcgtgccttcgtagacacctgcgaaaagtttcgaccaagtagccggtctttccgtcacctcggtacgtgttcaatatgttgcgcatatttgatctgttcatgttatactgtgtagtttacatgtgtagatttaatgatgcgttcatgctagttttcatctgtaatgtcatgatttatttatggaatagattaaatcattatatgtctataatctcaacatagccctccctgtcgtcgtcacccaccgctcgccggagccagcgaccaccgccgcggggaggcggcgatggcaaggagctcggcggcgggcgcggtgagtgagaaggagagcggaaacggggagcggtggagccgaaacggggtgcggctgcggcgacatccctccatggccaacagcaagtggatctgctacaacgtcgatgatgaaggcttccatggccggcggcaggggtgcgccgagcacgtcgtcgtccacagctggctgaggaggcatggtacaaggtaggcaccagatctgttgcctcctcatcctccaccgctgtccccaggcgacgagctcgccccgctgctcgacctccctgactccgcgactgctcctccttcctcctctctcctagggtatcacgctggtacccaggtttgatatctaggtacaagctcgatacccagataccaggtaccaggtattagccggtactagggtaccagggtaacaggtattagcctggtaaccaaggtgccaggtattagccgatactagagtatcaggtaccaggtaccagccggtacctaaggtaccaggtaccaagtattagccgatactagggtatcaggtaccaggtaccagctggtatctaaggtaccaggtaacagccggtaaccaaggtactagcagggtttcctttacaggcttaccacggggtacggtaatataaataccgcggtaacctccttaaattcaaataaatttaaaaaataatttaaatttttgataaattttgtacggttttgtacggtttttcacggttcccgcggttaccgcgcggtaaccgtgcttaccaccgcggtaaccgtgcttaccgccggggcgcggtaaccccggccccggtggtttgagaaaccgtgggtactagttattaaaattcttccgttgcaacggaatcccgttgtgtaggagttccctttttctttttccaaacggaaccgtttgccctgaaaattttccgcgtttcggcaagggaggacactgcccccagctgcaggggctccgcgtcgcgtcggtagtcagccacagacagccaagcctaccaaacccccacacgcaggtcgtcgtcgtctccacgcccgcacgcctcccctccaaaaacccacaggatccgagctaaagctaagcttagctaccacacagtggtggccgcgcactcctcctcctcctcgcactgcacacgccaacgggttacaagaacgagttggcacgcgagagccctgcagggaggaggaaggatgcacctgcacgcgaagacggactcggaggtgacgtcgagcatggcggcgtcgtcgccgccgcgggcggcctactacgtgcagtcgccgagccacgacgacggggagaacaagacggcggcgtcgtccttccactcctcccccgcggcgtcgccgccgcgctccctcggcaaccactcccgcgagtcctcctcctcccgcttctccgccgccaagtccggctcctcccgccgcaccgccgccgccgggggagacggcggcaaaggcggtgtcgcggctggccgcggcggcggaggtggtggtggtggtgggcggcgtagcccgtggatgaaggaggcggccatcgaggaggaaggcctgctgatggaggacgacgacgccgacggcggcggcggcggcggcggcgggttctcctccctcccgaggcggtggcgctatgcgctgggcttcgtcggcgccttcttcgcgctcttcttcttcttcgcgctcatcctctggggcgccagccacaaccagaagcccgtcgtctccatcaacgtaatgatatgcaaagctcgatcgatcgccattgaaatgcttgcaagaatcaaaccgatttttctctaacttgagagggtgatttgtttcgcatgcagagcatcacgttccacaacttcgtgatccaggcggggacggacgcgtcgctggtgccgacggagctgtcgacggtgaacgcgacggtgaggatgacgttccggaacacggggagcttcttcggcgtgcacgtcacggcggagcccctcacgctctactactaccagctcctcatggcctccggcaacgtaagccgcctctcaaaaccccatcttttagcttgcacccatcgattttgatctcttctgttcaatacagtagactagtttcttcttcacactgcatccgtagtcctagtaaaaagacactttttttaaacaatataaatcttaattagctgatgttttaagctgcaaagcagagctgtggcaaatattatggttatggccgagtttagttccaaactttttctaaaactttcaacttttccatcacatcaaaattttcctatacataaacttccaattttttcgtcacatcgttttaatttcaaccaaacttctaatttttgcatgaactaaacacaccctacgaatcttagctgctaagtttcagaagatgtgtgaaaatattcatgctaagtagatgccgggaggggataaaacctcagcattttgcagtaaaccatcctggtaggctgatactcttgttaaaagcgctatataatttatcacatgaaaaagaaaaatctcgatctcttgttcgtatttgtgaacaatggactacagctgcacattgaccaaaccaaactgtagcagttgtgataatgcctacacggcagcaccatggatgtagactagtactacttcacactgttgaaactagttcaacacattcagagaatctctgaaactctcaacatcatcttcaaacactagctgtcatccattcagtcaagttgcagcatcacacactccaaatttttcactaccttcattaattccaattaagaaaagagagagacaaaaaaaattgtcattgtggtccatccatccaaaactgatctgaaagtctgaaactttcttggcaaaaaacaccgagtgactgacaaaactgaaacattctcactcaggtgaagtacttctaccagtcgaggaagagctcgcggcacgtggcggtggcggtggtcggcgacaaggtgccgctgtacggcggcgggtcggggctgagcagcacgccggtgaagggcgcgccgccggcgccggtgccgctgcagctggcggtgcggttcaggtcgcgggcgttcgtgctgggcaagctggtgaagcccaagttcctgaccaacgtgcagtgcagcgtcaggctcgacgtcgccaagctcggcaagcccgtctccctcaacaaggcttgcagcctcgtctaatctaagctgcaatgccggcgagctagctgctcatcactgcgtcatcttcgaaatatcgtcttcttttttttcttcttcttgtttctttcttgtctgatatttacagtatattgtcactgcatactttgcgagttggttagtttggaaggagggtgaggagatcgatcaggttgtgtgtacagggaaattttgtcgcgaacattttgagatatcgaattttgggtggataataataattaatcacgccgttgccgttctttctttgttgctgagtttctccgaaatgttgtagcgtcaggtttttgtgaattgtgtgatgtgatgtgatgttcagacattcagttgtcacctgaaaatcttcttggaagtggtgggtgccgtgtagcccggcgttgcttccatttctgacgctctttgcctgttctgatcttctgttccagcacgacagcggccagatccagtacttaggccctgtttagatgggactaaaacttttgagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccaccttacttcctcccaaaataagtgcctcccaaaataagtgcagctatagttttccgtaccaaactttaatcattcgtcttatttgaaaattttttgaaaaaaaataaaaacataagtcacaaataaagtactattcatgttttatcatctcgtaacaataaaaatgctaattataaaaaaatttcaaataagtcgaacgattaaaattgagcgcggaaactaatggccgcacttattttgggacggaggtagtagaaaacttcccggatgatgaacgtttccatgttcagatttctgacgagatgaacgtttttgcaggctgctgctgatctgtgagctggcaatgctcgattgttgattcagattagatcatcagcttcaggtgctttgcaactgattactgctactgctactgtactttttactgccagatcttaataatcttatcgcggtgatcaacaagacagaatcttgttgacatcgagtagagccgttccactgtttccgtgcagatcgacgatcgagaatgggggta

SEQ ID NO: 23560 - DNA, 4889 bp, Oryza sativa
tttagttttggccgtggcatctactatctgaaagtgctttattgcaggtttgcagatgtactgcttcccttcagttcgcatatggagtaagtaatgcaaatgttatatgatccgaggttaattagttgtactaaatcatactttttctgtatcgcatcttgagaaaactttagtatggaaatgaaaaagactaacgtatttcttattaatatttaatagagaaatagtagtagtggattggttaagatattgaagagataaaacttatcgatttatgggagataaaagagtaaaaatcaacatgttttctaaaaggaggtgcttatactcattgttcattttttgcttaatttaagtggcaagagtactagtctgaattttggcaaaataagacaaaacaggctggatttagtactagtctgaattttggcaaaataagacaaaacaagctggatttccagcaccactacttcttaacaacgaacgctatgtccccagagttctgcagatttgtcggcattttttaacagatatatcacccattggaagtcaacgacagatgcattagtatttactactatattcctattataatgttagcaaatctgaagggaaatataataaagagaagagcgtgagcacgtctatgtattgtattggtgcgcaattcgatacaaccggctaacattttatcaaatataatcaaaacaatccatccagttctcccggcaaaaataaaaaataataaaatatagaaatttaaacaatcaaatatttaacaaaaatatgaagtgagcgtaacttaacgagttagtttccttatggtgaaaccaacccaccctaattcaagacctagatttgacgttggtgatctcatttacagttaattattctttttagtgataggcgacctacccgtaatggtttcgtcgatctcaagatacccaaacttctaaattgtacatttttgttaaatatttttatataaatttctttcaagcaatcattttttatttttaaattttataaaattaatattgaattaattatgtacttcctctattttataatataagactttctagcattgctatgaatgtggacaatgctagaaagacttatattatgaaacggagcaagtactattgattaatctcgttttatatgtcactaaaaattttagccgattagccaattcgaacatagctgaatttcaaggggtagaaacttgcatggttttatggattttgcagcccatatagcacctttcaagaaggcccagagagcttccacattgcttgtgtggcccagctccgtgccatggtcatcatggccttttttcttaaaggagactcaacaccatggaccatgtatcagaatgcatggaatattattattgtttaaatttcatacaacctcagatattattatggtttaaatttaacaaaatcataagagtttttatatgtgatacctcatcatgggtattataattttaagtttacgcaaaacatgccgttagcccatctcacttaacattgtatcaattttttaaaaaaattgattaacttgcatggctacaacatatgtacggtggattaaacaacccatgaattctggatataggtttacagctcatgtatatagtatattaaagaaaaactagttgatggtgtagttttttcaaaatgtaggaccaaaaacacctgtggttatatgcaacgggccaaaactcatatggttttatgcaatttgaattattataatatcttgattttttgtgaaatttatataaaaaaaataaatgacctttttttctctcagtttgccctccaacaaggagatgtaaagcagcttttcttatgctgaagattcctaggagcacgattgacatatatttcttagataatacgattgacatatatacctccttttctttttcatgatagctgtggcatatatgctacagttgggtattgtcatcaacacatttcatatgatcttgagagagaagaacaagaataaaaagccttttttttctatcattccctcacaatgaagattgtaaacatcttttcctgtatgctagtacctgggagcatggattgtaattgcacttgcacccattaccctatctttttcttttctttttgatgagatgcattaccttttctttttgatgatcataactatggcatgtactatattatagtacagtttgctagtgctgttagttaaccagatgggcccagacaaaagagagagaacacatcttgggcctaccctaccaccttctattcctttttccagttctttttatggcagaattgtcatggccaagacaaagaagataatctgagttggaagttgattcattacacaatcattcatgttctttgataacattggcatcaaattaaacctttttttggtgtggtgttcaggaatctttaataagctttcattaggttctttgaaacaaagtgatcgcctccttttctttccttctccatgccatatatctctggtctccatgacgagtagtaaaagagccgcacgcttgatccaccaaccggctatgagtaattgagcccaagaaagtactaatcatcactataatctctgcatcatgctgccaatgttgcttgcttgacatataatgatcatataataccaataattaatcaccattggaaaagtatttgccaggacaagcctaccttccaagccttggcaagtactttcttctgcttaatattcgagtttcatattataagttattttgggttttttctaaggtcaatattttattttgggttttcctaagccaatatttttaagtttgattaaatttatagaaaaacgtaacaacataatctctaacatcaaattagttttattaaatccaccgttgaatatatttttatagtaatatttattttgcgttggaaatgctactgtatttttctgtaaacctggttaaactcgaagatatttaacttaaaacaaacctgaaataacttataacatgaaatagagaggaagccacatttatgaagtttgatatatccaaatggcgacgagttggcgggaagcaagttcttgagtgcagtggagctgcaagatcgattatcagatggagtactcaaccgaaacttaatggaacaggatgagaataatgctagctacacgatatggtgtactaaactcaatgtttccagagattatcctgtctttgatgtgaagctcacatcaagcaagatcagtggtgcccccacaaacttttacagttttacctgatgattgctcattgctgcagaaatgtgcagggaattttctcatcattgatagttttcaggctagcgatcgtcgtcaggaactaaaatccggcacacggccctgaaggctgaattcagtttggcgtgcaacctgaactattattatctctgcaacaattttctccagtcattttcgtggctacagtcaccgtcagctttgcagtcaacccccggtcgtcttcctcgtctccatctccgtctgcggcggcggcgaggagagtgcgcgctgcgcatttgcggcggcgacggcgacatgcacgcgcgcggccgtggagcacgaggccggaaaggagcacggaatgggtggaggcaactcggcacaaagactgtgaagcagccaagcagcagcagctcagcccagcctgagtgcagcgtccaccaacacagcctgtgcttcttttttgctcttccctgctgcaatcagtttcatgtggtcatatcaccaattcatcaccaagataatatttatcccaaaagcaaaactttacctttcgaacagtggcattgcttgactcgccacagttttacacaacctattcttcattaattaacgagtacattattaaaaaaatgatattgcttttgtttttttgttataacagcgagagcaacttttacggtggtctaacattccaacaaacgtttctattataactagcaaaatatttcgaacagcaaccacaaactaaactgggccacgctgttcgtgatacgaaagcgaggataatttgctactactactagtatatgaaatggaggcacaccgaacacgatacgtccgtgcgaagcttagtgttcgaccctgtgaaaatgattgcaatgtcgacgaacatgcatgccacccatggatcacactggccatggcttattagctagtagctcactgtcttttcacttcctttttcttgctaaactattattatcatttatcttaagaagattcttaattagtgtagctttatgtcgatcgccttcgatcaaagagcgagctcaaataccatggcctccatcgatggacatggacgactccaatatgtatataatgtatccggtccattgccaccatcgccatgaacgagtgcaatccactcgtgtcatccactcactctcgttgctcttcttaagaggacgaagacgacgacgtcgaacacgaagacatcatgatggcatggaggagcttgtcgctggtggcgttcatggcggcggtggcggcggcggccgcggcggcgggcgatgaccggaggccgtacgtggtgcggatggacgtgtcggcgatgccggcgccgttcgcgacgcacgacgggtggtaccggtcggtgctctcgtcggcgtcggcgagggacgcggcggcggcgccggcggcggagcacctgtacacgtactcgcacgccatgaacgggttcagcgcggtgctgacggcgaggcaggtggaggagatccgccgggcggacgggcacgtcgccgtgttcccggagacgtacgcgcggctgcacaccacgcgcacgccggcgttcctcgggctcaacgccggcgccggcgcgtggccggcgt

SEQ ID NO: 23561 - DNA, 13575 bp, Oryza sativa
tccccctacgacaccaacgtcgtcgccatcggcgccttcgccgccgtgcggaggggcatcctcgtgacgtgctccgccggcaacgacggctccgacagctacaccgtcctcaacggcgcgccgtggatcaccaccgtcggcgcgtcgaccatcgacagggcgttcacccccaccgtgacgctcggcgccggcgccggcggcgcgaggagcatcgtcggcaggtcggtgtacccggggcgcgtgccggccggcgccgccgcgctctactacggccgcggcaaccggaccaaggagcggtgcgagtccggcagcctcagccgcaaggacgtccgcggcaagtacgtcttctgcaacgccggcgagggcggcatccacgagcagatgtacgaggtgcagagcaacggcggccgcggcgtgatcgcggcgagcaacatgaaggagatcatggacccgtcggactacgtcacgccggtggtgctggtcacgccctccgacggcgccgccatccagaggtacgcgacggcggcggcggcgcccagggcgagcgtgcggttcgccgggacggagctcggcgtcaagccggcgcccgccgtcgcctacttctcgtcgcgcgggccgagcccggtgagcccggcgatcctcaagccggacgtggtggcgcccggcgtggacatcctcgcggcgtgggtgcccaacaaggaggtgatggagctcgacggcggggagacgaagctgtacaccaactacatgctcgtctccggcacgtccatggcgtcgccgcacgtcgccggcgtggcggcgctgctccggtcggcgcacccggactggagcccggccgccgtccggtcggccatgatgacgacggcctacgtgaaggacaacgccgacgacgccgacctcgtcagcatgcccggaggctcgccggggacgccgctggactacggcagcggccatgtcagccccaaccaggccaccgaccccggcctcgtctacgacatcaccgccgacgactacgtcgccttcctctgcggcgagctccgctacaccagccgccaggtcgccgccatcgccggacaccgcgccggctgccccgccggcgccggagcagcaagccaccgcgacctcaactatccgtcgttcatggtcatcctcaacaaaaccaactcggccacacggacgttcaccaggacgctgaccaacgtcgccggctcgccggcgaagtacgccgtgtcggtgacggcgccggcggggatggcggtgaaggtgacgccggcgacgctgtccttcgccggcaagggcagcacgcaggggttcagtgtgacggtgcaggtcagccaggtgaagagatcaagagatggtgacaattacattggcaactatgggttcttgagctggaatgaggtcggaggccagcatgttgtcaggagccctatagtgtcagcatttgcccaatgagaagaacagatgttagcatagcaggatcaaaaataagagcatggaaatagaaaatgacactaaaacaaagtatactacatacaactaataatcatgatcaggaatataaagagtacatataatggaaagagagaaataattctcaccaggatactgatattgcacgtgtatttttgtactctctgcttctgaattctagttttgttactgttcttctcaacgtatcaaattatttacacaagggttacaaacagagcatcaataaggagcagcttgtaagatttatatacagcaacaaccttaaaagggaattacacctgatgcactacgtttcatgcagcaaaagattaaacagaagaggaaaatcctaataagtttttctaagctagaatgagcactactaaatagtctacatgcttcagcaagatgttatatgtattatatctcttatcaacattggggtctacaaattctgtaagcgggcaatcagcaggtgataattaaggatatccaagcaattcttccagagttacagcatattcttgagctatttccttgatcaactcctatgcactactgtagtcgaaggaaaatgagatgacatgaaaagcgattcaataggatatcattaacactaatccattcaatgttgaaggaatccaaatctattgtgtccttcactccacttagaccacttgctatgcacgagtgctcagtgctcactgttcagcatgaaaacattgaaaattcatggccatcttgttgctattgtgctaccaaaatcattgcaggtcagcattactggccaccattcctatacatagcataaaatcctattcattttgtattggtatgttaggtatacgatctttctgagctgaaaattgaaaaatacctgtagatgatcatcctcatatcaaagccatctgccaccaacttggaccttcgagctcatcatgtatgatcagttgctcaacttggcagccatgttgcttctgggagtcctaccaccttctgtccagagtcccacttagtattcagtcattgcatgaaccagcattctccaggctcagtagcagtctagcagcgcaggacggtaggagcactgatgagcagatcccaaataccagctctgaccaaattgcgagcttcagtaacaaggtatatcttttgttctcttctacttgtgaggaaggggaacagctcagaatatgagatgataccaagatttcgactcatcagtctgcagctaaaaatccatcaagtcattctacctgaaaagccttcacgccaacatcacagtatatctagtgatgacaatggcaattcacccagggactagaacggccatcaatcacatatgccagctatattaactatagttggttctctctgctatcaaagggttctacaaccagtattacctccaacaagtaaagtaattcactaagatatactctctgcagggtctacagccacaaacgtctaacccaccatgctgacttagccagaaaagagaaaaacaagcaccatgggttccaagcattgcctgacttacatcatttacaagtggaatgggatccatgctttacctgagtatcagcgcttgctgcctgagtgctagtacatgcttgcgggttgccactatcatcctgatatactcatatgcaatactaggatcccccctgcataagtaccgtggaatagtgcagatccatgtagaagcgctgggttcagaagcagctcaccagatcgcatgggttcctgagctgacccgaaggtagtatttcagaagcacaaatcctggtgcaaaaaaggctaacaaatataacctgagcagaagcaacaagtacacaagattgggcagaatagctctcttagaattctccatttaattttcatctttcaaaaacttcatctcttattctcaacaaatgcatcctcctgttttcaatctcttagaaaaccgacatggagtttcatatatagaacctatctgattgattaccatgggtttattttgccagttgattccagagataccgcagaggcacagattaacgagaaaaaaaatgtggaattaataaccacaaagtttaatagtgcataccttgtaaagctacttgaaagagaagtgacataccatatgagaagaaaaaccttcagctgattagctgcatctgcatgcataaatataactgtaagaattgtggaatctaaaataataccagatatctacagcttcaataaatagcactaaaaattaaattgataaaggtcataaaaaagcaaccaaacaacaccacataaagaagagtggaaaattaaggaaaatattagtctcctttcattcaaagatatttctaagggcttaaaaatatgctgccctgttacacatcgatgacaacaattatgcattacaatctttcaagggtaaaaggaaactcagtattctgttttctcagaagtacatcaatatttacatgttacactgcaatcgcctagcaaaatgatcacggatgctcctaggcaagaatcccatattctaaactctcagaagtccaactttaccttcaatactttctgcaatactcagtagtgattaatcaagacatcaagtatactggtacagtggaatataaatctgaaccagaacacactatgaagtatctagccgaattgatcattgctctgagtctgagatagatttctcaatggctctcacataaacagccttcggaagagtcccagtaatgctatgcgttttctctccatccttaaagagtaaaacagttggaatcctctcgatgctgtaagatgttgcgacttgtgggtaatcatcagtgtcaagcttatagcattttatccttccagcatattcttgtgcaatctcatcaacaattcggtggaccattctgcagggtccacaccatgaggcccaaaactcaataagcacaggtatatcactgcagatcacatattcattccaagaacatgccgtaattgttttggctgtacaaacaaacaaaacagagttgtaagataactcctctatatttgaacgtaaaactaaacaacaaatgatgttatatgtcacaacagttgctacactcaagtaactacaaaagatgctaaatataaccctgacactatccgcttgctgagagtaacagttgctatccagcagccctatgctcatgtaacaaagttaggaaaattgaacatcttaaaatgtgttgtagctactagtatttacggaggtgaatatgagccgagttaattggtttgcctcaatggtgcagtttgcaggaacagaagcagcggccaatatcctggaaatgaacaactgaacggtagagctgccgaaaactaagagcagccaaagaaagaataattgaagaattgaagtttagtgatatttcactacagctccaggattttttttcgaacgaaccggcactacagctccaggatcaatcatactttactagtaacgtgtttatttcaagctttcgacatgtatcaaggtttcaacttttctgtggtactgaactggctgacccatttcttgtacggttacactacccgaaaaaatggtatacccctacattgcattctctagcaagtaaaattaagctgcttccttacggcttctcccttgaagagtgcatccatcataccactgttcaactacattagactactacatggaactggaagcaatgaacatgagaattgtcactaatttgtcaaccacacaacacaccaaagggggcaagggcagttactacacgacaccctaaaggcagcagaaatttttggcacaagcaaacggttagcttcagggggagggggggggggtggatcatcatcaaccagcgaggaggcacactccctttacctccgcgaggagaatacgcgcagctcaccgtgcggatccggtgcgccgcccagcggcgccggcagcccggccaccggcgtgcggcggaggaggaggcgccgtacccggccctccgtcggccgggcgccgcgagcgccacgccgcggtagaggctccgcggcggcggcggcgcggggcaagcggtggcggtggcggccatggttgttggtgttggttttgggtggagactcgtgcgtgcgtgcgtggcggaggatgcgcggtaggtaggaaaatttacgaggcaaatccgcacgcgacgcgagcgagcgagcctagcgcttatgatgatgaggacgacgctgacttggaggtgattttggagtgtgatgcaattcactcaaaccttattatttcctccgtttttattatatttatcaatagttttaactttttttacaaaaaaaatatattaaagttaatcgattttataaaaatatatgatagtgatttgaccacaaagcaaatatgttatccaaatttacattgtttaatgaaactaatttggtctatcttaacaaagtttgactaagataaaagttaaaaagcgatatattgcatccctgtgtacaacaatgttcaactaggccttcacataacaattccattggaccatgtgtacctcatcattctcatccttcaaagaccaaaccggatgggcaaaaactcatctcgccctgcaatcccctgcatgactgaagatctgaaagttggtagggcaagaatgtctgaatctcctacattcttcagggaacaaggttctcgcagcaagcaacgcctccatatccaagaatctcacttacgtttgcacggtagaaatgatgaaaaaccaggagcttttcgcaaaaccttgatttgttcgtctcgagctgcccatgctgctgcgtcccggtgtatcgtaccatcagattcagagagagcacacttggtttcttgtctccctgatcaagactcatgaaatggaatggacacatgacgaacaccagagaacaaaaccgcataggcaacagctacaaagtcagagagaaaacactggaggatgccgtcctggaagatcttcatgttctgcacctgcagaaaatggttgtgctcatataaaacttttgcgacaaaatctgtaaaatggaaaaatgcatgtggtcatcggttcacatacacatctatatttgagtgcagaaagattatttttaaaacccattttttataaaactgagctcttcgtacaaaagtcaaccttcactaaaaaaaccaagtggagtaatttttttatgggataaaaaggcttagcgcccagcttttctgggaagctcaacgggattttttaaaaatatccggcatttgacacttgaaacaagacaataagatgacaccagctttgccacctcatcatcaaactacctatcagcacccaaaaaaaaagaaaactccatcatcaatatgtgactatgtgagcagtgttagatgctacaccaccagatgacaaaaaaaatccattcaaatgttttgtttggtagttcagactctctgaaaaagaaaaaaaactactccacaaaactgatgtttttcctattggattaacaactaactggagatcacccaacgttagaaataaagggctcgtatcctttaccataatgacatttttatcataggcattgacatataaagcaatatgaggatggaacctacatgccactgactgtaatgttagtgcaatatgcgatgtttagttcccaaacaaaaacttttcaccctgtcacatcgaatgtttggacacatacatagaatattaaatatagacaaaaaaaactaattacacagattgcgtgtaaattgcaagacgaatcttttaagtctaattacgccatgatttgacaatgtgatgcttcagtaaacatttagggcaaccacaatgtggggtcttaagcctctaaagtggtccttatacattgtgaaagtagtccatatagtagtctttagtatgaactacccatatgcataatgcctacccataagaataaaataggaattgtcagggttatggataccacatacctaatagtagttgactaaatctcggcagggcccaccacatatcatgtcctatacggaaacaacctgcggatgtaggaggagttccggataaggaaagacaaccggagttctacgtggaaacgataaggactactcggattgtatccatattggtttccctaattctacttggacaaagggactcctatgagtataaatacaaggccccctaggaggagaggggggacagacaatcaatacccaacacaatcgacatagaagccacaacatacaagccaacatactccaagacaagacgccggattttgacttcagggataggcatggctattcccctacggtgtctccggataccgtcaggagagacgaaagcgctatctctgatctcgccggacacggattcgaggagcaaggctaccctgttgtcgactacgagtcagaccttcagaccgccatgtcgacaacagttagataggctaccccacatattgtactggtgtgattatggtgaataaaaagcaacatcggcttagggctacctgaccgctcagggacccaaacctgtataaaaatcttcgtctccatctcttttacctcagtctcacatgacatacaacacatgacatacaattgagtgggacccaggctaatgccttctcttaccatatacattatagcaaacagtataactaatgccgggtcccaccttattacctaagtagacattatacattgagcatgcccttactaataacgatttacaggcgaaatttataatttattttgttattagactatgtttaatatgtgtcccgtatattcgatgttatatgcagaaactttacatccctatgactaaacagggccgcccatgattgtaaagcatcgtaattcgtaaatgaagtgaattggatcgagtgacccaggtgggccccacgcggcagcgacccaggctccagtctctactccacgtcgacggctcgttgacccccaccggctcgtgcgttggcggttttgtcggtttccccctctctctccctctccctctccccctcgccgcgctcgcctcgcgtacgtacgtacgtcacgtcacgtagccgcctgcctcgcctcgccccgcgccgcgtcgccaactcccccacatgccgccgcgccgccgcgctcccgagcaccacccacccgccacgcccgcgcccacgcgccaccagctacgaggcggaggcgtccccagtgtagcaccaccactatggcggcgcggcggaggcacgtggcggcgggggcgggggcgccggcgccggctgcgagggagtgggcggcggtgacagccggtggcggggctgcgtgggcgttgtcgccggtggaggaggtcggacgaagcaggagctgatgcggcggacggggctgccgccgtgggacctccgcgcgctcgacccggcgctgttgtcggcggcgtcggcgtggtagtgccgcccgtccgccatcacggggcgggaccgagccctcgtcgtcaacctggaccgcgcccgtgccgtcatcaccgcgtccgaggtgctcgtcccgtccccgcgcgaccccgccgtcgcgccgctcgtccgggagctccgcgcccgcctcgccctcgccgcctccccaacccccgcgccgtcgccgtcgccgccgcaggtgacacatgcatgccccccaccctaccttccttcttgcattgcatcgtacgtcttcttcttaagcaaaagctctgatctctcactccttttcttttcttttttgaaagcatggcatggcggtggggatggacgggagcatctcgccatcgcaggcgagccgcggcggcgaggaggccgccggcaacggcaaggatggagaagctctgggaggaggtgacaaggctctgccgttcgagttcagggcgctcgaggtgtgcgtcgagttcgcctgcaagtctctcgaacatgaggtgtgtgttcttctaccttgtctccatgctttttacctgcagtgctatctccatctccaattctccattcagaattggatggaaatgcaaccaatacctgatctttaagtgcagtgtagctatgcataacatgcattaaaaaaaaagagatttgaagagagatacatccctccaaacatttttcaagaagaaattataagcgtattgaaaattaaacacggaaccttggagttataaccacttactcattgctactgcactatcaattgcatctcaacatgcaatttgcttgggttgaatttaccatgaatagtgagtggctcaccaaactatgcaaaaagttatgcattgttgtatatttgtattaggtttgacattgtaattgtagacatatgttcaattcctatccacattgatttttctaggtatgtcatatgatcttttaacactcaactagacgtccactatcagtatcttgcacatgtatatgtctttccttgctttggtttatatcaccttcagaaggggaaaaaaagaagtggatttgtaccttgctacatttcgacaattctttagcggcatcccttctaatccaaccttttttattatatgaaaatgacttttgttcttctgccctgcaaacatgcttctccgattttcatggttgttgagatgatgctaagtatccatgccgtgccggtaacattcagtcatgtgtctcacccttttttacttcctgatagcactataacaatgtgaagacaaaattcatttctcgagcacattaaaacggtagtgtgtttagcaacttagcattcaggcaattctgcactgaaattgcagttcctaagaaaaatttgcttgatacatgattgcatcagacttgcacattggagaaagaggcatacccagctttagatgaactcacctccaaagtcagcaccctcaatcttgagcgtgtgaggcaaatcaagagccgactcgtcgcaatatctggcaaagttcaaaaggtcagcttcagtatatataccacaagcatatgtgaaactgaaattacttcctccgtttcacaatgtaagactttctagcattgctaatattcattaagatgttaataaatatagacatattaaattcattaacatctatatatatgtgggtaatgctagaaagtcttacattgtgaaacggagggagtaacatttatgtataccatggatcagatagtccattaggagtaattctgaagtgtttaagtaacattgccatgtgtatctcgtctgacaggtcagggatgaactggaacacttgctggatgacgacatggacatggcagcattgcacctaacggagaagctcgcttaccagtcatcaagattcgacatcgataaagaagcaagcgagctcgaagatcacaggtaagaaatttttttcttccataggttgatgacacaagtcgatatgcttcatccaaccgttgtcaacatgctacagatgtgtcgtctgaatgtctgaagctctgaatgcagcagcagggatgaagaaggagtcgagggaggcggcggcggcgacggcgacgacgagacgatcgccggcggcggcagcttcagccccaacaccgacgagctggagatcctgctggagtcctacttcgtgcagatcgatggcaccctcaacagcctctccaccgtgagtagttcctctcgccgatgaacgtcaatcatatctggacgtccacccatttattgtatgtcaactaaattattataatttttttttaaaaaaattaataagataaatcaatatataatatatcattccacgaatatataagctatcaattgtaacaaaagtgacaaataaaactcaaattagcagttaaatttgtttttttttacaacttatagaagtagaatttacttctataatttaaacttatatgtttgtgaagtgatatattatttattaaactatatgttaatttttttataaacatttagtggacatgtaataaacgggtggacgtcccctagagtgattagaatccatctcgatttttttataaccactaaatgacctgcattaaacgggtagacatccgctcgagtcattaaaacagattcccctctctcgccattgctaacgaaggtgaaattaaccatctgaatttatctctctctctctcacggatgaaactgaagctgagggagtacgtggaggacacggaggactacatcaacatgatgctggacgagaagcagaaccagctgctgcagatggggatcctgctgtcgacggggacgctggtgtccagctgcgccatcgccgtcacgggggtcttcggcatcaacgtccacatctccctctacgactcccccgcctcctccgccgccttcccgtgcgccgccgccggcatcgtcgccggcagcctcgcgctctacctcgccgccctcctctgctacaagcgcgccggcatcctccagtgacgttattactagtactacatgtaaaagaaacattgtttttagtattaactgtgaccatgagtgattaagaacgagtaattatgcgtgtgatagtgtgattacggtgttctaggcctctttgtttatatttattattactacctctatcccataatataacccataaaaaatgcatggtcaaacttaacacggtcactaatactaatttttgtcttataatttctcatatattataataaggattatagtaataaaattataaccatatgaaagtaaatttaaatatcaattcaatgatataatttttagcaagtaaaattcaattcatactatacacaaaatattttgaagataaaatctcaaaatgtgaacacctaggatggagggagtagttttttttttaagtttactacttcctccgtcccaaaatataagaactttcggttagatgagacacatcctagtatgacgaatctggacgaacgcatgtccagattcatcgtgctgtactatgatgtgtctcatccaaccaaaacttcttatattttgggataaagggaatatgatttataagccgacgaatttaaaaccatgtggaatgacatctctatatttgactatcttacgctattttttttcaaactactactccctccgtaccaaaagaaaacttaacttatggagtttgaattttgtcccacaaaaaaccaacttctaccatactacctacccttagcaatgctttattacttcgataccatttacctattttaatgatgtggggtattttgatcatcttcactctttactactgttgcattgggatgttagggttggattttacatgggatagagaaagtaacttttagaaagtaatataaaaatgatttatggctttaaataagaaaatgctgtttatctgtttagatgacttttcggttcataataaaccgatttataagtctaagtctatacaaagagtattcagggttggtttggtttatggcttaaataggcattaccaaattttgtcagtgccaaattttgacaagttttggcatgattaattttggtaaggcaaagttgtgtttggattgaagccaaaatatgctaagtttactattgaaatggcctattttcttaggcatgtcaaatttcgggttcaaaccaaatagacactaacactattgaaattgtcaaatattgataagtctaatttagacctcaaaccaaaccaacccttggtgtacaggagcttaatgatgaacactctcactgacaaccctggcccagacgtgtgtgccccaactgtcagtgtgtcaccaacaacccagcatctacggccccacgtgtacattccatttttctcctgagcgcagcgatgacgacgaccaggagctgaggagcagcaaaaaagaaaaaaaaatcgattagttcacgcaaaacccaaaaacgaaaaaaaaaaaatcttcattgagtgttaactacggaaaatatctgacgaattcgtcgcgaaatttcgtcctctttttttcgtcagaaacgaactaagcagcggggatctcgggatagcgaatccccagaaactcgttcggactcgatctcgctcccctccgatggtccgtctcccggctgccggcggcgacggcgacggcggcggcgactgcggcggcgtcctcaacctgacc

SEQ ID NO: 23562 - DNA, 2629 bp, Oryza sativa
acctggtgacgaagggcgtgctgccgccggcctccctgcagcgccgcggcgtcggcggcgggggatgggtccagctccagcctccgcccccgccacctccgccgccgcagggaaccctggcgttctatggtgcccagaatggccggcggcggttggatgatgatgatgatggtaatcctaacccccgctcgcggcggaaccgcggtggtgagaacaataatgatgacagtagtagtagctacaatggtagagggaagaggaaattcggtgcttacagtaggcattcggattgggggagggacaaggggaggagtagggggaattcggatagccggagttacgatgatgaggatgatgacgggcctcctggttataggagagagcggcgaggtggtgggagatttgatgatgctgggagtagcatgtcgggggtggcagcgtctaagacggaggccatgggggagtcggagctggaggatactgggtcgaaggtgggctctagcagtaatttcaggaaggatgtcgatccgccacaagaagtggagggcgttgataagttgaataagattaatgaggagagtaatccatcaaattcagaggtggtggagcaaatgactaatggtgagagcactagtaataatgcttcttgtattgttattgatgaggaacagacgaaggcaaaatatttgcctgtgccctcagatgacaaggtttcagatgagaagcctgacgatagtagtgttttgaatgagaagattgaagatgacgagactttagctgagaaagctgaagatgataagacttctgatgagagggtaccaggtgtgaagaataacttgcgtgatgattgtaataatttgctgagctattgcagttatccaaatgtaccgacaaggcggcgatcaatagttgcacacaggaatgcagcaccagcccatagggaagttgctgttgccgaacagattgatctggtttcctctgaagatgaaacccatatggccactgatgttacagggcatggcagctccttgactaatacccaggaaggcaacaaagatggccttgcctgcttggaacataccgatacaagcactacttgcaatcagatggtggagccagtaagattccagacagaggaaacacagattggaactgatgatttgagaggacagaaaaacattgagcaacattatgcagttcacgaatctagggaggagaatatgttacctcctaaagtgggtgttcagcagcaagttgaggaaggaatgcagatttacaatgttgatacaccgccacaagatgaagacttgattgcttcagctgataaagagaaagtagctggtgtggcattattacctagtatcaaagctgaagctgttgttgcgaaggaagaggacaagtttggtcagtcaagttcatttaaaatatgtgatctaaacctagttggtagtccagaggttgctgaattacgaaatgatcctggtttgggtcaattctcaactgctggatgttcaatggagccacaaaatcagcaacaagagtttagaaatacgggtaacagtgcagatgataccaacatgcatgcccaaattccattgcacaataaggtggttcaagttattgatcttgaagatgactcgccaattgaagctggtgcatgtgatacttcaaaagcaaagtgagttccttccacctccctcttatttgctatgtcattctgcttttatatgagtataattttttcttttggtattacggtttgatgatacagtacctagccttaaaggcttgtcccagactagttactattaggcaaccagttttgtgtagccagcgatgaatggtagctggcccagacgctcagcaatacaaaaatacaggggtgactgccttcttccagtcgctgcacaaggagaatgagtctaggcctttgctgtcttcttattgttgttgcttttcatgttctgtaggagtggcagctgatcttgctgcctaatcagcagacttgctgtcaatctttgtactcttcgctctgatcttaataaaatttctctgtcatctttatggctagcctgactaaaacagtatttgtacataatgcaccgacaaccatctaatttccacatccaacctatgcattagtttatttctgtttattttctcttcatttatttatccattgtggctgctaactacatacctttaattgtgtatgctagagaggaaaacatggcaaaccctgctgtgaccacagatgttcttcctggtatccaagatggatataattttgcgatttcagattatcttggtgctgatataccatgctaccaaccaatgcaaacagatcttcccaatgggatgagcctaaatgattcagaggtgaggttttctgatattgttatacatcatgtggaggcttaataataggaaaatagattcaccactatccagtaccagtagtgacatttgaggatttgtgaccatatgtttgcttgacatgcgtagacacatatagtcaccataagttcataatactgttttttttccatgagtaagagattccttacactttttttcctcctgttgcagggcattactgtcatggatgattcaatatatggttctctta

SEQ ID NO: 23563 - DNA, 1972 bp, Oryza sativa
ctgcagccctgtgtgtctttgcaagtgtctgcaattgtgaacacattgtaaactacaaatttcacatgaaatggaaatatataataatatttatttcaaaagtaacgtaaaattaaagtgtgtcagtactagcgaatcctcgcaataatgaaaacatataccacacaagatttgggaccattaaatcgagcacaaaaacccatttatagagcatcctagctaccctcttcccctcatatctatcccctttccattgtactccccatacaccccttgtgccatgtctcaagaaggtcccaacaaccatcctcaaggcacccaagaaacccatgactgccccttcaccatcgccaccaacacaccgttaggctcgacaaagatgggctactccgactctagaaagtctgacgagaataatacctcgtcaaagccagcaagtccagtggtgtctagtgatgttgtagagatcaaggaaacatgggaaaatgttgtcgttgcggatgaagagggggaaggtggcgaggatggcttcgctagcgatgctagtgaatctaagtccaagagctcatctgatgaagttgattatgagctcttggatcttttggcaggtgcaagtgaaggatgcagcggaggaaacaacaacgatgaagtgaaaaactttgcctatgcagaccacaagatgcatgttttgagagagagggagagaaggaaggagatgaaaaacaagtttgagattctgcatgccctcatccccaacctcccagaaaaggtaggatttacaatcctatgggtttgcatacaaataaatcatttaagtatgtttgagatacttacaattttattttttttcctggcttgattagaaattctagatatgtaaataaaagagtatgtgcgatgtatttgcatgtttgttttcttatgacttgattaaattatctgttgttctctgacttcattaaataatctagatttacatagatagattatgttgtgttaattgctagattgtttttattgtttgatgtacagagatagaatatcctttttctattttgcaagggatagagaggtttgagctggccataacttttaggtgacaacagttagaattactttagatgtgtaccgtggtctatgacatggtgtttgagtgatggaatggtttttttcttgttatacaaactatactgccgtgtcatgttcaactacattttagtaacttttgattagatctatccataatccaaatcaaaatcgacatattgcttgcacattcacatatttatgttactaagatgttgtttaaattacttgtattggatttatggatgtatgtactaacttgaatgtcatcatatttattaagataagtaaaacccatgactagtccatagagttacacgtgatgttactaaggtccatgaacatacaaaatgcacatttagctcggttatcttggtttaatccatcacaacaggctcaaacctcgcgcggttgactatatgactggccacttggcgcttcacgctggcaagatttttgcgttcgctgccgttcgctccctccgaagcacaacgcggcagtaaatttgcattgaccgatcaattgattgttgttgctattgttgatgttgttgttgccgttgttgttgttgttgttattgttgttgttgttgttgttgttgttgttgttgttgttacttttatgcatgtagactgacaaggccactatagtggaggcgaccataaactatatcaagaacctccaagacaaaatccataagatggagatgctcaaggtggagcgcgagcatgccatcgctctcgccaccgccgcaaccgccaccgccgctgcctctgcggacaccgcgctgcaggcaccgccgccgtcggaggaggagaatgaggagcacgactccgtggtggctgcagcgacgagggagatggccctggctgacatggtgcacgcc

SEQ ID NO: 23564 - DNA, 2490 bp, Oryza sativa
cgcgcacacacacccacaaatgggtcacctaacataggcttggaaaaaccaaaacctatagcacatccttgatcttactaaatttatgttgaatgcacacctatatgtgcgtaatattcgtggacaacatgatttaaaccctagtgggtggagttttctatgaattaatctaaccaaccaaatttgatgtgtttaaaagcaaaatctgcattacagcatgtacatacatatatgcatatccctacaaaagcaaattaaacttgcggatagaacatggatgcatataacctgatgatcatgttgcagactgacaaggcctccattgttggggaggccattggctacatcaagacgttggaggacgtcgtccagaagctggagaccatcaagacggagcgcgtgcgcgcgcaccagtgggcggcggcggcggcagccgccgtggcagccaacggcggcggcgaggggtcctctcactctcactctcagccgccgcgccacgccaccgccgtcacagtcgccgtcgccgagcctgcgccggtggcggcggcggtgaacgcgcaggcgccgcagaagaaggcggcggcggcggcggcgccgacgctgcagacgtggtcggcgccgaacatcacgctgacgatggccggcgtggacgcgttcatcaacatgtgcctcccgcggcagagggcgtccttcaccacggtggcgttcgtcctggagaagcaccagatcgacgtcgtcacctccaccatctccgccgaccatgacaagagcttgttcagcgtccatgtccgcgtaagtgccattagctcaccgacgataatctcttccaaaatatactccccccgtttcacaatgtaagtcattctagcatttcgcacattcatattgatgttaatgaatttagacatatatatttatctagattcattaacatcgagataaatgtggaaaatattagaatgacttacattgtgaaacggaggaagtagttaacttctggctactttttagacaagcatttgtccagatgcatagtcagaacagaagttgttatagtttaggatggatgcagcatttgttcggatacatagatataataatataagttatatgtaatgtgagtaatttgttcattttgcttgtgtggttaagcagctcaacgaagcatcccttcagagcacagagggtctgacgcctgaagccaaatacaagctcgcagtgtcagagttgatggtcaggctcgccgaatgagacgaatttgatcgtcctgaatttgctgtcccccttgctactctcatcgaggattcgtactctcagcatttggaataactaaaaccagtctttgctttcagtttagtcgttgaacttgttactttttggataattcggttaaagtttccgaacataagtacaccaccaggaggtaaaagtgtaaaatccgttgatgttgtcgtcgtcgttgttggagttatagacatgttacttgaataatatagtgttgtttcttgatacatttttttttgaacgactcgcacgagacggtacgaagttctattgatagagcaggaaaaaattacaagatcacaaccctaaagggtcgtaaccaggaaaaaggaaaaatataccaccacccacacaccgacagctccaacacacaagaccgggagaaggctaacaccggaccggccgccgctaagcttgaccgactgccgctagaccaacaaagaaacatagatgagatcgcccaaaagaacaccctcacaaccaatacaaagccaactcctagagtgtgcttgcaccaatcgatcgagaggcttcggctaggggataccaaaacgacgtattcaagaagagaagcgatggtaaaccaccgccgccatccgtcggggctcaaaggagccaggactgggctttcgcccggcaaccacccttgagggatgagacagcacgacaacaccctcaagagggggaattccatcgttgtcggtccggccatggccaggctgggttttcacccgctgctcaccaccggcgaatccacggctgacgcaccaatgctcccaccacccctcaacctctgccgacatgtgggacccctgcaccggcgccccctactggctagccttcgagcgccgaagaccgcgtcacatccatcagcagctcctcgaaccgaggtcgcctccactgccggccgcgcctctcgcgtcaagccggcctcctccaccggatgcgcctctcgcgccaatccggcctccctccatcggccgcgcctctcgcgccaagccggcctccatctcctccgcccgcgcctctcgcgccgagccggcctccgctgccatcggttgcgcctctctgcgccaagccggtctccaacccctcctccaaacgctgccgcgccggctagatgcaatcgtctcctacaccctcggctagccgtccaaggccgccatacatcctgccacctcaaccacggtgatcaccaccatgcct

SEQ ID NO: 23565 - DNA, 4112 bp, Oryza sativa
accgccgtcgccatcgccgccaccggggctgtggacctccgccgcctgccgtcgccccgggaggaccggaaccggcctcacccctaggccttcgccttcgccacatccgtccacagcagcgcgcatccatcgcctccttccggccgccgtcgccgcgaggctcgccgtcgcttggcccctggatgcggggaggccggatccgccgccaggggaggcggatccacctccggcgtggccggattcgccgcgacgacccctcggcgccgcctcccgcgccgctgaccgccgctcgctgttgctcggccctggacacggaggggccagatccgctgccgggggagacggatccgcctccggcgtggccggatccgccacgccaaccccccggcgccgcctcccgcgccgcggaccgccgctcccgagcagccccggtgtccccgccgctggcttcctcgaggaggggagagggccccgccaccgccgtccttgtggccggtcggctttgccgacgcgccgctcgggcggtggcgaggcaaaggggaggagaagggaggaggcggcggaggaggatgaggcgccgtccgtgccgcccctgggacgggagcgacgcggatgggagcgatggaaaatgatgaggtgtttcttgatacatatgatacatgctcctatcataccattgagctgggggtaaaatttacttgtctatggttagatgttgaaattagtttcttttgcagaaggtaacaaacatagccacaagtaagctagccttcagcttgacactccaagggatcccatagcttcccttgccccacactatccctcttacaaacgggaagaagcacagcaccagccacccacaacacatgaattcgccgatacccggggcacagggcacaccttccgctgtcccgaaagctaccctacatgctccgacagtgaccgcaacgatgtttaacatcgcaagtgccgtcacggggatgaacaccggcaatgagtcgaaggtgaacctcccagggtcagcaccatcggtgttgtcatcgtcatcagacatgcttttgtccttgccggtgacctcaaaaacagtttcggagaggcctaaggacttgaggagcacggtaagaaatgctagtgtccaggcagagaccgagatgatccgttgcatcctatgattgttccaccatgcacgggcggagagcccgcacgccatgtactccatgaagttgtatgtgttataggatatgaatagggctaacgggacgctgaaaccatcttctgatgcctacaggataccaagagtataatagttcatccatatcactctctagccaaccaattgaaaagtacttgaaaaatataaggaatgtattaatgagtggcatgcaaatgattacctttggcaagaaggattggtttgtgagtatgcaataaggtcccaacaatccatagcatagctcaaaaggcgctctcagaggccacccaaggacgatcaggtaggcaagacattgccggaatttgaggcgcttgaacatggttgcgagaattgggttgttccggctgatgattatctcagattggccagttgcccatctcttgaactgagttaggcaggctggtcctccaatcggcgcggagcccatgaatgcgggtggttcggttaccatcaatacggatctccaacccatcgcgtgtatccgctgtccggtcaatatgtcttctgttagtgatccatagacccaaccaacctgattagaatatgagggatgaattgtatgagacttgcagaaaagtgtactgcactgtagcataacctacaaaaatatggcaatggaagttgtctttacctcctgtccccaacatgtgccaatatcatagttgcaagctgaaactgcttttgccacttcaatgcgacttgatatatcaaccattggcttagaggacagatcccaaatgatgtttcttgctgattcgttcaattcctctgagtttccaaacctggtatgaagctccttataagacgatgaacctgaagaattatgccaggtctctcaatttaagggtgtgagatggcatgattgatgtactcctaacaatcacatcagtgtatgcccaatttcacctatggtatcttctctctcggctccattgaagttcggtggcacgccataaactgctttcctacggtgaaagcagccggttccagcataaaaggcaccctgaactccttgaaccccactgataaatctctaaacatgacacaagatcagtttaacttatttggaatattagtggggttaataagcagcatagaacgggatacggattaatgaagaaacattttgtgcatagtaaattcagatttgatcagacaactcattttccatatataagcaaatgtacagccaagcacgacagctactccctccggttctataattcttgacgtttattttaaaaggttgatttcaaacaatcagaacattaaccatcgatagattaatactccaacatacagatgaaggcagaaatactagctactagcattgatcatcagtacactagctatgtaccttgaaaaaacactccatctggttcccaaatggatcgtccttgagggcgtcgtagaatctctgcggcgcctggacgaacccgctgctggcctcgtcgtcgaaccccagcagcaggcacatcgcatggaggacggcctggggattgttcacaaacatgtcgcagtccatgttcagcatgatcggtgcgttggtcatcacagctgacaccctcgtctgcacagagagagagagaaaaaaatgctttgtcactgcagattctacttcggttttcattagcatattttttaaaacggctaaacggtgtgtttcatgcgaaaactttctatatcagaattgctctaaaatatcaggtaagtccattttttaagtttaaaataattaaaactcaattaataatgtagtaatgagtttctcgttttacatgcccatatagcatgtttttaaaactggaaaactttctatatcgaaattgctttaaaatatcagataaatctattttttaagtttaaaatatttaaaactcaattaacaatgtagtaataactttctcatttcgcatgttcatacttaatcttcatcttcaataatttcgaacggggcttagtgagcagagaagttcatgtatcacgatgaggtaaaaaaatgccgaagagctagctattgccatcgaccttgacgatggtggggtgattcctcctctcgacgttcaagaactcggcgaagaactcgccgccgccgtgccggaggagggagcgctcgtcggtgttcttgatgcgccgcactaacttgtcatactcatcctatatatgaaattgatcaaacaagaaaatggccataaacataagatcatcggaacatgacgctgtgttccggattatttagatgacatgtaagaaactcgagaatattgacttttccaagtatagttgattgaccttcatgaatgtccagtcgtccaagaacttgcgatcggccgggccgccggactccggcgaggaggaggaggagaagtaccggaacggggccctgacggcgacgccgtaccggcggcagaagggcacccacgcggcggcgaacccggcggcctcccgcagcgcgtggcacgtcagcggcgagcacccgtcgtcggagacgtagcaggccagccgctcgccggcgcgcgggtagtcgagggcgagcagcgagagcaccgtgttcaccgtcaccagcggcggctccagcgccgggtccgccgtcgtcaccagcatgtccaccgccggcagctcgccgtactccgccgccgtcgtcgacggcgtcctgccctccgccacgaggttctccggccgcgtgacgaaccggacggggctccacttggcgctcacgttgagcgcgcacagcgccgcgaaccacgcctcgcacacgagcgccacgcgccacacgccggcgtcgcccccggcgccgccgtggtggcgaagcaacccggagggcgaggagggcgaggaggaggaggaggacggcgaggccggccagccgccacgcccacgccgcgcgccgccgaggggc

SEQ ID NO: 23566 - DNA, 8294 bp, Oryza sativa
  unsure (1)..(8294): unsure at all n locations
tcctcccggacctcgtcccctcgccgccgccgccgcctgatctggtggtggaaccggtggccgccgccgccgccaccaccgccattgacggatcgatcgagcgacgaagcgatcgagccatgcgtcgagcgagcaacgcacgcggcaaccgcacacgcgcgcccacgccgcggcgcgcgcgtaggcgtagctagcgagcgagtacgtttcttggtttctcccattattatctactatagtattaaaaacgaaaaaaaatcattgtcttctcctcactccacgcacgcatcgcgggggcacgacgagagtatcgttttcttcaacacttctattttccaacatgcatgtgtttattctatcaccagtaaagtgtgtcgtcggtccttaactttgtttgttgagatttccagctactgtttccggtttgcaccgaccgttttagtcagtaacgataatcgacggtggtggaaatagaaacggtaatatcttccggaaatgggatggaggtttttccgaatgttttgtcggtaaccgtatttgtatggtaatttccgtcaaaattctaaaaaaattccgaaagttcctcggtggctcagttagcccaatccatcggatgcctatgaatgacggaagcctaataggcttgcagcccataaaaaaggggaagtgaccagggaaaatgttgttaaccctatgacgtggtatgttgatttcgtgaattttggtctcctcaatttatcgatgttaaagtattgtcgaattttgtttatattgttcgtcaaacttattatcgtatcattaatcatcatataacggtgtcacgtgcagagcgatgatgcaacaataaagttaaaaagtcatcttcgtgcatagttaaatgtgtgctatgccacactctgctaattccgatataattttcgacttccaaccaatatcggtatattccgttctgaattgttccgtttccgatataccgatattactgatatcgttaccgttttcggatctaccgttctgattctgttttcgagaaaaaaatatgaaaaagaaaatggtatagggtttttccaaccatcttcatccctaatatatatttttgaactctgaaaatacattttcagatctacaaatttattaaagcgtgtcatttcggtcctaagttatcatgaccactctagtatcctaagtgacgttgcttcgcatacgagcgccacgtgccacacggtgccggcgtgccacggtgccgcagagatgacttcgccaccaccgtcattgccggatcgatcaagctacatgcggcaaaggcacacgccgcgtgcgtgtagctagtcacatactttgcaccggtggcgtggcacatgcagaagcagctagcgtcgtatagtactggacacggtttttatctatccatgtaaacgtccacccaacctacgggccgttggatggatcataagatttggaatgtggtcctgagatcctaggtaccgatcgaattcattgggggagtacatgtgtacacacgaatcatgtggacatccacctaagtagataaaagactacctcgtatagtactcgaacatacggtgcactatgggggaccaaatcaatgggccaaaaaggaaagagaaatggccagtcttccacacatgtaaaacaaagttgacttattagcacatgattaattaagtattaccctaaaaaatttaaaaatatattaatatcattttccgaaagcaactttactactccctccttcccaaattgatcatcatgtaatagaatttaaaatttctcaaattgataatcatataactgcatggacacgaatttcatcggaatacaattaatataatatgcgagaatgtgtgcatgctacggtgtaattggcatagggttttaattgatgcatgcattgtgagagattgtgtgcatggtgtcttgattgatgtgatttaaatggttcttggtcttggtacataaacttatatgatgatcaatttgggaaggagggagtataggagatggaatagaatttcaaccgaatacacggtcaccaaccaaatactcttatatttctccaggggcacatcaataatacacatagcgggaacaacattttcccctcacaaacaaaacttagcctaatctctaatgccacatcaacattgcaaatcatcatccaatcaatttatacattttcattcacttccctgcatgaaaaaacatgccgaaactgaatatcccacagtcgtggcgggttttcgtcgaattggaatcctcgatgcggcgaattgagaaaaggtcagcagcggtggtggcagtgtcaccgctgtgatatcacggtgagggaaggaatgtatgaggctagaggctatggacccggtggcgacatcgcgcccgcatctccatgatgaaacaaatgaggacggtatagactatagaggcactcatcaagaggtggtggtgacacctcatcgagggacagaaggggttggggattgatgtattctatctagcaattggttagcccaatcgtacccatatgtaaccaaaagttatttagattgatacctgatacctggtggtacgttcttaagaatggaaaagcactcgtatttttataataatgtacttgtaggtattcggaataaagaattactctttgtttggaacttagggtctcatcgtttgccctagaaagaattagttgttaccaaaatttaaattttgaaaattaattgtggggttcattttagggtattttcaatatagttgttttcagcattggcttttaagtcgcaaatgacacatatgaaagcttttacctataaattatattttaatctctaataagttgttttagtatataatcagctcttaaccaaccgatgacgctcttagtggttgaactgctatcttatagaactcagttatgtttaccaacaacaccaccagctgaaagtgaaatactccatatgtttatagttgtcgtcatttgctaaatggaattacaaacatattgctcaaataatacatacatgaaacatgttaagctgactatgcttacatgctgaaactaatttctattggagcagaacaggaacaaggccaccagcaaactagccttcagcttgacactccatgggataccatagcttcccttgcccactagccctctcacaaatggcaataagcacagtagcagccatccacaagacatgaattcacttatacccggaccaccaggcacgtcttctgttgtcccaaaaactgccctccatgtaccaattgtgattgcaacaatgttcaacattgtcagcgccgtaacggggatgaacactggtgatgcgtcaaaggtgaatctctccgggtcaacctcatcgttttggccattgccatccgatgtgctcttctccttacgggtgacctcgaacacagtctcggagaggcctatggtcttgaggagcacagtaaaaaatgctagtagccatgcagaggctgaaatgatccgttgcattctgtggttgttccaccaggcacgtacagagagcccacattccatgtactccacgaagttgtatgtattataggtcaagaatagtgctaatgtgatgttgaaacaattttctgatgcctataggaacaagatattactgcatcacttctctgctcccaaccaattggaagtactaaaagaattgttcatgaatatgtaaaagttctacaaatatttgtactacaaaaactaattaatacttacaattatataagcaatgtaaagataagtatggagagagtacctttgacaagaaggattgatttgtgagtaggcaataaggaaccaacaattcatagcatagctcaacaaatcccctcacagcccacacataaagagtcaggtacgcaaggcattgtcggaattggagatgcttgaatatgctcagaaggagtgggttattctggcttatgagtatctcaaacaaacccgttgcccatctcttgaactgggttaggcaagctggtccacccgttggtgcgcagcccaagaatgctggtggttcggtttccaactttgcagatctccaacctgctgcatggatccgctgcccagtcaaaatgtcttcggtcattgatccataggcccaaccaacctgtagatatatggaatgacttgctatgaagcttgtttaaaagtgtagtgcattgtagcataacctacaaaaatatgacaaatgaaagttgtctatacctccagaccccaatgtgtgccactctcatagttgcaggaagaaacttcttttgcaaccctccaatgttgagcctctggaataaaattaaaaattttncnnccctattggctcaccggacatatccccagaaatgatgtacccagccgattcccttcaactcctctgaactttcaaacttgaactgaagctccttgtaagatggcgcgacctagagaagcaaattgaaaagtctcgcgatttagttctactagaaatataagaccaatgtgctcctgataagtgataaccatcacatcactgtgtatgctccaacttcacctgcggggccctcttttcctaccacaatggagtctggttcgatgccgtaaatggcttttctacagtggaagcaacccgttccaccataaaataagccctaaatccctgcaaccccgctagaagtttctgaacacacgtactgcaaaattagtctagttttttttctatagatagaaatctagcatctatattcagaagtggatatatagtgtagttttaattgttactttcaattgggttacacaaagatgtactttcaaactttcactataagaatggataagtgttatcattaattagtactccctccgtttattcacaatgtaagtcattctagcattttccacattcatatttatgttaatgaatctagacatatatatctatctagattcattaaacatcaatatgaatgtggaaaatgctaaaatgacttacattgtgaaacggaggaagtacttcatatgtttcatatgacaagtcgctttgacttttttagtaaaatatttttaagtttaatcaaatttatagaaaaaatatagtaatactttttaaggcaaacaaacatatttgtaaaatatattcaatgttatatataatgaaatgaatttagtgtaatttgatgttatagatattgttaattttttttctagctataaatttggtcaaaactaaagaagattgatgaggaaaaaaaatcaaagcagtttataatatgaaacggagggaggaatacactggtagatgtattataacggacaaccacttgtgtacgcacgtaccttgtaaataacctccagcttgttcccgaaaggatcgtccttgaggtcgccgtagaaactctgcggcacctgaacgaacccgctggagatctcgtcgtcgaaccccagcagcaggcacatcgcgtggaggacgacctggggatcgttcgcgaacatgtcgcagtccacgttcagcatgatcggtgcgttggtcatcacggctgacaccctcgtctgcacacacaagagagagaaatgtacacatgttttcagtactaacgcacatctctgggctcgatctgaatctgactcccattacatgtcgatcgagctaacagtagatatcagtgcactgatcgagctagtaccagggcgttcatggcgccggccttgtagtgatggtggtgtccggggctcttctcccttgagacgtatatgagatgcgggaaccctccttcttcgcctatcctgttcttgctgttattatcccatataacctgatgatgatctccccgatatgagaagttcatgtcatgagagacaagaaagatttgatgtagttctgacatgatcagtttgaaagctagccatgtggggaatcgaccttgacaatggcgcggtggttcgtcctcttggcgtccatgaactcggcgaactcgccgccgccttgccgcagaagggtggtctcgtcggcgtcctcgatccgacggactagcttgtcgtactcactctagaattatacacaatcaatatgccgttaaagattaaagtgctaaagagattcgataatttaacacgttttaaaatgtgttttgattatttaacattttggacattttcatttactcagatggccccacatgttattctcacaagtatcaattaaaataattgggaaacgaaagaagtgttaaattataaaatttctctgtgtaagctgtggttatttctttttctcctttgtcattttggatgttagcatgttctcactctggtcataatatgtgttgttttcgaattcgtgtagtaatatatgtttaaactttgaccgtcaaattctatttgaacgtttcggttctacttttgaatgttgtatggttaattagatttgtcctgaataaaagtttcaaaatgttatattaacttgtatgtatcttttataagttttatacttagtaatagtaactgataattaatagtcaaactagtgtcccagtgactatgtcgttgtttagcacatcacgttgtgatacgctaaaaaaatagttagcacagttgtgcacctagcataccaacagggacgaatctggaccttggggcctcgcgtagctctattcttgacccataatgttatgggctagctcaattaaacctgatccgcccctaaatttatttagaataaatttcacagaaccccacgttattggggtatctattaacttcagttattgtgatttgttttaagaaatctcatattttagagtaagatatttcaaaaaaaaacctatatttatgtaaatactcatatttcattattacattattgtttttttaataaattcacattgttggctcaaaatacacatttctcttatctagtttaattgttttttcaacttttcaccgcatacaaaactcaccataatcataaccgataataataaatgataaagcagataacgtgtatatatatgtattttaaaaaagatctcaaacatttttatacaattaatatagataaatatattagtcggatagacgatataagcttgtagctgagtttcatgaaacactttgcccctaaaacttgaggtttcatgaaacaaattgtaaaacccgggttttgcattaaggatgccccataaccttcgattctgtgaaatttatttccctctatttcaggttataatacgtcttgactttggtcaaagtcaaagtatttcaagcttaactaagtttatagacaaatataacaatatttataatactaaattagtttaatcaaatcaataattgaatatattttcttaataaatttgttttgggttgaaaatgttagagcaaggataatagtatagctcactttctactattagtccatcttaaagctaatatatataatagattagctataagattagttataattttcttctcctctatctatctctcacttatatatttaatgtatttatcttgaaacttgtgttaagctagctcttgtattagaatcaatactcttgattttttttttgttacctctctcctccacgtaagcttatagtagacttatagctcattattatacttgctcttactattttttttttcaacaaacttggtcaaacttaaagcaatttaattttaactaaagttaaaacgtcttgtaacctaaaaactttggggagtatttacttatccagggatagcataaagccttaccttcatgaatgtccaatcgtctaagaacttccggtcggccgggccgaactccggcgcggaggcgaagtaccggaagggggccctgacggcgacgccgtgccgccggcagaagggcacccacgtcctcgcgaacccggcggcctcccgcagcgcgtagtacgtcaccggcgagcacccgtcgtcagagacgtagcaggccagccttcgccgccgccggcgccgccgccgcccgggtagtagtcgacggcgagcagcgagagcaccttgttcaccgtcaccaccggcggctcgagcgccgggtccgccgtcgtcacgaacatgtcgaccgccggcagctcgtcgatcctgcatcaaagcacactgtctccgcatgagatcgagatggccggagatgcacgacgactttctaggacgatgggcggcgccacaccttccggcgaggttctccgggtaggtgtcgaaccgggcggggctccacttggcgttcatgttgagcagccacacgaacgcgaaccacgcctcg

SEQ ID NO: 23567 - DNA, 5511 bp, Oryza sativa
actcgagaagtcgagctagaagcagagctgcacgtctctcctctccatatttataccggcgtagctagcaccttcaatcaaatatcaatggcagccatgggtttctctggttgctcttgctcgatcgctggcgtttgtcgcgtctccacgggcgccgtcgatgaaccgccgcgtgacgacgtcgcgtcgagagagaacggccggccggccgagatcaatcatcgatgtcgagtaataattaatttctcttggggcgatctgcacggcctgcatgcatggcgtcacatcgtctggcctagctctaaaacgtagcgatccgatgaccagaaaacgagcagtaattactgagggagatggattagctgcgacatccccttatctcttactcccttcctccgtcatattttaagttatgttctgacgactttctatgtccattgtataattgttcgtcttatttaaaaaatttattaaaagatttagaaaaacaagtcacacataaataatattcatggtttatcacctaataacaataaaaagactaatcttaaaaaattaaaataaaatgaattgtcaaacgttgaacgcaaaaactcgcaactgcacttaagattaggggtggaatcgagccgagccaggcttggctcggcttggctcgtgaaagcttgacaaagaagaggatcggcttggcttggcttgattaatgaaacgagctaaaatagcagctcggcttggctcgtttcaaagctcgagccaactcgagccagcttggttcagatacaggcaatgaggtgatggacggcatcaacgccgtagaggacggaggcggtagaccggcggcgctgggaatggaggcgacaggctggcgacgctgtagatgagggaggccgcggaccggcggcgttggccgctagggatggaggcagtgccataggggagggaggcggcggaccgacagtgtagcggagggaagaggcgccacaggggaggaaggagacggtgcagcgcagcgcctcgatgtcctcatgcggtcgctgcggactcgcggtctcgcgtagtgggaaggggagaagacggctgcctacgcgtggggtgggtgggagactgggagaataggttaggaacttagggtttttgatgggccttgggccacaacagcgacaataatgtgctaggccatttttatgcaaaaagcttgacgagctgaacgagcgggttgcgagctagcttgggctcagctcgatttagaaacgagctgcgtaggcggcttgagcttggctcgtttaggtttcaagccgagccgagcttttgcgagctcgaaccaagcccgagcctgctcacgagcccgagctttttgtccacccctacttaagatgttatagagtgggtatatgccatctaaatagttattatttctttaaaacagattaatgagaaatgtatcactccacaaacatgtaggatcaaattcgacttctacaagttgtaacaaaaataataaattaaattgcgtacattcacggttatatatatttattttttttacgacttatacaagttcaatttgaattcgcatatttatgaaaggttatatttcatattaatttatcttgttaaaaagaatttcaatttttgtaactatttaggtgaaacaaggggatatcttctcgagagatgaaaacacttttccattgttgagtggtcataatgcgaaaccccgtagttcatgcgccgatcgagatgtgatcgtctaatcgagatgtgtggtgttgaaccggtgtgatgcttcttgatgcttcatccatagacaaattgcacgaactgttggaattattacgtggaatatttcaacatttatttttgtagtgtagtcagtttggaagtattgtgtgatagggaataactgatgcacaatgtaacatgagaaaattgttactcgtcgagggtgactgtgtgcacaatgtaacatgagaaattgatactggagatatccagggcgactatgttggaatatagtagatgaattacttgagatacactctactacaataattgtcgtacacatacgtgtttttttccctcgtcacagggtgaaatagatgtgtttgtttacaaaatcggctctattataagctgttgaccaacatgatcatattgaaattaatcttatatacaatatgatcatgatacatgactcacatatgtgtgctagggacttaggtcctgtttgattcagcttagaattattataatatgaattattaagagtaaactgaaacaaacagatagcttattgtgatagtttattataatctataagctagattactgtaatctggtaatccactctaaaggtgcttttttaaattattaggtggctaacagctaacaaacaactaataatccagagaaacaaacaactaacagtttattctatgtaggcttattataatccagcttatagtaatctggcttaataatcttaagctgaaacaaacaggggcttagtcatataactgaactgtctgatcatggttggtgacatggttataagaagtctaatggtctatcgaaaacatttatagtgtatgtatatatgtgtgtgtggaagtggggtccataaatatatcgctaccctctactaacctcataatgtattatgagcggtccacgaaattgatctagaattaaaagcctaacatgaaccaacatcatccaaattttggttgactcaagcaggtaaatatactagctttaggttatgtacaaatcgactcgatggctgagctttttcacgcacctaaaacgagcatagctattactttcttaagaaacttctatatgaaaagtcgaatgaaataaacggtcggtccttaaatttggaccagagcatcacatagatcgtaaatgaggaagtactccagcgcataataagttgtttaattaaaacatagccagtacaggtagccactacaggaatcctggattacatcgggataatagtataatacattagagcatggtgatgtcaggtaaattctaacagtactagcttgtcgggaaatcaaattaggcctggtttagtttaaaaaaaaattattttcgtgatgtgacacccaaaaattttcttttagtgaactaaacaaggtcttagcttggcatggctctgtcataacaaataatcctaacggtgttaaccgtcacaataaatttttccttcatatcatctacaccgtcgggtcgtttattccaatctcaatgacttgtaatacgcatttaatcaatagtctcacgtacggaacttaaattcaaatggatctaatataactatgggaccgtataattatacgttcaaagcgtaaatatctttagaatataatggacgtacgtagcaatacataggatactctccacagaaatttttcctaaaagggaaaaagaaagagtaaattgcatccacggtgcatcaacttggctgatggatgcaatttggtaaaaatgagcgttctagtgcaacaacttgcaatgtaggtgcaatttagtataagaactttataagtgatcgtataaatacaacaacttgcaagataggtacgattttgatacaataaattaaaaagttatgcgacaacttaattattttgagcattttttaataaaaattcaatttgtaagtactaattttgacaatatactagcgcaaatttgtataagtatatttatatttttatcctaataactaaaaactgaaagccaattaaactagatgtagaaattattatatttggttgatatttgagaaggtgaagaaaacaaaaaaaatcttaaaggtaattggatgtaaactgtattactatgtgcagtataattcttaaagattaaattcaatattataaggtaatattcatatgatttttttaaattcaataccttataatattaaattcaatattataaggtaatattataaggtaaaaacattgtgaaaaaaaaactcacctttcatatgcttagcaaagttgatgcaccaaaatactaaattgttaagttcttgtactagaacgcacccacttgtcaagttgttgcactcggacgttcaattctcaagttcatgcactatatcgcacccacctactaaatttgtatcgtgggtgtaatttacttaataaataatgtatagacgtagcaagctgcagcgttggtatccatgtatctctccgagatctctggcgtagcgactacttctgttatcgggcgttcggacatatgcatatatggctgtgtgtacaatcgatcgatcgacagaagcgatcacctcggtgtggacgtctggatgtggtcacgccgcatcttggatggacgtttgtgtttctgtgtgtgtataaaggttttataccgaatgtttctatgtgtacttattttagatgtaaacaaaaatagaaaaaaaatcgaatctgacggaacgtggggctcctcaccgggagaccgcgcaggcccccctttgccggttcggccgggggcgctaagtgagattctttgccctcgatctgtggaatgttcgcgagagagagaatgcacgagacacggacgatgtagacaggttcgggccgctgagaaacgtaataccctactcctgtgttctggtggatctatatatgaaggagttacagagagctggagagcaagagagtttaggctatagaacctctcctcctctttctctcctctagagctcccctatttttgttcttttcttccttccccctttcttttttttcttttctcccttcctctttttttggtgggcaaggtcctccttttatatctcaaggggataccacatgcaccacttctacctactcttctttttggtggggacccaccctatcttgaccaaaatcacagcttgtccttgagtgaggcccagcgccgtcactcgcctgacacaggggatacccctgtcattcctccattaatgggcggagatttgcaatggccgctgtccgaatgaccctccgatgggatgggtcatacctacttccactccgccggaagcagatgcaatgtgggagcacggttgtctgccgatgacgtaaccggcgtcagaccagtcacagaccggtcattcttgtccaccacgcgtcagtttagcatgccgcacgtctgtccttcttcatacaatgacttccttgcaatggttgcgatgaagcctagaatgaatctggctgggactgacgtgccaactccaggagttcccacgccggctccggctagggacgagtgcctggaggctctcattattccgacgggacggggcgaggcgagtgaaaaggccgcctgctgccacctaacccacgatctgaccggtctgtgaccggtcatacgctgcgaccggtcacggaccggataagcgtgcgctgcgctgcattaaatgcagcgtggcgcgctcgtataacccgctataaatgcgggtaggtgagcgccgctgtgctcacctaacccacacacgtg

SEQ ID NO: 23568 - DNA, 4137 bp, Oryza sativa
ccgacccctcggggagacagagggtggggtgtccacgtcaccctcgggcccaacccccctgagggggtcaggccacgtgggtgagggcggctgcccaagcctctagtcacgatactcccggtcccatgtcaccaacagaatctaattcataggagtgatgtgaccatggctaccacggatacaaccattgctcacatcatggatgaacaagaagatatcgagatcaagtactccaagtgctgaaatccgattcggccacctactacactgctgacttcaaacggccaccgaatctgcatacgacctccgttttcggcccgtgagtacttgatggaaagctctcggagccctctttctaacggatccagcctcttctctaaattccatctcgtgtggccggaatcacaggaacaaagtgatgcgtcacctataatgggcctatgggcttgtaacttcttttgggaccccgacccaggtggggcccatgtggggtgcgccccaagctggtggagcacgaccctaggcacccctaggtcatcctcccacccctatatatagctagttacctcttcagggtttctcgggttttgattaattgtaagtttagccattgctacttcgcttgcagcgcgcgtgtcggctagaccgtccgtctgcttgttcggaaccccactttatcgtgtatcaattcatctttgtgtgtcttgtctatctagcaattcagattgcttttatcttgttcttgcttgtttcttcgatttgcttgcaggaataaggttgatttgcaccggcaagatcaacaacccacagagaggtgtatcgatcgctaagacgcaacgcaacgtcttgtacggttgtagtcgggtcgtcaacgtttctcccaaatcgtagttattatcaactcaccgaaagatcaggccaacaacagccgtgagtgtcgagaggaactcagggttcatcaaggagtatcccttccccacctctccttcctctctttcctttttagggcgccggtagcagagaggacgggagagcggcggtcagccagagcaagggagggcaccgatggctcctcacctcttctctccctccctcctctctctctcccatcactggtgctctgagtccagctcgcctatgttggtagcctcgacgagaggctcgtgacggtagatgaggttcgtgtggcccttgcccattgcctccagaccgcgctcgaagtgggtgcgccaaggtcaacaaagccaagaatggtgcggaaggcaggggcttcgctcatcagcggggccatttgaggcaaggagcgcacaaaaggcgatgatcgccgctttttaatacaccattctacacgaggccgggagggcagcgatggcaaagtggggaccgcgccatccagctccttgttatcgtcgctgcctcctcgattgccgtagcatggaggagagtaggtggcgacaaagtagcaacaatagcaaaagctcgacagccaaggaagtcaccatgggaccccgtgtagattggcaactatggtgttgactgaagaatcgattcgggtactgcaagaacccatacctctactatcatgcaaactctgtcctcaatgtatcctcttgcgtgcacggacgggtgaccgagcacgatctcgtgcaggactcatccggctactggtgccactgcttccctttgtactgggataggcagtcgtgcggggcaaagaggcaaccgttttttttatttttagtttcttttgtcacttacatgtgggtcccacatgtacttttaaatttcttcacgactaagttgtcacgtggacatcaaatcagcaaaaaggcaccatcaataccatcaaggaagctattttacacgattttagtagttgaaggagccattatatccggttttacggttgaaggatacgactcatatgatccgacctatatttgagggaatccaattggactttcccaacagaatatacacgctatatcatacatgggctttggaatgggctcggtctaacttggactccgtgcgtgcacatgggctcttacccgttgtgggcctaatatactcatgttcatgggccatctgatcatcaagaagtcatcggaccaggagtccaggataaagggcttctttggcatgcaatcaggtactacgaccattctacaatggctggcccctttacccggtaaattagcatgcatgggcgatccatgggtagagcgacaaaatatgtagtgaaaattaagaaactatgatctgaaaattgttcgtgtcatgaagagtaatggttaaatttgcgagtaaaatttatactcgtgatgacgtagataaatcttagacatattttatttaacgaaagttttcaggttttcattttattcgtgatttgcattacatatttttcccggctagagtagtgcaccatccatgaacgaccgtgccatcatggtccattatccatgtggactagctgaaggctgaagcagtagtgttggagtatcttttttgcctacttgtttgcaggagttattgaaacctacatacgcttccaagatcaatgtccaattattagacatcgaaggacacgaaaagattagtatatgtatggaagcatgcaccgaacatagtgcagatggccccatcgttttggctcattcatcaaataaaccaaacgacatatttacaaataaaaaataatttattaataaaacttttatatacgtgttcttagcgttttaaaaccaaatactgaaaaataaacttcgttgaaaaaaaatcccaaaatcaactgcaaatttatggttaaaatttaaattttggcttatatgcataattataagcgaaaagatgaaaaataaatgaaacaactaaaaataattataattgacttgtttatgctttaaaaatctactccatctttcaaaaaaaagtccaaattcatatcattggactttattttacaggaggagtaagtctgaaaaataacctatgaagaaaaaaattcaaaatcaacttaatttaaaattaagttttgaagtttaaattttagctacggtttgtaagccagtactccctccgtaaaaaaaaaccaacctgagaagtcacatgttgtttttttttttactgcagcagccggcggtactcccgcctccaggacgagatcacgcagcacaacaccaagatattagaatcctcgacctccgcgatttcagtttcttattttgcagaaattcaggctctaaaaaatcgaaagccacacatccagagttaaattttcgatcaaaaacctccacgaggtagatctccttgatatcgatcaaacgagtcctgtagtagtaaatttatttgtactttgtattggtgtattttcgttttgcgtctaacatgtaatcgcaaaaatattttatttttattatatatattataatagaaaacatagtgaaagatatattttgaaaaccatgatattattcaaaacgttaacaattatgaaagtgaagaaaataaaggatttacaaatatcacacgatgtacggttattggataactgtaataccgtcataccgtgaggcaacgataacccttatcaagacgacaagggaaaccatgctactaaccacttaaccagcaaccacctgtaaaaaaaaaaagcaaccaaaattttttaggatctctgttctttaaaaaaaggaataatcttgtagatatgatactacacctgttacatgtaatcatgcttgagtccacttgctgtactattgtagctgttgtaatgttaatgtatcaacagtaagcattaactaatcaacatggtccactgaactaggagtagtatagtatatcattaataagccatttgccgatcgcttcaaagaacaggggaatgacgcttgtgatctagcagtgcaaaggtagtactagcaatcagtggcttgtactattgggaccaagccaggtgtttcattcgtcacaacaggcaaaaaaaaatcgaagaaaacgaagtaaaatctccggataaattaagcgcacatctgtccactacctagcttacacgtgtccctttttcaacgtcgctctccagcttgattcttcgagcaagcaacccctccccaggtcgttcctatccggaaa

SEQ ID NO: 23569 - DNA, 1842 bp, Oryza sativa
cggcagtagtgcggcgcgatggaagggagggtggcgcgatagggatggaatgggaatgcagcctggatggatgagggtggcctctagggtttagtggtgtattaggcttattgggcctcctggacctattgggccacaattcagttttctcgattaattcagttaaccgagcctaataaccgaattacccgaataaatttcggtctttgacatgctgagaccaaattactacacgaatttctcggtctcggtcttttcggtctcggtcttttcggttcggttcttcggttcggtcttattttgcccacccctatatgtagctgaagaaactagtctagagagtagagacgaatggaaggggctggatggccacatgatgtacatgccagaagtacgtggagaaaaggccgtgcgaggtatgtcacacaaggacaggaaaatagaaggagcatggttactgacatccaatgaaatatatggtgtatgtgccaatgtgaaatcagggggcgatcacctaaatatgcatgaaaatgtcaaaaagggagacgataccatagatatgatctataatatgtgcatcgaatttgatatgtcagcctaatattcgacttaaaagtacttttaggataagtgttactttttcttactcttagatatatcttacatttttgcctttaaaaaatgatttttttttccagtgacgactaaacatgaacaccataagctccatggcaaatacacgatatgacatagcaaaaaggttaattcatccgtcccgtaataagtattaagctgcatgcatcgaccagttcaacccgaaagcttaagctgatgaggaaagacagacaattcattttatattccaacactccccctcacgcgaggcgccctcaatccagccaggattcgaactcgagacctttggctctgataccatattaagttgcatgcaccgaccagttgcacctaaaagcctaagctgatgaggaaaggcgggcaattcactttatattccaacaataagttcattttagctcattccgtttattccaaaataagtttatttttagagcaattattacatccgagtttgtgaaattagaaaataattatcttatcaggagtagataaagtgaggaatagttgcattgggatttgataaagtggagtttaatatttttattttgtattgatacgtgtaggataagtgaaagataaacttattttggaacagaggtggtaactaggtgtactacataatttgttgttcaaatttttactgtggagccaagcacaactcccattttatagtcttagtcgccctctcaagaagaaacaatattttgggatcctcttgacaaaatcctaatttgtgatggataaagaggaaagaaggatagtggaagcaccatgaatgctacagttgtttttgatgctggaatttgatgggttgcttttgaccattactcggacaaacttaattcatggtgaaagtgatatagcaaatgtgaaaaaaaaaacagagaggatcagtcctcgatagccatgaagactagcatgtttgtgccaagtcattcatcgacaccacacaagttgctatctctatctcaaaatgttactatctaattaatatatagaatgtaatatcacctagtattataaatataaacagaaaaagattcatccagattcaaatgaacatatatgtatataactcaagtgagtgctcttggctaactttttttttaatataataagttcccaacaattcctacggtggtgcatgcagtccatgtaagaaaaagtttgccttttgatccatttgcaaggcccctaccaaat

SEQ ID NO: 23570 - DNA, 6927 bp, Oryza sativa
ttatagctggctaatagcctgctattcgctcttagagtaagcccgtgccttttggctgcccacctggaccaatcggaaacagaaagggcaaaaaaaaactccccgaaaaaggtcggagtagttgtagctttcggtcttttgttcactttctctctcgttttcctttgacacaatttttaaactactgatggccctttgatttagagaagaaaaacatagaaattttgaaggattttaattctataaaaaattttcctatgaaaacctttaaaacaaaggattgaattctatgttatcatttaaaattcatataaaatggataatcctatagagattttggagaaaatttagcaagaactctaacctcttgaaaatttttcttcgagtctatctctctcatccgattcctatgtttttcatgagcttcaatcaaacggtcattcctatatttttcctatattttgcaattgcatttctattagaatcttgtggtttttctattcctctatgtttgtattcctacgattcaaatgggcgctaaacgatgtgtgttttaaaaaattaacgaaaaatacttttaaaaatcatattaattcatttatttttttagtaaatatttaattaattatgcgctaatgaacaatatcgttttccacgaaggaggtggagttcacctcccgaacacaaccttcgtcaggaagggagcggtgcagaaacggaaaccatgagaagaagcaggaggaaatttgttcctcgttcgatcctgacgaaatttgcccggaatccatttgaatccatgaggttttcaagtttcgggcgacagttttctgaaacttcgttgtctgaagcagtatttttgtagggctggcgattggtgcagggaaatagtagtggcaagggaaattttgccaggtttgtctagttctgaagtagtttgggacttgggatcaaggtgctataaattgcgagagctactggatgaaagtgacgatacatcgaacggtggcccagtgctgaaaaagggcgaaagcaaccagtagaagataggcaagggaatgaaacagccgatgtgtataatccccaagtggtccttgggtttgtgctgttgttcaatccaagtccttgaccacctagctttaacatgatttaaattcattggtgcaacttaaatataagctaggtggtgtccgtgttttgctgcgaaaattacaaagcaatcttcagaatgtttttttttccaacaatcaagctaggagtccaaacgatattagttattaacaataaattaaactggtttaccaagctatgtttggagagaaataaatttagtagattatataggagattgtagatgaaatgttatattgttggctaaaattcgcattgcaagaagcagaagatagaaaaaaattaatgaaacatcagggtttatcaataatgatcataaaacaaacaaatgatactcacactttgatacaaaatatattgacatgtatatgttttaagtattatgttgaaatattatggaaatgatgtgagtggtgatgaaaggatatgtttgcatgttgattaagggtgtgtttagttccacgctaaaattggaagtttgactaaaattgaaagtttgaagaaaaaagttaaaagtttatgtgcgtagaaaagttttgatgtgatggaaaagttgaaagtttgaagagaaaattgggaactaaactcagcctaatttgtagaattcaatagattgtagattatgttacatgcttacataaggtttgatatgtaattattattagtgaataatgatgtgacacggatacatgttgagtttagtatatgttaactatcctagcccctattatcaatggcccctatggcagcgtcccagtcagcatgaacagtcatacacatacgaggaattaacgagctgtagcttctgaacaggcacaatcttatctcattttaattcacttatatgcatatttttttgccatcacattgcaacgtccaaacttcaaacagtacgtggcaccaactaacagaggtgatgtgcatctcacccaaaaaagaaagtgagattgatgctttaaaattgaggccaaataattggattcgtcgtgatatagtcaaattctagaaactacttttaagccaaatggaacattcttagctccatcgtgcaaaacttggttcgtgttacatcaaacccttggacaaaaaatgttgaatttctcgtccatccagaactttataccttgagtaaactatgctcacaatacatatacttacgtggtgattataaataaatactcgtaagtatcaccttgtaaattgctagttctggtacaataacttatctaatccgtgcaagcgtgtgccgaaacaatcaagggaagcaaattaatttcatataacatggcgcaccctgataacgcctttgcatgctccggatgtttgtagttgtgtagacctgcgcacgctagtttaatttcagttttgtagaacttagcagttaacagtaataattttgttgcaatcttttgcaggtgcttccactactggagtacttttttaaaaaaaaaaaaacaaaacaactgctagcttgcattgctgatcaatttttcatgtgcgatttgttttgtatcaggttcacatggacgtactactatacgcaagttattctatccgaataatcaacttgtaagttgttgttgtacatattagcatccatcctgcaagttcattcgagtgtatgtattaacaagtacttgtctaaatctttagttagaaataaagtttgtgtgggagtgggacagagtaattactgccggtggtgtttgaatctcctgaagatgaatataaaaatgaagattaagtgttttacgtaaaacgagatagtaataacgtgtgattaattaagttttaattattacaaacttgaaaaatggattaatctgatattttagaaaaactttcatataaaaaattttcacacgaaacacactgtttagtggtttaaaaaacgtgccataaaaatccaaatcttaatccaacctttccagaggaaatgaacggggccgacacagaattatcctaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttataagtagtctatatttaatactctaaattagtgtctaaagacagggactaaagttaagtccctggatctaaacaccacctaagtactccgtgctggcagaaatgttaaatttatttatcactgacagcctaaaaacactacaagtataaataaggagtacatttaatagtattaaaagtactcgtatttatacaggaaatggaaaatgggcccagctgtcatcgtaggttttccttcggcgtacgcccgcgaatctcccgccgggtataaatagcggcccggaacccacccaaactcccaaattccaatccggtccctcgcctcgcctcgcgtctcctcctcctcctccttcccctccccgcctccaatttcttcctactcctcccgcctccccgcgaagcttccccacgcctcagccgccaatccagccctagtgtggcggcggcggcggcggcttctaaaagccctcctcttcccggactccaggatggcggcggtggcgggtagcgcgagcgcaggcgccaacggttcggcggcggcgcatcgggtgggggcgccgacgaaccccatggcgacggcgctgctcaccgatcagtaccagttctccatggcctacgcctactggaaggccggcaagcacgccgaccgagccgtgtgagcgctccctctccttctcctcctccttctccgacgtctctctctcgttggggccgcgccgattggattggatcgggaggcggcggtgatctaggggagagttggtgcgctgaggttgttggggttatggattgggagagagagagagagagagagacagagagagagagagaggtgggattttacggggagatttttcacctcctgcgattctcgcggtgtacatgattgcattctctcctcttgcggctgccaatccgatggtttcctcccacctcccgttctgttcagatcgttttatttttatttatttacttattttgttttcgtagagttgttttttttcttcaaagttcatattgtttttttttttttgctgagatgtagtactgatttagtgcacggtaatctggtggttaacctgtactgctctgagctggcaccctggttttttgcttcgggaagctctcccctccttgtgcagtttttaatcatctctgccttgtcactttgtcagaggtctaagattctcactatttctattgcatatactacttgaaatatgatgtcactattgttgaaacgatttaggaatagttgtgtgtggctctcctttttttttttgggtttatattcgtgtatttcttcaagttgtgtgttggacctttttaatgttgctttcagtggccgactttgtatttgctggaagccatttttcagtttgtaccggtttatttataatcgcgtaatgccaaagttggattcgagttgtctttcaattgtttggagtttgagcaattgagctggttccacgtgggccctcgatattatactctgttgataaacctggaatttaatattgtttatctcgacgtagttccaaagctggtgttccttgtgattatcggtgaagtacatatcaattacttcttgtgatgaaccacaacatacagcatgtcatacagccagcaccgtccatgagttttagtgtgtaggtggagcactttctatatggtgtaatgctatttaataacggttcagatggagccaaatggaatggaaaatctggatgattttaagtagatttaatgtgcttcgctacttgagtaaaccaatcagattgttggttcttgggtttcttattttaattgatttggctggttatctgttgtcttattcatttattttttaatataaaaagtgatgtgagtttgaggattcttgttcagaagctggaaggttacaaaacgtagcgtttttattgaaagaatattctgttagttacgctgaaatcttgagttcgcctctgagtcacacttttgtatatttgctgggaacaacatgaaaatgcaaaatttgggagttgtcaaaactacatatgaatattgatacaaaagagtcaactttggaataaagataatgttgctctatatttgtattgcatgtgataattgtctatgatgtctaatgatttttcctaaactaatggcatatatgtttctgaatcactacgctatgggacatgctttatggttatacttattactatcacatttttggataattatcctttgtttttttagttttgtgtgtgagagaggtggggtgtaatccaaaaaaacactaaagactaaggaacatgtcactgtgtgaaatgcatttttctcaagttctgtttttatggatttgagcatttctctggggtatgctatgtctttggttttaggtacttgggatttatgtcgactgattcagaatctaccaactaatttacagactcagaatctaccagctaatttatagattcagtagtaatgcagatgcattagctgattgtgtattccattggaacttgaaaagtactttggcataacacagaaccacttctcttcaagttactaaaagcagatttaatttaatgtgctagctctttagatatattgagttacctttttatgtccttttgatacagaaccacttcttttaagttactaaaaagcagtttgtctaaaaatgttgtatagagcaatcacatgtgttttttcgttgtgcactattagtgtaccgttaatcataaacactttttttgtctagttcatcttggaagttggaagtaatacttctctgttaaattattgactgaatggaccagtttcagtaaatgctgaactatggatggagagagcctatttctttagatacaaggcttgttttggatgggcattaggattaagaaggatatgaaaccaagagaaagtgaagacaaatgaccatgtgttaacacttaaatatcttgggaatgagtgagagagagagaatagctggtgaggctgaggacattacttataaatgtaggtcagagaagatgtgctaaatagaggtgttaaacatcaataaatttgcatgcgttccttatattttgtaaggatcttaagaaactatgggccttgtgttttgaaaagcagggaatgtaactagcatttcatacattggtcgacctcatgctgacctggttccatttctttttataggtttgatctgtacttcaggaaaaatccatttggtggagaattcactgtttttgctggtcttgaagaatgcattaagttcattgcaaattttaagttcacagaagatgacattttgttcctgcaatcagtcatgccaatgtgtgaggtaagctgttacataaaattatctttctgtcttaaagtggcatatggttctgatataagctgctatactatctaaaatcctattaatttgccatatttatagaaaggcttgttagcatagtctacaaaaacattgccatttcaaatgtcagatctttaatgtatcacttgttagttgtttgccatgataaatgttcatttactgatgtgatatgcgattctaggatgcgttctttgattatctca

SEQ ID NO: 23571 - DNA, 3221 bp, Oryza sativa
ttgttgaataacctgcacttgctttgtttttgatcctttgttagccatgctagttatttttatgctcactcctagcttgctgatctagtgagtttttcctgtctttgcttgatacttatctgaggtacatagataatcattttatcaacatagcaactatttttctttctgccattaacgtgtgatgtgcatgacagtttgtattatcccttgtatttgcaataatagagagttatattagatatcatacattctggagactttttctatttttataccacttgttgctagttgttgcatgagctaacaatcttttcaaccctttcagagccttgatgagatcccagacaagtccctcaagagcaaagatggttcaagagtctgcaaagattttgttagtttggtaaaagagtggcttcaaaagattcaggtatagctgtaaaacctcgtggcattgcttttacttgctacagtacccttatgttactattttgttggtttcagttagcagattcgttatgtggtgtatttggtgagacaaatcaaagtgagctggcagcatttgcatcctatgcattggcttttccgaccaattttctagctcttgtggacacatatgatgtaagttgttgcgatgttctttaatcattttattgttgagatgcatatatgagtgagtagttctgacccttttttctttttgaaacagaaagtaggtatggaacttcacatatcatactttgtcaataaacaacttgacaaaaatctcatatttgtcctttggagtcttccttttttatgctagcatttctcagtggcttcttttacaaaaaatcatttttctttgaacgttttgcaacctggattttacaaacagagatgcaaccagttttaagtgtgcaagtatttagacttgatgatgatgttcaactatggtgatttcgatgtcataattaatctggcactcctccaggatgcataaactctgaacaatcagtgtgtacatctgtagcctttgtttcatatcatttgatagtctgctgtgcgtagtgacatgcccttaccggtaccctgtaagtctgtaactctttagtggtgtgcagattttcaatgcatttatgccgcacatgtacgttctatgttctctagctttaactcaccaagttttccctttcaggttatgcgaagtggaattccaaacttctgtgcagtagcgctagcactccatgacttagggtaggtcaaatcaaacgtatccttggctactgtacatttgcattttgattgaagctcgattgaattggagcttatcttctcatggagatcttacatgacagtgtcttacagaaaatataaatgaagctaaagattaaggcaaagttcacccaatacaatccaatttaagatggtacaagtttatatcaaatttgtgttttccaaatctgaatcattctgatctatacttgcaaaataatctgtaatatcttagtaatctagacaccatcatactttgggcatataagatgccagttggttgcaaatttgtagtttttaacatgtgttcttattgtaacattagaaaacatataatgcatcatgtgcttattgttttctcattaaatatttgaatcatcaagttttataaagatgtcttattttgtagatcactgtctaataaaaaagaaaaatcttattttgtaggtacaaggcatctggtattagattagattctggtgatctggcctatttgtctattgaggcccgtaaagtgttccgtacactagaaaaggagtttaatgtgcccgcttttgggaagatgataattactgctagcaatgacctgaatgaggaaacaattgatgccctgaacaagcaggtaataaaattgccaagaacttcattgtggcatttatgttatctggcgcatttgtgtgtgctcctgtggactacagggcttgtttttatttccaatccttctaatatgatttaaatttctatttatttcagggccatgaagttgattcctttggtattggaacttatctagtaacatgttattcccaggctgctcttggctgtgtctttaagctagttgagataaacagtagacctcgtatcaaactttctgaggatgtggctaaagtgggtctattttttcttttcatgttgacaaagaatttcatttctttttgtttacttatagtgtcatgatgggttccaggtatccattccatgcaaaaagcgatgtttcagattgtatggaaaagaaggctaccccttagtagatatcatgatgcgtgaaagtgaaccatcaccgaaggtaactatgaatattgtccaaattatccctatttgttaccatgcaatgctgctgtcacttatatcctttgctgacccttttttatctacactaattattctcgattattaaactgatcttgtttacacctaacatttcaggctggagaacgaatcctttgtcgtcatccattccttgaatccaagagagcatatgttgtcccccagcatgttgaggagctcctacaatgctactggcctggtacatcaagtatgtatcgtggatctttctaaaaaatgataagttcttcagttgacatggctaattttgaattgtaaaggaactaatcagagttggtattctatcctactgcttattgtgcaacaattacatttgcatatgtgtccctttcagataaacctagggtagagttaccctctctagaggagatcagagggcgctgcatgcaacagcttgaaaaacttcgaccagatcacatcaggcggttaaatccaacaccttacaaggtttgtcttcgtttcaatctttctttccctttttgcttccttcagttcccttttttttttacaagatctttacttcgagcaggtgagtgtgagtgcaaagctgtatgagtttatccattccctatggttgaatgaggccccagtaggagagttacaatagatttctacagaagttgggaaaaacagagaagcgtattctttgaagcatagcaaaatagcaatacatcaaagaaaagtagagctctgttgtaaaaaaataaaaaaaatcgtcagttcatgggcccaaccttataggatttttgctccccaatttttattagtacaaactagttatcagtatagagataggccaacctatctgactgtacatccatgatccattgtactatacgtcg

SEQ ID NO: 23572 - DNA, 9911 bp, Oryza sativa
ttcccaactaccattgcattaacagagctgaacataggagtactggtcaggtatttaagtggagacaagttggcaaccatggtcatttgaccattccctcatttgccattattgccatcatagaaagaacaaaaaaagggaaaaatatctcctcatttgccaataataagtggaggcaagtaggtcgtctatttcatttcacccatatttagggccccctttgaatgcaaaaatagtggaatatgaaaaatgcaagattttaataggaatataagtacaaaacagaggattgcaaaatacagaaaaagcaaaggaaggaataggatgagagagatagattcaaaagaaaatttcttagaggtttgaagctcttgctaaattttctctagaatctctatagaattgtctatttcaatggaattttaaagaataacataggattaaatcctttgttttaaaggccttcataggaaatttttctataaaattgaaatcctccaaaattcttatgtttttcctccaaatcaaataagcccttaatgggtattgtgtaactgggaaatcaatggattttgcaagcgtacgggacctaattataaaaaataaaggttaaaaacatactcctcagcaacaaataccaagttgtacctcgctaagggctttcataatttaaatggttttaaaatgccatataacctacgggcactcattaaaaaaacaattctcccataatgcaagtggtatctttgatcggcctcatcttttcgtttatacttatacttatcagccaaaaaataaattttaaattggaagttagttttggagttttttcatcggagtttattttttaacttttgcttttagatcgttaagaacatatatataaaagttttattcacaagttatttttagtttgtaataggacatttcgcttattccccgaataccccgaataagtggaatgatgggaccggatatttcatatcagcctctagcataaaaataattctaccactcgccacgtcacagtgttgttcatcccctgaggccacgattgagaagccaaaaccgccacctaagccaggaactgtgcaagcaaccccctccacagtgcatgtgaccttccatctattatagtgggtcccaccactcttcattcctcttctctctccacctttccccaccgtcggacgaagcgagaggagaccaagatgtgccagcggggaatggagcagcgatgcgccggcggggaacgagcggcggcggcgcgacaccacgtgaggtcggcggcgggaggaggcggagcagcggcgtgacctcggtgccgccacgcggtgcctggaggtggcgctggccccgctgcccgccgggtcgctcctcccgctcaccgaggcccgggtgcggctgcgtctcgcggccctgctgctgcgttcccgctccaagggcttgccaccaccaagtcccacctcgagcgtgccttgctgctcccctcctcccagagctctggcgtggatatccggcgggcggagcgatggatccagcgacgacggagcagcttcagggcggccagatccagccgagcggcgatggagcggggcggagcagcggtgagggcgccgggcgaagcagcggtgagggcactgagcggagcagctgcgggcgatggcggctcgccggatctccttctctcttcagctcgcctgcgccaaatccctctcccctctcctcgtcggcgcctgctgttctgggcaacgacaactagcagcggggttgcggttgtgcggatgcctgacgaatcctggctattccctgacgaagaacgtgtgtcccattttggctccccgttcctcgcttggtcacggtagcgtctgacatggaggggaatcttggctgaggctgggtgaggctgaataccacctatgcgcactgtgaacgccctgagtcaccggcagcaggagcctccaacccaatgttggctttcctttttgtttgtgatgaagtagtagtatatggatgtactgtcaaccttgtactaatattttcgctgcagcttttgttaaagcaaaagccaagattttcccattatcgaaaaataaagcagcctccaaaccctgtacgggcaacggactgatgaatgtacgaacttctacagcgcagatatggactgtttcttctccctaggaacccacattgtcatcagtacatcgtttctgttttcaagggcatgtctactgcattagcattactactaaattaatagtggtactaccaaattcagcagctttttgtaggtaatgttggtatgattagtttaactgcttagaatatttatgattagccgttgaattgcgttcatgtactgtctacttccggggtttgtttgatataggtggatattagcttcgaactttatgaatgaatggacatggaagttgaattgatccacaacaacctgaatggattgaattaaaatccacaacaacatgaatggattgagctgaattgggttactcccatccacaagatcatgtcatgtttgcaatgattacaggttttatgtggtactcctatgattacaggttttatggagtagtatgcagtatcaatgttaaggtcctactcctatgtgaggtctgtaagttcaatagtactactactttgtgaagttgcttttcaacaaaatttctacaaaagaaaaaaaaatccataagcctacaaaagtgattagtgacaggagtaccattgtggcaaggagaaatgtgctagtacaagcctacaaatatgcaattaatttgcaacttctcttcaaggctataatggagggaaagcgtccacctaaaccgtatgcagataacaatacgtccttgcatcctgttggtacaatacacacaagttttgtgtagaggctgttggttactcatcatgcaccagcacacgtacacacacacacgtgagtcggtgagtactaaaataagattgaacacaagcttcagcttcaccattatccatagccgaaatttaaattttagaatttaatttaaagttaatttaatatttttattctagtttaattttcagcattggcttttaaatcagtagtaatacatatttaaatgttcacgtatggatttttttttgctaataagcctcagggtttataataagcaatttagcaccagctacactaatggtcaaaagaaagaaaaaagtaacttctagccgcacaagaatttagtcctattcaaagaataccacaaaaattttagagtaacaatgaatgccaaaactaatcatcaagtatatcaaaaatgttttcccgaataaaaaccctccatagtagtaaaaacattacaggatagctttatcgtgtaggtgttcacaataatattatgtctgaaatgaatcaaactttttccttgccctgtgctgattactgagaatatggatctaaccacaatgctcttcctccatagttcatggtggctactggctacccttggttaggttaatttcaaaacgaatcaaggtcgttccatagcctctggtctaaattattggatcccactgcatcaaaatcataactttgataaaacctatactttaaaatatattttctgtcttcatatataatatatttctaaaaagaaaccctttaattacaatgaaagacacaacacagtaggtgtgtgtagtgtgaaaaatatttccatggaagagaaaccctaatataatatgttctatttgttgtacagacatcaatacttaagtctaagggctcctttaatttggccaaaaatcatagaaattttgaagaactttaataagagctctatccttttggaaacttttttttaagtctatctatctcatcaaattcttatgtttttttctatgttccaatcaaacagtcatttctatttttttctatatttatatttttctatttctttgtttttttcattcctataattcaaagagcacttaaatgaaactctttccttgtcccatcccaattactaaaaatttccctagatgtagccacaaatccacaatgctcttcccatattgacacagctatgataggctcaaaataaatctaaggtttcatggatctggcggcaccgtgctgtccgctagctcacccaccgcagctcaagaagacctgcattcctcctcccccaaatcacccccatcaaaaatatcctaccagtattctgtattcccccatgcctcccttctcttctgacttgatttgtttattactgacgataatcttgacttctctgcctccaaatccgattctccacacatgcaaaaagaattaagaattgcatattgcatattgcagccttgcacttgcagttgcaaggcagctgctgctactacaccctgtcactcactcacacactctcatccctgcacacacacacacacacacacacacacacacagtggcagtacacactacagtacatgctgcagccagcagctacctatacactcactatcacttttgcaagagtgtactactccatctaataattgcatccttctcctctacatttctgattgatttcttttctccccctttgatttgttgtttgttgcttcttgtgctcctccctccaaagatcaccaccaccaccaccaccaccaaccacccacaccaccttcctttctctcctccctctaatcttctccccctctccccaccaagaaaaatccaggctttgtattagggaccagattaagcagagaaccaccaccttttgcctttttgcagtttgctgttttcacctcctcaaagagaagaagaagacactccaaattcttcaccccccacacaacacacattgtttcttcccaaaaatccaatcttttggttttgggcccaatttgtcctcctcttaaatcccacttttccatcactccattctgtcataaatcctctcctcttcccctctcaaagttccagcttttcccactaagaaaatccaatcttggccactccatttattcgctgagcaaatttccagccttttttgcgcccaattccattgggagatggagaagtagattttagcgcaaaaaaaatcaggtttttttggcacccgattttggttgggagagctcgccggagatccgccatttgaggtaaggcgaggagctctctctcccatgtcggactcggagctgtcgcagagcacggtggtgttcgggctccacctgtgggagctcgtcggcatcggcgtcggcgcggcgttcgtgctcctcctcgtcctcctctcgctgctctgcctcgtcgcctcacgccgccgccgccggcggcgaggggtcgccgtggcgacccccgtgctccacctcgccaccgccgtcgcgccgcccaagcaccccggcaagccgcccaaggacatccaggaggtgccctcccgcgccgccgccgccgccgcggcgcccaaggcgcagccggcgcaggtaatccaggcgccgccgccgcagccgccgccgtcggaatccatccagatcgagacgggcaaggagcaccgcatcacgttccgggagcagcagcatcacccgccgcagccgccgccctaccaccagcggagcgggggcccctcgtcgcccggcggcagcggggaaaaccgcggcggcggcggtggcggcggcggcggcggcgcggagcccggcgtgcccgaggtgtcccacctcgggtggggccactggtacacgctcaaggagctggaggacgcgacggccatgttcgccgacgagaaggtgatcggcgagggcggctacggcatcgtgtaccacggcgtgctcgaggacggcacgcaggtcgccgtcaagaacctgctcaacaacaggtagtacctaccactcttaccacctgctgctgctgctgctgctgcttcccatgaactcaagcataatagggcaaaatgcagcagcgtgcgtgtcgaattgggtctcttttttaagaatgcgtaggttcaaggttaagcattaaggaaaggcttgcttagtttcgtgagggcattaagcattacttgaatggagatgttgacaattgtagatggtgacatttttgctgagaacttgggtagtagagacgatcatgtcgtgttccgcactgaacattttcttatggttcacatgctctgtgtggaagctgtcgattttagaggccgaaatatatgtcgcgtgtgacgtgtgttggttcgttctagtgctctctctctgttgccaaatttagtaaaattttgatgcttgctttgttagggggcaggcagagagggagttcaaggttgaggtggaagcgattgggcgggtgcggcacaagaacctggttcggctgctgggatactgcgccgagggtaaccaaaggtaccttgaaatcaatggattctatgactgagtagcttgcaatgtataatattttctgtacgaatccttttcaggatgcttgtgtacgagtatgtcaataatggaaacttagagcaatggctccatggtgatgttggtcccgtaagccctctcacatgggatatgagaatgaagattatactaggaacagcaaaagggtatgcatctttcagttcattaccgtagactatagacatattggtaacattatttacattgtgcagcttaatgtatctgcatgagggacttgagccaaaggtggttcatcgtgatgtcaagtcgagcaacatcctccttgacaagacctggaatgctaagctttctgattttgggctagcaaagcttttgggctcagagaggagttatgtaacaaccagagttatggggacatttgggttagaaattagcacccttgtaatgtgataattgtacaagacacatgaatattttgcttatgcatcttttgttctttgcaggtacgtagctccagagtatgctggtactggcatgttaaatgaaactagtgatgtctatagttttggaattcttatcatggaaataatatctggtcgggtaccagtggattacaacagaccaccaggggaggttagttattgtttgccttgttataaggattctaaattaagatcttgtcgaatgcatctatgaaatcagcacattaatcctttcaggttaatcttgttgaatggctgaagacaatggtgagcaaccgaaactctgaaggggttttggatccaaagatgactgagaagcctacttctagggcactgaagaaggctttgttagtagctctgcgatgtgtagacccagaagcccgtaagaggccaaagattgggcatgtcattcacatgcttgaagttgatgattttccctacagagatgtaagttaacgtggcatgtggctccttttgtcttatgttcagtacccatcattttatatagtgaaaattgtgagcatcatttgcaatgcttgtgtggcccctaattcctctcgcacagttatttccaaggaaaaaatgacatcgtagtgaccatgttgagttctgtacacactatttagttttagattattataccaacccatttttgtttttcacatatttttgaatgtcaccttttggttcattgctgtattggtgactgtttttcttggacaacggaaaacatggttccaaaatcttcattccccaattttgaaatgccccatcattctccctgtaaattatgcatatgaatgacgtgttccaagtcagtctttaagaaatgaccaaaaaatatttattataatgtgcttaaattccatttttaatcttttctgaaaaacaaaaggcaggagctttgcctatatattagtagagcagggaaaaattccactttttagttgttgttatcgcactgaaatcgtgtacattataaacatatattgttgtcactccttttgccaggaacgtcgcggtggcaaagctccaggtcaagtgaaatcgggagaaataccgccagttgaagctggtgatagcagcgggaacaatacgccaaaagaaacaccaaaaggtcaaccgaaagatgaacctttcaagtggagaaatcaagcggcggcctagctattagcaagatggtgattcttctgaattcagtaagacgacgatttttctgaattcttacacctgatcaagaaaccgaatgccgcaaacttgcaaacagctcatttgctgctcgttagttgggttggggcacggaaacatggaacgcgccgagatcgtgagagcatctgtacattattgggttagtatgttagccatagcgattttttggttggtttatttggttatatttatgtactaagtgataattcttgtatgacaaattcatgttactcttgaggtaaaagttgatgagcggtgcttagataaaaccttccatgtagcaatatatcccccaaatgccagtttgctcatcagtcatcatacaatgctcagtttcttatacttttgagatccatacttgtcacctaaattgtgatgattcaatataccagactgaatcctcaggtgtgtgcccacatttctttttcctgtatgtaacaaaatgaaatgagcagcactacagtagtctgaattttgctgtttcatcaacctggagaagaaaaggaaaggcttggttgtcacatgatggagcctcaatgacctacctctggacactgatagcacacacaatcactcattatttagcaaagcttgataagccagcaagcttaattaagtagccactgattgattgccccccctgctactcagatcttctccagagactccagagtggcatccagctccaggcaagctcaccagcagcaagcaagaacccagacagacatgcagtgcctactactcctagtactccctcgtcccaaaataaatatagttttgtattgtttatatcaaacatttgaccgttcatcttatttgattttttttatgattagtaatttttattagatgataaaatataaataattctttatgtgtgactaattattttaaattattttataatttttttaaataaaacgaacagttaaacattggacacggatatgtacagctacacttattttgtaacggaggtagtagtactacctgactggaaatgcaggtgacagtcggttaacagatggcatccgggggcaagtagtattagcgtgaggtaatccggattagtagcagatgtgatgtgacacgaggcgacagcgaccaacaaacggaccaggctaggctacgttggatggtttttgcggatgatgaaaaggatctggatggacggtaggctggtggtggatagtggtagcagtagcagttgtaagctgggggccctagtgaaagctcagcttcgcctacgcctccggtggcggtggccgtaccgtccgtgatgccttctttccctcgtgtggccgccggccggcgccgacggcgagggggagttgctttccgggcatctgttgctgcatcattcctctttgtcgtgttcctctctagctcgagactgaggctgagttcgtttcagctttttgaaacactacttccttgttctctaacgaacatacttcctaaactactaaatgatattttttaaataaataaatataaattttaaatttatatactcgggtaattaattttatatttttaaaaggaagaattattttagtgtcgggtacttgggttgtactgacacttcaatgctgcagcttgtaaaagtctgaataacagagcggttttccatggtctgtgaataatgaatgaatagtatttgcttttaaaacccagttgttcctcaaaccatcattgaaatgtccgtggtttttttttcaacaaaaaatatatttcttccaaatatgaagctactagctatccagtttagagcttgtcggtaagtgggatttaagcaaagccacccattttagtttggtttta

SEQ ID NO: 23573 - DNA, 1152 bp, Oryza sativa
caaatctgacagacagaccttgcaaaggcccattaaagcacaattaactgggcctgaaaagcccagcccgtccactctgacgattctacccctctaaccctacaccggccagcgactatataaaagcggacccgtctcgagccgctagggttcttcgatttctccctcgcgccgccgcctcctcctcaccctccccgccccaggcgcaccctacgcttggagctcgtccgatccgctcggcgcccgccatggtaaacgcgcgaagctctgaatccatcctctgttcctcgcggtctcgcgtgcgtgccgtgctgcttgctggttgatgctaatctcctcactcgcgtttcgcctgtttgttgttgcagatcatcccgaagaagaaccgcaatgagatctgcaagtacctcttccaaggtcagtggttcttggtccctatttgcacctcgtaatcgtactagaggcgtagagccgccgccatgtttagtggagattgttgttttaggtttgcaaaacgaggagattcgtgttgctccgtacaggagcacggttcttagtgcaggaactgccctcttgttaaaaggagaagcttggtttagatgtaggatttgatatgctagtgataatttttcattctaggaacccaatgaactattggttatatactagcgaaatctgtgcacccatgaacatcaacttaaattgattgtttcggtcctggtgttgtgaaaatctgtgtgtaaaaatttcaagaaaaatgatatcgctgttggtgtatgtcagtacagcgttcgcatgccaagaggctcaaactgaaagtgattgtaggtgctggttttaacttggtgtatgctgttgttgcagagggagtgctgtatgccaagaaggactacaacctggcgaagcacccgcagatcgatgtgccgaacctgcaggtgatcaagctcatgcagagcttcaagtccaaggagtacgtcagggagaccttctcctggcagtactactactggtacctcaccaacgatggcattgagcacctgcgcaactaccttaacctgccatctgagattgtgcctgccacactcaagaagtctgccaggccacctggccgcccatttggttctggcccacctggcgaccgcccaaggtata

SEQ ID NO: 23574 - DNA, 643 bp, Oryza sativa
gtgcatatgaaacagggaatcagggattggttagttaaaattcaagcaagaaactgactctagtcacgcagagtaagattcagaacatgatatcatagtttgtgtatatctgtggattgagaagaacctacctcagacacgcaatggccttacttatcatagacagtatggtaatggtaatgaataatgagtttgaatcacattttgttgcctatgtattttctgatctacctttatgttaacatattgcaaccatccattctacaaagtatgcttttgtaatataattggaagctagttctagtaatcagtatcatttggcaaacccgttgaatgtgtaatttcagctgcgatatgctatcatgcttttcagatacattcagctgattctctgttgaaactagtgtcagagcttaagagaacagctatcttttctgggcttgcttcgttaactgaaaatgtggataggcggattgagatccttagtcaacaagctgaaggaacagagagaatgctggagaggattgggcaggaggcagcaggaagcctaaaggagttggaggcacattactactcatctgttgtgcggacaccaccggatgaatgaggtaaattctacctttctctgagtgaaagatatttc

SEQ ID NO: 23575 - DNA, 7067 bp, Oryza sativa
  unsure (1)..(7067): unsure at all n locations
nnnnnnnnnnnnnnnnnnnnnnnnnnnnnnnnnnnnnnnnnnnnnnnnnnnnnnnnnnnnnnnnnnnnnnnnnnaccaggtaaagcgtcaatcgtgcttcaaaatcgagtgttagtttgcatgcattcttggaatttctcttgactagaatcatctgctctgctctcatcagggaagcagtttgcgcgggaagaaagttcagcttgttctacactggcatgtcatgcccaaggccggtgtaatgatccgggatcgaatggctctctcagagttcaacctgccagactcctatacatcttgagcagctctgctctatctgatcagttctgtagtagactcacacatgtagatctggtaacaatcctctaatgaacatgacgattaagcattgtgcatcctaggcaaaatgctctttccaatttggcatctgccatacgttaggataattgatggaaaaccgaagcagcatatgaaaagcacagaaacagcggctgcgtttattcttgccccagctcgattgagcacatagagatgcattacatgtgctggcagagtgactgtcagtgaagtactgacatcaaccagctacatcttcactcactgcgtagtacatatatctaagaaacaacggcttatttgttggcatgtaacttgggacggcatgcgtatgcacgaactcaagcaccatggccatgctctcacagcacattggagtttggattgagaggatttcagtgcttgcagggagggccgcacatgccgaggaaggtgtcggtgcacttgaacttcttcacagggtgagtcttgacgacggcgcagctcttgcagacggggtcgcacttcttgacgacgtcctcgcaggtgtagagccccgagaaggagaagttgcagttgctgcagcacttgagcttgccaccgttggtctcagtgttgcccttgctctctcccacagctgcaaccaattatccgtgcaaccattcagtgattaatcagacatttttttacactaatttggatagttaaaacggtgaaagttggttacgcagcagtagaaacttgggttgaattgttgggttctttccggctttgagcctatatccatttatgtggatgaatgatgcttgtgtatacaggctgttaggttggttggcatgatggagcccagccaatgcatgctttggatgtttttgtgcatgtcgagtgccagtgacagtgagcccagtgaatgagagtggccgaccccaagatggcaagatctacgagcctatcctctcgacggcgaccttgtagtttcattcattcggtatgccttagaaaaatctctaaagtatacgatgcataatcatcaatcaccgcaattccgaatcctgataacaacaacacagtacgggaatggaaaggcacactccatggttgttctttctaaaactgtaaagtagttgactggcttttgttggatccagttattagaaatctcgtgagagtgtaaatccagtttacagagcaggttaactagcattttcccgggccaaaacttaatttgacaattaagaaacacacgtaaccattctccttagccacagctgcaaaaatccccatgaccaggacggcctggagaaccaggatcaccatgagcgtgctgctcttcatggccacctgtaaattgttatcgtgctatagctatgcacaaagctttgcccttgctcggtctacttgcagagtgctttgagcggttgtggttgctgctggctaagcgcatctgaccagctctatttataggtgtccagatcggatttttttttctcttggaaattaacttcgtcaggtgcgtctttttttgaccctggtctgcgatctggaatgcacatgtcagcttggtgtttctcccaagcttactttctaaagtacaagaactgtagctattaggagacatcagtgcttaattaacctcacttaatttggcaattgcaaaacctatacctccttacaatgtataacccaacgtcacttctcagtatcagtaacatggagagaagcatcattccacagcataatctgatggtacacacagcacagtacagtcgagtgatctaccacggctaattaagcaactcttcctacatatcacgtggacgatgctcgccatttgcaacaacttgcaaacctgacggtgacctctcataattacaggaatggattcgatctattccccgagaacatgccccagcctcaacaaacaaatcacaccctccgtcctataaaattagtagagtcagattgataccaaaataaatctttccaaaatttagtaatatcaaaattttagtaaagtgacggtttgtcaaaattttggtagaatagactcaatgtaatattgccaaaattctatagatattatcaaatatttggcactaaaaactaaatgtagccacacgattatcatcttaatacaaataatttagatataaccgaaagaccaaacacttagttaagaagtgctaattacatgaaactataatattaatgagctaaaagcttagcttggctagactcattagactacgactttgagcttattttccaccccatcgttgagtgcacctcttatcacactcaaagaaataaatccaatcaacaaatctatggttttactatcctattaaaaagagcaattttaccatccaatatttggtatttcgaggtaccacattttacacataaaagtttggtatcttgagataccaaactttacactagaggtaccaaaatttacactagaaaatatgccgatgtaccaaatatttgtggtacactatgatttgtggcacctcttatgcactcaagcatacataatatttgtgcacactatgattcaaatctggtgggtctgtgggtggaattatgggatgcttccccgttcaaaggaatatttttgttatgaaaggtttaatcattaattgattacatgaaaaagattctctatgttatatagtactaggagtatatgtaatatgttcttctgacatgatgatgtgctaatcagtaaagtgtaataaaagaagttgatctttttaaacttgatggttattaaggtagacagattttccttgctgacagataatatagacaatatatatctattatcacaagataatattaacattgttctcatgtccctctcaagtccaggggaaacacaagtctcccaagtaacatgcaaacaccttctagcttcattatttttatttggtccttcactcagacaacggcttattgttcgagtatacagtatactagcatcgagatatgatatataatgcacactgtatatcacacagatcacagatatatgacagcaatggctcgcgttcatgcattattcaggtcatcatcgatcgatcgatcgatcagtgcttgcagggagggccgcacatgccgaggaaggtgtcggtgcacttgaacatcttcacagggtaggtcttgacgacggcgcatttcttgcagacagggtcgcatttcttgacgatgtcgtcgcaggtgtagagccccgagaaggagaagttgcagttgctgcagcacttgagctgccccgggttgatgtcgatcgccttgctctcacccacggctgcacacatgaaaattcgatcattcagatcaatcatagggactacattgtactgcatgacattatcatcagtaaacatctgagaagacagaaatggtcagtgtgagaacgcagttaagcagcctagctaagataggcgaatcatatatatccatcagcggcaagagattaatgtatacagtagtacagtaccattttcttttgcaacagcagcaaagattcccatgataagagcggcctggacagccaggatcaccaagagagtgctgctcttcatggtgatgttcttgcgttccaaagccttgagctatttcctctacttggtactagtagatggctttacgctttgtgtttgtggttatggccaaagcccaggagagcatctgtatatataggcgttcagatctgaacaacatattagcatgttgccaaatgccattctttcatgcttgatatcgaatatattttttggggatgcatgttaggcgtgcctttgactgacgcggctgctagagtgtgaggcgttgaacacattttgtattcttccatgtcacactcacgctcctatcgtcctcgtcagcggtccaaaatggacgaaattgacaccaccagcaccaacaaaaatcgttcagttgtacagtggtaagctttgcaaatctttaagggaattaataatgatttccccatctcatcacacaaacgaattacctgttttatattattatgtataaatagaactcatgggggttcaaaacactattttatcaactagtagtcctattttttttccttggactcgtctaggatgtaccctctccgtttttttaatagataacgccattgacttcttatcagactattcatcttattcaaaaattttatataaatacataagatttgaatcacgaataaaatactttaagtgataaaacaactcacaataaaatagattataattacgtaaattttttaaataagatgaatgattaaacgtgtgataaaatgtcaattgcgttatctattaaaaaacgaaggtaatatatagaaaagcagtatgctgcggcttaactagaaatggtaatactgattactagagtccctgcgtgtcagcatcccctgcttatcaggactaactgtactgtgtatcgaaatggacccagttttattacaggtatatcatgatcttctcatcacacttggatgacaaaatgattgtacgtgcaaacttggataaccgagcaagctgagctgtccgttgggagattaatcacgagctcattctcgaaaagcaattttttttcaaacgcgtaaaaaaattgtacgttaatatattagagaaaaatagtttttgttacacggtacaatcagttaaactggcgatagaggaaggaagaaaaagaaaaaaactgtagctatagaaaagaaaagctaccgcggcgactaaacacaactctgatcaacgggagagaaggtactctgtgcccttaaaaaacccaaaaacaataatgctagctgaagaccgcacatgatcctctgagataatagactccaaaaccaataatcggtattaggcaacacgacacctttcttgcatatcatgacattccgcccaagtctataagaaacgcagattaatttggctaatccgccatgcgcatgatcaattgatcagctctagcatctcaaagccaaacaagaggcgaggataagatcacaggtcgctatcgagcgttactctcactggcccagcgttaaaccaaaccctcttttgatgtttctggctccacgtaaatacgtcctggctgccaaacctcactaccaacctgtcattagcgaaatcagagcatctgatggtctgtttggtacaatttcaactcctaaatttagctctaggagttaggtctgaagtggagttgtggagctggcagcttcacaactctagtttattttgtgagagagctcttcccaacttcgcttccagttttagtggagctgaaactgtttggctgaactccagctccagaaggggtggaggtggaggtggagctgtgtcaaacaggaggttgtcagtatggcatcgtgtggattggatgttgaaggcggcaggcggctaattaagaagcattgaccattctgatgttgcgtggttcaacacaattctgcttctcaattagtaccatctggaaaacctgataaatgggcctccatggctttttaaggaataagtttacattgcgtctcccaactcatgtacctggttaaatcgtatccctcaaccgctctcgccgtcccaccgcttccaacgtcttgctgctctcaccgctctgccaagctcccgccgtctgccccgccgctctctccatctcgctcgccgtcgagtgaggagacgagtaactgacacgtgtgcccaaaatttctttttatttttatttaggtttgttttttactgccacgtaagcgccacgtcgatgtcacatgggatgaagaccagataaacccgccacgtaagtgccacgtgggaaaaaccgcctccgaaaccatcgagggagtcgatttgcaacggtttttgaagttaagggacaagttatatccggttttgcggttgaggggtgtgattcacccagacgcatgagtggagggaggtgaagtagacttattcctttccgctttttaatctctgtatctatctgggcctaattcttcaaatcttcatgatgatgggccaaaaatctatataggcccttcttttcggggccttttctccgtttcttttggacatccataattatcctgacgtacaaaatggtcctgtgttgactgacgattgggctagcaagagtcagtcacagtagcgtgtaacccgttacagaggtaactgttcaggactggtcatcggctcttttaaggtgatggtgccacctacagcaatgtatggtggttgatttattggtactcaaatctagtttctcttggacattgattccgcgaaccaaattctagtccacgttcgcacaatcgcactatagttaattactccctccattctaaaatataaccactctaacctaaacgctaagaaatactccctccatctatttttgatagacatatttccaaatctgaaaaaattatttttgataggcatagtttaatccaacaacatatcatcttaatgaccttctcggatttaatgcatgactcttcattcttacacacaagattggctacatagacattgagaaatgtaaatattaatgaatcgcttgtttacgaggaatgactagtagcatatttaaatggatgataaatataattacttatctttggtctgtgggccaagatgaaatatgactatcaaaagtagatggagggagtaattattatcaccttatagtttgaattatcttaataaatactccatccgtcccacaatataagggat

SEQ ID NO: 23576 - DNA, 1499 bp, Oryza sativa
  unsure (1)..(1499): unsure at all n locations
nnnnnnnnnnnnnnnnnnnnnnnnnnnnnnnnnnnnnnnnnnnnnnnnnnnnnnnnnnnnnnnnaatcgatcgagcaaattaagcggaacgacgcacacagtgaagcaagcaatcggcgcgcatgggcaactgacagcccatgcgtgaatgatgcttcactcatcgacgattgacttgctctcgctggcaatggcattcagctaagctatagagagatgttaaatttgacggatcaaaaatggacaaggatcctccaagcgcgctgcgtgtccgagaaacgcggtacaaggtgacaaagctggaaccaccgctggctcgtcgcatgcgcccacatcacccggcacgcacggccaagttaatttggacccccccatcttcaccaaacacacatcacccctttaatcttcacatgaaccatggacaaaattccaagttataaaggggttgcaaggtttgaacaagcacacgtacgcaagaggttgctgctacggtagcgatctagcgttgagaatacgttgaaaagatcccgttccggaagaggcgcttattacgtttgtaagttggtgatcacgcggaaggatgtgtgggacaagtggtggcgtggcaagagcgatcgcttgcctgtgcgggtatggaccagataattaggcggatggcccctactggctactagttgtagtacagtttttctctttgtccattgcggcgtctgcctgccacgaccgggccggacacgacgcactgctgcctcccaaatcccaaaggccaaagctcacatgtggcgtgcgagaccaccgctcacgagacggcttggggttggacgcacgctgcacgtggccgtgctgctgcccactgtaccgctctctcctcactgtgccatctatgggggcatatatgcgagatttcagaggcgaccacctgtgtgtgtaccccggcaattggcccagccaattcggcctagcaacatgtaaaaggagagcagggggcagcccatctgtagcgggccgcgacgacgaaatctgggctggcgcctcgcaggcccagacggttggattctcccactatggatgaaaacggtccaaaaacgatatcatttctatggaaaactgtctcggcatggttgaggatttttcatatttatcaatttaaatatctagttgttccatacgatgcatatatagacttttttaaaaaattatacatagtgaattacaaacagttggaaacagtcacacttctacgaaaatggtctggaattgctttaccaaattcaagtgtccctctagccaaaagataacatatcaaatttgatatgtttcaaatcagaattttaattttaacgtcgatgtatataaatatctacatttgatgcatagggatcatattataagatttatcttgaaaatactacctttataaacttatagactatatcaggtgtcaaatattttgcattcgaagttaggctgtgtttagttcacgctgaaatttgaaaatt

SEQ ID NO: 23577 - DNA, 800 bp, Oryza sativa
  unsure (1)..(800): unsure at all n locations
nnnnnnnnnnnnnnnnnnnnnnnnnnnnnnnnnnnnnnnnnnnnnnnnnnnnnnnnnnntccgcaaccattatagtagcctgttatagcatttcgtgaccgctatagcaatccactattaactttgttggatcgctataatgcttaaatgatattattcacatataatatgaaaactttgcatcttgtgccttcttctatattttaagtgaaacttgatgttaatattgatacacaatctaaatgtatggttattttttaatttcgctattggaacttagcgttcgttatctttaattcgctatctagacactagtcctctgtcaatctactatatcctatttattagtccttgcatatacaataacaacatagtattaggtaaaaataacaatcagtagacaaactcgtcagttaacttttctgacgataactcatctgattggaatagccttaacacatatagaattctttgagcgttttccctcgtacctatggaacaaagtcgtgtgtgcacgatcctgaaacgccgtattgccgtgggttgtgtaccaggttatggtgggaaactggatagctaggccaggtcaaacacatgaacacgtacaccctagtgaccctgcggctacacgcatgacgatatattcgattgatgcaaatgggtgcgtacacggtggaggtcgctttcccgtgtgctgtgcggtgcgtgcaatccatcactcatcgcgatccgtcgatgggtctagagatatgctagctaagctaacggagtacaagtcaagtcgcctgcatatgccgaga

SEQ ID NO: 23578 - DNA, 409 bp, Oryza sativa
tataagtagtaactaatgaaaatacagatatcaagctacacatttatgcattgcaccttatgtatatgcaggtcaggttcgtcgttgtttgaccagagagtgaaaccgtctgctacacctcatatatattcaggtcaagttcgttggcggctgaccgccgagtgaaaccacctgttaatccaactcgttttcatcagaatacctactgcaaatccaactccaaagcccacgccaacaaagagaaacatcacaatatcgacatgctcagaggagctctctacatgtggttcagcacttggaggactccaactggcacatttaggcaatgggtctccacaaagtcctgcgttgccttcatatgaactgttttcaaatgttgcaaattgacgtgactctggtatctttccct

SEQ ID NO: 23579 - DNA, 10863 bp, Oryza sativa
ctattgttctcagagcaactctatgatatgggtgtcgcttcttgaatagtgatctaaatttgttctgtaaatttgatcaagattgacactgctttggagcaaggggtggatgctgtgagaactcttgtgttgaagggttttagtggaagtattgagagattcaatctggttcagaagtacaagttccacagtgtttgagaattattaagaggcttggatatacttgctgaggacgcataaatacgcatcatcaatatcattggaagtgtcggacgtggtactttgcacaatctacgtaagtgcactaagttgcttctgcagtatcctataattttgaggatgctaagaaacttgcagggtgtatataggtagagtacttttgcattctttccttagagcaattttcattagagaggtagttgtgacctctaattttgttcatatgtaagctacttattaagtataagaggtagcatatacaatacaccacctctacactagctttattacactaaccccaataatctaaaagtattttcattttatttgtttgtttaatctactcttctcttttcatatagagcttatgtagagattgccccttgagtgaggggtggctcctcctatccctcttctcttctctccctcacctcatcatgtgagccaacatgcaatcttggggcaagtgcttaggggtttattttaattgctcttaagaacacaaattgtttactcaaattggaagctaaatatgttattttgacaaagtctagaattacttgtcacttctgtaggttaatgacgaagacactttagtgatgtaaaagaggaaagagtctttccttctcctgcttcctaaatctctgattttatcatgcaaataaatgtagctgtctttgttggagtggatcatctgcctgcaaagtgatcgtataggtgtttttattactccggccgtacaactcattttcatcaacttgatgtggtaaagttgtttagtagtctggcatgttatatatagacttatagttatacatgtctatgccctgatgttatcttgtcattaagaaacttaaggagatccttagcaaatctttgataaggacttgatattgaatattgttttctattttcttgtgctgatatgtcagtctgaactcgtgagggtgagtatgggcagaaaattttctttgccatgtaaaagttatctcaacttctcgcatcagttaacctacagtactatctagaataagagtcaagctgatttaaccctctactgttcagggctaatctgtaacttttggtgattaaatgccacctgcagctctcttgcaacctattatctagcttagcttaataaaaaactaggtctagaacattgcgatatgtgataatttaaggaggcgacatctgttaggctttggttaatctattttcaagtgatgacaggatcctctgggtattagagtacatgaagatggtgattataattgtatcaccttctgctttcatgccttgtttccctattctcactttgtttctgcagtcatcctatacttatatctgtgcatgctaatatgctaccaaatgtgcacaaagccacaaaatatactgaaggcagttgtttacctcttaacatggggccatatattttttagtaccatgaaatgcaaacaataatctgatgcgaacatccataacactaaaatcgcatcatattgttttcctttttgtgttttttggtggctggtaccatgagcatgaaaaatatcatttgtttgtcagtttttataaattctatttttttttctgtggtatactttctaacaataagaaaggcagtgagggagcaatgggtgaggagagcatcatatagtagagactgaggatacatggagttgagcaagaaggctaatagtttttctttttttctaaggtggaatgccatgtgggctagctctgtccagcatgcgtgattgttatcatttgatgaggcatttaacacacttatcccacacacttgcagtaagtattttttctgccttaaatggttgcttgattaaatttatggttatgcattgcattgtctggcattgcaagtgtgtgaaagctaaagaaataagcatgcaccccttcaaaaataaaatgcaaaagctgttgggttcttcattcatattcggtgaagagatgcaaatcaaattttaaaaaaatcatcgatgttgagttactattatacattggtccaaaatacccgtgttttagtaacaatttgtaagctgctacttcctccttttaacatttctagatcatcacttaaaatatcttgtgaaagaaccatctagaggtgaatgtctcatgaagtggaaattctatcttatgatgatccaaatgtgttcgtttcttgctggcttaaaaacaaagtgtaacattaacttaatcagttctttttactagtacatcaaagtgaaaatggaaagaactagtccaagtgcagtactacctatgttccagaaaagctagagataacttgtggtgtgatattaccaataaggcaataaccaccaggtgatttgtctaatacatcacaaagatacgatatttgtcaaaggcttagttttgaccttggtttaaagaccaaaaagcattagtctaattacctcacttccactactttctgctaggaaaattccctccgcctaattcttttctaaccaccaagtggattccaaagttttaaagattatattatctaaagctctttcctccaccatcacgttacctaaactacttgctaatccttttcttaaagccatcacagaagtagggtatggagtaatcatacatctaatccatgtgcatccatctgttgatcactcgctcacagaggcgcattagatttaccaagtgtcgtgattgtagctgtatatattagcttaattcacgggctatgctggatccctgttttaaatattttctgctgtgacgattaatcctagtgcttggttaagctttggacattctagattataagattttgttctaggtgtttctttaatccctcattgcataattaagtatactggagaatcacttcacatgactttaagtgaaatccacccaatctcaagtacttatttttatggagtaggtaatgtcacttggcatactagaacatagtttatagtccttgctcacactgcctgggtttattaactagctttgaaacttattcttaaggaagatatcaaacccaattattaagccaaaccattctttaatcccccgtggtggcccaaaaagcacttgtggagaaaataaagagatatggttactaacttgagtgttatatatacacgcatttatatatatatatatttcctaggagcaaaatgggtgaggtcatccaggggattaaactatgtgctaaacttgtcatcatgagcccaaaagaaggattttcctttgagagcacaacttggtgcgggccccttatgggattcgggtgatcttaaatgttgccaactttgtgcttgcaatcaactaacaaaaatgttggggatgtgaccaggagcctttgttgaggcaacacaacaaacaacaaaaacatgggacctagtgtgtctagcttgtaatcaagcggcaagtgacatgcattgtatcttatcagcacccgtcaaggctactgagtggtgttttcctgctgctgtgattaaatgcttaaatgaatggttcacatgtgttaggtgctccatggagtaaggtgccgtgactgccgtctagggaagccttgtgcaagccatacaaggcagtggcaagctttcttatctcctttttatagccttgtttctgagcattattgcagtagctttgtagaagatatttggatcaaaactatattttttctgtttgtataattggatagtcaacttgatagattttattttctagttgcaaataaggctctgtattatattagagaagcaaatatgcataaccagctaagagtgccacaggagaactatacgagagccaagagtgcataatttgtgttttcttttccttgagggttagagaatgtgtagatgaggtgctcagtgcactgcaatgcaaggtggagaccactgtagcagaaaaagctattgacctatgcaacacccaaatgaagttgtcccttgttggataacctctaatctttaattggtgggacactcagatgattcaatgaccttatgcttgtttttggtcataaactaggaaatagtaagtggaacgacaaaaggaaacgggtacatgcattttattccctacattttagataggacataatcaaataaagggagataatattgacatgtacagagatacatgtaggaactcctcttattgtgttcctaaaaccaaacctgtctaaaaccctaaaagaacctgtctaaaaccaaacctggaggttcatgacaataacacaattgttaaactatataaaattatatccagagcttatgtttgaattcaatcctgagataatgctttctagcaccgttttcatattacaatgattacttacacttctgggatcaaatcttaataatttgagtaaagatgaatgtaactgtaatactattttattaactcaacttgcaaaatatgatcaagtgcatctgcatgttatgatcaagtggattttttagttaactatcttgccgagtcatcaaaaacctgaacctcatcatacaatgcatgtgcatttgctggtcgactagaatgcatattagattctttgcaagcataaacaattcatattagtgaaggagaacttgcatattaaaagaaaagaccatgtgctttgctgcaacctgcagtctgcaaggaaagcattttggatggcttgccttccaaccgtccaagcttctttcagacaattcctcctggaataaaacatgttagatattccgaaagtagttggtgtctttatggggtcctagaattgctcatcctataaggaagctcagagtatggaaggacacaggacaagtagatgaggacttttgaagttaaagaagccaaagtttctttatagaacgtagcaacttggctcctctacatttttgtattttgctagaatagtcactagcttgggggatgggttagaatcagtcctaacaagttaacttttactgctctcttcttgttcgatccatacatgggagatgaatatttttggctcaagttctgtcctatgagattggatggttgatcataatgaatatgtattttttttgttccactttaaattattagatacgttacagtcctttaaaatgatattatggtttgtggaactagctacatttcttcagattcatggaaaaagtagttactgtaacttgactaaaacggtgtttgtttggacaaatttattgataactgactattaaaaattagatggttggacaaatggacatatcattgagatcgaacctagctaatatgccttctatgtcaaggcaattggtattcatttcatgtcatctttcccagttgctccctgtagagtgaaggggtctcaaaatcagaagaaggtttgaaatgaaatatgactagatctgactgaaaggaacacttcaaccactctgttttgggtatctgacaggaaaattactgtagtagataagaacccaaacaggtttagtgttcctaataattcaaattggacctgtacaggagtaggatctatctcaattatagcatgcatggtggtcacatgtgtacaactttccttcctcacatcattgcttttctgaaatgtgcatcatattgtgtaatattgttgatgttttttatgctttccatgcattagcttacaggctagaaaacaatcttttctatttttcttctctgtttcaggacagtcatcttaggaattcacgtgaattggtacctcatttggcatattaattacactgttcttcgtaatctagaaacttgaaacgattgagctgctgggttacaagttaatagaattgtttactaggagatcctatacattgattgaattagataggtgattagtctagatcctccaattatttagaaacaaaaactccctcgtccatctgttcaaaaaactgtaatcacaatatgaactcgtgccgtgtaaaataattcacaaagaagcttgcttagtttttgtcggtaaacggtcttgagctcattgtaagccgataattatgcatgatgtgagtaattattggctcttacaggaatattcatgagctttggttattgaatgcttgtctagatatgtagcaccgtttacaaaatggatcaactggggagcaagggaagattcaatgcatgtgatgtttcttatgtagcgtctgctagtctgaattagaatctaggaactgttactagctatgtatatcaaaagtttatcatctatctattacatatatttgttggttagttttgtacagaatattagtttaggttacaggtgtcaatatcaaataaaaggcagctttgttgaaatgaaatgggctatcaggttaactgattcataagaacctatggacgcttattaaatgattctttgactctacatttgttgtggatggaggctgtttagaataaaaaagggtacggacatatatactttatggtcaccaatgcaatcaagtatttgatcaacttgtctaacctgaaacaattaaattaagctgaaggtccatgatctaagcataggtagaaactacagagtaaaaaacgaaatggatcagattaaagccaccttaggtgacagctatataaccaccactcctctatgtgaaactactgataatatattgaagatatcgtcatttctttaataacagcacttgctacctcaaagctcatgttttggtatttgaaagggatagaaagaaaggaactgaggggagctgagtttaggggacagggtgggccttgtttagaagttggagaaagactttagaaagagaggagataagtagggaatttgggagtgaaagatacatagaacctttcttggatggtggaggcgagattatgttagagaaaaaaagatgcagaattctagctttctctggggttagtaggatttggggagatttctttacaaccgggttgaagcaaaagtctaaccaaaaaggttgctgatttgaacttgagacgcaggagattctgggcttgatatacagcccccaattagtttagctgtgtgaaaacacgtactgtattaagataaaaggcaatctctgcgcactagttacaattgtgacttataaaggcttgcacacacacatgatctgatcctcctggatgctgcaaaagttgcaatgtgtatatagtgaatgcatggcaattccttcctccttttgattgtaagtcaaacatgatttcttctaacaaggtagttcaactttacaagtgccagtgacctctcaggagttgtcttttctctacaaatgacgcctatggcaagtacaaagacaagaaaacccaccgcatcagctgagcttttaagtacatgtttttcttgtaagacatgactgatccaatgttcaggtaaaagaattactaaagatgttagtaaagcaaacgtacaagaatatcagatgactgttcttgaagagttgtaggatgatctagcatagcctggtgcttaattactaacctgcaccagcattctactcaattacatcataatactgtggtagtgcataactgtgcaaattatgacatacaaaataagatcgtattctaattgacatggattccgcttcttattttactttatagatcaatttcttgaaattgccttttatatttcgatgatcccagcttccgttgctgattaattcccactcatagtagtacaccaagtggaactcttttcacttgagtagactagcaataattgaacaaatcttaatgcttcattacttaaattaataatgtgaaatgttggggaaaatataactagctaggttggcaaaatatattttccattttatcgtgcctcttttatttccccttttgcaaagtttttcttctgcattgtgttccttttttgtgattaagcttaaatttctgccagataaaaacagatacattccgaacactgggaacataattgcgtcaattcttgtccttgccacttttcctgcaacattgtttattattgtgatggaatatatgtttaatgcttgctgcaagaaaattccaagtgcgtctcaatgtgcgttcctagtgacataaaatgcggtgaggacgaagctgtgcctgcatgtgcgctcatgagctaatcagtgaatattcttatttggttgatcgtatctcaatggtttatagaaagcgattaacaagtttttcgagctgtggagtggtaaattgcatctagatgaaacgaagagaacaaaataacttttttgtgtacgtatatgaagtaaattgaacagataatccctactgtttagagcatgcaactgtgcaaatgcctgttgaaatcaagctagagaaatacagctacaaatctacaagttaagctaaagggttattatttcgaactactctggttgtcggtgatttgagctttgaagttgttgattgcttaccatccgttattaatttgtttgtgcttgttgatttgcttgatacaactatgaattgtaagttgatttaggtgctcgaggaagttgctcctgcggctttaatccgttgaatgacgttggatttcttagcacttgcgcttcttccaattttgtattttattaatcagtttcttggaagagcaataaatgttattctgtcgcctggtggaatcatatatagacccccacttagccgctaatagcgattgactatacaagccatttcatattggcagtattacactgggatctatattctactctgttttttatagccttaaaagaaaacatattgttcataccttttccgtacgcaaacacgaatatacatgcatgctagctagggctgattttatggctagaatatttttatgatgtaggagtacttcattttatttgtgaaagaaaatcatgttgaaagttttcttttcttgacgaatatctatatattgttctgcagagacataatattgattccagggatgggactcaaaggcgattctttgccgaggtcatccatcatcatgataggaattgaaagctatagcccacacaacggaacaaaacggagcaaatacgtacgtacatcagtacatgtacatttcctacgtacgtactactgctatactcttctgcatcatatacatttctacatggagaattttaaaaagcatatagtccaaccccaacacgcatgagcattgcaactttagtttgtactctacacgcgcagatcgaataagttgaacaatcgggtataatttagcttagctaagtggcacccacttaattaattagctctcctgcacatgcatggtccctcactgatctcttatctctttctacatacatcgatcgagccataatacaaggcaaattaagatatttaatacatagacacagttatatataagtacaaaagcgccgtaacaaccaggaacccttgaataaaattatattgtattccgttgcctctcctctacacaacaccgcgactctatcggtataaactatttgcattacgtacacaaaacaacataattgagcatccggctgcatgcatcggtcgatccagctttgattaagaaatgagccctagtacgtattagttggccacagacctaagctacatgcctacaaagatatacatatagtactcatatatatatttatttatatatctaaatatcctatcatgcgtgtgcctctagccccggtagtaattaacaaatcaacgaggaagacgagcacataaaatagtgcaacatggagccgagacaagcgcaatctagacctcgacctgtctcttgtgacctctgtgtgtgtgttgcttctcctgttcatcacaagtactccaactcatactactactaatctctctctctttcctactttgcatcgatcgtccctctccctctaaagtgcaagaggccgggatataatattgtgtacatgctgcatgtattcaaatcattcacctgcctagctatgagctccatgatatatccattctcgcctgtgcaaatcctgcagctccaggtcttatatatactgccccttctcacctgacacagctccaacccatgcacatccatccaacttaatttgacagcaactcactgcagcttagctctctttctctcttagttctcttcttctgtagcaagtaccaccagtgccaagcttctacagtgtgctgctcgctagctactcgtctttgcagccatgagcatgacgagccccaggctaaagctcttcggcttcgacgtctccgaggaggagacggcggagcacgaggagcagtactcggctgagccggagagcgcgccggtctgcgggggcaacggtggcggcggagccgtcggctcggactcgtcctcgtcgtctactacgaccaccacgacggccacggccggcggcgacgggcggaggtacgagtgccagtactgctgccgcgagttcgccaactcgcaggcgctcggcggccaccagaacgcgcacaagaaggagcggcagcagctcaagcgggcgcagctgcaggcggcggccgcggccgccggccgtgtcgcgggcggcgccgccgcgctctacccgcgcgccaacccgatggtctccgccttcgctccgaccccccacctcctcggcggcggcgaggcggggcccaccagctgggtctacttctccccgcgcg

SEQ ID NO: 23580 - DNA, 13959 bp, Oryza sativa
  unsure (1)..(13959): unsure at all n locations
ataaaccaatcataattaaacaagctaattgagagatggcatcatcttttctcgaagatttactggctaattggctacgaattgcatgagatggaactactggtaatctaggcttgcatcatcttgggatcttgtgttgcttgtgggtttagttaattggtggcccaagtacacgtaggtataggtcttttaataaaaagacaagctgtaggtgacgcatggcgagtcctgtctagtgcagagagaattcattctatatctctccttggaagtttagaccaacaagcaagttaattactctttgaaagagctagccggccatttttaatttactactaattaatttgtattcaattgtttggtgactaaaaccggagatgagctctaggttgtggtttgaatatttgcacaagatcaggaaggaaatttatagctaagaagatagctgctagatgaaagggatggccaaattaacatttaattaattaatttgtttgaagtgatatgcaattaatcatcttctagaattgcgatgtatgcatgtgtggggccggattggcaacttcttagggttcaagttgccaaattcttgttccaagtgatgtgatatgaaaggtgatgtaaagctaggcatgttgataaacatattgcgccggtaggtttctatcctgatatcaactcagacttgtccttcttcttcctgtctcgattttctgatgcaattgtaatcttcaaagcaccgaataattaagtatttaatctgtaccatttagtccaccagcgtacgctttatttgaagactaatttagtcacaattgtactgcaaaaagcttgctttcactaggcccataattgctctttaagaaattatttttttgccagaattaagcagctagctagcactcatctgtatgtagccgttggacttttccaaaatactagagttcggcggttgctagtttagaagtttttattttgtaattatttgtagttaattgtgtggtcttcctgtgatctgcaagatgggtgttctaatttattgtttccgcccctggaaacatgtttgcccatttgccattgccacctctttctgtcgagagagcttgcaatgcacgtgataaaaaaaaatggtctctgatcactttcttatatgcagagatgaaccctcgtactacttatattcagtttcagggatcgctttgtcagggttaacatattttaaatccaatttgctgctactaaacattcctctgtgaccaatttggcacacaatgagtacgattccttttggactgtgcattgtccagtttcatcagcttttgtttggaacagaaatgcaggggatgaactgtttcatgtaaacttacatgttacatgctcctagtagttctaaaatatatgtaactgcaaaggttgaggcgtaatatatatgttacacagaacaaattcttctcactgctagtttgacatatagtttaaaatttctgtacaagtggaaggcatacttccaaaggtcaataattgatcaccattgcacattgttatgttctgaaaaaaaaaagtacctgcttttgaaagaaggggacataacaaactgaatgaccaccaaacaacattttcccaaagctttcttaaaccatacttgtaagttggacacccaaccactagaagcaataagttgatgaaccatcatatttcccaacaaactgctagctatgttgaattgatacccttattaccacaaggcacctagaaaaaaaatattttttgacccctaggagtaaaggctaaagaattaatgctagctaaaacctttggcctgaggcccatgtgagtcaccatcaccaagatgtcccaactacaaacaagatctcaaaaggggagatttgaaaacacttttgttatgatctcacttgagtccttgcattgatgtagttttatgtcaagaaaaccttatctcaaatggaacgtgattagattgtgggccctaccctgcctcttattatattgtttgttttataggccttctttcaacttaattattaatgggcgaaaagattgcatcttaaattgtgtgatttttgaagagttcaaatatgctataagtaattgcggtgttcccaattttgggcaagcatcttagttggcatgcagcatgcatcctctagtggaaccaggacataaggtagaagcacatcaaattaggctttgacagacaaggatgcacttgttgattgaaccatctatttgtctccgctatatagtcacaatggttattagtgttattatgctattcttgaccaatttggcttgaagcattgcttgatgaaaaggaccatcgaggagaaaagtcttcagaatagaacatatctcttttattatcattattgaatagaacataactcttcaatattctctatattattttactgtcaaattgataggttgctgtaatattcagtgacgtaaactcgtttcttactttactgtaaggaagatgtaaattcattttcatgtatatacgcttctctagttttttaagaccctctgtggtttttaatgggttacttatatgtcctttaatttaactaggaaggtagcccgcgcattcgtgcgggcatgtatcgtaggttgcatttgagaaacttataagataatgtactaacggaataatacatgccatatttcaaaactatgatttgtctatgttttctccgttagcattgcatgacgaatttaattacgttatttataaaattgtctattggagattggattttatggtacctaggacatctgtctgttgaagttctattggaaaagagagaaaacttaagttgctataaaagacattggatatgtaacaatatataattaattgctctaccaatttatgtagaaaaccaataattaatttattatttgatagtagacgtaatcgaattatcatagctagccagctagggatagttcctcatagaaaattatgactattgtataaatggaaatatgatgagacatacagttgttttagtgttcaacctttaataattaaaaaaaatgatttaaatggataaaaacaataaaatttatgattcaaaggtaatagccattcaaaaccttgatatctcaatcgactaatgcattcgaccaatgtggtatttttttttttttgcaaacactcttgcacacccttatattagaagagaaatgtgagatatctacgatgagatcaaacagtggaggggatggacatgtaggtttgattaatttaagcagaaataaggatcatacgtttaatttgtttgtttctttaccataacttttataatttccattaacttattagaggcgttaagagaattttttagtggcaaggtgtttaatacaatcacaaatatttgctttgatttaaaatacctttttatgttactatggggtatttataaatcatataatcatttatcgattccaggtttaatttgcctttttctttatcaaattttttgaattttcttcaacttattagaggtgttaaaagaatttttaggaacaaaatatttgatctaatcacacatttgattttatttaaatttcacaaaactacatgtattttgatcaaactatcacaaaattacatatttaaggcgttgtattataaaactacagatttagcatcatatttatcaaaaaaataatatttaaggttaagtatcacaaaactgcatatttaatattgaagttaacacaaaactatagtttttagagtttaatccctagcaccattattatgctggagctgtaaacattttttttgactaaattggttctaaatctgtagttttgtgataatttagttactaaatgtgtagttttgtgacacttcattttaaatgtgtagttttgtgataaatttggtgttaaatgtgtagttttgtgatacaccaattcaaatctatagttttgcaataatttgatcatagtatctgaagttttttgtgttatttactctgaaatcattcatggaatccagtatcattgtccatggagtgtacattaattgaaatttcaaaggttagctgatgctttcatgtatacaagcatgccagacatatataatttctgattgggatgaaagagtatatatataagttaaaggtatcaatctattaaaaaccaaagtaactaacaaattgtaaatcgtgaaggtatatgtctcacactattttttatttgacaataaaatcatagtcaatgtgcaccttaaataattgattgatatattaggatataaaaagatagactaataaaagaacaattcaacatatatatatagttaaaaggttattcatcgacgatcacatacatcagtacatgtccatgccggtaggctcgcatgaagatatactttgaggccgggagatccggctatataccatggaaattttatttaaaattagttaacaatataatgcttatcttaactaccgtggagaaaaaagaggatggagaagggcgtgcatacgtacgcgcgagccgtgatgggagaggatcggatctgtgggggcagcggcgccgtacatacactattttatatataaatttaatggtttataatattggacccacgtatttaagtgaaaaataaaagggtagatgtttttgccatgtggcaatctgagagcgtttttagaacaccacatggcagcttgagagcgttttaaggaagtttaatggacttttagtatataatagatagataatagatagatagatagatagatagatagatagatagatagatggatgaaaaccaacacaattcacacacaacaacaacctaccggcattcatcagactagcaagaactgaaaacttctataaaactcatccatatgactataaacttaagttgctgcatcttatagtactccaaaatatgttttttttcctgtaatcagatgactgcttgtttgttttgggtaatgaaaatttcctgttatctaagaaaagagtactccaaaatgacactaaattgtttttgaagaacatcaattttaggcgaggcagtttgaagaacattaataaggcctaaaaggctactgctcatatatatgaaataaataaattttaactagctagctaaaccaataatgttgcttgccaagaagaaagaaacatgcatgactgcagtgtgcactagcatggatttccaatagagaagagaacagctttgcttcttgttccggagttcatcaatccccctcttttaggccccctttgattcaaaggaaattcataggaattttaaaggatttaattcctataggaatttttcctatatagccctttgaatcaaaggaatgaatcctatggaatcctataaaattcctatggaatggctcttcccatgcaaattttgaaggaaatttaacatgaggttctacctcatattaagaatcctttgagtctttctctctcctcaaattcctgtgtttttcctgcggctcaatcaaacggtcattcctatgtttttcctgtgttttgcaatcctctgttttacacttgtattcctatcagaatcctatgttttttctattcctccgttttttcattcctgtgattcaaagggggccttagggggtcctgcaggaggtagctagtctagaactgaagcaatggagtcaatgtctccttcagatcgaatcatggaagacattagggcatcatcatgctcaagtgcaagaagtccctgcgttttcgtggagggtggggtcctccccctgtggcgccaaccagtcacaaatcaacaagtagagccaatgttttagtagccctaggagtgagtgctatgattagaaggaagatgccatgcttaagctagcagctgacaccttgacatgcatagcatagcattatgtaggggagatcaaggaggaggcagggattaaagtgcacaactatggtggactgctgatcatttggtctgatgaaagcttgcccactttattggtatctgtactttgcctttcacttgagacttagcctgttttttctggtatagctaagctaatctatgcttgctcatcttttccacaaaggctttgtgctcaactggtgagttttgattggctgggagagtacttgataagtcttcagataaaaacactacctttttgttcagctccagcatatgcatttcaggtttcactcctagtaattaagataatgtttatgcatgatgtgtgtctgcaagtgtgaattttggcctacttagtagctttcagttggccaagcactttgacagtgccctccaccctggcaaattaaattaactctggattaattctgcaatgcaatctgatccaaagaccctagctagttgctgatgccattataattaactctagattagctaggcactgagttagttataaaaaccatgcacattgctagagctgaaatgtttaagtgtagcacatgcatgctaagtgctgtaggttccacgtttaagtagatgggtccaaacactatagcttggatcattaagcaacaaaggtatctcattattgagctgctttctaatgtactcagagctaatgctcagctactgatggagtcagtaactgtgctagattagctatagtgtggtgtatgcttgattaccacttgttgcataggtacttaattaggtaggtttgttagtcatcagttgtaggcaggcatctaattaatggtgattgtcggtcggagctagctaggtagccaccatcatcaaatttttccttttaaaaaaacaacttgagttacttgcaaggcagattaacaacagtgacgtgtgatggtaaacctgacgttgatcagggacatgatgcagcacccaacacggaacagcagattagcttagctacagcagcagcaaacagcaaattcggagttcatcagacgacagagagagatggggaaagggaaaggaacaagaaagcaaaaggaagcgagatcgatggatcgaaaggtggtgagaaaagggagactgagaaaggaatcgggcaaagctggtgtcaactcctgttcccgatcctttttttctctttcttcccaaaaaaacattattctcgtgtatactcttctttgcttgacatatcagatcaaccagtgtaggcccatgtcttgggtgaacgaatctgctgtttttgcataattctgttcgtcgaatttggtcagattcaggaactgaagggttattactctgcttcagatttcagacaaaacttcgatctgttgggccttgggaggcccaatcacacaatcactggtctaaataaggaatatgtatatttttctccttcctgtcttgctctatgtagaatcgcctccctcaagacttattcatccaaagggaaagtttactttaggtccctcaatttgtcgacgagtctgaattcatccctgaactaaagtaacaagatataacatgcccctcaaccttcaaaaccaattcaaataaggtctctggacggtttagatggtggttttggctgacgtgacgcctacgtggcacttaaagtatttttaaaactatgggacccacctgttagtgagttccaattaaaataaaaaattacagtggtcccccttatttttcgttccttctttttttctctctcacttttctcctttcttgcttcttctcattcccggtacctggcggtcggccacaggttgccgtcctcttctacattcttgatgttgctcaacctgttctggaagaagattggcccgccctagtcggtcaccacgaatgagagggagagaaaagatggagagagcggagaaaagagagaaaaaaaaggtgagatccactgtaattattttattttaattggacactcactgacgggtgggtcctatggttttgaaaagactttaagtaccacgtcaatgtcacataggctccatgtcaaccaaaaccaccatccaaaaccgtcttgcaaccttatttgcactggttttgaaaattgaggaacacgtcatattactgcggttcagggacgaattccagacttggcaacaagctgagggacctaagtgaacttattcctcatccaaataactcagaatttgcgcattccgtggcccaagaaacacccgcaagtcaagtctcgtcatgggccttcggatagcccacgacgtggtgctatgaagtgggcctcgcattgcttcctctcccgacgaagcccagagacgagaggcacccacctgcgccgccgccatcgcagcagcagcagcaacgatgagcaagagcgccggcgcggcggcggggccgacggcggcggccgcggcagccgcggtgcagaagcagaagacgctcctccagaaggccgacgccgacgtctccagcctcgtcgacaacttcgccgccttcatcaacatcgcgcgcgtacgtccccccctccccacttctccctcctcctcttccttggtgtcgtaccaaaccctaactcctacttccgctccgctcgtctcaggtcaacgacccgcccgtgcgcaacacgcaggaggccttccagatggacatgcgcggctcccgcttggtacacacttgctccatgacttgtttcttcgcggcggtgtttaaatcatgccctatagtatttgtctaaatgagcaaatttagagctacgatgcccctaattttaagctttaatatcacatttgatgtgccggctggatggagaactggagatgttcctcctacctcagtagtggagacaattggtgtgtaagaagaaataccgaggaattacttgctcaatttggtattaccattgtattaggggtcaaattaagccatggcagtgaatccttggtgccatatccttgatagctgtttgttaggatttaggagttatagtattgatttcttgatttcaggtgcaccctgatctagttggaacttataactagaaggcaatcctaggcaagagtgaaactagctttgcttggaaacctcagctgtttggtagaggcaaattaatcttgctttgctaagcaaagtaggcaataaccgtcaacaaatccttgcccaccatggagagccaatttggctctccctggacggcaagcaatgaagcccaatgtcatggatgcaagcagtcaaagacatgctggaaccacttggagggacgtacagacaagcaactcgcttgaaccaaacaagcatactaacttctatgagctagcgatcagacggcctatcctatcttatcctggctaagtaaacttagtgaggattccaaacgcgcctctactgagtcaaagttcaaatagacgaagctatccaacgcagaggagatatcaccgtgtttaatccgacacccaaaaacactatctggaaaggagatatctagtgcaaacaaggacatcgctatagagatggaatttgatatttgaataacggtagggatgttatctgggtagggtgaaaatgcagtgcatatgaaacagggaatcagggattggttagttaaaattcaagcaagaaactgactctagtcacgcagagtaagattcagaacatgatatcatagtttgtgtatatctgtggattgagaagaacctacctcagacacgcaatggccttacttatcatagacagtatggtaatggtaatgaataatgagtttgaatcacattttgttgcctatgtattttctgatctacctttatgttaacatattgcaaccatccattctacaaagtatgcttttgtaatataattggaagctagttctagtaatcagtatcatttggcaaacccgttgaatgtgtaatttcagctgcgatatgctatcatgcttttcagatacattcagctgattctctgttgaaactagtgtcagagcttaagagaacagctatcttttctgggcttgcttcgttaactgaaaatgtggataggcggattgagatccttagtcaacaagctgaaggaacagagagaatgctggagaggattgggcaggaggcagcaggaagcctaaaggagttggaggcacattactactcatctgttgtgcggacaccaccggatgaatgaggtaaattctacctttctctgagtgaaagatatttccttgtaattgctggaggtgcatagttgcttacaatactaagatttggtgtcaattcatggttaattgcaattttcagtcaaagacctttgctgatgaaaaattgtacatcaattgatatgcaaagcataacgtttagttgggtctaatttggaattcttgcaagatggacaagttggtgggtatcccatagattgttttgctgcctccataaaagatagccagttaaatttgttgaatttaagggcacccacaatggttatctataggctctctacaagagatccatgtcagcatatttttctacttggaagatattaaatgaagagagagagcaaagctatctactaacttagagatagtctatagagaaaaacgaggcaaggcatgagagagctatagatacctatgtagacatactattgaggtggtttactattaatctagtctattgctgaaatgtacatgttttatagaaagcacattactttaccattgcgggtgctctaagcaacgtcttttggccattctacatgctatgcttatatactactccctccatctacttttgatagtcatatttcatcttggcacacagaccaaggataagtaattctatttatctttaaacatgctactccctccattccaaattgatctacatatagtttttttgaggttatttctaaatgatctacatatttatgttcattcattaggtctattcgttatttgtgcgttggagtaaatggacattgatgcatgcatccatgcacacaagcatttataacccacatgcaatatcttgatttgctattggctaggaaatagtggggatgatgcatgcattgagtttgttgctagagtaaatatagtatgagagagttattatttttttttgtcttggtatacttatgaaatatgtagatcaatttgtaatggagagtatactagttattcctcgtaaatatgcgattcattaatatttacatttctcgatgcacatatagccaatcttgtgtggaagaatagagagttacgcattaaatccgagaaagtcattaagagaataggttgttggattgaaatatgcctatcaaaaataaatttttcatatttggaaatatgcctatcaaaagtagatggagggagtagtaattagcaagcacctagatagattcacagcaaaaggtttgcctattgataattatggagacattaaggcagcgcggctgttagtactctaatgatttatttttttaagcttaagttatttggtttggcttttagatgcgaccgtatatgctctttttatatatgaaatagactaaatgaccaactcctaactagtcagaaatgactagtaagtcgactctacaagctttctactcattgatcgtctttactatgttatcaggattatcccttctgaataggcgtggactttaaagcagtagtgacaatgacttgttcagtatgtcttatgtaaaatcacatttaatttaatcaagaactgatttgatcttttagccccaactttactgtataagttgttgggaacttgggatgcctttctggtttctacctttttaggcgttctagtttccacccaaacgaagctgtttgctctcgtacggctgtgtaatttatctctacgtgctaaattgattaccttgcattggaggaacaatattgacgcttaacatgtgttacagcggacttgttcaaactggttaatatgagtacataccattttttgcataccctgctgatgttaatctcagatcgttctgtagaaattcatagtacgttcttcagaactgtagaaaatctcagattgctcatccgacagtccttgtgatgttggattgtaggagtacctatgaggctatgacaaatgacaatccttgtgatgttagaaaatatcaggttgtagtaggattctgtagaagaactatgacacgatctttaccttttcgacgtcctcctgcctcgtcaaatgtcagttccagcacacttctgtgagctgtgacgagaaggaccggaagaagtgcatggtatcgtgtcattttacagtgttatttccttttgagtctctttttatagcactatctttgttggatcttttcgttcattacttctactccccctttccaatttttttatttttttatagattttttctaagtcaagtatttatatattttattaatatttttttaaaaaaaatcatagtttaacaacgtgtgaataactctctgtttctttttttttaattacacagtacaacacagacactcacaacgtacatgcactcactcttataaacgtacgcacgtaaaccctacctctgtttctgtttacgaggcatgcaggcatgccactatacaatgaaaatgtcaaagccagcgaactttagccattgattcctcataaatggtattgttaatacgcatacaaaagtaatctttcacgaaactacgtaacgtaagagtataattctattgatatcgtttttaatactaaatgtgcaaatcctggagtaatcattggtgaaaattcactaactttgactcttttactttatatagtagcatgttttataaaaagaaatgaagggagtttatatatatcatgaaaatatttttaagatgatgttaagctatatgaatttttaaaatttagtaatcaaaatatatcaatgtttgactgatgataaaactatctattttagggaattgatgatcaaactagaacgagacaaaatttaagacggaggaagtattttaatggtgaagctagtgtagtactccttccttccctaaggccctgtttagatttcatcctaaaactttacaccctatcacatcgaagatttaacatctgcatgaagtattaaatatagactaaaaataactaattgcacagattgcaattaatttacgagagaaatcatttaaacctaattgttccatgatttgacaacatgttgctacaataaatactctctttatctacttttgatagttatattttcaaatctgaaaaaattatttttgataggcatattttaatcgaacaacctatcatcttaatgactttctcagatttaatgcgtgactctccattcttccacacaagattggctatatggacatcgagaaatataaatattaatgaatcacttgtttgcgatgaatgactagtagcatgtttaaatagatgataagtagaattacttatccttggtctatgtgccaagatgaaatatgactatcaaaagtagatagagagagtatttgataatgacggattaattaggcttaataaattcgtctcgcggtttactgactgattctgtaattagtttttttattagtgcctgaacaccctatgcgacatcatatataatacccaatgacacgctaaaactttatacccatagaactaaacaccccctaattagagggctgaggatgtgaaattttgttgatgttgtctgtccctcggctatttgcatgcatgcggaacgacgcttggagaattgctaggtagtaacgtttagagaaccgctctctgcattccaaaatttaacatataaccacccttaatcaaaaaccaagaaataattattaacatatcctaatttggatcaccaataaatatattttaagagtagaagattttaaaaaataataatttaatggagatgaagttctagtcaattgcatactacatgaatgcagaaaaaatcatagtcaattgcatatgaacgcatgccttatnnnnnnnnnnnnnnnnnnnnnnnnnnnnnnnnnnnnnnnnn

SEQ ID NO: 23581 - DNA, 17532 bp, Oryza sativa
  unsure (1)..(17532): unsure at all n locations
tgtttgcgatgaatgactagtagcatgttaaatagatgataagtagaatacctatccttggtctatgtgccaagatgaaatatgactatcaaaagtagatagagagagtatttgataatgacggattaattaggcttaataaattcgtctcgcggtttactgactgattctgtaattagtttttttattagtgcctgaacaccctatgcgacatcatatataatacccaatgacacgctaaaactttatacccatagaactaaacaccccctaattagagggctgaggatgtgaaattttgttgatgttgtctgtccctcggctatttgcatgcatgcggaacgacgcttggagaattgctaggtagtaacgtttagagaaccgctctctgcattccaaaatttaacatataaccacccttaatcaaaaaccaagaaataattattaacatatcctaatttggatcaccaataaatatattttaagagtagaagattttaaaaaataataatttaatggagatgaagttctagtcaattgcatactacatgaatgcagaaaaaatcatagtcaattgcatatgaacgcatgccttatattatactccctctatctatttttgataatcatattttatcttggcacacagatcaaggataagtaattctacttatcatccatttaaatatgctactagttattcctcgtaaataagcgattcattaatatttatatttcttgatgccgaagtagtcaatcttgtgtggaagaatgaagagtcacgcattaaatctgataaagtcattaaaaggatatgttgttggattgaaatatgcctactaaaaataattttttcagatttggaaatatgtctatcaaaaatagatggagatagtacaatactaaaaaaaaagttataccttatattataaaatggagggagtacaaccattataattgaggacaatgaataaggttaattaggacgtgatctttttggtattggcctgtgtatagttcacggcaaaattagaagtttgattaaaattttaatgatgtgacgaaaaattggaagtttttgtgtaggaaaattttaatgtaatagaaaagttaaaggtttaaagaaaaagttaaaaactaaaccaggcctcggtgatttttcttcacgctctctgattagggacggagagggagtagtattgacttcagtccttgcatatcccggtaccgccaagtctatcttggccatgaagaaaaaacatctgagcttgcaggtgttgataattgtagtagatcgatcttgaagaggacgagcgtggcctcggtgcacaatccgaggagcacgagagctgccgacaccgcagagcgtccagctcgacctcccctggctcgagatctgtggacgcatgcattgcccagcacaaaatggtcactcaactttcctcgcgataacattcatctctagcttcatgttgcttaattaacttcccgtgtaatgttagtattacttaacactgtcagttgtgaccatttatacacgggaaaagctactttccaaaaccgccagggccggggttacagcaccccggcggtaagcacggttactgcgcggtaattgcggtaaccgtgaaaaaccgtatgaaatctatcaaaaatttaaattattttttaaatttatttaaatttaagaaggttaccgttgtatttatattaccgtaccccgcggtaagcgcggttatcgacggtaagtcgaaccctccatccatgtcatatggtctcattcttttctaattgatgcatttcatgaaaaatattttttatatatagaagcttcaaaatatcaaataattatatctttcaaatttagtagaattaaaaacttaattaatcatgtgctaataactcatacttaatcatataatcgtgcgctagttagacacataaaagttgatttcatttgaaacaaagagcatgtaataagtacgttcgtgtagcacgttgtgtgttgcatgattccatagaaaaggcagaagcatcaaacacatccgcacattcagttgcgtgagttcttgtgcgccatacacatatactctccctccgttactaaatatttgacattgttgattttttaagcacatgtttaaccgttcgtcttattcaaaaacttttgtaaaatatataaaactacatgtatacatataagtatatttaacaatgaatcaaataatagaaaaaaattaataattacttaaattctttaaataaaacgaacactcaaacatatttaaaaaagtcaacggcgttgaatatttagaaacggagtgaatacatacgtacagttccaaggcgagagaaagctatgatgctcgttgacattgtgtatttttcctttctggaatcaaatacgagaagactaatttagttttgtgtcaacgcgttgacagtgcaccgccactgaacgaattcgacggagtttagcacgtgccagctgaaggctaggtttctctttacaaaattttattacaacgcgggatgtcttggtcagaatctcacccaaagcacacataacggcaactttctcatgcacgtttaaattaaaaactttaattacaacttcttacagaatagtaattgaagtggataacctccgttttctactcgcaaaacctaagaatgttttggtctcagatgcaggtgtgcatttgcagatcattacggttggactacgttggcactgttcagtactggagtagtacaagctcgcttttgtcctcacccccattgctcagcaaccacggaacagggtagacttctgcccaagtacggctgcaactgcaacagctgcactgcaagtcagcaactgctatcccgaatcataatgcactgggtttgggaaagttcctgaagctttgccaagcacaacccatttcttgaacaagaacagcactacacctgtaggactctctcaattacagtaaaaatgctttcagcaaaacagttccttttgtcgactgtcgacatggggactcgatgactcatcatttcatcgtcagttgaacgatcattactactacctgccatactttgtcagagttgaaagtatcccagaaagaaggaactactgctgctacatgtttgagcaacaattgcatccatgcatgtcgccctgttgatattatgttaatcccatatgaatgttaggtgcaatgtcaaggtcgcacgtatgatcgatctggaccatccgctaccaatcagatggcctctactgtacaaggatcgccctgcaactcgacctgcagaggagaggaccattggcgtgccgtgccatctatccatctaataatctacttgtccacagtctcatcactgttatttactcactcatcaccacaaatcgagccgtccaaaattgacctaaaatggtaaggtagcagtccaaaaatttaataccactcccactagcaacccgtaattccgtatcaatagctctcgtttaacacatgaaaacaaccggcgcagcagcagcaaaccctcttccggctaattccagcaacgtgcgtggaccaagcccaccatggtccgactggccgagcaaacctggcccggtccacgtccacgaccgggcccacccgtgattagatacgtgtcaaccatcctcagttcctctgacaggtgggtcccacgaggcactaaaaagccaaagtaaaaacaggcgacgaaaaggctctccctgtgctcactggcaagcaggcgccagggtttgcaaaactgttcggctccagtgcgggccgggcccacccgtcagcctcactccctctgcttgcggcaagcgatgctgttggcccagccgcaaacccagcagttaccggtatgcgaccatgattaaggataacattggtaattaaatactataaaacttactgattggagtactacatagtcaaataacttgcataatatcgttgccaccttgagcatgaagcagtgcaatcgaaaaaaaaaacaaaagggaatttaacgatggatgcatggaaggaaggtagcattaacattgcaattgagatgttgttaacaaatgtaccatcaaggaggacaataccactactgctaccacttcataattaggaggtccttctgctaacaagaacagctactccttaattaattaccactgctaatattgccgctactcccactctgttcaatcaaccaatcgatttactactactagctcgtaacaacaacaccataacaagggaggaatttaacatggggttaataaggatcgattaataacaggagattgttgtgattgtgatgatcgatgaattactagcttctgggatttcttgcctgatagtagatgtcacagtgctctgatctgctctgctcagctcaccgatcgtcgggcacccggtaggactcgacggtgatctcggacagccatgcaccgggaaatagcagctggggacgtgaatttttacgaaattacggatgggtccctggaggatgaacggtgggggccgaagcgtaaggaaaagggaagagatggaggaggatgaactcacatcgagttgcttctgcacggggcgaggtcgccgccgaggccggcggcgagggcgcgcgccggtgacagcgtagacgtcctcctcgatctcctcgctcgtcagcgtcaccgagaaccgcgccctgtcgagggcctccgcgcgggccctcgcggccctccgctccggcggcggagacgcgctcgacgccggggcgaccgccgggcgacgtcgactgcgcagcttccacgggcgcgaagcagccgccgccggggccggggcggctaccgccgccgcaacttccgcgtcggccaccacgtcgctcccatccacctcgcggaggtggagcaggagccgctccttgaccccgtcgagctgctccggggaacgcctggcggccgcgatggcgtccccggcgcggttgacgtgggcgcaccgcaggacgcggtggctcccccacgtcttcagcgacgggaacgacgagaggaccgcggcctggtggcgagcgcttgacgccgccgcctccaccgccgcggcgccatccgcgacgggatccgggggagaaggcgggtgcggctcggcggagatcaccatggccgcggccgcgggcaaagccgcgacgacgaacgcgcgcgtggaggccgccgtcacccagacctcctccgactccgactccggtggcggcgacagcgggggagggggaggggaagagcgtgggacgtggagaggagggcggctttggctttggggcttgggtggggcgatggaatggaagtgtgggggaaaggaaaaatagatggaatagttggtgttgcttgtgaataaatattgggggcgtgtgcgttgaggccaagtttttttttcttttcttttttgttgttggatgatttttttaaggagagaagtgtgttttctcttgatgttgatgggtggtaaatttggataattatggaactgcatgggggtgtggttttctattttcatgcaacaccttcctgccgtcttctaggtccattctttaacaattgactaaatttcgcggttaagcacagcacggataagcactattttaggatgatattagtaggatcgaatgatggtttttcccaacgttgtctcccgacacggcagttatagcaagattaattgaatattagtaaaaaacttgaaaaatatattaatatatttttaaaaaaagtaaattttcatatagaaaacttttttaaaaaaatataccatttaatagtgtaaaaagcgtgtgcgtaaaaatcgaggaaattgagttgggaaagaggagaaaataacatggcctttaggcagtcccaaccctctacctaggatggtgtttatggcattaattacattgctatgtagaacttttatcttatgtggcactatattaattaagagagagtgaagagaggaagaaattgggtctcatgcaagacacagctttaacacgagaacctatgcaatagacactatcaagttttgcattgggagagaataatgtcttcataatagatgaagaataaatatgattggtagagaagatagatgatgtatttattaatggcccactttatgaaaccatgggttgtgaagtgtagtttctattgtgatgtcttattggcataacatcatagacactacttatggacattatgagttgggactgcccttaacctctactcctatttatatgttctttcctcaagattcctagcctcacctctcatgttatccatacacacgctttccaaaatactagactatgcgagttttttaaaagttaatatgcaaaagttactgtaaaaaatcatattaattcatgttttcaatttttaagttaacacttcattaatcatgtgttaattcatcgtttcgttttacgtacgacgaggatgatatcctaacctcttcaaaataacaaagccttagaatttgattaaacatacctttgtatatgcttggtgtatttccatgtttgttttgtgcttcacaaaacagcgaacatattttattcacgggatataaaatatctacttgagtgtagtgatacattaatatcttaaaagaaacaaactttacaaacaacttaggacagttgtctaagcaatttaagattttttttgacaaatcctatttttagaaacataaagcaaataatcataaaaaacaatccaatagattaattacaaaatcacataagaccttattggtttggagaagattaaaaaggattggagggaattgatggaaaataatttaacacaataataagtgtaaataaattgcttccaatccctcctttacggggattaactgaacatggtctaactgaattgtcactacagtcgattggtattatgagatgaaaaactgaacaattgttgacacgtgcaatggcaatatctctccgagcatgatccgaatcccctgcagtttgaattgctaatgctacagtctttctcggtagcacttgagcacttagattaaaaacgaaacggttcagatcagcaagtattgtagcatcaatattttattttttagcttgtactatcacgttaataccgtagaggttggttatagccctagaattatgaatagaaggtgcagatttctcctaatttaatttactgtagcacctctccatttcatactctaatgcagaggatcccaatccgagcaatacatgcttgatgaaacatgctggatacaacacaaataggattgtgatatgattacgaaaagtggtatggatttcgtgatgattgttgcaaagtaccactgccgaccatgtacgcaaggaagcgcgagatgacgaggggcaaaatggggaaaccacactggaaactggctgcgcggcgtagcccgagaccaaagagcatccatctccatctccgagcccgacctcgcgaacagcccacacgtacgttactgacgccataacgtccgagccacccaccaactaaccaaccgacatgtgggccacagccgttgagccccacactccagtgtccgtttacgtatcgcgtccagggaggagagcacggatcgcaacggaaagtgcggcgtgcacaaaaaactccgtatccagcaactggcatgtgggccccacaggatggaggccccacatgtcagtttttttggggggtgtctccgtcttttctctatggtttgaatgttcttgggcgtacggctgtcacgtgtttccggcggacgagtcttttttcagcggtaggggtagtacggctgccatgtgggacccaccaccgaaaaccgtagtgactctctctctctctctctctctccatgcaaaagaaaggaaagagaacagctttcgcgatgggacggttgattctcctgcttgtctcgctcgaccgccgacgacgaagatacattgtactcccgtctcactgccaggtgggcccggacgtcgtgtgcggttggcgcaacgcgcaacgatttgggcaacacgactaccacgccggtttcgaggtttttgttgtagacgcagtccatggaccgacgcgatcagtagccgtccattctgggcctctaagattctcgaagcggtcgatcctgtggactgggtctacgctgaatctacggaaccaaccgactaacgaggtaaccaactgtttactggtctccatcaagtttataaccgctcgcgtcgcgcccatctccaccaatccaccaccgccacgccacttcacccttgttttttttttccccttctcgcaaagttcaaaccccctcttcttccctccctcctctcctctcctcgcttccgggttccgccgcggcttcatccgatcgcccgcgccaagaactcgatcctcatggaggaaggcaagcacgcggttgttgatctctccgaggaggaggagcgcagaggaggaggggctccgggggagggtagctccgacgaggtcggcgatgccgtgggcctggggcgaggggccgagtcgacggagccggagggctcatcggcggttgacgatgccggccatggggtcgcggcggaggttgccaagaacgacgatctcgaggtgagtggatgagggatgagccgcattgggtgctgggtgctcgaccgactctaacttctctgtttcttggcggttcgtcggtgcaggaaccgttgctcgagccggagggagtcacggcggtgggaagcggcggcggagatgggaccgcgtcggacggcggcgagaacgaactccatgaggtgcccaagaacccgatggcgactcgcttcggtgagtattcccgaaccgctcccctgttcttggtcatcttcttcccgaatgaatgttcccctgttcttggccatcttcttcccggatgaatgttcccctgttcttggctatcttcttgattcgtctgacgatgattctttttcagcgttccgagccacggatgcaaacgcgacgccggtctccacctatcgcggcatgttgtcacgaagcaggaagaatgccggcccgacgcgcttcgtctccgcgggagctcccccgtcggctgatcccgagactcctgctctgagcacgtcgtcgtcagagctcgtgaaaagctcaccggagaatgcctctgcagtgcccgatgctgaccatggcgcctcgccaggcagaggaaacgagcaggatcttgaggcggccgagaagcagagcgaggctcgcttcggtaagatcactaaccccgacgagttcttgttcttggttttcttcttgatcgattcgtctgacgacgagattgccagtgtccggccacacggcggcgaacgcgatgcccccctccaccttccgcatccggccgtctcgaagcaggaagcaatccagcccgacgcgctccatcctcagggaagccgatccgcctctgcctggtaagatgacaattccaattttccaaacggcttctgttcttggcttggtttccattcgattcctctgatcaatcgacttcgatcgccagctccgaacgcgccgccggcggcggcggcggcggcggagtcctcgcaccgcgagccttctcggagcaagaagcagccccgccctgagcgcttcatcccggaggaaggcgaggcggccgcccgcgccaaggcttgccggagtggcattgctctcgacaggttcatcacctctcagctcaacaacccgtcgggaccgagcacggagtgggagagggaagtcacggcggctgacgtcgtcggcggcggccagggagaggaatgcaccacgagcgatcagccttcttggctcggtacgccatctctgattcggggccacctgaagagccgctacctgacgacaggcgaagaatctacagcgttctggccgttcttggcgtttcactggccgtcagtatggccgtgctcgcgctgttctacatctttggatccgagtctccatctccgcccagcgacccgaaccaggaggtaatcttcaaacagtactgattctgaatttctgatgcatggtttaatctgttggtttttgtgagttctgatgtgaaatgtgctgttcttgttgtctgtgttcttcagtgacagggagcgatctgaatgattcaagattcaggaaaggatagctgacacaattccttatctgtaattactttttcctcttcggtgacgcgctggtgttatctgcttcactgcttgtaagggagaagatttgctgagttctgttcgacgcgttgctattagatggttgtaaatgtagcagaattactgattactgtctgtcttgtacagtttcgatcgtgtgttgttacacggtcgctctggtgcctgtatataagtgaaagaaagaatcactgcaagatagcattagtttcatgaacttcagcctttctgtgttcagaatggttgcaatatgcagtttccttttttttcgtaaagaatctaaacgatatggagctgccatttttcagttccacaggatgaaaatatcagcttacagattaatgaattcttgttatgtgaagtgtgaatgttatgtcggagatgtattctcccctcttaattgcggtggacatctgtacactgtttcagaccttgtatgttcatctgaatcgtggattctttgctttggcctgaaaaataaggaaatggaatactactgttctgaacctccttattcttggtctttcttaaggaaagcaggagctctgcagtgcattaaatatagtactctagaaaataagtagggttacaacatttgcgtaatggaaaaaaactggaagaaacagaaaataaaatgaatagaattatggattcttttcataataaaaatatgctttcgttgagagtcgaactcaagacctcccgcttactaaacgnnnnnnnnnnnnnnnnnnnnnnnnnnnnnnnntgttagctcgcaaaacggcacttgttatgttagctttgttcttactaaactgcattagtacaacatgaccagagcaacaacttacactggtaaatcataatactcatctcttgcatttaccaatgtgttaatttgaaacattcacaacatttcttctttatttgttctgctcttgaatccaacccctgaatccatcgactgcagacggcccaagactctgaactttgtgaaagtgcagtgtcccgtagaggccggattggatgcatccattgaagttagtatccaacaaagctggcccaagcactagaatcccagaatcactgcttccattttccttccaattttcttttccagtagagaggagacaccaacaggtacaggcggaggcttgtgctatccggcatgcgctgtggctggccaaagaagaaggcttccataacgtgattgttgcttccgactgtctttatgttatccaaaagctaaactcaactgggcaggatcgctccaagatcggttgcctggttgaggacgtcaagaagtttggtgttgagtttatcagtgtttcctttatccatgttagtcgttgttctaatgtagcggcacacacattagctcgttgctctgagccctctgtctgtaatgtttaccgtaatgagactccggactgtatccgtgagatgctcctgtctgatgctcagtaatcaataaagtgccgtcttcatctaaaaaaaacaggtacaggcggctggacagcgccaagctcgccgtaacaacagtgtagtgagctataaaacgtcaagaaacaccatagatccagggggttggccccctaatctaatcagagagcaagcaaacacgagggcaactgtaacaccagcctgaagccagtagaagatgccagccgagtgaacagtgatcactgaggacgaacagaaagaactgttactatacacagcacagccaaacattcgttcatatggcttccctgaatacaagggcgaccctgtttcagatgctcccctatactttgaccattgccgcctccatccttaggtttcagtttcttcaacatcagcttaatctaaagctcaggtttttgttattagtagtacttttttttctcgcacgcacagaaggattgcacgtcaatatattagaagaaaagaatatttggtacacaacacattaagccagaccgacttatgccaatagaggagagaaacaaaagactaagggaaaaaaaaagactcggatactacgactccaaacagcgggaagggggcatagcccactactctcctaataaaaccccaaaattagcaatgccagctaacaaacaaagatggccctactagtagtactttttacttctttctcatattgaagcaacatttggagctggtgttagaagtagaagtgaagagaggttgcattactgcgtcagagttgtgttagctgtgactgattaacaggtcacttgaactagatgtgtcagtgagatatgatcatatggttgctaattaaaaaaactctttggcaattatgttaaataaatcgtttgcatgcatggcactgcacaatgatttctgatctactctggtccagcatctctcaaaagcgaaggcacggaagaataattgggcgtgtgttcagaaggaaggtgactgttcagttgctttaatacttttatacaactatatatgatgtattgtccaacacgctgtttcctgatcgatcatgcagacgtgtacacggttggagaatggagacagttaccttgtcatagatagagttcatgactttttaccagagacccagactagattcacctgtgtggtcaaaatggagaagaattcaaagatcttttcgctttttcttgtttctttcttcagtgcggcgcctgaatggagaaagaaaaaaggaaagagaggagggcgagaggctaccttttctgatatttgtttctgtcttactgtctagagagcatgattttgggatatttgatcgaaatatgcatgaaatggagccaacatgggttgcccatccccccgtgtttgcgctggtttcactgattgagagatagggactagttaggccacccccatcatattctgttccaacaaagagcttaacaatgtcttgctgtcgatgtctcgccatgcattacattacagcatcaacagtgacacagtgatcatgcattttctagccttcgttgtaagttgtactaactaattgtgaatatctcattctcaccgatgctaaatttaactaaatcccagtatatatcgatgtcgcctctgtacattgcgcctcatgattcaatgatggttgaatgcatgggactagcatggattttagaaaatggacaatgctgcaaactgagtagtacgagcagcagtacaacatacgaaatgattaacatgacggttttgggtagaaagcagagcagcggcctatgtacgtaggctaagcaggatgaaggctgcacgccaccaaaaatgccaagctggattgccaaaatttcacatccaaataaacgagaaaacggcaaaggcatatgtcattcacgtaggtaggtgaccgaccaggggacccgtcccgcgcgcgttacaccgatcgaatcaatcgcggtccgcaccagaagtggatttttatctctcgggagatatctctttccatgtcacttagatgattataaaaaaatttaagaaaatatattaacatgtaatatatcactcagcaaacatacaagttcaaattcaacttctacgtatcgcaacgaaaaagataaatttgactgtgaatgtgaatatatgttaattaggtgcagtttaatttgtttttttacgagatgtagaagttgaatctgtacttacatgtttatggagtgttatatcatatactaattaatctttttaaattttttcttaaccatctgactgacatagaggatcaaaacggtttcccgtccgcacccacaattccgctgcgaaatttgcacacacacatgcatgggtcccctgcccttccaggcctccgctctatttatccatttcttctctccaaacccgcttcgcctcgatctcgatctctcgctcgcttgtggtctcacactactactagctgtggcagtggcgccaatggaggaattagcaccggagctgatcggcccgaggatctccttctctcacgacggcgtcgtggcgaccgccggagcggcgacaccggcggcgcggtcggacacgtcgctcgtcgtcgtcatgtcgtcgtggcggcggctccccgagccggagttcgacttcgccaatgcggccgccgccgacgtcgcgccggccgatcgactcttcgccggcgggaagctgctgcccgtgccgccgttgccgccggttcatcccaagccaagcccgtgcaagcagcagcaggcaacaagcggcggcggcgtgaagccgacgagttaccagaggcggccgggttcttggacgtcgccgttcacgcgcagctgcagcgtgaattccgccacgacggcggcgccgcggtcggggtcggggagcttcagctgcccgtcgttcccgctcatgcggagccgatcggctggctcggcggccgcggcgcagggcggcggcctcggcggcgtcgtctcgggcggcggtcaccaccggccgccgcagcacaagaaagccggtgctacagcagcagcttactactatgggggcagcagaaatggcagctccggccatggcgttagggttagcccggtgatcaacgtgccatccattggcaccagcatggtgaacatgctgagctacttgctctgcgactgtggcaacaagaccaccaagaacaggggtttcggacttaattgctagcttaggtggtagtagcttagatagaagtaattaaacgattaagcaaatgtactcatcatgcttgctaagattctaaattcactactactagtcaattgggctatgaattgtgataaattttcgctagtttgacgctgatgatgatgctcctcgatctagcttgtgtgaggggaacagatggcaatcaatttaatgaagtgatctttcttgaaaagatccctttaatttagctagctagctagctattggtgcattgatgattggttttgtgtttggcaaggcatgggtgagcgacgaggagaggaaaggggggaagtgcatgcatgtgtaattgtgtgtgggggacgtgcgttggaggagccatggaaggatggatcattttgcggggttgatggggtgcatgggggagtaagggtccccgtctttccgcctgcgcttgcttggcttcgcagcattcttctcctacagcaaaattgccacgaaatcgacgggcatactttcattaatttaccgcatagttcgttgaatttgtaaaaaaaaaaactttcgcattcttcacggcatatatagtacgtccatttgccacagtttgatactgtggtgtagatcgatttgcacctgtgtttctccctgttccctgtctcttcttcttcatcctgttgtttgcatcctgtatgtcgcaccggatgccctacctctacctattggacagaccatactaaacgaacatgtttaattaagcacagttgtctaggcttcagctctagaaaagatggaagagctgtgccaaacacaccgtagctaagcacggatagttcgattgcagattttacattttttaggtcagggataaccaattttggccaagtgtactacagtgtactactaataacaacaacaattggtaaatggtaatgtcataacgcgtagcaataactatgatctcgtggagtgccggagaggaagcgatcaaagcgaggcatttctgagacccacacagatcacatattcacatgccaccgatctaacgtgcctgggcctccgaaccctgatttttgatcggacttggacgatccagatcgggtcgctattattggtagctctcctgtttccgttagtcttcgtgggtgggcctacaagcagcaacaggaattttaggcagaatgggcctaaaaagcccttctagtaaggttcggcccatattaagttatttacggcccaggtaccaggtggcccgattctctcgtaccaatttccaccagctaggcccacttggtggtgagggcccacagtaccaggcctcgctgcgaagaaccggcccaagtgagcttaatgggctccgatggaatcgccgccgcggtcgtgctcagatcacgccgccgctatctcggtgtggggaacccgccgccggctgcacatccgaatggcggagctcgctgctcgggaaccaggcagcccgcagcttgattccctgcagatttccatgcgcagccagcatcttggctgcgccgacgatggccggacggctgatgcgtcgatagcttgtggcatcgagctccacggccttgcctggccgcgccgcacgcctccatgcgcagctactactgaagccaggcgttgcgcgagccacccgtgcggcgccgcgcggagctcggcggcacgcgccatggccatcggctgccgcaagtgccatcaatttattctttgatgagtgacggtcggcagtggttgaatcggttagttcactgacttgtctgttcatcatgttaacgaatagaagcccaaaatcctagttggtcatataattgatccgaatgtctcaagcttcaccaattgcaaatgggttaattgccgtcattgtaaagaattggcaacctgtggtttgaagcacagttgatctgatgaccaactacccaacgagaattttcagaacataacacccaatacgtactgctttcaggatttgtcatctaattcgtactactttcagaatacaccactggagtgcgaattttcttcgttccgtaacactccgtcccctagcgtcagttggcccgtcgtcctccgtcctcccggcgccgccgtcgtcaatccgccaccgctcgcgcccgcgtcagccccgtcgtcgccggtccgtcgccgcccgcgtcagccccgccgtcgcccgtccgtcgccaccatcggcgcacgcggtggagggccggaggagaggggagcagcggtggagggcggagggcgtcaagctccggcggcggaggttggaccggcgccggctctgggcgcggtggcggcagcctggtgcggcggcggcggcggctgagctcggggacgacacgagctagctcgccagatgcgtgcgggaggaggagctcgctagcgtggggaggtcgagctcgccggcgtgggggaggatgagctcgccagcggccagattcgtgcgggcaaacagacaggcgtctttgggtggacggagtgttacggaacgaaaaaaattcgcctctagtggtgtattttgaaagtagtacgaattaggtgataaatcctagaagcagtgcgtattgagtgttatattctaaaaattctcactacccaacctctagctggctagctgtgtaaatattagtagtccagaaagtcagtaagcacttgataaaatttggcaggcgccaggcgttctnnnnnnnnnnnnnnnnnnnnnnnnnnnnnnnnnnnnnnnnnnnnnnnnnnnnnnnnnnnnnn

SEQ ID NO: 23582 - DNA, 3633 bp, Oryza sativa
  unsure (1)..(3633): unsure at all n locations
nnnnnnnnnnnnnnnnnnnnnnnnnnnnnnnnnnnnnnnnnnnnnnnnnnnnnnnnnnnaccgtctgctacacctcatatatattcaggtcaagttcgttggcggctgaccgccgagtgaaaccacctgttaatccaactcgttttcatcagaatacctactgcaaatccaactccaaagcccacgccaacaaagagaaacatcacaatatcgacatgctcagaggagctctctacatgtggttcagcacttggaggactccaactggcacatttaggcaatgggtctccacaaagtcctgcgttgccttcatatgaactgttttcaaatgttgcaaattgacgtgactctggtatctttccctccaattggttattgctcaggttcaagacggttagaaatgtcaggttagtaagctcttgaggaatctcccctgaaatccaattcgaagacaggtccagtgactccagagcagttatgccgccaatctggggtggaattcttccactgaaggcattatgtgacaggtttagcacatgtagtgaaacaagttttccgaccgactcaggaatgcttccttccaatgcattatcagataagtcgattgctgtcaaggtagttaagatcctttcaaaagtcatagagaaccctttgcatgagattgtgacagtatcttggtaaaatccatctgatatgctatgacgatggctgatagtttctcctgtattattgtacttcttcatagatataaacttttcaaaccattgcggatgcaaactgccagtgaagttgtttgaggccaaatcaatgatttgcaagtttgggaagtgatctccagatttgtcctcaaacgtataacctatagaaccgtacaaccggtttgatctcaagacaaggacacgaagattggaaagacttcctagccaagatggaaaagtgtcggcaattttattatttcccaagtcaaggacttccaaatatgtgcagttacctagtgcccttggaagccgaccttcaatcttattcccatttaaatctattgtctggaaagcacatcttgtaacattggtaggtaacatcccttcaaagtgatttcccctcaaatttaatatgtttctgaagtacgtttgttccattaggcaggacggaaatggcccactaaagttgttatgcgccaggttaagtaccagcaggcttgaattgcaaatagaatgtggtatatttccacttatattattcttggacatgctgagataccaggttttactaagatataaagtgaagtttggcagaatagaagagaatgcattatgtgaataatccaagaattcagctgataagtttggtataggaatctgtccttgaagcatattggaactaagatccaaagtttcaaagtgcctattaaaagggagaagatatgaagcaacttccatactggtgagcatgttgtgggagagatttaaatgcacgacgctactgctccatttctcccatatccactttggtatgttcccactgattttattgcaagaaaggtccaaataagacatgtcactcagacgagtcaaaatacttggaaatttagttatattgcaacatgcaagtcctagctctttaagttcagagagatacgtagatgaagagttatcgccttcgtcatccataatgacagacaagttattgtgtgaaagattcaaatcacggagcttttttaaccttttaaaagatgaaagatccacagagcctgccaagttgttcaagtcgatttctagagcaattaaactagtgagttcaaagaatgacttgggaaactctcctgtcaattcgttgctggtcaactgcaaactcatcagatatgaaggcacagcatcaaactcttgtataggaccagaaaaatgattaccaaaaagatccaagaagagtagtgctggaagagtgaaaagccgtgctggaattttgccgctcagataatttgctggaagccccaaatatatcagtttgctcatgttgacaattgaatttggtattctaccagacatattgcacccttcaataaataacgccctcaattccttaagttgtccaattgaataaggtattggtccagaaaaccgacaagctgcaatttccaaggtctgcaacttagtgagattgccaattgtggatggcattggcccagtaaattcacaatttgagaataccatgctcttcaagcttttgaggttgccaattgcagccggcattggccctaaaaacccagggctgttgatatacaagctttttaaatttgtgagattgcctattgaagatggcattgaactgtatgtattgcagtttgacatatccaagctttgcaagtccacgagatcaccaattgcagacattattggcctagtgaggttacagccaaacaaccacaagcttctcaaattcttgaagttactaatggatgaaggctttgtgctagagaagtcaaactcagatagtatcaagcatgtcaagttcttgtgggcccctatccatgacaacaaattggatcctgaatctcctaacaattccgaattaaggagttctagatggcataaagaccagatcaaaccaaacgacgtgagaaaatccttagaaattaatttcccttcaagacccaactccttcagcatattgaaattgctagaagaaattcgtttagcataggaaaagttggtcccctctagtctcaatgtctccaaagaggttggaacttttggcaaatgccctaacagattcatattaaaggacaaatcgaggattcttagatttttcagttggaagaatttgtcaggaaaccacccttcgagattattatgagaaagtcggagcacagttaaattggcgaaacccatgaagaaatctggaaatagattgacagctataccagggttggactgaagatttatcactgtgagagaatggagcctcaaaagggagtgatgaataggagtgttgagagagcaaccatctaaactaagtacctgaagacgaggaactgattgagcaagggttttgcaccagtcatctacatttgtagacatatccacatggtcgaggtagagctctttcaaattgcttaggttttctactagggacattaacctggattcctgcagatgattataactgtcacctgtaaagataatctcatcatcactctcattaaaagagatatcactgttatcgttaacatagcgcttggaaaggtccaaggacacaaggttaatgagtttgttgatgcccataggtatctgaccatccaagcccgaattggagaggttgaggtgggtgagcgaagtgagcctatcgaattcagcatctttggtggtactgctggtacccaaggaattcatgctaaggtctaggcgttgtagggatgtgagactgaagagtgcaggttcaaaactatcactgtacatgccccgcccactgagatcaagtaccgtgacaagatgagaagaagcatcgcagccaactccctcccaggtacaacaatcggttccatcttgccatgtcggaaggatgaccggagaattaacccagaagaaagattgctttagctggaggagcgctgcagcctggtttggatggcacctaaca

SEQ ID NO: 23583 - DNA, 930 bp, Oryza sativa
tcccaggtacaacaatcggttccatcttgccatgtcggaaggatgaccggagaattaacccataagaaagattgctttagctggaggagcgctgcagcctggtttggatggcacctaacagtgttgttaccgccaaagtgggcactggatccggtcgctattgtgggaagatgtaaaaggaagagtagtagtgcccaaactatgaaagccattgatctgaacacaagcacttaacaagatggattatgagtagcaggatgtggtatggtatctaaatgacacgaatatataaaggagagcagctgcaaaactagcgcatgcagtggatcagaaaaaccaaggatagctcttgtgacggaagactaggtgtaacgtgttagatgggtttcacgattgtaactcagctcttacataattttccattagaaagcatctcgtaatcaatgttgcttcctccattccataatattttttaaagttatttaataacgtatactcctccggttctataataattgacgttttggacaaatttgaggtcaaactttaataactttgaccatcaataacttcaaaaatatttagtttaaagaaactataacaacatatatatatttgtctttcaaaacactataataaaagtaaacatgcatttatttattgtgtatattataataaaaaataaggtcaaaggtatattttgtagaccgtgtcattgttcaaaacgtcaattaaaatgaaaccggagggagtaactattttttaaagttatttaataatataagacggacatgcatgcatgtcattacctagcacatatttttcactaaaatattattattcaaatccttgaccatcaagatctataattgtagggtgcatgtattctactccctctgtcccataatataagggattttgagtttctgt

SEQ ID NO: 23584 - DNA, 1483 bp, Oryza sativa
cagggttgtaatcttataatttttttcatgctatattaatagaacttcgcaccatctcgtacgagtcgttaaaaaaatagtacaattttgcacacaattgacacatattatatctttttggcaaatacatgatacatatattagaggtgccctgcactccttcagggcccctttgaatcaaagggtttatgtaggaatttcataggattcaaatcctataggaaattttcctatttggccctttgatttaaaggattgaaactttccaaatcctatgaaattcctatggaatagtacattgcatgtggattttggaggaaatttagcaagagctccaacctcttggaaaatttcctttgagtctatctctctcatccgattcctgtgtttttcctgcgctccaatcaaacgaccattcctgtgttttccctgtgttttgcaatcttctgttttacacttcaattcctgtcaaaatcctgtgttttttctattcctccattttttctaacatgcgattcaaagggccctcggaatcttagaaatatgaaaaaaattcaccggttctttttgtttcttcttgagtgagagatacttttatagagttgattgatatgagtaccattcttttttgctttgatctttatctgtagatgcgcatggatgattgcacacacttttgccaagtcacgcacagatcagttccggaccaaaaatcgcagtgcctatctctgtctggcccaagtgccggcaccgtgctctctccttcgctgcccggcctctccatgtccgcgtcagtgtctgaattattggagcaacacaacgctggagtagtagttgtttatctcctcaggttagcaaatcgcacatctccctgacctggacaaaagaacgattcctcgcctcattcgtattcgtatccagagaaaaaaagaagccacaaaagagacgagaggaatatcatgtctgtgcaacttgctgaagtggtgaatgattattaatcaattattataatctccggcctacctctctttcgatcgaactgacgtttgttcgctgctgacttgccgtcgatcgatcatgaacaattcttaagaggagagcgagatcaagtaggtaatcttaagacgtggaatctgcccccctcgagaattaaaaagtcacatctctctctctctcttctttggtcaagaaatatatgcagatggaattgtttgtggatgacttgttggtggtggctgcttagccgtgggcgatcgatgaagcgtacgtatcagtggacatgtgctgcgtgtgacgacggcgtcggttagaacatggaagaagcagcgactcttccactcaacaaatggttggatttatgcattattttttcgaaaaatgcacgggcatatacacatcactacactacacatgtaccccctctttcccatataaaacgaatctaagaccgaatgtagtacgacgaatctgaatatatgtatat

SEQ ID NO: 23585 - DNA, 6073 bp, Oryza sativa
  unsure (1)..(6073): unsure at all n locations
taaaagatttgtctcgcaatttacacgcaaactttataattattttttaaaaaaattatccacatttaatactctatatatatatctctaaacattcgacgtgatagatgaaaagtttttgttttggaaactacacaaggccataattgacttacgtactgctagctggattcgctgttgatacgtccagtaggcacgtatatacacacttggacggtgacggttgagtcagcacttggcaattatagcaagttgcaatccgtacgtacgcagcgacgtgtaggatgagatcccgatccagtggtgcagagcttaatcaaatttacggcgacaataatacagctggtacgcgatgaacatgtcgtcaacatgaatgatttcgatcgacggagcggtagctgtgctagctgtgtgatcgatcggtggcggaagttcgttgcagatcagtagatgacgacgacgacgacgactagtagctacagcttcccagttgcatgcaaaaaagagagaaatccgtgcctactagttagctagcgagcgagctcctctggaagaataatcaccaccagtacgttgctggtgccagaaaataaccactacgccgcgtgacgacgaaggagatagataggatcggtggtgtaatctggcaggttgggcaacgtgaaggacgttccttcaccgacttgacatgcccaatttgtgtcgagatgcagctaagctagctagcatgttggcaagtgtaaccgccggtgcatacgctggtgtggtggataaaccatctttaatcggtcggccgaaattcacaatagtcccggtcccactaaaaatcgggattaaagatgatctttagtcccggttggtggctacagtgggcatatttgatctttagtcccggttggcaaccaaccgggactaaagatgatgtttagtcccggttttaaacctgccaggccttgttaggccccccgggatctttactcccggttggtgttatcaaccgggactaaagatcctaactttactcccggttggtgttatcaaccgggactaaagatctagaagatttagtaccggttggtattaccaaccgggactaaaattcaacgcttaatatataatccttcttccctatcctctcctccacaaccgcctcgcacttatcatctcagatcgatctccctctcctccctctcagatcgatctccctctcctccctctcagatcgatctccctctcctcctccccctcccattcctcctcccatccccggccctgtcctccccgtcctcccttcccatccgctcagatcgatctccctctcctcatcccctcctcccctcctccctctcagatcgatctccctcctcctccccctacacctccttcccttcccctcccatccccggccctattctctccctttcccttcccacgcagcaggcggccggctgggccgcgcacgggcccagtggcgagcggcggtaggcggcagacgctgccggcatctttttttttttacaatttgtgattcactaagatgtataattttataatttgttgcatgatctgagatgtataatctgtgatgtatttggtttgtgtgtaatttttttaagatttgtgatgtatttgatttgtgtgtataagtaacttaagatttgtgatgtgaatgttttgggatgttactttgatttgaggtttgatttggggatatgtatcccacttgatttgggagaaaatacagggattaaactctagctaaaaaacaatgaaaaaaagagacctaatgggactgacgctaccctctctttagttccagttggtaacaccaaccgggagtaaaggggggttaccaaccgagagtataaatggtttcttcaccagtgatatgtgcgtggccggctgggccagctccgttaggcaaacgcatcttgggggtgtttagagtatgtttagttagtgaaatgaaattttattttagtgttatatcagaacgtttgatcggatgtcaaaaggagtttttggacacgaatgaaaaaactaatttcataactcgttatctggaaaccgcaagacgaatctttgagcctaattaatacatcattagtacatgtaggcacatgtaggttactgtaacacttatagctaatcatagactaattaggctcagaagattcgtgtcgcgatttacatgtgaactgtgcaattagtttctttttatctatatttaatactccatacatatgtttgaagattcaatgtgatgtttttgggaaaagatttttggaactaaacagcccattagatcccaccctaaaattttacaccctgtcacattgaatgtttaaacacctgcttgaagtattaaatataggctaaaaaaataattaactgcacatattgcgactaatttgcgtgacgaatcttttaaacttaattgctccatgatttgacaatatggtgctactgtaaacatttgttaatgacagattaattaagcttaataaattcatcctgcggtttactgacggattttataattagttttttattagtgccaaaacacctaatacgacacactatataatatccaatataaaacgtcaaaaatttaaacctgtgaatctaaacacccccttcgttttcgcagcctgcgtactctccggactccggccggctgcgcctgccgcctcgtggtggtggtggtgggcgcgtgctttgtagttgcgcgcgcgcgccggagagaaaaacgtacagcggcgaaggagacccccatcgatggagtcgcgccattaatttgtcctacaccgccaagttgcatggagtaatccaagataagatgggttgcttgctataggctaaagtcacaaggaacatccgcgaaacgaaaagaaacaaaagagagaaaaaaaagaagaagatcgatcaccttggcgtcggcgcttgcgttgcccacggacgctcctatactgacatgtgggtcccaactctaccgcgagcatctttggcttggttacatgtgttgacacggcgtgtgtaccacgtcgactgaaatgaccggaatgcccatccaagccacgtccggctcacgtggaccacgccccctggttacaccgaccagatttattaacgtggtagtctaccacgataaataagtaatttcatccttgtcgccgcgccttcatcatgtcccgtgtgctaccctaatctacgcgaaaaataaaccgtttaatatttccataacctgctcttttttccacaacgatccagtaagtttagaaacggactttttcgcccatctcgctgtgacaccaccaaacaaagtcgtcagtaccagtaacactattactccatggaatacaatacagtactccatagttctatggtactctctccgtcagtggcggatccagaaatcggtccgttagtatcatgatatatctatcggtgttatagtatactaattatacttagatcatgatattataatatatggataagcagttttgctataggttttaccgaaagtcgtcggtgtcgcctgacaccgattcttatactgtagctctgcccctgctctccgtcccataatataaagaattttgagtttttgtttgtattgtttgactacttgtcttattaaaaaaattgtgcaattataaaaaataaaaagttgtgtttaaagtactttggagaataaagtaagtaaaaaaataaataataattaaaaaaattgaataagagtaagacctcgaaatccattatgttataggacggagggagtacttctactttgccataattaccactacggacctggacccacgtcttgccgaggcaactgattaacgagaaagacagggggcaaagcgataaactccggtaccccacgccgtgccaaatccgtgcactcgtcgcatttgcacccgtaatgacggaaacaccctctctaacctgagacgtggcaccgtagtgacaggaggggcaaaacgggcattttcatccactcgaggtcaggcgccgcggaggcgcggaatttaacgcggcggggccccacctccggtcgtatacgcagccggtggggcccacaaggagtaggcctcgcgcagcgcgacgtctcggtcgcaacgagggcgacacgtgggctttggatgggccgcatcggctcggagtcgggctccgatgtccgatccggctcggggataggcatggacacctactactacgccgcatccgatctggatccgatcccgtgccgtgcctgccgcaccgctacccaagccacccgcatcgagaggtttttacccctgtgccactatcggtttcttcgtctcacctcacgtgctctggcccacaaaagtagtcccactatttgacacgtaaaactttttctatataaggggtgattagattcagaaagttttggtgtactatatctagtatgatgtcgtaagggtgttttgcaataaaaaactaattacataattagttagtaaatcgcgagataaatttattaagcctaattaatccgtcattagcaaatgtttactttaacaccacattatcaaatcatgaagcaattaggcttaaaaaatcgtctcgcaaattagtcgcaatttgtataattagttatttttagcctatatttaatatttcatgcaggtgttcaaacgtttgatatgacatggagtaaaatttttggttgggatcaaagcagggcctgactctacaactatgatactatcttcgtttttaatagatgacgccattaatttttaacaaacttttgatcatttgttttattcaatttcttttacaaatatagaatttaagttattcttgaataaaattgataataaatcaatttgtaataaaataaaatataattattttttctttaatatgataaatcaaatttatcggaaggaagtattattataaatctccttgctcagctagtatctggttggttctgttcaatccgttgagctgataattttactgttcttttagatgaggtgggatcgagttgtgatgagattcaaccgatagagggccttgcttgtgcaactcttttcgatcacgatcaagaatgagttggcagccattcttttctcaatggttggacgtctaacaacctctaaatttctccctaattttgtcaatctaagatatatcaacacggacgaacagtgttctgcacccgtaacttccaccgctagtccgctaaagtgtacatacctagctatagccttccaagaaagaatcctggtgctatgcatgcaatttagctagcctaattaaagttgcatgtacaagcaacgaagcaagggacaaatttagatgtggccaacaaaacggtgactaagccacgcgtgtctgctgtgagaattactacaggcacgcgctatttcattgtccaccagcagcttccaaacaatattctactacagtaccacgtaacgatccttgcgtttcacgtagcatctaataattggatgaaaaataaaaatatccaaaaaaaaaacagctcaattcacacacacacacacaagcgaccttcatgaaagcccccattattttcctagatgttgtacttctactgtctacgtatgaaaatattactgtttacatcagaatctagcaccttaatttccagaaaacagtatttctggaacttccgtcgttcatatcgaaacttcttattggatagttcgttaagagatcgcatctccccacgtcgcccttgtgcaggcgacacggggggcgaaacgcccagcgccgccgcctcccccctggccgccgccagagctcaccaccggaaagccagctggtgagcgaggagggcgacgacggggccttctccgacggcggcacatccttttaggcgcgggggaggcggcgagcgccgacggcgaggagtggcagcaacgtgccctcccggcaaggcggcggtagatccgccactgcagtcgccggatctggcccgccacaggctggatttggtcgaagcgggtggcgacgccatggcgtgtagccggcattggggcgctgcantgtgtgtcggtgggcg

SEQ ID NO: 23586 - DNA, 4102 bp, Oryza sativa
  unsure (1)..(4102): unsure at all n locations
actccgatgtctctgttgccctgtcttcaactttcagttcctcctccagcaggccagacctcctcgccttccttgatgctccacccttctgttggccggtctgcttccaaaccttggtcgtggagtctatcggtggatgaggagacgtgttcgtccgtgaagttggtccaacttgttcgtggtcagggctttttggtctcacccgtgcttcaagtgccttgtgtgctagtgaacatgtcatagggccgagtttggagcggtgtgctttgtcctctgtagtgctagagttttagtgcttaggcggagtcggagctactgcatcgggtctaaccgatgagctgggcaacgataactctcggcacttttgctctggtttcttggaggttctgcacctttcgagggagtctcaggcgaaagccctacctagtattccaggcttgcatgcctgcaggtcgactcttgtggatcccccgtgtcctccttggaggtgtcgctttgtttgactctcttccccttcaggttaaaacccaatccagttttggatgggcgatggcagcggcttctatcgttgcttccctccttggaggcttcgctttgaaggtctagctcttacctcggtctcttatgtggctcgtagttgttttatcacatgctttttcgctttgtcttctatgtgggtttttgccggtttccccgtagtaaacagtgcagttgtatggtttttgggcctggttttccttataaacagggtcaattctcttatgcttataaattccgatagatctcctaccgtcgtttcttaaaaaaaaacttcttattggaattatttgataaacaaaacaaccctaaccagaatttccgagttatggattggaattctttttcaggactggggtttttagaaagatttaggtcgattttgaaacagatttgaacccgattttaaaggaaaaggaagagaaataatatattagttttattgatgggctattgtttcaatcggcattggcttaattagaaggtgtggtcttgtcttaatagatcttatagttaaattaaaacatcgtccaattgacaaaatcaatttattagttttaccttttcttttttctccttggccctttaccctttgaatctcgttctctcttttatttctactacctaggtgtgaagatcagagatactgtatacgcgcatggatagcatatccaactaaagataggaggtgggctatatatgtatattatgtaaatatagactagacttgtttatccaggcatattccataagtcttagtagtgtacaattatgtaaatatatgaggaaaccgagtcatgtacgattgggatccttccccttataaggtgggcaaagagccccctcagggcataaacacattaagatcttcagatcaatacaacctcttttagatacaatacctgaaacaggagtagagcattacttctcgtcgagagagtctaaacatatctaaatctttatccttttactcatccactttaatctcgtgcgctaccctattttttcttgccggtttctagaattggcactaggtttcttttgtttctactacctaggtttcatcggccgatcgagagcacgtgccatgacgaggtccctttatactaacaccggaagttccgatttattgacgggatgttcagtatccccatagcggagcatcttcagaccgttgtgggttgcaaacagaatgatcggtgtgtgttgtagagggcagtggtgttcctacggtattgtagccggggtcacaagaccccggatattccattctttagctgtttaagcttataataattacagtatattattaattgcaaattagagtattatatgtattaggacatgtataggattctggtgatttttttatgggttcgccattggtagagggacacgtttttgtcaataattacattactgatgtaacattatttaagaagatagaaatgatgaaacagtgactcatacatcaccttgtagcctactctatcctttattagaagttgcggacgagaaactgacaagcacattatcacatccgggaatcgagaagatgggcattttcatattttattttagaacagagaagatgcatggacatgcatggcctttttctccttgcaccggatccgtggatgatgtttacatttacctgcagatcgaatagttttcgagaaaaaaaatacctgcagaacccaatcagttcttatctatcggaacggtatcgctggttcactcctgttcctggctaagaactgccaagcgaatccaagttgccagagacgcaacaagtagccgccggaaaccatgaatacacagatagcgattgtgtgaggccaaaccgaaataacgtgtcacccaaaaagaacaaaaagagaaagaaagagagaacaactaggagtactctttccatttagtaccccaatttgaacgggtgttattacgtttgcgcgtgtgatatgtcacatacagagacgcaccttttattctcattttaattaattaggttgggttcctttgagggttcaaaacccttccctctcgacacataaaacggaatggttcattaatataattttttaaaaaataatgtttatttttttaaaaaaacacacacctaatttgaaaaatgtgcacataaaaaacaagaaaatagaagttacgaaagaggagaaaaacacacccttaagatttatatacgaactgaccatgacccacctggttaggttcttcatacgaaattgaaatgatagtagggagtgttgtctttccctacgtttgatttataatacggtagagatattttctttccctatgttgttcatgtccctcgtggggaacaatttaaggcgtagggtacagtagtgttggatttaagttataggtttggcatggataattatgtttacgggttattatcattgatatgcaatgtgttgattgatagcgagatacttagagatgctcatcaggtaagagatgtatgtgtgtttccataaaggtgtgaaagaaataatttagattacgcgacgctcagccagtaaggtctctgttggtaaaacttatccgaaatcaagtttggtgacataggtgctcacatttactatagcttttttgactggaattaatctagtgacacgatgctcgaatttttgatgacaacgagacgcttatggtgaattcgacaaagttgatccagtctttaattgtagtagtaggaatatagtgtgccgatatgtgtatatgagcgactaatgtattttttttaaagaaaataatttagattatggcattcgaagttgcaaacacggcgaaccaacgtgccgggcaaactatacgtgaagcaaagcgagcgatcggtcgatgcgtgcgtccacgctcgcgactcggactcgatccaccggctgcctgcctgcctgccttccttgatgccttccaacctgtggatctcggcatatgcaggcgacttgacttgtactccgttagcttagctagcatatctctagacccatcgacggatcgcgatgagtgatggattgcacgcaccgcacagcacacgggaaagcgacctccaccgtgtacgcacccatttgcatcaatcgaatatatcgtcatgcgtgtagccgcagggtcactagggtgtacgtgttcatgtgtttgacctggcctagctatccagtttcccaccataacctggtacacaacccacggcaatacggcgtttcaggatcgtgcacacacgactttgttccataggtacgagggaaaacgctcaaagaattctatatgtgttaaggctattccaatcagatgagttatcgtcagaaaagttaactgacgagtttgtctactgattgttatttttacctaatactatgttgttattgtatatgcaaggactaataaataggatatagtagattgacagaggactagtgtctagatagcgaattaaagataacgaacgctaagttccaatagcgaaattaaaaaataaccatnnnnnnnnnnnnnnnnnnnnnnnnnnnnnnnnnnnnnnnnnnnnnnnnnnnnnnnnnnnnnn

SEQ ID NO: 23587 - DNA, 7029 bp, Oryza sativa
ttcatgtgtttgaactggcctagttatccagtttcccaccataacctggtacacaacccccggcaatacggcgtttcaggatcgtgcacacacgactttgttccataggtacgagggaaaacgctcaaagaattctatatgtgttaaggctattccaatcagatgagttatcgtcagaaaagttaactgacgagtttgtctactgattgttatttttacctaatactatgttgttattgtatatgcaaggactaataaataggatatagtagattgacagaggactagtgtctagatagcgaattaaagataacgaacgctaagttccaatagcgaaattaaaaaataaccatacatttagattgtgtatcaatattaacatcaagtttcacttaaaatatagaagaaggcacaagatgcaaagttttcatattatatgtgaataatatcatttaagcattatagcgatccaacaaagttaatagtggattgctatagcggtcacgaaatgctataacaggctactataatggttgcggagcgctgcagtacctgctaagtttcaacacgctatcttcagtccgctgccttctagcagtaacggtagatgtccgctacactgttacaacggtcgctactaatactatttattaccttgcatatatgaggtggttaatgatctacacagttgctttggatgaatttattcaacttatgcaaggacgaatttaacgtggttgtcaaaattctttcctcgatccgccgctggtgcaattcttggatggaacacgtaattgtccaacgaaatttcttaggtgcaaaagatcaaggtagtacaagtgcatcatgttcgtttgcaagggagcaaccaccagtcagggtgctttgttgttctctcgttctggcttgcggtcaatacaagtgatgctacaagtctctggttgtggttggatctgtgacaacgtgtttagaactaatcaatttgcaaatggcctgcgtttagttgcctgtctctattaacaagttaccacctgagcaactaatttaattaagtctacaaaaagttgttaacttcaacctttttctacacaatcgatacaatactaagtagctagggaacaaaccaaaatggcagaacttgatgacaaaagagttaaaatatactagtgtttggcacaaatatgtgctcggtcatgtttggcacaaattcaaaaattaacgaatgacacttctatctcaaaataaaaactaaaatcttttatattttaagacggtataatatctattgtatcgttatatcagttgattcctacatcttccaaacaaaccatatatgtacaaattggattatcgaggcataactcatcgataacacatcaccgtcgttattactttgagactactttacatatgaaaaatataattggaggtaccgattgtcttaactcatgttcatactttgaactgcaaatataatgaataccttttttcatagtgaaatttaattcgatctttactttaaaaaagttattacaactaactattatagagttcaaaaaaatacaaacaactattatagagtttgtaaaacgaatatctattaattacttcctccgtaccaaaatataagtatttttagctatgaatctggataacatcatagtagttgttcagatttatagccaaaagttattacattgggatgaaggtagtagattactaagaatacgatcttaaaagatatactagcttgctttttatgtacgatctttaagtatatgactggcagagtactggtagcatccatgactatataagcatggataattaaaaaaacacaaatacacaaaaaaaatgaaactaaaaaggggttatactatttttcaaactctagaggctataatatacaagacaagatcctggtgagaggctgctagctgcaaccctatttacgactaatcatcagacaaaccacaacttggtgatggttacgtgggtgtgcattttccataaaactagtgggcaaaatgcagtctcgcgcacagttggccttgccaatttgtaaaagcgccgagaacccaccgttgaaaaatccaagtcaaaaaatagaaaaaaagcaaaaccaccagccgtagttgagccggctccaagcgagccgtccactcgcgattggtcggaaaagaagatcgctatcggctcatcttgggtcggctcggctcgcggacgccaaacccgcggacttgaagcgcagcggatagcggacttaagaatcgaaatttaaatcgggaaattaaatagaaactggaaaaaggcgacgcgcccgtgacggatggccccagaatcccgatctccacgctcccgccactttttgcgctttagcccctgccaagatttcttatcttatcaatcctctgaataaaagtatttgaaaaagtacccactgttctggtgcttgaatgtgcggtgtatttgcgtttaagaccccaagattttcatgttttgagaattgatccgacagttggggtcacatgcttggcgctttggctggttgggttgggagcgtggtttttgcccggataaagggtagagtggttggttgggtacttgggttgggttgggtggtccattctgtacggtgcgccgggtcgtctccgtttttctgcctaagccattttggacaacaaagaaaccgtgcttgaatactgttttcttctttcttttttgtgagggatgctttttaagtttttgggtgttggtcagatcttcacactgttccatgatagctgccggcactaacccttcactgtcgattaatatatatggtcgattctatagttgtagtatccatttggaatcctaattttgtcattatcactccaaaacaattaattaagttttttttgttctaaaggtattcctttcaccatactgtactattgtaaaaccatataaatgtgcacagcagtgacacacacagaacaaaaagaagaaatatcaagatccgcgtgggtaaaatatagccattcttttttcccctcttaactaaaaagagacccgttaaaacagcaccgattagcaattacccctcccacgaggcagagacggatgactttacagcgaatcaaaatccaaaccggtggcagaaaaatatcactccctttggaaggcgtctccgttccaacccccgtctagaacgcacggcacgtcaaggcaaaggcacgaccacatccatagaaacctgacttgccggctgcttgctggtcttccacatgccacacgcacccctccccgaccaaaaccaaataaagaaaacgtctctccgctcacgagagccagccgtgccaaccaagccctcaccgcaccgcgccgagccgctcccacgcacgcacgccacacatgtttttgcgcaaaaacccccccgcgagtgcgcacccggcacccgcgtccaacgctatatattacgcggcccccaactcggggtagcaccgcaaagcaacccccccttgctttttgtactcttccatctcacaatctctctatctctctctctcttccttacgcggcaaaacacaccgtcgtccatggacagttctaataacaacaacaacaacaagagggcgcgcgacgccgaggatgaggccgacgaggccaagaggctgcgggcggaggacctgctcgacatgctcgacgatgataccgacgccgggggcgccgccggcgacctggcgtccgtcatgcggagcttcgaggaggagattgttgctggggatgtcgccggggacgttgcccccacgacgcagcccgagctcgggttccttctcgaggcctccgacgacgagctcggcctgccgcccgccaccgcgtcctcgtcggaggaggaggccggggctggggagcccgaggatgccatcgggttcggcggacagatctgggggttcgaggacgagattggcggaggcggctacgctggcttcgccctcacctcgccggaggcggtcgccgccgccgccgccgcggcggagtgggacgacgacggcttcgacgccggcttgttcggcttcggcgacgaggtctcggcgcttcgccacgagaccatgccggccgtctgatgggcctgggccgaagtggattagtttttttttattttcctcgttttttttaaatttggctaaccttagctctacccttgtttaaccttggatgtaaagtttctagtagaaggttaaaaaaacagaggggaggaaacttggaaaaaagtttcatggatggagaggagaaaaaaaaaacagatgtaggcatggttaaaagaaaaaatctgatgacaatgcctcacgaacaaaaatgagaagaatggcttcatgccttcataccagtactacgaccttacaaatattttatttcaagcaaacgaaagatttaatttaatcagctgccacgataaattacatggagcagttcaaacttcaaaaggatattgtgaacggaagagaaaataatttcatggtggatgaactgtcgacgttgacctgcacacatgacaaaccgagatggaacaaaagatctgaaatgaactgtacagcactaaaatggacggaaaattcgaaatccgaagcttccagtcctccttggagtgcatgaaaaaggtgaagctgggaaattgtgaacgtttaattgaaaaggagcggataattgaggccggcatggttgacctagaaatgaaatctttatgcaatttcgtggagcgagataaagcccacaggaaaagatggtgagccaacgtctttcacgtcggtttcaggtttgccgtcggcttgaggtaaatgggaacgctggagaagagttcacgaaactcccgtggaatcatcctttctttactactcctaatctttaataaacaaaataaaaaacaatatcttgtgggtgcatatgatatcaaagtctaggtcgtatgtgcgcaaaccaaatcttgttctgaaaaactccctactagtactacttgacattgattaacacttgcgtttttaagttaggcggcaattcacatgacataacgaaaatcgagtgttcttctttttttttttttcgttccctctccatttgtgtcttccatgtttggttgaagatttccagtgcctgtctagtgctatcattgacgctaggggccaaaccacaaaaatacttttcctgcaactgcaagtataatatttacgggtcatcagtaacttattcgcaatcaaaccttctgtaattctctggcaatatttattttgggagcaggaaagttggattgggagatggaaagctgatagggccatttaccaggaaaatttaattgctgtgatcgcatcgcacacgtcgtgcttgccccggattgcaaagtagtcctaccacaaaaggttgtgttcaaaccacgcaagctaaagccacccacggcgttgtgcttgtttaggaataatcggtgcttgatttctctctctctctctcgggacgtcgttttctcgtatgagtaaggccggtttcagatgtgcgttgccggtgggttttctcatttcgtttgtagcgtgtgatatctcgcctgctctcatgtggttcgcggcgcgccgatcaaaaccattactccccggcaccaactgcacccgacccatccaaactcatcatgtacactgtatagatcgatggacaccaatcttggctgtttcctcgtcatcccccctcacgaaacacataaactcatcgatccggtacagtaccccatatctatagtagtccagaagcaacaaactgcaccgcgttttttctcggtcaagtgcggtacggtttttctcttggcgttttgcgtggtatgcaatagggagagggggtatagtacgtacgagtaatgcacggtcggttggggaggtggttggatcgcgagaggacggcatgcgagatcggttaccgcacacggccacatggtgggcagcggcggtggcgaccgaccgctgccacggcggtttgcaacgcaagcaaacagtacgtgacgggaggtcgagaggaggcggcaataatggcggaggaggaattgaaaaggtggaggtggagtggtggcagaagctgcatctgatggccattgcatgcgaatgtgtgtgtggatatctttattaccggtacagcgtctaaactggccgccggcccatgcagcgtgcgacgagctgcagatcacgcacatggactggtgccggtgccggtggttggatcggggatctcatctaaataaccgactttgtgttcaactcattgcaaccgctggtggtggtctggtctttgatgtgagctctccccctttctttctttacttgttcaaacgatcaaaggtgggtggtttatcagagagccatgaaccggttcaggatgtggtgagaaaacgatggtctgaagtgggtgattctgtggctgatgctgcccatattataataatatcgagctgtaactgcaaacggtgcgacctgttgcaatgcagtgacgttgaatagtttttcctttggttctgatgggctggtgcgtgacggtgaaatttcgggagcatatcactctcactgaactacccccggtctactctactgaaacatagtccagaaaagacatacgcttggtgggcctaaggcccaatgtatcaaggaataagttcatctgaggtcccttaacttgtcaacgagtccgattttcgtctttcaaccagaaaaccagatacaacaggtccctcaactatcaaaaccagtgcagatgagatccctcgacggttttgagagtggttttggctgacgtggcgcctacgtggcaaatttgacttggtcttcatctgatgtggcattaacgtggcgcatctgtggcaatttgatccgaaaaaataataaacttcgtgggacccacatgtcagcctcacacataaattaataaaaaaatggtgggggcccacgtgggccccacatgtcattctcagcatctccctctcttcacctagagcccctcttcttcttcctctctctccct

SEQ ID NO: 23588 - DNA, 3109 bp, Oryza sativa
acttattccatgtatcaatgactggtaagggcagctcggttcccttagcccaacacggcgagcgaatatggtgaaatcatgcggcctgttagcccaccgtgcggatctggactgtgatgggccaaacaaatatccggccaacctttttctctcgaaacatgttcatgccattcgcatgaattgttcatagccatttacgagcacacgcaaaaacgagtagtacctcacaaaaagaagcagtgcgctaacaaactgacatttaccgcgactgcaaaggtaaaacagcacacggaaccttttgtaacggtaaatccccaccggcacgcatgcgcgctacgtataccctgcagttaacctttggcccgcaccgtccactgcattttttactcgtttcacccgcctttctactcctactcggcgtgcaacgcagcggtgcaactgctgcacgctgaccggtccgctgtttgtgttcgcttggtcaccgcaggggatctccactccacgcaccgcacgactccacgacaaagttgggaatccatttggctgcataaaatatttcgcaccttccttcacaaaaataaaatatttcgtactgtaccaccatatgagaaagcgagagtccgtccaagtgggtggcgactcggccgcgcgtcacgtggcgcgcatgccgccccgtacgtgcgactcatcggatccgctcgtggtcgtgccacgccgacgccgatgcttttcttcgccgccgaaacaaaaaccggcatggtctactctactatactgtctactactactcgaccatgcatactgctgcagctgatgatactgtatattatcccgtctgaaaagagagagaggaaaatgaaaaactaaaacggcgcacgcagctcgcacgtgctgggccatgagggaaggctgctgcgtgcacagtgcaaacagcttgcacgcctcgaaaagggagaaaagaaaagaggagaagaagagaaaaagggacactaccggtactagcgagaaagaaagaaagattagtcaaattgcgcacaccaaccgacaagggcttccatctgggacccacccacccaaccggaccggctcgcttcactccctgggcctcgtgagtgagcacctttgggtctgggtctgcgtggcggccgcctacgcgcaccacatcgagtccacacatgacacacctcacgcgggcgggcgtgccagctgcaaaggcgagccgaggcccatctcctgcgacaaatgtccacgttggtctcgccacgatgagaaattccttttgctttttcctgccgaactaattccttcccgaatattatccccctctttatttttttctcctccaacgtgtaaatatactcgctatattccaggtatagcatattagggtttaaatgtttgtacaagattagtgctcgtgctcctataaggagcgaatattttgttcgagtcactgcattttgagtaaagaattttttttccatcttatgcatattgagtaaaaaaaaatacctttacatagaataatttccaaggtttcctaattactccctccatctacttttgatagtcatatttctaaatctgaaaaaattatttttgatagacatatttcaatccaacaaattattatcttaatggctttcttgaatttaatgcgtgactctttattcttccacacaagattgactatatgggcatcgagaaatgtaaatattaataaatcgcttgtttatgaggaatgattagtagcatgtttagatggatgataagtagaatcacttatcgttggtctgtgtgccaaaataaaatatgactatcaaaagtagattgaggggtactacataactagtgcagaagttactgttagtatacacttttttttacattggtaaccaaccttaaataatcaaaagaaactttttttttcggttttcaatatagatcgaatgtacaaatctttgactttttctgcgaagaatcctgtttacggcgcataataagatcgaagaatcacgcctaactgcatgcagatacagtgccgagaacagaatcagatctgcggattaacggaagacttgttttagcttccgtctttttatctggccatatgaaacagtctctcctaaaaatagaatcactgtatagtaaacaaatcttgggattgtcagcaagtgccaagtccacgtagaggaaaatcttccaaaatatatcgtgggtcatcagatgagagattctcgcacaaaacatgcttacgtgtcaaacgaggcacgctacgaaaaaagaggaagctgaccaatcgacggcccctccgtggccacatgtttttgcccgcttttccaaaaaaaattccgttccgttttacggtgcccgtttaccttggccctcaagttagctggaaacacaaaatccttccaattctgtcgtggggcctctcacgataatttcagcattaagtactttatttattctaaaaatatctatcgccatttccatgtgtcagaaattagttctgagttaaggacgtcttgattgggagattagccttggccgcgtggaatctcaaccatagaatcccaatccccttcttttccgttgccctatcactagatctggtcactatgcagaagtgtaaggggcccacatgtcatggagacgatgatgtacaggccaggcgtgtaggtgaagcatttatcatttgctagccgcctcatctcgcccattcgcttccccgtcataaagcccccccaaaaccctccccacctctgccatttggtgcttatccccatgagtggtggggacacatcgcccgggccccacatgtcagctaaaacccccgcatgcttccggacggtagcaccggtaccgagatttttactccgcgaggtgaccgctctgtcactgcgcgtgggcccggacgtagtagtggcccacccgtcactgtgttcgtagcaggcgactgtgcagaaatctggtgcgtgaagccgcagaatatcatccggaggcagagaggccactcccgcgtgacatgagggaccatatggtggggtgggcccacgcgtcaatgtgatggggtgggggataggcgcctgagggagaggaatgggtg

SEQ ID NO: 23589 - DNA, 7649 bp, Oryza sativa
  unsure (1)..(7649): unsure at all n locations
nnnnnnnnnnnnnnnnnnnnnnnnnnnnnnnnnnnnnnnnnnnnnnnnnnnnnattctaaaaatatctatcgccatttccatgtgtcagaaattagttctgagttaaggacgtcttgattgggagattagccttggccgcgtggaatctcaaccatagaatcccaatccccttcttttccgttgccctatcactagatctggtcactatgcagaagtgtaaggggcccacatgtcatggagacgatgatgtacaggccaggcgtgtaggtgaagcatttatcatttgctagccgcctcatctcgcccattcgcttccccgtcataaagcccccccaaaaccctccccacctctgccatttggtgcttatccccatgagtggtggggacacatcgcccgggccccacatgtcagctaaaacccccgcatgcttccggacggtagcaccggtaccgagatttttactccgcgaggtgaccgctctgtcactgcgcgtgggcccggacgtagtagtggcccacccgtcactgtgttcgtagcaggcgactgtgcagaaatctggtgcgtgaagccgcagaatatcatccggaggcagagaggccactcccgcgtgacatgagggaccatatggtggggtgggcccacgcgtcagtgtgatggggtgggggataggcgcgtgagggagaggaatgggtggaggagtggaaggggattaaatatcggcggaggagacgagcccaaccccttttgctcctctccccgttttggtcggggttttagcaagcgcgtgggaggccgaaggcgacgacgacgaccgcgccgccgtcggagaagaagcccgcggaagcaccagtaccagcacccgtatatgtcttctagccccttctccgatctggtggtagtcgtgctcctcgtctgcgcagtcgtcgccgcagccgtcctcctccccctcgtctgcgcccgccgatctatgcaccagaggctccacggctggaacaagtccacgtcgatgctcaggtgcgtccgggtgccccttccccccgtgaaatttttcatctttggcgaggtttacgccgatctggagtggatttgaccgggtttcgcggccggttcgtccagatctggagggttcttggtgggtttttgtggggtttttgattgatgggtttgtttctcgtctgtgattttgcagggacgggttcggggtcaagtattccgggttcctccacataaggccgtgtggtttctgtcgaggagattgacggattcgatcgattcgtgttcgtctccgtcaaatttttgcacaagagaaaaaaaaagtttcccccttttagagtttttccccttcagttttgtcagttttggtgaggaattttagagttcttttccggcaagagttagaagaagagagaaatggccccttccaagcagcagcagatgctcctcaagaaggtgatggcgaagaagcccaagacgaagaggctatccgggtttggccttaaaccctctgctgctttctccaggccccatgtgccgtcggcggcggcctccctgcagccaagccgtcgcgtccgcgtcgtgttcgaggaccctgacgcgacggactccgactctgacgacgacgaggacgccggcgccgcctcaaagaagcgctactttgagctcttcattggcaagccagcttcgtcgacgaagcaggcctctccggcgtccaccgtcgctgcctacgccaacatcggcaaggttgggagcacctgctaccgtggtgtgcgcctccggaagtggggcaagtgggcggcggagatccgcaaccccttcaccggccatagggagtggcttggcacctttgacactgctgatgcggcctccgccgcctaccagtctgcctcccgcaacttcgccgaagagaagcgccgccgtggtgtggcctcctctgcctcacctgctagttcggcgacccctactccgactgcgtcctcgtcgtcctcgacttctgccgcgccattcgcccacccttcgccgtcgtctgtgctcgaagccaccaagccagctccaaagccagagtcgccgccgctgccggagcaagctgcaactcccctcctggtggaggctaccaacgagaccgccgagctgccggatgacccagagttctacaaggatatactgcgcggtctacagctgccggacattgacccgatggatttccgagctgggctggatgctctggatatctccgatgtgccggcttacatgaatggcgaacaagacgtactcttcactgaggacatgctgcttggagacttcgctgaagaagatgacctcgacctcgacgacatcggtgatgacttctgcgaggatttcccagagatacccagcggctacgacttcggccgtggtgatatgttccggcaggtggatttctgcgtgtgaattaagagcttgctaaagttattcatgttggtgtgatgggcctgtgagtgtgggtgcttgggaggagatttcttgggttttttccccgagcaaaatcaatctgctcgtgcccttgagatttcagttccgcccataagaactccaacgcacatttagcattcggagagtaattttgttaggttaaaagtatggtaagttataggtggtatgttatgtttttctttttcttttctcaatgttatctggtacctaagtttgtcaagaaaatcatagtggacaagtcaagtatttggggctgtcgtctctgttatggaaagaaaaataagttttgattacattacatatcttttgctctcgagatctggtcatgtcgtcgcattgcaactcgtctcgtctgtatgcattttactctgctggtttaatgttgagattgtgtagttaatgagctgttaccctgagattcctgcactgaggatgtgcagctaattttatgagtttgactaatgaggctagatattttacctatgctgtgatcgtgcagctggttgttttggacgctggtgggcagatcgtgcggtttttttttacaggtgctggtatacaagatgcggctagatccgatacgcatgcgtacaagctgctagacaaagtccgggttcagtgttagctgtgagcagtgatgcgttttgtttatgtggagagagcttggtcgttgcacggtggtgcgtactaaaagtattttcagaggttgtgacctgttagagagggactgagcgagtatactagtattagtacagtagtagtgagctgagccgcctgagatttttattgcgagacttgagcatattggagaatggagagagtatcaagcaagttggccataggcatcgaccgagtgagtgagagagtgctcactcctttcttcgtttataggtgcacttttgtgaaggcggcgtgggggagagtaggccgcgacaggtggttcgctcgccctgtgccaaacaaaactgagccccacgtgacaaggtacagcaaatgcgtacccagctcacggctgggagcagtagcatttggtgtgagtcacggaggtgtgggcgtgagtcacctcgcagtcgcaggccagccgctgcttgtctcgttttggcgcggcgcgcggcgacgcgagacggctggccggctggggccatggtttttcccccgcgggggcgtgtggtgctgtgtggtgtggcgccgcgcgcgcgggtggtgataaggttcccgatgagaccgcggctcaccagggcaaatcccgcgcgtggtcacgccccgcgcgcgtccgcgcgtcctatccccggccgcgaaacggcgtcgtgtagtcgtgtacgtagacatgacgcggcgcgggataacccgacggggaggcgatatacgggcgataccgatacggatggcgtggctatcctattctaggaccggccgcgctggtacgccacgacgtcgacgcctttggcatggcaccccgcgttttgttcgcttcctccctctctcgctcacatgccgtccatgccgtttctgttgtgattttcccacaagcttaacctttttccgaaagaccatttcccagagcttaacttgttttaatttgcgaaaggactcgcacgcatcggcacacttgggacggggtacggcacagctggaagccacgctgcgaaggtggagtgaggtgagtgaatgcgttagctggtaggggacggggacgtggctgggttgggtcaggtgggtggaggatgaatcgaagtcggatgtcagcttggcgtggccgtgcaaggtcgagatatcgcgcgcttgttgctccacggttgttgacatgtggcgcggcgccgatcgaattgccggctcgcgcacggctttgttgcctctgctttttccaccttttgccgcgcacgtcatagcgtgtggctgtgttgtctcgttcgacgtcatggcggctgctgctgctcatctcttgcgcccggtgcacgcatcgaatcattgcgctaagttggtttaggctacctgtggcagtactaggtttggctaataatccacgtgtgtaggtaggttagttacggacttacggtggtgcaaaagtaaaactgttggcagtcacacttgatatgatcgctaaccatagtcttttcggagaaaaatggttcagataggtggttcgatttctgccatagactactcgtcaacaaagtccacgcaacaagaagaatggccacgagccaggtgaaggcaataatgatgattattaagaccgcacctaatagtactaggatttttggcacctaacagcactaggatatttggaaaggaacagtcctaaccccaaaagaattggaacccccaacttcacttccatgttgacatcttcactccctccgggaatacgagtgaccgagtgacgtgtcatttttctttctggaacgttctgtgcggaatccagcagacatccaagcttaagaacttggcgtgttcctacttcgtctttacggagatacagtgtatccatgcgatttttgccgaatcttgttacgaagtactaacagttttcgtcttctcgtttgtacgctatctggccgtcgagtgactcgccaccactcgacgatgtgtgtggatcgaaacggtcgtctttgccgcatgccgaaacagttggtggcggcatgcggcgcatcgcctatcaaatcgcaatgttgcgtgttggaagaggagttattgccggctccatcgtccgtatcgttcgttcgttcgttgaatcttccttcaatcccccggtgcggcgctgctatttgccgatcgcgacgcgggcgccgcgccgcacggccgaactcgacggagacgacacggtggcgcgcttgatggcgcgtgcagctgccacgcagatcgctcgcgcttcacgttagctcatcacaggcatcgcacgatgggcgcttgttaatgcggccttgaattggccctagccctgtttggtctgcatcagatccggatctacactaatcctgctcgagttttgacaggatctatgcttcgtgttgccgatcaggtagacagtccccatcgcgagcgacatcccgagtcaaatcggtgatggaaccagggggagaaaatcgcacaaagtcgtggcttagtccaacttcttccaattatccactcttttcctggaacatatcgcttgcgtcgatggaaaaatataatccatttgattagtcggccgaaacctgtgatataggagtatactactgctactatccctctggctattgccgcttacggcgaagacaaaacatcaaaatcgcaaacgtgtccatatactactactgctggtgacaagtccgtcctcctgcgagaagatccaaagctgccggtaaaaggaatcgcggtacatcgcacagttgtagtactgctcgttgctacagctccaagcaagttgagacaagattcagttttaatttttattttttttctccttcaacgacagcgtctgaccgaccagctgccggtcgacatggtgagctccgcccccgatttctcaacgttttcctgacgagatttgccgtgtggtaccgtggtgcccgcaagcagggccagtggtgtggtcgctgtcacgtggtgttgtgcgcgagatgaggtgagtgtgagggctcgagggagacacagagcaccagcctctgaccctgctgatgatctggggtcaaaacgactccggaggctgcagccaagttggacgaacgagggagtgtattattggcgtattttactgtcgtggaatcaatcattcgtgacctggtgtggagcactctcactcgatcccttggcttggctatcacctggctcatctttgccgttgatatttttgacctgtgcaactcatggattgtcagtcgtagtaggtagtagccggttgctttgctttcactctagagagctgagcagtgcgtggatcactgtactgaatcgcttttagtagaaagatccaagcactaatgctgtcactaaagtgttgtttacaatttcctgcggcttcgagagatgtcaagccagctcgctactttggtagtatcgcttggagcaatgttcctctttctgtcactctaatcaaactccactgttgcgcatatcttcttgtacggagcctgtttaggatatgcagaaaattgaatgtttcatcataaatagcattcactccgttctagtaactttttttcctctcacgtttgttcccaaacaaattcatttttaccaattattgtatcgagtttgtgaaagtacaaataaatgtatcagaaatagataaattaatggataattgtatcgggatttaactgaagcgggatattatggtcctttcgattttatatcgatatgtagggtgagtggaatataacttgttttaggacgaaggcattactagtaataaaatagagtcgagtttatttcaatatattgaggaaaaaataatcatatgtactaaagtgaaaatcctaaaaagagaaaaggggacagcctcaatgtttttttccccgaacatgttgaactaattttgagtaaattataccgttggcggagctacaaggtaggtgtagcctgttacatgaacatgtaaaaacctcagaccaatacaccaaaacggcaaaccgcatcaattcttgctgcgtcgagtacattgagtaggatatcacgtagtcgtaggcacacacatgaggaggatgttatgcggatatgtatgtgatcagtccactagagactaaggtacacttgattatttaggttgtgtttttaagtcaatgttcctaatttcacttgtttctttttcacgtgtatgttttccaaaccgttaaatgatatttttttagaaaattattataggaaaattgcttttaaaaagttatatcaaactatttttaagcttttatacttaattaaccgcacactaatgtgattgttataaaagtacgtcgatataatggaacgacaattaactttttcgatcgcttcagtcattggtcacctaagacacgctaaatgacgacataagaacacatgatatttgttaaagagatttagcctaagcctacatgcatcccagggctctaattatgggcaacaccaagacgctacgagtctatggcctcaccgccatagtcttcctgcgtgtctatgatacattatagtcgccatcttttatattgtggtgccctc

SEQ ID NO: 23590 - DNA, 2716 bp, Oryza sativa
ctaaggtacacttgattatttaggttgtgtttttaagtcaatgttcctaatttcacttgtttctttttcacgtgtatgttttccaaaccgttaaatgatatttttttagaaaattattataggaaaattgcttttaaaaagttatatcaaactatttttaagcttttatacttaattaaccgcacactaatgtgattgttataaaagtacgtcgatataatggaacgacaattaactttttcgatcgcttcagtcattggtcacctaagacacgctaaatgacgacataagaacacatgatatttgttaaagagatttagcctaagcctacatgcatcccagggctctaattatgggcaacaccaagacgctacgagtctatggcctcaccgccatagtcttcctgcgtgtctatgatacattatagtcgccatcttttatattgtggtgccctcctctctttaagagaataccgggttataaagtccgactttaacttcacccctaccaaatattacaactccaagtccaactttaactaaatagtactagtatatttgacatttattctaacaattctcaaccccttctcccgaacacaactagagtgactttcgtcccaccttaaatgaagcttactcgcattatatggtactcataaactgaaaatagaatctccctgtataaatcacattgggaaatcaccctcatcttattgccatattatgcgctagtcgagatgaggacgctcttggcgtcgttgacatccattgctaagtcccacgctataacctctatcacttgaacactaaaaactccactcctcgtctcctcctaactcgaatgacttccatcttataaaccgttattgaaatttaaaatttaaaattatttttttcagcattttttgtttttaaaattacatttgaaattgttaatgacacacatataaaaaattcaaccatccgtgtattaagaaaacacatactctattcgtttttcatattataagtcgtttgacgtttttcctagtcaaacctttttaagtttggccaagtttatagaaatatagtactagtattttcaacataaaacaaacatattatcaaaatatattcaatgttaaattcaatgaaaataatttaatattttaaatgttgcataaaatttctataatcttgatcaaaattaataaaaaaatcgactaaaaaaattcagatgacttataataagtacaatattgcagtataggcccatactggcctggccggagaacacagcagtatttagcccaaaacgaagatgcattggtccacctggcccaagctcagtctaatccacgagcaaacatagacacaatttcaccatttctaatcggacggcgcgcaagtccgtgcactcgtggcagttgcaagatcgccgtccgttgattcacatatagaaaaggcgaggaaaaaactcgagaggaaaaagaaaaagaaagagcccgaaaagaaaaaaaaagggaaaaaaaaactcggagcgatgcactcttgggtgcagcggctgttgacgacggcgacgacggcggcgctcctcctcctcgccgcctgctgcgccgcctccgcgctcgacgccttccacgtcccctccgtccaggcgcaagcccatgtacgaatccgtctgttcttcttcttctttttgctccctttgcactatcacgcctggaatcatccgcgactcggaaccctcgaaattggggatcttctctgcattgcgcagcatgttgatatggctgagatagttctgaaatgtttaggtatttgttctagccggttatcgtagtctatctagcaacgcgaaattgtacagttcactggaagatctttatagggttagggtttagggttctgtgatgtctgggaggtcattggtgtggcaaaataggtggtattttgggggttataggatctttgatgattcttgtttacaaatggagatgctattactggtaggttgttgtcattttcggctagatcatgtacatatagaatgtagacactgatttgtctggctgaaatgtagaattttggaaggttgggtgccaaattctgattctttcaacaatggtaaaattgtgaatctatcagagtatcagttatctctgcaagcagtgctcggttatcatctctttgttggtcttgttgcctattgatattagcatcaatgtgcttatgtaatttttttttcttgtaggttacaaagataaaccgattccacaagcagctcaatggcaacgacaaggtctgtgccttaaggcccttaacctttcgtgcttgcgtgtgtgtgctgccagaggcctaaacgtatttagtttcattatgcgataatttcaaattatccaaatcacagtttcagagtagtgtcttctaaatagagcaagatttcaatatgtgctattctgttataatcttctacgctgtataattatgtcatagtacgtttttttaccttttctcatcaagtagcctgggttctgccattgtgtattttcgccttttcagtttagattcaatacatttcattatgtgctatggagagtttgcttggtctgaagttccgatgttatgaattaacagtcaaaggcttgccttcgctttcttttaatgcaaatctgctttgatatctgtaatcaagaaatacattttagtaaaaaacctttcgtgtgcaaaggctt

SEQ ID NO: 23591 - DNA, 2053 bp, Oryza sativa
caacttccaaccacctgcagaacaaaatctgtcaacttccaatagcatgatattcataaatatacaacaatgatttttccaaagtaatattatctcactttcatatctagaacagagtcttgtaaatccgcttatgatataatatgtttctctcctcaactactaatatgcacatctgtttgaattacttgatgatttgctgttgcaatatttcctttgtgaaattctgcgaatatatcgatctcataaatatactgtgttacttcctttgcaactacaatgaaaactttgtaaatttgtgtgacaggtgacactgaccttcaacttgtccgcaaatttggagtcactattcacttggagcacaaaacaggtgatattttgatttcactagaatatgcagctcatgtttcaaatgtggtatatcagaaaactgcgctcacgtttatccctgccagtccggcgaacaatattagctgaacatcgcaagtaacatgctcgggtagggattgagcaattcacataatgttactgagaaactggactgctgtcctcaatatagaagcattgaaaaacttgagcaatgagtgaccatcactatttgatactttaacattgtcatggttcatgattgcttatcctgtgaaaccagtaataaaaagatggtcaccgacgatctactgaatgttattgacttgctacatacatatttaatttggcagtccatacttcagttgtaggatttcccaatttttatcacatgattttgtaaagttttggtttacttcaatgttttcgtagccagttactaagttgttcctttgatacaggtgttcgtttttctgactgctgagtatgagaactcgaagaattcgcttaaccaggtaactagttcacattttaccttggccagcagattcttcctgccagtatctgtactattacgaacaagtagctggtcttcaatcagtgattacatgaaatctgtaatcatgcatggaatgtttagactactgtacatacctacccctttctttttagctttttcactggattatttgctccacgcttctacaaatacaattgcttagacctcttgttctaagctatctgttaaggttatttctcaaaatatttaatttccctataaccaagtagataatctgcggcaataattctgtgaataatttgttttgaacgctaccttatagaaactggctgaaatctgtagtaatgttctggtacatgtattcattgtgctggtatagtgcagtctttcctttaaccagcaagtaaacttttgatcaagttgttccaacaagttgctcattgctttgatactatgtagtcagatatacaattaagctggtcaatttatattctatattctagtggttgcggttgatcaatccatgctcatgttgaaattgtgatatttgacaggtttcattgtgggaccacatcatacccgacaaggacaaagcgaatttgcaagtggaggtgaagagcaagtatcctctgattgaccaggtaaagcgtcaatcgtgcttcaaaatcgagtgttagtttgcatgcattcttggaatttctcttgactagaatcatctgctctgctctcatcagggaagcagtttgcgcgggaagaaagttcagcttgttctacactggcatgtcatgcccaaggccggtgtaatgatccgggatcgaatggctctctcagagttcaacctgccagactcctatacatcttgagcagctctgctctatctgatcagttctgtagtagactcacacatgtagatctggtaacaatcctctaatgaacatgacgattaagcattgtgcatcctaggcaaaatgctctttccaatttggcatctgccatacgttaggataattgatggaaaaccgaagcagcatatgaaaagcacagaaacagcggctgcgtttattcttgccccagctcgattgagcacatagagatgcattacatgtgctggcagagtgactgtcagtgaagtactgacatcaaccagctacatcttcactcactggg

SEQ ID NO: 23592 - DNA, 1789 bp, Oryza sativa
  unsure (1)..(1789): unsure at all n locations
nnnnnnnnnnnnnnnnnnnnnnnnnnnnnnnnnnnnnnnnnnnnnnnnnnnnnnnnnnnnnnnnaggagggggagggggttgtcatacctgaattttattaaattagagggaaaatccacacagcaaatcgttcaaattacatattactccctccatattttaatgtatgacgtcgttgactttttaaccaacgtttgactactcgtctttttcaaaaattttatgcaaatataaaaatacttatgtcatgcttaaaaaacatttgatgataaatcaagtcataataaaataaattataattacataattttttttgaataagacgaaagatcaaacattcgtcaaaaagtcaacggcgtcatacattaaaatacggaggggtacaaattatggaagagaggaggaaagtaactccttccaagagaataattggccgatcgtcggagatgctcgcccaaagtgtgccgtcttcaatatagtcacaaggcgaggtagcgacttacgtggtgtttggatctaggatttaaatttagtctatgtatttagacactaatttagaatattaaatatagactacttacaaaactaattatataaatgaaagctaatttgcgagacaaattttttaagtctaattaatccataattagagaatgtttactgtagcatcacatagactaatcatggattaattaggctcaatatattcgtcttgcgaattagttcaagattatagatgggttttattaatagtcacgtttaatatttataattagtgtccaaccatccgatatgatagaggcttaaaagttttagtcccatctaaacaggatcttattcagtacgtgcaaaacaacattgtggcgacgattccataaaccccagcaacaaattatactctaaaacatttggtagtgcatgcgcggcatcctcacctggcaagaggagagagaggagggggggggggggggcgcaaaatcgccagctcctccatgggcgacattggtatctactactcccttccgtatttaaatgtatgatgccgctgactttttaatcaatgtttgaccattcgtcttattcaaatttttgttataaatataaaaatatttatatgatgcttaaagaacatttgatgataaatcaagtgacgggaaaataaatgataataacataatttttttaaataagacgaatggtcaaacgttgattaaaaagtcaacggtgtcatacattaaaatacggagggagtatataccaacagattaccgaaatgcatttgtgaaaggcatggatgcacatatgcatggcagtttcctccaccttttcacttagtttgtacaccgagacgagccactgaactcttgccaaatccatctcgccgaggatgattcagtagaggcaagggaagagtggaaaaagggggggggggggaatttaactatttaccacttttaggtttggcaattatccaaatgttccttttaggtttgcgcttaataatttgacattggagagagatgatttcttaactatttgccacttttacttatgtggcgtgccttcgtggtatgcccgcatgggaagcaacgtagatcccacctgacagcccctcccctctgcttttccctctccggcctccaacgaggtgactcacgcctgtggagtgggatgagctagggcgggtcgaggcggccgtatacgtgtggctggtagctgggcacatcggggctgttaacagcggccgggtcaacaacgacggggcggggcgggggcggccgccgggga

SEQ ID NO: 23593 - DNA, 3405 bp, Oryza sativa
aaggctagagagggagaagaagaaaaggggagggctaccgggtggggtccacgttgctttccacgcggacatgccacgatggcaagccacgtgaacaaaagtggcaaatagtcaagaaatcacctctctgcagtggtaaaatattaagcgtgaatctaaaagaggcatttggataattaccaaacttaaaattggcaaataccgggaaaaagtggttgggggcaatacgaggagaaacttgaatgtgagttagattaggtagctaatactttagattacctacactgcgaaaataaattaaaatggttgcgtcccttatataatatggggacgaggtagtaaatccgtaatatatgagcttggctactactttcaacggcaagtaaccatagcggcacaccatcaatagcatattaggtaagatgataaccaaccaacaaccatatgttacgatttaatccctccatccataaaagttttgtcaccaaaactaaagaaaaattaaatcattttggatattataaaatcaaaagtgaatttaaatatgcagccaataagtatttagattactccttgagttctaattaaatatttaatttatctaattaaaatcaaaaagtgaatgcaaatatgcaattaataagtatttagatgactcctctcattggagctcattgtgactccctttgttttatattataaaattattttaacatttttttaatcgaactttttaaagtttgatcatgtacgtagaacaacatttccaagacagaatacatatattatcaaaatatatttaatattatatttaattaaactaatagtattttgttgctgatgttgctaattatttttatagatttagtttatctaggaaaaaaatgatcaaaacgactagtttaaaaagagcaatatctattccacattccaaaatatatttaatattatatttaattaaactaatagtattttgttgctgatgttgctgattatttttatagatttagtttatctaggaaaaaaataatcaaaacgactagtttaaaaagagcaatatctattccacattccaatggccccaaactcttaaaatatcggccatcctctttattaaaagagactactcgattgttggaattgaataagcctcccattcccatcgtatgggatggacgaaaattgaactgataaataaatctttcaataccgacaaataacaaagttgtcacgagcccgatccatttcataactgtcaaccgcaaaatgctgggaatactgcattccacctttctacagcctggacagagaattccgaatgttgatagcaagccccactttgaatgatcactgatcagggatgacatgctgatcaaggaaggtataccacgtcaagtgtgatcgaaagcaagcaggcaaagaatgcaaagaaggggcatttggaattgcagcaatttgcaatctgggaattgagatgccaccacatcatcagctactccagctagctaacctcgtcaacacattgttggctacgcactcgacattgattcctgtaccacgcaacaattactaccaagtaatctaggggaaaaaaccaaagatgaatccgatcgatcacttggcggcgtaattgggtatctcgtagatttggtggatcctccaaatgtcgtcgtcgaaggccatctcggcgtcgccgcgggcgccgaggcagcggaagtcctcctccacgaaggggaaccaccccagcagcttctcctcctccaccccgaacgtccaccacgacaacccgttgctgagcccgccgtcgaggtcccactcgacggtggtcgccgccccggcctcgtatcccgcgccgccgccgtcgccgtcacacacgttgggcacggtgggcgccatgtccgctccggaggagcaggaggaggacgccgcggatgtcactgccgcccccgcccccacagacgacgacgacgactcgtgcgccgccgccgccgccgccggcttcttggctgccgccgacgccgccttgggctgcctcggctgcttcgccctccgctgcggcttcgggttggcgttcccggccgcgccgccgccgtcttgcccctcttggagcttcggctgctgcgctctcgtccgcttcatgcctcctcttcagcgcgcggcgcggcgcggcgaggcgaggtgaggaaaaaaggggagtgacggggtgtgagtcagtgagagtgggagtgttttggcagcgaggcggccgcctcttcgcgcttttgtagtgtactccagcatcgagtggctcggctggtttggcgcgccgccgtcgccgcgcgcgcgcgcagccggtatgtgcggaccaggtcgcgtcgcctcctctgtcctggcgtgcggtgtatcgggccaggtccgagtcgtgacgggagcccgtgcggcgaggcaacttgcaaccggtaaacgcaccaatcacacaacgttgtaggtaaccgctttttttttcccttcagatagtgaaaattaacgagttaattaattgatgaagcgcacgaggttgtactgtagacagggaaacgagcagcagtagtaatcctcctgatattttgttgggtgcagtcgtgctgtgcagcgtaccgggccagggtgtgtggctttggcagttttttttttccacgatatgtgcgcgtagcaacggccagtgatggagggacggctcacgtggaaacccccggaaacttggggaggttgggcgtcgacgagggcgtgcgcctgtctgtctgcgtacgcaaaatcgcatgccgacatcgtgaaccactcctttgtacaactattagcttccaaagctctccaatctctacttttcatggtattactagtgttttttagtctcgtgtttttttactactactacagacggagtatgcgtatacttgacgtgcatcgatcgtgtggttgacagatattttacgtgtatactagtggtgatagcggcattgtatatttgtatcgtggcacaagggacgggaggagaaagtgtgtgttagccgtatctcagtcgagaaagcgatggattaagggtcatttaagggccgacaggggcgtggccatatgtcggcaaagaggcgtgagtaatggctcgcagatccacgggacccaacaccttgccaacttgacgccgctcgagtcgtaataatacgagtatttttatgcaggaacatgcataatactcctacaatgcgttgcacggacgggacggcacgcctctctgccagaacaaccagatttgacgagaggaggctcgtgccttgcctcgtggtcggccgggtcctgcgccgagaggagcaggcgctgcacgtctgcacctgcccgtgttcgctcgtctcaccgcccacgtttggccgtctgacgcgacgggatatactc

SEQ ID NO: 23594 - DNA, 945 bp, Oryza sativa
caagatactagtactcgggctaatattggagtactagtagtgtatagcacagtcatatttgatactgtacgtacgtacgagtatctcaaagtaccctcacaagtctcaaatctcacttatggagccacctaggagtagttagcagcttggcaggcaatagtagtatctgactgggccgtgtctggtttgggacgagactgaccacgcagatgttgatctgcagcaattttgacaaacgggccgtatttatatggccggcacataggccttaatttgaatgggccggcccaccattactcattgggttttgtttgaccttaccgggctgtgccctcaactgcaattctgcaaagaagacgacaatccaaagacgcatgaaggcggcatcagaacgccgatacaggtggcttccaaaaaaaaaaaagaaaaaaaaaagaacgccgatacaagtgacgcatgtctatggtcagctcgtgcagtaagacgttaagtctcacagcgagtgtaaccttcgtggtactggttgctataagtttagaatcataaacatgcaaattgctgaacaacgagatctcaaaatcttggatagatttgagttggtggccgaagagtttaggtttggacagtctcggctataactttcttattagtctagcggcaaccggtcacgctcagtagagatcgattcggtgttaatcttctccttgattatacgtaggcgttatcggtgcatagtgttaatcttcttttctagctattgtcttacatgacaatagttttataattttttctactctatttaatgaatcatcgctatgtttgattatgaccgttaaaaaaggagatgccaatgacactactgtgacagcatcccagctacagcactccggtggatcttaagatatactccctccttccaaaaacctaagaactatttcattcttt

SEQ ID NO: 23595 - DNA, 390 bp, Oryza sativa
ggattgtttcttcccagcaagagcgattgattaaccaggtctcacctgttcacacacaaggaggacaaggcagcgccatggatggatcaatccaacactgcagctagctgcttctagctagcaaagtagttgtaatcagtgagcacccgcatgcgcgacgcgccgcgtttcctcgtggcgcgcgcctatgccggggcgcgcgccgagcgcggcgtggccggcgcgtcggacggcggctcgacgttcaagtcgaggccgggcgccgggcgccggggcggggtggcgttctcggcgacgcgctcgtggtcggcgggctgctgcggcggcggcggcgcctgcttgggcggcgcgtcggcgaagtcctcccaggagaagctggggcgccacgcc

SEQ ID NO: 23596 - DNA, 6240 bp, Oryza sativa
  unsure (1)..(6240): unsure at all n locations
tgaaacatatcaatttgatatgttatcttttggttagagggacacttgatttgggtaaagcatttccagaccattttcgtagaagtgtgactgtttccacttgtttgtaattcactatgtataattttttaaaaaagtctatatatgcatcgtatggaccaactagatatttaaattgataaatatgaaaaatcctcaaccatgccgagacagttttccatagaaatgatatcgtttttggaccgttttcatccatagtgggagaatccaaccgtctgggcctgcgaggcgccagcccagatttcgtcgtcgcggcccgctacagatgggctgccccctgctctccttttacatgttgctaggccgaattggctgggccaattgccggggtacacacacaggtggtcgcctctgaaatctcgcatatatgcccccatagatggcacagtgaggagagagcggtacagtgggcagcagcacggccacgtgcagcgtgcgtccaaccccaagccgtctcgtgagcggtggtctcgcacgccacatgtgagctttggcctttgggatttgggaggcagcagtgcgtcgtgtccggcccggtcgtggcaggcagacgccgcaatggacaaagagaaaaactgtactacaactagtagccagtaggggccatccgcctaattatctggtccatacccgcacaggcaagcgatcgctcttgccacgccaccacttgtcccacacatccttccgcgtgatcaccaacttacaaacgtaataagcgcctcttccggaacgggatcttttcaacgtattctcaacgctagatcgctaccgtagcagcaacctcttgcgtacgtgtgcttgttcaaaccttgcaacccctttataacttggaattttgtccatggttcatgtgaagattaaaggggtgatgtgtgtttggtgaagatgggggggtccaaattaacttggccgtgcgtgccgggtgatgtgggcgcatgcgacgagccagcggtggttccagctttgtcaccttgtaccgcgtttctcggacacgcagcgcgcttggaggatccttgtccatttttgatccgtcaaatttaacatctctctatagcttagctgaatgccattgccagcgagagcaagtcaatcgtcgatgagtgaagcatcattcacgcatgggctgtcagttgcccatgcgcgccgattgcttgcttcactgtgtgcgtcgttccgcttaatttgctcgatcgattcacgcgagcacaatcgcatgtgcgtgcatgcgtgcggcattcaatcaaaatactcctcctatcattcatgatcctctcgctacaccacttacaggatctgcagctgatgatgatggttgatgagctgatgttgagtgaacaaaagggatggaggacacggccgggcacgcggctggccgccgtggtccgccaatccggcaagatattatggcagagatgataaggtgcgtgcccatgtcgcgtgcagtccagtgctctcagcctctcgctatccgttccagtcgcgattctcgtctccaatgccggttactacgtgtcttgccgccattcatttattttcttattccggttttgcaattacgtgcttatgttttctgttaatcattcttgcaaatgttgtgcaagtacagtaccagtactagtagtagtgagttgtgaaagctgacgtgttgctgtgcccaaggttgtactagggttgtagcacctcgaggacgaacatgcccacatagacatttgttgcgatctggggcctattctgtttttcggtgattctccaatctatcgttgagtagcgtgcctgacaccattcttttttatctttacagctaaagaaacacagctttcgatccatttgtttaatcaatcttgtgcttggcttaacttgagccaggtggatgcatgcagatcagcagatgtactccaccgttgcaacattggcactgctaaaagcatgatcagtggttcacaagtatagtagggatgcaagtgggccgaccagcgaatctacttacttcatccgtttcacaatgtaagtcattctagtattttccatatttatattgatgttaatgaatctagatagatatatgtctagattcattaacatcaatatgatttggaaaatgttagaatgacttatattgtgaaacggagggagtgtatgctaaataattcgtgggttttcatatcatagctcgacttgccacgtcatagagatgcaaatgaattaacccataaacttatttataggtcaaaattagtaggtaaccctcaagtcaacccgcgggttactcactaattttacctataagcgggttcacgggttggcccgcttgcatgtctagtgtctacgtaatcatcatgcaaataactcatatatagtagtatgttaatagtagtataacatactactataattaatgatttagcattataactgatgttgattttttattcttacaatttttcactcctaacatatataaaagaatcttttccatttataattaagtatatgcatcaaccgttcaacatttaacgacattccagaggaccaattgccccatcagtaacctatttttaaaatttcttcacattctagtgcaatccatcctcccactcaatgatggcacaaggcatcggcagtttgagccctagacctgacttcataatccccttttgaatcatgtgagaataccatacaatttgtgaaaaaaaaatgacgaatgcgacgggaaaaggtgaggagctccagtttatatgagtagggtggagaaacatcaagccatgagctcttgccagcaatcccaatggtgatggcgactgtggtaaggtcctctcggtcatcctggtatgccttccaattgttacatactcctctcttcttcgaaactatagttagatccaatttgttcggtcgttggcgcaattgtggaacacgtggcaaagcgacgaagctacacaacaagatgctcaggccatgtctctactcactacgtgtatgtgtcgaggctatcatgccttctataagacacgagaaacctttgcaagccattcgcttttttccctctctcctccacgtcaactcttcgccaacgtggctgagcgaggtcacacgttagcaggaagagttgtttattcccttatgtcattaacaatgtggtgcaaaaatagtacataggtaatactccatccgccccaaaatgtaaggatttttttagggttggacaagagttataagaaagtacgtagaattaaatgagagaatattatgcttggtagagaaggggaggtaggtaagaagattgaacagtggagggttgtaattgattgagaaaataatgttggtgaataaattgttatattttgggataaaccgtaagggctaaaatttgttatattttgggaccgatagagcgagtaatattttattcagccatctaataatattatgtaagagaaataataaaagatacccatataaagtaaacaatattatctatatctacttttcttttcttttttgcctaatactactttgtatatatatatatatatatattgcgaggattgttataataaaagttgatttatttaaatctaataccccgattggtgatgcgctagtatcacagtatcactcagctggaccccctgtcagtcatagcgacagagcactccgattggatatggggcctataaaacagagaaaaaaagcgccccatccaatgaacatgcatgccactcaatgcatgcagtgcagtagaggaggagtactgacactgctcagcgtccctctccctgcacatttactcgtatgcacagcacaacacacactcctctcctctcctatctccaggctcacagatgagctgtgagctgtgtgtgtgacacagtctactgctctctctgtacaaagggagagggtgagaggaaattaacagaggaaggagggagaagaaatgcgagaaatgctggcgtctctctcttcttcgtcccgtgcggccatctcctgcatcccgttgtgtctcctcttcctgaccttggcgagcagcaatggcgtgtttgccgcagcaccacccaaggttgggtccgggtacaagcttgtgtccctggtcgagcaccccgagggaggagctctcgttggatacctgcaggtgaagcagcgcacctccacctacggcccggacatccctctcctcaggctctatgtcaagtaagaacagagtaaaatcttttttatgcgactagtgatcacttgttgttcgattccacatgccttgatctttctgtgcacagtgttctatacatgttccattgatttggctccctcccaattgttatctaatagagtaagtgatagtacttacatttgaggagaatgttcgtggctgtaacaattgatagtttagttgcatcttttcttcaatagtaataaagaacgacttgcatttctgatcttgcatatcataatcaagctcgattgaactactgctcgaagaagtaagattggaccacaaaagttcgatgctttgctcaattttttttatatattatgttacaatgtactcatcgtgctcctgctgcttcacagcatgatttccatatgttctaaagattactgagtcatattcaacgctagcgctctaatggcgaaattgcaatgctgcgcaggcacgagaccaaggacaggatacgagtccagatcacggacgcagacaagccgaggtgggaggtcccctacaaccttctccagagggagccagccccgcccgtcaccggcgggaggatcaccggcgtgcccttcgccgccggcgagtacccgggtgaggagctcgtgttcacctacggccgcgacccgttctggttcgcggtgcaccggaagtccagccgcgaggcgctcttcaacaccagctgcggcgcgctggtgttcaaggaccagtacatcgaggcgtcgacgtcgctgcccagggacgcggcgctgtacggcctcggcgagaacacgcagccgggcggcatccggctgcgccccaacgacccgtacaccatctacaccacggacatctcggcgatcaacctcaacaccgacctctacggctcgcacccggtgtacgtggacctcaggagccgtggcggccatggcgtcgcgcacgccgtgctgctgctgaacagcaacggcatggacgtgttctacagggggacgtcgctgacgtacaaggtcatcggtggcctcctcgatttctacctcttctccgggccgacgccgttggccgtggtggatcagtacacgtccatgatcggacgaccagccccaatgccgtactgggcatttggtaactactgcccaacttcattttctttgttttttcatcatttttggatgagttctggtgtcctttaattacgttttgtctggtagttttattagttttgttttgtctgtatagtttgatccatccatcaatactggagtatatttattagtactatgattagctaattttatagtagtaccatccagattcaatgatgagatactccaaatctccaatatttggagacagcaggggtatgggatgttggtcacatggcacacgctaatttaggctttttggaatttggggacagcaggggggcagtttgattgtgggttcatttgtcttcagtcaattcttactatgcaatatggcatttttcacctgtagtagttgattgcaattagtaactggtttccaatagatgcaatattcccctgcagggtttagtagttccaatagatgctactccagaatgaagtcatgccagctgctaggaatagtttctggagttgcattgttactctgtagaatatgacactgacaatgtttttcataagttatactagtgccctactgatctacccagctcactcaaaatgatcagagacgagagaaacaatcagcaacacatcagttgtcttgcctaggcatttcctgcaataccatgtgttgtcattttgctttcaacaaagtagtactcccttgttatcacgacagtaaacactgtttagatgcacatattgccagatgcagatcataagtactaactttaactgtcagcacatcgataaaatatggctcccgctgcacaggatcagatcaatnnnnnnnnnnnnnnnnnnnnnnnnnnnnnnnnnnnnnnnnnnnnnnnnnnnnnnnnnnnnnnn

SEQ ID NO: 23597 - DNA, 1211 bp, Oryza sativa
tgagatactcaattctccaatattggagacacaaggggtatgggatgttggtcacatggcacacgctaatttaggctttttggaatttggggacagcaggggggcagtttgattgtgggcccatttgtcttcagtcaattcttactatgcaatatggcatttttcacctgtagtagttgattgcaattagtaactggtttccaatagatgcaatattcccctgcagggtttagtagttccaatagatgctactccagaatgaagtcatgccagctgctaggaatagtttctggagttgcattgttactctgtagaatatgacactgacaatgtttttcataagttatactagtgccctactgatctacccagctcactcaaaatgatcagagacgagagaaacaatcagcaacacatcagttgtcttgcctaggcatttcctgcaataccatgtgttgtcattttgctttcaacaaagtagtactcccttgttatcacgacagtaaacactgtttagatgcacatattgccagatgcagatcataagtactaactttaactgtcagcacatcgataaaatatggctcccgctgcacaggatcagatcaagacagtaattaaccaacaaaaaaaaatgcagagtcggtgctctaaattgtactgcaaaacaaatatgcaaataccaaataattcgtttcagataacgatgcgactctctaatgttcttctcacatgcttgttctcagggttccaccaatgcagatggggatacaagaacttgtcagtggtcgagggcgtcgtggagggctaccggaacgcgcaaatccccctcgacgtgatctggaacgacgacgatcacatggacgccgcgaaggatttcacccttgatcccgtgaactacccgcgtcccaagctgctggaattccttgacaagatccatgcacagggcatgaagtacattgtcctcatcgaccccggcatcgccgtgaacaacacctatggcgtgtaccagcgcggcatgcagggcgacgtcttcatcaagctggacgggaagccatacctggcgcaggtgtggcccggccccgtctacttcccggacttcctcaaccccaatggcgtctcgtggtggatcgacgaggtgaggaggtttcatgaccttgtgcccgtggatggcctctggatcgacatgaacgaggcatccaacttctgca

SEQ ID NO: 23598 - DNA, 608 bp, Oryza sativa
aaaaggttcgtgtgctgttttacctttgcagtcgcggtaaatgtcagtttgttagcgcactgcttctttttgtgaggtactactcgtttttgcgtgtgctcgtaaatggctatgaacaattcatgcgaatggcatgaacatgtttcgagagaaaaaggttggccggatatttgtttggcccatcacagtccagatccgcacggtgggctaacaggccgcatgatttcaccatattcgctcgccgtgttgggctaagggaaccgagctgcccttaccagtcattgatacatggaataagtacatatgaggtcccttaacttgtcaacgaatacgattttcgtgcttcaaccggaaaccagatacaacgggtccctcaactatcaaaaccagtgcaaaaccagtgcagatgaagtccctcggcggttttgagggtggttttagctgacgtggcccctacgtggcaaaatttgacttagtcttcttttgatgtggcattgacgtggcgccatacgtggcaatttgatccggaaaaataataaacttcgtgggacccacatgtcagtctcacataaatcaataaaagaatggtagggcccacgtgggcccca

SEQ ID NO: 23599 - DNA, 1459 bp, Oryza sativa
  unsure (1)..(1459): unsure at all n locations
ttttaatgtaatagaaaagttaagggtttaaagaaaaagttaaaaactaaacaaggcctcggtgattttcttcacgctctctgattagggacgaagagggagtagtattgacttcagtccttgcatatcccggtaccgccaagtctatcttggccatgaagaaaaaacatctgagcttgcaggtgttgataattgtagtagatcgatcttgaagaggacgagcgtggcctcggtgcacaatccgaggagcacgagagctgccgacaccgcagagcgtccagctcgacctcccctggctcgagatctgtggacgcatgcattgcccagcacaaaatggtcactcaactttcctcgcgataacattcatctctagcttcatgttgcttaattaacttcccgtgtaatgttagtattacttaacactgtcagttgtgaccatttatacacgggaaaagctactttccaaaaccgccagggccggggttacagcaccccggcggtaagcacggttactgcgcggtaattgcggtaaccgtgaaaaaccgtatgaaatctatcaaaaatttaaattattttttaaatttatttaaatttaagaaggttaccgttgtatttatattaccgtaccccgcggtaagcgcggttatcgacggtaagtcgaaccctccatccatgtcatatggtctcattcttttctaattgatgcatttcatgaaaaatattttttatatatagaagcttcaaaatatcaaataattatatctttcaaatttagtagaattaaaaacttaattaatcatgtgctaataactcatacttaatcatataatcgtgcgctagttagacacataaaagttgatttcatttgaaacaaagagcatgtaataagtacgttcgtgtagcacgttgtgtgttgcatgattccatagaaaaggcagaagcatcaaacacatccgcacattcagttgcgtgagttcttgtgcgccatacacatatactctccctccgttactaaatatttgacattgttgattttttaagcacatgtttaaccgttcgtcttattcaaaaacttttgtaaaatatataaaactacatgtatacatataagtatatttaacaatgaatcaaataatagaaaaaaattaataattacttaaattctttaaataaaacgaacactcaaacatatttaaaaaagtcaacggcgttgaatatttagaaacggagtgaatacatacgtacagttccaaggcgagagaaagctatgatgctcgttgacattgtgtatttttcctttctggaatcaaatacgagaagactaatttagttttgtgtcaacgcgttgacagtgcaccgccactgaacgaattcgacggagtttagcacgtgccagctgaannnnnnnnnnnnnnnnnnnnnnnnnnnnnnnnnnnnnnnnnnnnnnnnnnnnnnnnna

SEQ ID NO: 23600 - DNA, 2127 bp, Oryza sativa
ccaatgcagatggggatacaagaacttgtcagtggtcgagggcgtcgtggagggctaccggaacgcgcaaatccccctcgacgtgatctggaacgacgacgatcacatggacgccgcgaaggatttcacccttgatcccgtgaactacccgcgtcccaagctgctggaattccttgacaagatccatgcacagggcatgaagtacattgtcctcatcgaccccggcatcgccgtgaacaacacctatggcgtgtaccagcgcggcatgcagggcgacgtcttcatcaagctggacgggaagccatacctggcgcaggtgtggcccggccccgtctacttcccggacttcctcaaccccaatggcgtctcgtggtggatcgacgaggtgaggaggtttcatgaccttgtgcccgtggatggcctctggatcgacatgaacgaggcatccaacttctgcaccgggaaatgcgagatcccgacgacgcacctgtgccctctggccaacacgacgacgccatgggtgtgctgcttggactgcaagaacctgacgaacaccaggtgggacgagccgtcgtacaagatcaacgccttcggccagacggcgcggctcggcttcaacaccatcgccaccagcgcgacgcactacaatggcatcctggagtacaatgcgcacagcctgtatggattctcgcaggccatcgcgacgcaccaggcgctgcagggctccagggcaagcggccgttcatcctgacgcgctctacgttcgtcgggtcgggcgcctacgccgcgcactggaccggcgacaacaagggcacctgggagaatctccgctactccatctccaccatgctcaacttcggcatcttcggcatgccgatggtcggcgccgacatctgcgggttctacccgcagccgacggaggagctctgcaaccggtggatcgagctcggcgcgttctacccgttctccagggaccatgccaacttcgcgtcgccgaggcaggagctgtatgtgtgggagtccgtggccaagtcggctcggaacgcgctcggcatgcggtacaggctgctcccttacctgtacacgctcaactaccaggcgcatctcaccggcgctccggtggcgcggccggtgttcttctcgttcccggacttcacgccgtgctacgggctgagcacgcagtacctgctcggcgcgagcgtcatggtgtcgccggtgctcgagcagggcgccacctcggtgagcgccatgttcccgccggggagctggtacaacctgttcgacacgaccaaggtggtggtgtccaggggcgagggcgccgtgaagctggacgcgccgctcaacgagatcaacgtgcacgtgttccagaacacgatcctcccgatgcagcgcggcgggacgatctccaaggaggcccgcgcgacgccgttcacgctggtggtcgcgttcccgttcggcgccaccgaggcggaggccgagggcgccgtgtacgtcgacgacgacgagcggccggagatggtgctcgcggaggggcaggcgacgtacgtccgcttctacgcgacggtgcgcggcaaggcggtgacggtgaggtcggaggtggagctaggcagctacagcttgcagaaggggctcctcatcgagaagctgtccgtgctcggactggagggaacaggcagggacctcgccgtccatgtcgatggcgcgaacgccaccgccattgcaacgtcgaggccgtactttgcaggtgccgaggcggagctgcacgggcaccgcgacgtggagggacacaagaagagcgtgatggtggaggtgggagggctggcattgccgctgggcaagagcttcaccatgacttggaacatgcagatcgaagcatagatcgaagctttcttatgctttcatctgcatttctccattctgtctctctgattattttaggttctagatcagcaaggttatgtcaacgtgttcaacgacacaccaccatctctgattctcttctgcatttgaatccttgtggaaataaaacatgattctaaacatatatccttctttctgactcttacatgtgcgcacaagggagacagtcgaaagaacatcggctagattgcggatttgcggtacgaa

SEQ ID NO: 23601 - DNA, 739 bp, Oryza sativa
  unsure (1)..(739): unsure at all n locations
ctnnnnnnnnnnnnnnnnnnnnnnnnnnnnnnnnnnnnnnnnnnnnnnnnnnnnnnnnnnnnnncagagtaccacgtctcgagaaaagtttccagtccacaagacgacaggaagcgggctgttgatctatcaatcgcactacgacgtcttttacttgcctcgtctatcaatccaggactacccgaaattataacagctccacttatctgtcttaacgggactgcgttagaatcataaaaataaagaaattgacacacaaggtgcaatgtcgagagattgaccttggggctatgatctaacgccatgtgtagggcaatgcttgcacccattgagtagccaacaacaaccaccgctccatgggttatatttcttatcaacttcagtaacaaatctgcaactgattgaactgcaaaggagatttggttggagctttcaacatcatgctgtagaatttcagactcgccatggccaggaagaacgacagctataacccgtgcactacgagagagagcttttatgattggaacccaggcttcactcgtactctgaaatgcatgaagaaagagaatagccttttgctacattggctgaagcatgacaatagatactgtgacagcaccatgttactacatacggagaaactaccagtatctcaagtatacagtgcaagggaaacgtaggataatgaacatatgcctgcatctggagcttaagcggataactggacaaccgaaatcaa

SEQ ID NO: 23602 - DNA, 13254 bp, Oryza sativa
  unsure (1)..(13254): unsure at all n locations
ttgaggatataaatagatgaggggttgatgctagaagtatatcaattttttaggagagaaaagttatagttttgcttcgaggcttcaatactagttgacagaggagtgctttagatacactttgtaaacacatattgatgcaataaagttgatctactttcaagagtttcgtctcgtcgatatgtgatttttggatcccgatggtcagaccgacaattggcgagcagtctacggcaggactactgcggtttaaccggtagcaatcaacatgttaggcctcccccgcccctctcctccccttcccgtctctgccgtcgcagtgtcggcagtgggcggcgagcggcgacagcgccctcccctctccgtcagcagcgggcggcaagcggggacaccgctctcccctcctccccttcccctctgtcggcggcgtcagcagcgggcggtggcaggcgtcggcgggtgggaggcggcacaggtgatgcgggcccaccttatcgtcaccggaggcactccgcctccttccccgctggcctccgggttgccatcgccgtcggcatcctcgtccttgacaggagggaggagcgccgggcccgggccggcgatggcgcgaacgaacagcatcgcggcgagcgcggccaggagctctccttctttctttgttcttctcttctctttttcttattttctgaaggactgtagttcagaattaaggggttcatgtatagagtcgaccttcaggcatgcaagaagtgtatctgcaaattagtcccctttttgcaagtgagactagggatgtgtccggattccagtgatggtacctaatccctctcacacgattaacggatgtgtctattagcgcgttattaattaagtgtgagctatttttttcaaaaacaaatcatttttttttttgaaaccatctttcgcatagacactttttgtactgatcgcctcggtatacaaccacacctcagtatgtgcgcataacagtatgtgatgtaccattttgttgtggaaaatgttcatccaacatgtggtatcaaatggttgttgagtatgtacgttcaatcggatttgggtaatatgcaagtagtaataagcaatgaaaaaaaaggaaaaaaatacctttagtcccgattgacaacaccattcgagatatcttagtcccggattagatatctcggtttgcaaagggttccccagtagtgtcactgtgtcaggagctcagctcggatgtgaagctggccaacatgtttttttcacggatatgcataggacttgcatatcattttgtattaataaaaaagggtcacggcgagagagagtggcaactaaccaacaggcaacagcatatacagagcagcaaaatatgaaaagagcactgtacagctcgggacaatgctgcagcacacaagtactcctagaattcgtcctcacaagtactcctataccgctatacgtgaagctcatcaatgatgatttttcctgctactcgttggagggaagaatcttcatctctgaagaccctcgcattgcgttctttccttaccaagtctgtcacatggttaggaactttgcatgataatggagtcacatcccttctctctggatctaatctttaatcctcccccaccagtccacaatgagaatagttcccgggctggtgtaggtgagactaccggcggcagaatagcatccagaactgccgcacccatccgcaccaaagagttggtctgctctgctgtctctggctatcgctgtaacttgaactcctctacatagataattccatttcgtaatctacttggatatcacgtctggtatatcccttaccaagaacttcctgattgctctaactaaaggaagagggttctcaacgtgcacggcgtggccgctgtctggaataatgatcatctcacatagaccatcggattcgcgatccttgtgctttcttatctccctgcacatttgctgcgatatctctttgaattttgggtccttttcacctgcgacgatgaggagagggctcttcaagtgcttcaaatcttcccacagggacctagaacattgaaactaacatgagatcgaatcacacatgattttcttattacacaatcactaatgtaatatgaccatcaaagtgttcacaggctctatatgtatcatcggcacactatattttttaccactattaacgtcaaaattactaacggactcgatggaacatgactttatggatatcatcaatgaaaaatataatacggagtatgggaaggcaagccttacttttgcgtccctatgcttgagtcagcgagaaccttagatagagctttgatattattgtgtttcattcgtgtcctcactagagaatcaaatttaggatgttctcgtaaactgtaaatttggtcatccatcaacagaaaatatcccagaaaaggaaaagaaaaaaggcatgtcaatacatttttggcaaaacaaaagtatattgtcactgcataacaatattacctggcccacattttcgcagagtaccacgtctcgagaaaattttccagtccacaagaagacaagaagtgggctcttgatctatcaatagcactacgacgtcttttacttgcctcgtctctcaatccaggactacccgaaattataacagctccacttatctgtcttaacgggactgcgttagaatcataaaaataaagaaataaacacaaaaggtacaatgtcgagaaatttaccttgtggttttgatttaatgccatgtgtagtgcaatccttgcacccattgagtagccaacaacaaccaccgctccatcagttatatttcttatcaacttcagtaacaaatctgcaactgattgaactgaaaaggagatttggttggagttttcaacatcatgctgtagaatttcggactcgccatggccaggaagatcgacagctataacccgtgcactaggagagagagctttcatcattggaacccagtcttcactcgtaccaagaaatccatgaagaaagagaataaccttttcctacattggttaaatcatgacaatagttactgtgacagcaccatcttactacatacggagaaactaccagtatctcaagtatacagtgcaagtaaaacttagataattgaacatatgcttgcatctggtttttaagtggataactggacaaccaaaatcaaaggagtaaaaacataagcagaaatttaactattactgagattaggaacaaggcacacaaatgaaaagagagcgtcaaagcactcccagaatgtatgaaacttgtccattgattgaatgatgtgaatagaaaacagataacatcataattagcaagaaagacaaactcaagagaaaacatgtaattatgaatgtgcttccttcaagaaatgaaccaaggacctatcaaatatattattgaatcattcatatggagataataatgttttcacttgaattttaactgttagtactaagaacagtagttttaaatcaatacgtgaacaatattctgcagacctttgtgatagttccgcggtctacagcatacctccttaaatcccgagtaaagtaggatacatgtcgattaaaagaattccatcttttgaaactatgatatgcttagcaatatattccagttaatatgctactagcaatagctcctgctgtttgcaacttaatcatctaatttgctctcatactgcaaatatctagccatggatctcgtgtcagacactgagcactaatctaaaccctcttatataacaagctggtaataaactgttggttttcaaaagaaaattgaagaaatcttacatgtgtgcaatcaccaccctcttgaagcttgacttgataagaaaaattatccccatcaacttggatgaaatatgacctcaatttttcttcactataagttctttctatcttcttgtcgtttataactaaatgctggagatagccatgggcatcttctgccgaagctctgattccatcaccaagtggtggcgcatggatttttaacttttgatctgaaacatcttcccttaaccattggtatgttccaagtccatgtgccacatttccacaagaacctctgttctttattctggatgttatgtcattttgtctgtcaacataatgtgcaaactgtatataggttgccaaacctacagaactctcataggtgctactgatgacagccatcttatcatgcatgtgagcccattttgctatataagctgcagtctcaaagccaccaacaacactgggttttataacctgaatatcaacatgaaaatgaggtcaaatctagaaaatgaagcatcagcttgaaaactagcccgtaaagtttgaactcacaagagcaactattcctggatgtgaaaattgatgtagcttagggattacatcccctgtaaggttgtcgatagtctcgtctagtgcaacaggcaagccactattttcacagaacttgatgatgtcatttacagagtccactggttcctgtggttaaaacaaatgaagactctcaaggaagaactgcatgaaaaacagtctcttccccaaccagtattatgatatgctgggtacaaatttaatgctttgtctattttagattttcgatgcatatcagatgaataaaaggcagattacctcgatgtattgcaaacataagccttttaccctggatccaaaatcaattgcctgttcatatgtccatttcctatttgcgtcagcacggatattgatcttgtatcctacaatttcccttactttttgaataacagctgcatcttcagcgggattttcgcgacgcccaacctttgggagattttaaaaagaagcaatgtacagattcttttagaagctaataaattcaacttcctataattactgaactggtagaagatttaccttcagtttaacggtggtgaaaccttcagcaacaagtttgacaacagcaagtgttacatccattggagtgccacaggagtctacgagtgcacatatctgtatgtttgcagtgctgctctgattatattcgaccacattggagccagtaaaaataccataggatctatctattcgttgtgactccagcaaattaagaatagccatctctagaccacacttaacactagggaatactgaagaaggctgtgaagaagaacacgcggaaaaatatcagtctctcgtatgtttttcacagaaaattttcttaagtcaacttacaggaatcccaagggttgtccatatccaattggagaaggatcctctcaacaaaggaacaacatctagctcagcatctttcattctgtgaaagagaaacctaagctgttcttcaacatccaacagatcctcctcatgaatttcaattggtgcaacctgttattttacaagggtaaaaaataatacttaataaaagctaaataaatgcacggtgcaacatgtaatatatttttagacgaaacaaagttaggagttctgccaatcaattaagaggaatgaagaaataacagaccagcctcaactaagtttacaaaaactagaagccaataaacataaaataaaactactgtaaaaccaacaccaaacctccagtaatatgctgtatattccttcagtgaaacatgggcatgcataagaaacatttttctgtattatccatttgaaggataacatcttcttcaagtataaaactgtgaggtaaggtaatttttagaccaaattaatttgcacgaggaaaaatatcctgcctactacaagtttgccagatattctggttgaagcacaacatgaaaagtaaccttaaactgctataacatatattcagctaatatacaaggtcaaatgattatgttaactggagtatttttttaattagtgttttatgtaaatgttcacccactctgtggttctgagggtttttttctagtattaaagtcagagtttagatctggacccacttccatgcttccatgagtatttggatcaagctaaaaaaattgtaaaggagaaatgctccagaccagtccatttcctacttgaaaactgtgagtagacaactaagataacattttagtatagcataattcaagaacagtaattaaggcccacaatgagttagaaaaaacagacagattacagtagtaataaaatcaaacctcgccgaatcccacaatgctgtcacccacacataactttagtatgaaaccttcatgaaagaagctgctttctgatatcccagatgtacgtggtgcagcaagttggatcctgcatagaaggtaaatcctaaaataagagagttcccagttctaactactgttacacactttgtaatttgtcattgtatacttttgaaaattcataaaaaaatctatgttaaaatatgttcactcaaaaaaatatgtataaaaatataatcgttgtactgtaccaaaaggaaaataaatgacttatcagaacttttgcaaacaataactttcttgtcttttgtgtgtggtgatacacaatacatttgatcatatatttgcgcaatttgtgtctctgcacattgtagcatgccctgcatgttttttttttctaaattttgtaagctgcaaaatccaaaacatgactttcttgtcttttgtgtgtggtgatacacaatacatttgatcatatatttgcacaatttgtgtctctgcacattgtagcatgccctgcatgttttttttctctaaattttgtacagctgcaaaatccaaaacatggtttagctacacttatgtttagaatttccaggctgtgtgacctgtgcaggagtgaggtgtgtattgattggttaaggatgtacctgtaaaacatgtattctgctgcatgtattctaccaacagaaaagccatttaccccatccttacaatatggacctcccagaagatatgccagatgcatggttgcactatggtctgtgaacatgcttataattctgcagaatgagaatgagcatataaacgcgatgtagaccaaaataatcaaaagaactagtttgaatataaaacctatgaaagttggcattatcaacaatgcgattctccacttcgacaacacaatcaacatgcccctcatgggacttcactaaggcatcatgaagttcagcttttgtctgaactagaatatgttttatcctgaaatacaactcatgagaatgctggggatgcaaaattgccaccagaaagttatttgttgtatccacagctgactccataaccaataatgtaacaggcagaagtctcagcagaaaacatctaataaatcccagaatcagtaacagcgatgctacgttagcatcaggcaggcatattgttaaaattgtatttctataagcaaggccgaggtatgtaagcaccagaatacaacaatcgcttttacctgtgtgcagcacagagtttggaaatcgatatgtcatgcaaggtgtagaaaaatttctccaaaatttggagtgaagctgtttttgcaactggtagaaggctgaagattgcaccaccatggttgttaatgacaattactgtcatgggtttcctctgcgtccttcaggaatgtgagatgcattatcactttatcagaaataaatattcatttaagtagatggttatacaatagctttacagagagaatatctgtagttctttttatttctttgactaagtagtaatgcaaaaacaaatgcttgggtcaatgaaaaataaattaaggaaatgacaatgagccaatgactcgcagaaaaacaaacggtggtggatagcatagaatagattcaaactgtaaacctttggttcagaagtgacaatccattggtatcatgaagaaaagatatgtcaccaatcacacagaatacctgaaaatagtgcagccaagtcaaatttctgccaaaagcttactcaaaaagaagtacagcataaatgcattggcaactgtcagtatctaggaaatacacaataaaaatattataagataatcagagtagtttgagaactgcaggtggctgtgatgaaaattaggaatattctctttgaagcatagtgtttttcattgtccccaagtttgtgcagctgcagcaagcgcatttatgcattccatatctagggtaacaaatttcatcacatgaagtacccatatgagctaaataactaacttacatgcttgtttgatccaatggcaaatccaattgatgtactaagcaaaccatcaataccacttgctcccctgttcccagctactggtgcaccaagaaagcctggaaaatggtgcatcatagcattatttgcatttgtactatggtcaatccagcccttgccaaacatatccaagtctcgaatgaccatgctattcccaataaacatagtagcatcgccataaagtgcttctccaattacatgagcaacatatggttctgtaagtgaacattctgaatgcacctgaaacattatctcctgtgaaacctggaataaacaacagttatcaggattagaaaaaagcagatgatggcaacaaaaggtgtttgttagttatttccagaaaaaatctgttcaagggcatgcttacagaattgaattccttatgtagtcaagtttccatggggacaaatatatgaactagaggcagttggttaagtgataaaccccttcatgcatgctatttacagatttcagaaagagacattaaatatcaattgagttttcaactttcaatgtcaatactatttcaaatcaatttgtggtgaccttttacctatactataacctgggtgtagggtgtataataccaaagtttactgcagaaaatgattgaaacaaatgactaaggttcaggaaggttgcttacacataaggacaagttttatcctatccatactatcagaatattttgttgcatattttcaagataactaccctcttatggaccataccgctgaattcagaaccattaaaatatctgaccatctgcttgtctttgtttggaaattacactggcacagactagcagcaaattcagttatagtagcctggattctgtgagtgacaacatgtgaaggatcatggcggcatgggtgtgcatcaattaagatgtaagaagacggggagcaggactcaagatatgttcccactcgtttgctagtgatccggcttccaatctgtcaagcaaaaaaaaaaagaaaggtgtcattataaatatatcacataatgaaaaggaattcaaatgattaggtaatgcaaaagtatggaataaaaagaagaatcagtgaggagatgaacctggacaataacatctggagttttccagcttttaacagattcagacagtagaatttgatctatgtggtctataaaacaaatgctcttatctagtcctggaattgatttctgtactttcctcattcgcaatccagacagaacatcagcagcaatcggccaggaaaggtgtctagctagtaaagtcacagcccagatatcatcttctgtgtgaatagcaccaactaataaaagcccctggtttgcgttctttacaatctccagaacctcccttactgaacaagaatagttacctaatgcagaaaccattttcattcctaggtatctagtgtatggttctctatttataaaccatttgtccaaccctttcaaacagtcaacactccaatcttgatatccgtagtctagtggttctctaaaagcacagtttatatgcactggcccttgtggtgcttgcatggcatagtaggctgctgaatcaactgttgtaagaaccattctcgcgtaaatatgatcatctggtggagggagactaaaaaagtgtcttacaaaactgccaaaatgatttacctgaaaatagttaaaaaaaaatgtgacgagttcttcacaagaataacagaagaacatcataggcttaccagataagtttgcatatgctatagaggcagtatgccattaaaaggaaataaacataaaactatatgcataaactggaatggtaatccagcaaattccaagttcactgtatgggtcttattgcgtgaggaatataggcctttgcttctcaagttcactgtatgggtttgactagtgttctgtatatgtctttgcttgagtgagacacataggtcatgtgaggaatatatatggattgtacaggtaggacataattttgatggtgctgagaaataaaataaacactaaaacatagttaagggaacaacatgattggctttatgtgcatgacaatacttataagcaatttaaggcaattaaaaggtagccaaaattctgaattaacagtgctgattcgaagctcttttcagaataggagctattgccagaaacttttagtttttgtaatattgtattcagttacaatacctgattgatggcttggttggctcctacatcctgcagctcaggaggacgatcagctgtgagtaaaataagtggtacgaaatcttgacttgcctccaccacctacatatgaatcttgattaaacactatagactatttctcaatagttgatatatccattactgcatggattgcctgtagtagcacatagagagcataaaggtatacactacacagatgaagttatagcaacaagacttgttgaattgtgatttcagcaaatggtgggtatttctgtaaaggctggaagtaaggaaataaaaaaagtaagaaagagaaatgttccaactcactgaaggaaggagatttgatacagcagttcctgatgatgtaattactattgcaggcttccgagaacctctcccatagccaagagcatgaaatccaagtgaacgctcatcataacatgatatgcaggttgtcaaaggatggactgaagcagaaagtgcaagtggggatgatctcgaccctggagctatacagaagtactaaagcaaaccaggtcagaggcatggtaaaaacgctagagctatgtattcagttaagcttaccgtaaaaccaagcctgacaaattcttcaactatgaaggatgcccatgccaaattaatgttagagcatctcctaatgaaagattcaattttgttgctttgcaaacataaatcctataaaaaaattagataagtacaacttcaattacagagagcaaattacatactatctgtttttaagctaacccaccaattatatcatattctaattatatgcatcattttttttaaattggaaagtagaaaatgctgtaggaaaaggcttactacagaaagcttgtactccctccgtttcacaatgtaagtcattctagcatttcccacattcatattgatgttaatgaatctagataggcatatgtccagattcattaacatcaatataaacgtgggaaatgctagaatgacttatattgtgaaacggaggaagtatttaacaaaataatttaatggttatttatgaaaaaaagaaactcaggtagaaaccattaccatgtttgcacaaaacaagaactgcggcgaaaaccgaacaaatgactgatcagaagttgggcaattctcctacagacaaaagaataagttccatatccgatcagggatataaattcaagtttattgtgtctagtcttataagagaacatgaacaacaaaaagtttaaaaaggaaataataggaaaattatgtctgtcctaataattgtggcgaggtctatgtgtacccatgaacttcttgactttaactttttggtccatgaatttgtggagttggtcaaaagcaattcaactaactaacaggtaggcaaacttgttagttaccaggtaatgcagggcagcagggacgtaaaaaaaataatcttgaattactattataaatgtgataggtgtgaatgtgccttccagcaagatacagacaaaatatccataaaccgcaaagaaagaaacataatattcctttttgcaaggggcatttcttatattaaaaccagggattaatctcaattgcaaagtaatgaaatagcttaaagaagcttaccagggttaagaggataccttttccgtgacagctttgccatctattacagcgagaaattcagcatccaagtatacctggaacagtggattcaacaaaatcaaattgagcactttgatgtctgatgataataggaatagcagataactgtcgaaatacataaacagctataaagagtgtttgcgtgcaaactagaactatgttccataactcacaaactggttaacgatgaatagccaaaactctgtatggaatacaatatgagcacccaatctatatcattagccatagctaatttttttggaagccagcatgttctatatgttaaaaggcatagacgtttcatttatctatttttgttgaaaaagaggattttttttatcattcaaccaaaaacaaaatggtgggaagaatggccattagagattggagaagcaattgttgcaaacttcagtagagcacatcacaaaactctgctattataatcctccgtaatataactaaataatgtttcagactcaaaaccctgtgaactaattaaggcatagaagtaagaacatcggaatagtgaatatgagtgttcatgtgaaggcctgatacaactgaagcttcatcacagatggactttgcagagtggagaacaaatggcacaagcgtaaattcatgaaattaacaaagtgattaagattgatagaaatatgtaccaactgagtattcctgctctctgacatacgcgattctccaatgtaacttgttaccatgttttcataacagatagtagctgaagaatcatagctactccatatcttacaggggaaaatacaaaacagaaaattaattgttttaaaagaacatggaaatgctatattaatatgaaagaaagttaaacagaattaaatatatttttttcttaatctagttagttccacatacctgactgaaacaagattcaaataacaaacagaatcctcaaatgtgtgagacacggagtcatcccaaacaatagttgacgataacatggaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23603 - DNA, 1967 bp, Oryza sativa
  unsure (1)..(1967): unsure at all n locations
tgacgataacatggaatagccatcaaattcaatcagctcaacctgtaaattcaattttgctgatcatcacgaatgctataagatcaaatatctacattatgcctgcagaagataaccaagaaagaattctgtaaattcttactgcctcctatgtgacttgtatgcaagaatgcaagaaaaatcctcaaccaagttgacctccacttttaaccctttgcatttgcattactttctgtgcaataacttaccagtcaaagtaggtcataaagcgttgtgatcctcttgtaaattgtttatgtagatctttttaatacattaaaaaaatgttctaataggctaacttctatgtcatttttctagatataagtgcagtacttgtgccactcatgcatgttcagaataggactttctttgcaccaacggattactttgaggaccccaccacaatcataaaaaggctaacaagaaaaattcaggtgtaaaactgtttctgttgtctgacaatatgatattaaaccatgtaaccaaatttatacagggaatgtcatatcacagaacttcgaggattttccttgctaaattcaaaatggcttgtacacatagtctgtatctcgcaccaacttgataaatattcaggtagctagagtagcaccacagaatactgaaagttgttacctgaggaataaagaagtaaaatgaaccaattctctcctctaaagacaatagttccttgtcatatttaacacctactgatccataggctctaatcaagtgtgaattaaacgaaagatatctgcagggacaaacaggtcctaatttagttagaaacaccctgcatcacacgtacgctacggaaagcaatagagaggaggcaccttgatatcaaatcaaacccattatctactcgagaggaaccatgaaagcaaattgcagagccagcgccagagatttcaagctgaattgatgaatcagtggtttgcttcctcgacaaataaaactgaggaaacaatgatgatctcttaaactgtgtgcacagccatttgagcgccttcgtactgggtggaacaagcacctgcaccgttgcattgtcagaactgagaattaatcatcattgtttcacttgttgcttagaccgtaagggataaacaaatccaaatgcatcgcaaagcataaacaatgagctagacgcgagctcgatttacgcctattgcgtcaaggagctgagtggattattcaataatttcacagtgctggattaaaattcgtaagggaggggggggagcatgtcgcctcgccgccgcgcagcaaatattgcagcggctgctcacaacgaaaccaactgcaaatctgtaaaacacgacatatcccctcccacacagcctcgctgggcggctcacctcgaaccggatgacgccgctcgcggcggcggcaggcgggcaggccttcacctcctccccggcccgccgcagcgcggcgaggccgtccccgagggtgagcaccggcggcagcctccgggtgaacgacacgtccacggggaggtcgcggtcgccgacctcgcccacctcgtcgacgtcgatcacgatgcccgcgcgcctcgcggcgacggcgcgaaggaggaggaggccgccaccgccgccgccgcataggcagcggcgccggcgaggggcgagcagaggacggcgaggggataggagaggaggaggaggaggaggaggaggggtggtgaatgtgccggggaggacggggagggggaggaggcggtgaccggaggagaagacgacggcgagcattccggcgaggtgggtggagtgaataggaggagacggcaggtgtagtgttcgaaatttttaagcaatttttaatgtgaggggataaggtttctgggcccacgtggacagaattnnnnnnnnnnnnnnnnnnnnnnnnnnnnnnnnnnnnnnnnnnnnnnnnnnnnnnnnnnnnnnnnn

SEQ ID NO: 23604 - DNA, 573 bp, Oryza sativa
  unsure (1)..(573): unsure at all n locations
nnnnnnnnnnnnnnnnnnnnnnnnnnnnnnnnnnnnnnnnnnnnnnnnnnnnnnnatccctagtcatagactagcgcatgggttctttagttgggagtattactgcccgccgataatattataagcaacttttagttataaaattaaatatatagttgattagataactaaaagtttatattttaagatgaaggaagtaacaattttgacgatgtcgataggctatatcgtgactacaggatttgtagggtatggtgttcgtcggtatcagggtgtacgcgatattagggtaaaagagacaataggcaagaatttatatatagtgtcggcccccttaactgacaagctatagccctactcatattagccaaatccagagttacctttatatatcaatatcttattagttcaacaattgggtgacttaatccaatccttgttagcatagaggccttgcacccttacatgcagccaacagctagtgtagtctttttcttcgaatgtgaactcggtgagattggaggcagctctagatccctcatgtttgcctatcaagcttcagataggatttgc

SEQ ID NO: 23605 - DNA, 915 bp, Oryza sativa
  unsure (1)..(915): unsure at all n locations
tnnnnnnnnnnnnnnnnnnnnnnnnnnnnnnnnnnnnnnnnnnnnnnnnnnnnnnnnnnnnnnncacgacttgcatgaccgaccaggccgtggtggtggtgtcgtcattgggtactgcagcggcgtccgccttcatctcgaaacagtaggactgggcattgtcgggcacggcggtgggcagtgttgagctcaacttccttctcaccacaaccgtcgcgctgttgacgccacgtgcaccaacgcctggcactactgcttccaggcctgctctacaccaccacgtcgacctctgtattcgctccaccaagtggctcaccgacgtagcttctccagcctggcgtgcatccactcgttctccatccgcaccaccgcgtcaatctctgctctttgcaggcacaactccgacactagtgcatctcccaccgctgtagctgaggcggccgaccaccctactcatcgacgtcatcgtcgactccaccagtgcagccgacacaaccagcttcatcatcctcgagatcgatagcagcaccgcagacgataatgctattgttatagcaaccacctgctgccaagaacattgctcaaggaaaaaggacgggagaaagaaggaacaaaacagaaaagaaaaagaaaagatggatggaaaacgtgacggccatgatactattttttttataaaattttatgaaagggtatgtagcctagtggttacaagagcatttaacggtatcgcactttcagtggtaggcgatgtatacatcgacagacgagtcttgttaatgaattactgatgttggactgtttagctaggtgaattaatgcacagaaacagcatctattttgcttaagctggcttgtttacaaaaaccgagattaggagacggcgtcgcaactcggcacagccaccgcggggac

SEQ ID NO: 23606 - DNA, 723 bp, Oryza sativa
tgctgactgcactattcaccgaccgaaaacattattcactgtattttcaataaacacttacttttgacaattgtttatcacatagattaaatcaacacattaatttcacagtaccaatcgcctacaactacaataacactgctgatcacctaggtataaagcaacacatcattatggactttaaatgggatatggtgttacaatctcatctgctcaaagctgatcgaacaaatgaagtttgcagttgtaaagctagaaatgaatctgcttgatttgtgcaataaaactatgctcgaaaccacttgctccatgtgttttccgccttccgtttgcaatggtactgttgctaccaagttgccgcggtcggttacttttgtgggttaaaaccgtgtcggaattcgtaataaccagccgactgcacgcagagagaggcatctcacacctccgccttctgtgacttctgtcccgattcctgaatgttggtttttcaaaacttcctaggggtgcgagtcttgatccatcccgggtgccccttgccttggatcctggtcttttaacactagtgtcagtgccgtagaatcgctctacaacttccctctttttataaacgagaaaacctgccgccgcgcaggcgcaaccatgtgagaagtgttgcccagtcacacgctcacacacgccctgatcccaacacaaaatttttcatcctgtcatatggaccattta

SEQ ID NO: 23607 - DNA, 1248 bp, Oryza sativa
cttgctcttacttgaccgtcccattgctcacgcacgccattgtaagttcatattcatctttgcagcaattaattgttaccatagtttttctctgagaaaagcaccatgaaatttgtggcaggagcatttccctttttctttcttcgtatgttcaactattgttgattttaaccagtattactatcttttttgcagtgaagaacacgtccatgtcgagccgtggttcatcaacagaaagaggattagaagattcaaagaagaagctcgatgaggagaagaccaagaaggttgaagccgtgcaagttggatcaaactctgtccatggagggagcccggatgttcatcagtttgcgaagatagtagtggttgaacgccggggaccaacgcctcaccctaagaagcacaacttatgagtatagatagccaagatagatggatatatagctgccaagttcatcccgctgtatctattttgatttagactagcttttctttttctcagttttatctttctctccctaggctaagataggagaggagtgaccaaactccatagatcatagctagtagtgtactactttccagcagcacgtcgttgagaaattaacctcaataaagatgtcacatatagcatcttttcaattttgtagcctgtatttgactactgatttttcaatttatttagaattttttttgaaggattcaggggtatccgatccatggcgttctcttgagtccagagagtatttgactacggaattctcaatttatttagaaaatttttgaatatggaagggaggaaaaaactagaattttttttttgaagaattgatggatacccaaatatccaatgcgtcctcaagtccatgttgagagggagattgacaactgatttctctaagatttttctaaataaattagagcctcttaagagggggataaaaaaaagttgagagttggtaaagagggggtcaaagtgcgcgagccctttttgccccccacaagagagaaataagttcactttgggtccctctattttttgtcccggtatgatacgtcccccaacttaccaaaaccgggcaaacgtgatccctcagcggttttggctggcgtgacgcatacgtgacttgtttgaataggtctttcgtccacgtggcattgacgtggcgcttacgtggcaattatatctaaaaaaaataataaaaaacgtggccccacatgtcaactgcacaaaaaaataattttaaa

SEQ ID NO: 23608 - DNA, 4086 bp, Oryza sativa
  unsure (1)..(4086): unsure at all n locations
aaggcgagcagcgcggggcgccctaaacgccatcgacgctgccatcatgtcgccgccgccgaccacccggacgccctccgcgcgcgccgggacggcattgccaagcgcctctacaccgcgctcgtcatgctcccgccgctgcttgccgccgctccacaagccgtctacgccgcgctctcccctcccgacgccgtgctccgtctcctcgcctccctcccctgcgcccccaattccttcatgctcaacaccacgctccgtgccctcgccttctcccccaacccggcctccgccctcggcttcttctccctgtccgccgcgacagcggcaaccagcagcggcagcggcggctcgtactcccctcactccctcccgggcacgcgcgtatgggaaaggggaagaggaacgaaggagctagagccgtcccgagctccctcctctcccgccggcgagctaaaagggcggcggacggctaggcgagctccctggcctaccggcgagcgcgcgggcgtcgctccctcctctcccgccggcgccacacctgtgcgtcagccatccgtgtgcggtccgtgcgaggcgccgctccaggcgtgcaggcttccacgcgcctccttcctcgctcgccgtcgccctcccttccactggtaagtgattcgctctgctccatgtgcgtgagtggcttcgagttcgagatggcaaatttgagtaaattccggagctcttgaacttttgaaattggttccgattctacgtgccttgttcttaatcgagtgtggtttcaatgtacgcgtgtgtttctggaagttcggtggattggaggaagggaattggtttgaactttgaactaacttggagtccctcggttggatttgagcatctgtgatgaagcagtggagaatcgcctcataaattgcttgtctatgtttgcattgcggtgatttgaaccttgctgctgtgatttcagtttggttattaggcgatcgcaacataacccagtgaagcaattctggtgctgctgtttgaatcctctagctctggattgtggttaactcttccattctgtcgcatttggccaactgaattgcctgttctgtttgcgtttctgcattgcagtatgtgaatctcgttgctgtgaactcaatttggtttgaagtgatcgatcgtggtcacaacttaatccatctgttgcgcaagagagagatggccgcctctgccccacgcgcctcgcgtgccgccgcgcacgccatcgcccgccgccagccatgcgctgtacatcgccggcgccgcctaccgccgccgcgccgcccgtcgtgctggacgccgcccggcgagaggagggagcagagagatggggagagctggagagaggaggaagaagaggattggatttgatcatttgggaatgacatgtcatttgggcccctccatatttatttttaaattattttttctatggttgaattgtgggaccacgatttttattacttttccaatatacaattgccacatcagcgccacgtggaacggagaactagtctaacaatccacgtcaaccaaaaccaccgagagaacttgtttgcacggttatggaaagttgggggacggggcgtagcccggattgggcgacaaataaagaactaaagtgaacttattcccacaagagaaggctcctcgtctccttactacgtggaagcccgcacctgtggctaaagcgcaacccaaagtacactcgtaaagcggtgcgagaacacatatacacagccgcctcccgcctcccccccatttatatccacacttgcaaacgggctcgcgaattatcacgatgaactccgctaagtggtaagctcagcatgtgagagttatttctgtccacagacccgcgacaagcacgcgaaatatcacgatgactgctttaaagttagtgggctgtgcgggggtaaaaagtttattttctctggggcctttatttttttgacatgggctctaccgacactgaccccgggagcaatgcctgcctcgggtaaacttagacccaggacgagagactagcgcccccacggatatccgactcgttaccaactctgccctccaaagaagctggagtttaaggcccgcgctaccaggcccggcgatggagactccggggcgcactcctttatcctgggggacgcgctccacggcgagcggtatggtactaaaaaataatagggtcggcggtgaaaaaaggagacgtgccaccggaacggtgagagaagcgcttcccctctcccctcccagtcccagtcccatcgcgacatcgcgtgatgaactgatgatcgccccagtttcagattccagcactttggtcgcagtttcagaaaaccagatgtcagttcagacttcagaattcagaccggaagacgaatattggtatgatgaagagaaaaggaatacgttctagctcctcaaaggctcaaaccagcaaagatcaacacaaactaatttttttttacagatagcaatgcaatccaatgatccatcaccccctaggctacacgctatttatacacctcttcactcctcttctcgctcacggtacagagttacaagccactgacaaaaccgacaagccatcttacctgctacaggaccaacaaaaaagaagaagcagggtatacatatatggcgtgcaaatcagacacttcggtggagttacagatagatttcgaccgacttcagcagcgcatcagaatttcagagattcttcaggaggtataagaaaaggggatgctcagaatttccagcagaggaagcccttattccagccacggcgccgcttgtttcgcctccgctccgctctcgccatcctcaccgggctgctgttccaatcccactgtaacctgttcatccaccaaagcagcacatacctcccaactttcagttttgagacaaaagttgttcatgaacacaaaagaaggtttaagtttatagttgtaacatgacagagtggatgaggatggatgcttacactggaaatgcgaaggaccgggtgcttgtcgtgctactatctgaccggatggagatgttgccaatgtgaccagaggtcgacactgggttgcacatgatgctaggcccaagagagcatggctcaaggggatacccattgccaatcagagattttccctttgcattattatcaggcacatctagttcatccacatgagtggaatccttttgcgcatcggtagaactcgtgctaattctgccatcgtttgttgcgtctgcgcagctctctgaatctgtctggttgaaatcatgcacatcagtagcaccatcgttgtcagagttcttgttgttcatctgcctatttgcatcactggactctacaacatgaggtgatgaggatgtggccactgcattttcatcctgtggatccgctatcggctcgctggtgaagctttcggggtggtcgttgctcttttcggatggttggacttctgaagaactacttgatgtcagagcatcaggcatggcttctgctgttccaacttcgttaaattgtttggagccaattaaaccgtcagtagtctcagcagtggacatgggtttatctaatgctgcggttgcatcatgtctgtcagatattgttgctgatgaaccgttggtgttattgatacttgatacgttgctagtaataagttcatcagtttttgatgcagttgcaacatcattgcagtcatttgtggaaacctgcaatgtggtgtcaaacctgtttgtcagtctaaaaaaccaatctaaggatgattgaacttctcataactatataattcaagttatcacccaaaagagtagggtcaggtaataaaaaaataataatgacaaacctggtgatagtggtaatgagaaaacaaatttgattacagattaagccagtaacttatgtggttacctgtgcaatagcctcttcatgaacagggggcatgtttttttcatttattgcagaagttgtgctttgatgctgggtctgggattcttctgcctttcaagtttaagtctttccttggattcttctgcgctttnnnnnnnnnnnnnnnnnnnnnnnnnnnnnnn

SEQ ID NO: 23609 - DNA, 673 bp, Oryza sativa
ccagcttaacccattgaacccggccatgtctcgtccttcaggacctgcgctgccattacctgatagcttccgcggcagcaagacgccatggcgaaggcatctgcgtgatcgaggaaaccaagcaagcatcggctatttagcacgcacgtaagtgaacaaccccgtagacgttggtgccggcggcgccgatgccggcgaggatgccgaggcagccaaacggcggctcccatccaaggaggaaacaatcgctagctcgccgccgccgctggcttcctgcctgcctgcctccatcgcatggaaaggctaagagccatggtgcaatcgcccgctgttgagcttggaaggacatccatggttgtgttgctgttcttctgcttaatcccggtttaacctgtcaaaaccgttcaaaacaaaccgtataaaccggtactagtatttctgggttggtttgccttttctgaccaaaccgctaaaaaccgtcgatgaacaaccctatgttgagatatatcacatatataggtggtgtttgaatctccagaagatggagatgaagatgaagattaagtttttttacgcaaaacgaggtggtattaacgtatgattgattgagttttaattattacaaattttaaaaatagattaatatgatattttagagcaacttttatataga

SEQ ID NO: 23610 - DNA, 7278 bp, Oryza sativa
ttagattcgtttgtggtggaaccagcccacccaggtttaaatcctagaattgacatgggtgctcgtatttacgggctatttattctttcagtggtaggtaatatacccgtcaatagcgaggcacttacacgcatcaataacttaatgggcttcaacctaactggaccaaccaacggtgctcacacgggctaaaaaaattataacaggcccatggtcaacttcttttttatcacaacttattacaatatatctatagtgtaattatattgtaattataccataattatagtgagttacactataatgataatgtaattttagcttgtaactaaattaaattattcacttgttcgactgacgaagtgcatgttctagcaattagaattcatatgccatcccacaaaggcacttgctggaagattttgtcagcctacagtagcctagtgttggtaacttttttttttttggcaagaagataatcataatcgggacacttaaatgtcttacagtgatataaagtcgccaaccaccccgatatagccaaaggctaaatcaagatgagttttatataaagaaaagctaaaccggctagcggagccgatttagagatcaaaataagcctctaggccgatttagatcgatatgaggataactacccatctcgtgggtgaactgaaggtttacgggacaaacctatagaggggtaatcgcactactctcgcagcgacggcggacgatttacagcgcaaatcgacaaagatgtagtaaaacaagaaagtagaaaacatggctaaaagtaaagataaaagaacaattcgattgtgttcgggggggggggagagatatatcaatcgaaccggtcttgtcccttaaaaaggggttggtcttacctcctacaaatcctcctccacgtccaactcgggatagaaaccaatggaaatccgaaatataccttcccgagtaaggaaatccgagacccgacgaaaacaaactcaggctcggactctaccggtctgaccggccacacactgccggtcagaccggtcctcaagcaacgatctgaccggccaacatacggtggtcagatcggctctgtagaggaaacatgtgatatttccaaatcttgacaataatttcttaatttgaacctaggtgccaaatttgagtataaacaaaagaaaacttatgttctgatgtggtaggcccaagaaaaaaaggtgtcatttgaagtaagaaatctatcgacaaatttatagtaaaaccgtatgattaaacttgcttttagcaaaagcgacgtcatcaatgaagtttacggatagtgcacgaacaagactcctctgacttaagtcagatgtacatagccactaacgtgtgagcccataaagatagtctcccctgtcagggaccatgtctctctgattttaagcctgaggagatcgctccggtagtacaccagtgtgcttgtactatgggtcggtactttttttggcgtgagataggattgatctgctggctggtgatgttgatcgaggcgtcgtccgcgtggtggtgctgggtggggtgtggctccgtgtgtgacgggggtcaagtcgtcgcctggaccccagccgccgcccgcgactcggcggcgagctttggtttgactggccaagccttgtttctttgtgatccgcgggtcgagggagtcgcttgccagagtccaaaaggacaccgcgatttttgcgaagcaccgcgcctggtgagtcagacagtcacgcacgacgagagggagttgtccccgggtcagattggcatgggaatcgtcggtcgtcttctctttaccttaacctgatttgagtgttccagtttcactgcgcacggtgcgagaccgaggtccgtcgaaaaacgtcgctagctgtttctgttggccagtcacggtcaccaggggaattcgcccagccatatatggcttggcaagccggatggcaactccgttgtagtgcgtttttttttatttcataattagtaaagtttagcttcaggaatgggatagagagacggttagagttgctgcataaatcccctgtgatactgcaaatatattaatattaacagcgactgacatataggccaaccgaaccctctgggtaactgcacagctgcagcctacaccaccaaaataacattggctgtgtttagatccaaactttcaactttttccatcacatcaacctgtcatacacacacaacttttcagttacatcgtaccaatttcaacccaaacttccaactttgaaaggaactaaacacagccaattatagatcacaacatgcgcatgcaaaacttccatgttgcaggcacgacgtccacttcgcacacggtaaagcgcataccgatgctgtcatgcctcaccctcactctttttgaacaaggaataattaattatttgccactcttacggatggtgataaatgatttaccactggacccacatgtcatagacacgtaagggctcacatgtcatagacagcgagtggcaaataattaattgccacatcttaaaagtggccaaaagttaaatgtccctttgaacaaaagtagagcacctgaaactatgaaagcaacagtacagttagcaacttggcactcgactgcatgtccacaagaaaccgtaagccgtagagtcacctttcagtgaactacatagctctgtagtagagatcactgattagttcatgacaacgaaactgtacctgtaattcttgcagactgaagaattgacatgaagaaatgtttccattcacgaggctggcagcaggctcagtcagttacaaaagacctaagtcaacaactggactaagattttctttactgttttccctacaaagctgcatacatacagatcaaagaaaggccagcattgcagttctacccaactatgaacatatggctgcttgattggcaacatcgtgttgttttgaaggccaccatgattgctggggcacttcattcttctatatttcagaggctgaaaggttccgtagatcaatatttagaccgcaggaagttccagaacttttttgttctggaaattgcacagcactttcgatggaccgacaaaaatggtcaaatatttaacatgcaattcaaatactcgaggtatttggcaactgatcaagccggctgttcagtatttggtgagctcgcgcacttcggtattgcagtcgctggtgtagtgcttctgacatttgatcaaaaaaatcaggatcccatctctgaattaaacggggatcctcagcatagcatatgtatatcgatgtaactgcactttcgacaactacaacagttaccccaacctgaaagggggaaaaatcaatcagctcaacatgatccaacaggggtcatagtagagaagtcctgctgtgtgactcctagcaatattctattgaatttgtccagtaagagaaatccttgtttccttgtaaatttcaattagattttgcatgaccataagaacttaccagtatcatgcccatcagcatagaggttgagccaaccataatagctttatcactttgtttaaaatatgtccaaacacccgtacatgttcctgtaattaacccacctaaaatggtgctcatcagaagggcagcccctggacagtcataagcaacaagtgcttcaacgccagttgattggaacaactcccaagcatccctagctgagcgattgaaactctggccattgatagctatctgaaagtgaaaagtatgtgagacatttgtgcaagcccaataggatatcagtaatttgatatagtcgatatccatacagtgatattgattcacaaagcatacaaattggtgtaacatcaatccaggtaaggtatcgggtatccatgtgcactttgacagtttgtatagtaaagttgaacttattaatagcttaaggaaacatttaaagttctatcagttcagaacataaatgataaagtggcaaacacatcgaacagggacagttttggcattggcatgagattatcaaaacttccacaaagataaaacatctgtcactgacctgtacatatgcatatttgttgaagaagcgaacaagagtttccacgatatgaaacaaaaagtcaacacagcacagcaaacactcattgttgcctattttagaacgaattcctcgaatctgaaaattagttaaaaaaataagaaaagggaaaattaatattttattgagagaatgacaataaaacatggtaatctgaaaatttcatgcggcgaaactctgttaaggtaaaggtacaaacctcccaacgtaaagtcctaatagcagccgtaaaaagtgatccatagcaaatgctcccaaatgaagttgttacagcgtactgaagtgattttagaagtggttttgggggcatcgatgcagcagcttgaccaccatgaatgagaacaagaaaaaccatccctgatactatgacatggactgtgttactaaggacagctccagtccaaaataaactgactgagaaaatctacagattacaagtgaaacaatcagaaaatatataaagaataggaaagacgttgaaattcgatatagaataaacaaaacttgcccgctcaccaaaagagcccaccattgccctccattaggtatgtgaaaagcaagaatgccagacactccaaaggaccataatgccatccaacaaagcatgactaacacaaatgcatatgctatcctcatcacatcaggaagttcccataccattcttactgccttctgcaatacaagcattgtgaaggggaacctagcaaaaaccaacccaattaatgccattggagataaacggggtatgtatttttgcagcaaatataatgtttatgagaatagaaggggttatttctcatgattttagcatagaatggaaggaacaattttagcataagaattccttatgaaaccaaaccagatattttcagggcttaaatagttttcttccacagacagccatgacatgcaaaaaggttgccataagacatccatgttaacacctaatgttcacaacaaacttttaccacctacaaagtttgtaaacctagctaaattctgtgagttgaagaaaaaacagttgctgtcaaattttccactgataacatgccggctgatattggatgacaaaatatcaataatcagtgggaacatttacaacctacaaatatagtaataatactgtttgtctgtttgatactggtttgggacataagctgattattgcagagtaatctatagaatagttgttttgttgaagtgacactgtccattaatgtaattttgcctaaagatctggttttactcacaaaagcaattattttcccatatatacaacgttatttgaaaacaggttatcaaactaaatttgcacattgcattgtatgatgtctctggcaaataccaaaaaaggaagcttgaactgtatttaaaaaaaaatgcttgaccagtgggtttaagacagcccgtgacattcaactaagttgagaaaaatcccccagaccgcagttgagcacactcaacttctcgtggggagcacgcttctaccagtgcctgcgaggggggatgttttttgggcaaaacctgggttcaagcctgggccggcatcccctctactggagtctctaccactgcgccgcaagcgcgtttacaaagcttgaaatgtacaaaaaaggattgtggaaaacccattccatttatcacatttcaatgttcagaagttatttagatattcattgtccattggtaagtttcatttccatcatggtgtagagcgcactacatggataaaacagaaatcaatagcatcttgtcctcatgtacaatcctactgggaaatgtacagaatttgtaaacaaatgtacatcaataacaattaactccaacaattcaaacatgtacaatcctactgggtacacagaatagcagagacaatctgcaacacctgcttaaatcttactccgtctgcttttttatttgacgttggttagttcaaacaatatcaagaatggagggactactatgtacgcacgcaccaaaagaatggcatgatccctgacattgtagtttcttgtacatctttacagcatttgtaggcactaaagcctaaaagcaacactagcccatgcttaaaccgtgtgctaccatccaaatcaagttaactctaaaagagtgtgaagaaacaaagcactagcattgcacacccatacatatgggtgcacctgttggtaatgggaaccgacatggacacgcgccaacagcctagtaaaattcttataaaagagagctgcgcaattcatcgatttctccagtggcaggaatttagcttctgtcggtgtcagcatcatatgaagtatgaaccctcacctactcaagtctaagtttgcctcgaattgcatacgatttctaattttgtgcaggacatttgagaagacaaaaagggcagttgctgtgcattattattacctatcaagaactgacatgacgtagaggaagtgcagcgctccgccgacggcgaacgccacgccccagaagaagtgcttcccccagaagcagagcacgctgaccaccgcgaggtaggcggtgaggctgtgcacggcggccctcatgaccaccctccccccgtccttcttccccgcggccgccgccagccacgcccacgcgagggcggtccccacggcccccgcggcgccgtagtagggccagtacgactccgtgagctcggacttgggggtgacctcctcggcctcgagcgacggcggcgggggcgcctcccgagcgggctccggcgacccggcgaagcgaggcgcggcggtgaggttggtgaagcggtcgatgttgaagcggtccgcctggccgaagcggttgagccccgtcagcgcgagcgccccgccgaagacgagcaggtggagcaggaacaccaccagccagaacacgtcccggcaccgccgcctcggccacgccgccgcccccacccccacccccgccgccccagccaccgccgccgccgccgcaggccccgcggggcaggggctagggttcgcgctctccccctccgacgacgacatcgctccccgccccgccccgccggagatcagcagcagcggggaccgcaccgcaccgcaccggagcgagggatcagccgcgagcggatcgcggggaggaggccggaagcggaggggatgacttggaggagaagaagaggatggggaggaggagtaactgctcggcagtagtagaag

SEQ ID NO: 23611 - DNA, 3903 bp, Oryza sativa
cgctgaaactgtgagaactgggaagcgatgggcgatggcgacgtcgcggcggtgtggggtgtttggggatttgaggggaaagccggggaatttcgggggttttgctgttgggtttggggggccgggcggagcgcgaccggctccgcccccttcctccgtccgtcgctgcgcctggttggttggctttgtggattctagaagcagcagccagcatctcaaagcaagtggcagttgggattggagaaggcgaggccttggtggtggcgtggtgccagttcggaattctgatgcgccccgctgcacgagaggagattccgcgacggcaactcccaacttcttcgtccgtcgtttcgactccccgattcggcgattcgctaccggggatccaaatccatatccacggcgtttgtgttcgtttaacctgcaacgtttggcaccgttcgaacgtgacaccgtcgatctgtcagttactctcggtgtcaccgtcaagaaactacggtgaagttggaatttttttccatttttaaattttttatttttaatatttatagaaatattgtaccggcgaaaatttttacaaaagtataccctgccgagggcggcagtgtgacatgagggacgaacaagataaaaaaaacctagaaaaatgcatctttggtagggcgaaaattgcatttgcccctttacagcccttgcagaggacggcaagggacctcagtgcaaaatgcgcacaccttgccgtccttcacttgggcgacagaggccatttctgtaaatattttggatggtataatatttttgtaaatattaaaaaataaaaattttaaaatgaaaaaaattcggtgaagttgatgtgacatcgatgggccgaagacgagacggttttctgagccaggcctactactgggcgaattctggagaacggcccactggagtactctctgtctctctcccactggacagaccgggctcaacgcagacacggaacggagccagccatggtgaggtcggggcaggcgtcatgtgcccctgacacctgggcccccccgcgacatcatcctccagtcacgtcgtcctcctccacctcgggtccccaaccttttcaaccacacccacccaacacgccatgatgagggcagcagacaagtgggtcccaccaaacagtgtcgacgggtagatgcggctagcagccgtaacaatccgggcccaccttatcaccaacgcggagtcacccgagcccacatcgcgtgacctcactgacatgtggggcccagacggttaactgccggtgggaccacggaaacagagagggcgggggagaggtggggccaaggctccacctgtgcgtggaaaccttttggactgctttggtgtgcccagctttttatgggggcaggagcgcgtccggaaatagaaacatctcgccgaatttgaactccacctgagcacaggagaagccgcagccactgaggtaaactgctcctcctcgccgatttcccccctcctttttctctaataccaaattactcgagaaattgtgttggttcggtccgcgggtagcgtgattcggccagatctggcgtctgtgtgtgtggagaattcgagggttttgtttgggtttgtggggggagtaaatccggacgaatctgtggtggtttgggggggaattcggtgtgtgtttgagttgatttgagttcgtggatgattccgttggatattgataggtcctagttctgatccagaagtggcggctacgcctttgctgtagcctcaccgatccgccgccgccgccgccatgaagttccgctctgattcgtcaggcggcgacgagccccgcgctccggctgccggcgacggcggcggcggcggcgacgagccggccaagaggcagcggaccgatccgtcctccagttcgagccagggcgaggcctcctcttcctcgcagccgccaccgcagcagcagcaggaggagcagcctccggaggatgcgggagagggcgagcagccgagggttccggatctcggggaggacctggtgttcgaggtgctgcggcgagcggaggcgcggacgctggcggccgcggcgtgcgtgagcagggggtggcggcagctcgcggaggacgagcggctctgggaggccgcgtgcgtgcgggagtgggcgaacctcggcttctccgagcggcagctccgggccgtggtgctctccctcggtggattccgccggctccacgctgtctacatccgccccctgcagtggcgtggcgccggcgtgcccaggcaacaggggaggcggcagccgccggtgaggttgggccgggaccaggttcagctctcgctgtcactgttctccattgggttctttcagaatatgccttgtcctaagaaagacaagggaaatgacagtgataagaatggagggggccaatgcgggtagtcgaatttgtggaataagcttcactccaacaagcatcatcctaagctaccatggcagttgccctattgttcacactggtgatgctagagagtgttggagagacgaacaggaaaatcggcatgcttgatttgggacatgagagaaattaagtggaattgcaagatctgaattggttcggttgtgttccgcacttgtaagatttatgtgatagtgtcacatggattgatggacgttgagtgctatgaggacagttgcgtgaatgctgatgacaagtgatttacttcaagagaagggagaaatggtttgcaattcgttctgctgttgctgatattctagttatcagctattgtgtcaacttgatatatctggcccaagagcagtatggactgtgtgccttcttgcgccggtaccaagctttagagggaaagctgatgcaaatagcttttgtttgcataacctttttcaattagggaaacataatttcccatattaggcatatggagaattatgtgaggtattgattgtttgtacaaaaataaccattttattcttgaatattgcattttcacatgttaactaaggttcttaagttgatctgactgccatgtacaatatggagcccaacaaggggtagtgacacatatttctcaacttcagtatgcaataagtcagtcattttatatgtttttacatgtggagctgcggataatgtgacaaacttatgtaatcgtgaatgatcttttgatgtttctctgtttttctttcatgtagtttgatataggattcctttatctggcactattgaagttttgttgtaaataatgttattcttgcaaagattatcttaaatcaatcatttctggatctgaagaggtattgtaacaatctgaagctttgcacaaccaattgcaactaaacttttgtatttcttagggtgaggacttgaggttggtgtgatgggcatttagctaactgaaatttctctcaaacctcacagatttgaccttctgtttctaccagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttttacctcaagatgaaaggcgactactacaggtattacaatagttcctggc

SEQ ID NO: 23612 - DNA, 9914 bp, Oryza sativa
tttctttatattgtcaagttcatgtgttagaatgtatgtgtttgataggtacctcgcagagtttaagactggagctgagaggaaggatgctgctgagaacaccatggtggcatacaaagccgctcaggtggtttccttaacagtgaatttgttgttgcggcatcctgtttgtttgtttgtgccattttgcaattttgattcggggtattcagctaaagttatttgtgatgtgttctcctttggtctgttttgtttttctgaatattgttggtgataaaatctttcaggatattgccctggcagagttgcccccaactcatcctatcagacttgggctggccctcaacttctcggtgttttattacgagatcctcaactctcctgaccgtgcttgcaatcttgcaaagcaggtttaatttctactgcattctatttcattatttgtgaattggaggaccatatggagttgagaagatattttgaagtttataccattgttgtgaaatataatgtcttagtaattgggattgaacaaataacatgtatgaattagtaatacacctggaacaggttctacttagttctgttagcaaatagcaaagtgtaggctccttaatgcaagtaagctgaacgggttaggtgcattgtcatgatggattttcttcattaagaatacttgatagaaaatgatgaatcaaataagaggtgtaagaaattatagtttacagttacagatttgcccaccttgaatacttgagtgcttctaaataactgatgaagtccgagcatcactatggccattgtgacgtggaacaagcttgtctcaatatggccatcgttcattcatagaggcctaccagtttgttctgtaatttgttaataatagatatctgatgtatatagaatggtttactgcagacaagtttgctataagttcactgctttgtccatggatataattgatcttggacttggagcacacattatgtgccttactttatgaaacttgcttgtgctagtacttatatttgccatcataatagaatgtgacagtaacctactttatctcaggctttcgatgaggctatctcagagctggacactctgagtgaggaatcctacaaggacagcactttgatcatgcagcttctgcgtgataacctgacgctgtggacttccgatatctcggtattttcttcgccgctagcatatatatttgcacttgcatcatattgtctttggaatcatcttaaatgcgtaaattccatgtgtgcggcttcaggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctccagagtccacagtcctgccaagtgccctgcttgagtgtttttggtttcttcgatgtaaatcccgttgtgtgcacgatggttcttgattcaccacacattgttgtctacattgccaaaacgtatgcttcaagtgcccaaaaggccgaagcggtccgagaaacattattctgtcaggtatgtgtgataagcggtttcatatgcaacaatgctgtagggacccaaatgttcactggcatcatgtacagatacttgtagtaccaaaattagtttagcagatataagcaccagtggtgtggttatggccttatggattattacgcacacacgattatgccatcactagaaatttagtgactaagatttactaatgacttctgcgtccactcaacgtacaaatattgtagttttctagatgatttttttattttctataagactcatcaaaaaatattatatttgataggatcccttgaaatttttagttgtgtttttcatgagaatgagcaactaaacataactaagcataggggtgccttctgcttgaaaatttttatcattaaaaaaatggggttttcttcttcaagtttgaatatttaatttctttcttttttctacaacattttaaaagttggcactaaagaagacaattattatgcaaagaagataatacatctatttcaatcctaccagaatggaaagctctggaagctgttaaatctttttttccctttttttaccttgcttccagattgtggccccgacgatggtgtcaccttttctattttcttttacatttggagcttaagcatctctattgttttatttgagctccgattctagagacattcttagcatctagaaaatattttttattccaataatgtcattatttatttcatattttattatattttctttattttctttcctaatttttattttgcaatttttcagaaggtgatgtttattttagtagtagtattgttgaaggatctagatgttaccggtttaatttattgagaattagtatagaagtttctggagagactataagctgcaagaaagcttgagctctgtggcatcttttcttgctccatttgtgttttttttttcacaaaagagtctatcatttatcttggaagctagatgcgccaagtgaaccaatcagctggctggatctccaaccagctttagaagtatagctccgttacaggttataagacgttttgactttggttaaagtcaaactatttcaagtttaactaaatttataggcaaatataataatatttataatactaaattagtttcatcaaatcaataattaaatatattttcataataaatttgtcttgggttgaaaatgttactaattttctctataaacttagtcaaagttaaaacagcttggttttgaccttgaaacgtcttatagtagtttttttttatggaaccgaattctggaaggagtaggttgtaaacagccgccgtttgccatatacatatccaaatcgcaagtctcccgccatcgcattgcccgccgaaatagcctccctgcacatcacgcattcacgttcgcacgcagagccaggtaaaacggtcactacccgccacgccggcggccggccgccgcgccaactttgcaccggtttgatgtaatgatgtgtgcagtggtggaggcgccgccgccgccgccgccggacgagacggagggccagcaggcagggggcgacgattcgtcgggcggcggcgaccggcggagaggcgccgccggcgccggccggcgcgtgatcgccgcggtggctttgggcggagcagcctccgtcgccgcgctgcttcacgttttctgatgatctcgcacggcaacaggccgatcaattattattattattatttttcagcttctttagactgtcagtgcctcccagtaatttagcggtagaagatatgcaatgtggcaatgcaaatgaacggttatcgatggttaatttctttcgacgtaaacatgcttatcgatggttaatttcttcatgtaatcaggtttagatgagaccttgaggttgaatatgtcgttcggcttgtgatgcgaacatcccagattcaaaaacatcaagcaaaagagctatagtttcagccaagaagtccaaatgggaagcatcatcagactcgctatatttccctgatttttcaggtaccacaactcgcagctcaggttttctagctctgatcaataagaaccagatacaacatacaaggcacggtcggaagcaaaagctagttttcttcatgctggagaagtgactcaactaaaagcttccagagttcatggattggatgccaaatgtttacatcggctgcagattaatttccatggagagccacgattgttctactcaccttaacattctacggctcttggacgtcagatacatataatacacagcaattttttaccttgtaatgaatcgatttttgatctcattgtggatggcctaatggctcgacagcggttctgaagagaagaacgtagaccttgtcgacggagaagtacaagaagcctcccacagagtgggtgacataggaaccaaagcctgtaccaacaatgcagtgccaagcaggaccatatgttgcgtcgaattcctgcaagaaaatgaaaaaccacattaacaatggctaagacatttcatcctagttggctcagtgaaaaataatgtaaaacgtagtgttcaaaaggaaaaataataatacagtagggaagttgctacaaactttaacctaaggtgcaaccgtgcaagtgcaaccgatattctgagcattagcattctgtagtaaccaaccatccatatgagaaccacttgtacatagccagtttaggagcactgagaatcagagcttacagacatgcactctgaacttttttgtgtgaaccttgaacaagctgaacaacagaattcgatggaaggtgctgggaaatatgattggcaattaggactaaaaaaatgtgccctaattttcatctgcctttcagggatatctaaatttcatatagttttttttttcatgtgatacataaatgcctgatgaaaaaattatttcaagtagcaggtgcctttgggcatgagtatttatttaacataggaggtttgctataaaagtatcattcctacaaaaggtgtaagactgcagaaaatcttgttgggtcaagcggtcttctgacttcagatagggctgcaattttgtaagtaactcttcttcttaatacaatgatgcgcaaatcatttgtgtattctcagaaaaaagactgcagaatatgacgaagtaaacacagaaatattcttttgcaccacatccacaggtaagagttaagatgttgataagttagcacgttgaggttattaagaaggataggcagacctctaagtcgaactgtcaaagtagtcataagtaaaagcaaaatactgttacttcttctagacaaagtattttttttattcaggcttctacacaaggaatgcactttaccatccattattacattgttttagccatatgttgacgaccaatgctaacaaatagcactcattcacaaaattgaaaccttgaatgaaaaccatctaactacaaagcaaaatattgtgtacctagatggcatgcatccattttttaagcaaccaatttgcgtacctctttagaggatgcatttagttaatctaccattgagcacacagaagtctagattgctctcagattcttgtaatcaacaaatttctagaagatctgttccacattttaatgctcaggtaatgagctactccggctaaaatataaaatcagacaaagcaaaaggatcagatggtgtgaacaacaacatatatgaatgggaaattctgttaggggaatggcgaagaatgaatcttacaacacaggggtaaaacaaaagccagcttctgagcttcacgggtcacagctaacaaatgctggatgtcacatgtgttaggctaagctgtcacaattgcatttctggtatatgattctaaagtagcttttcccctatccaatgttgggaccaaatgataacacatctctaacagaaacagaaaattttcaaccatagtcactttcttcaagatatcccttccagttatttataatagagatgctggcattgcacctgtctatctatttttgctaaactagcctcaaagacatcgttttccttttcccattttcctgtttttaaggttcccatcactagccacctccttgcttgagttgtgaggctatatatttcttgagaaaattcccaatatacccctgaaaatttactcaatcccttcaatacccctgaatttgacatcatcccttatatacccctgagttttcattttgatctcctctatacccatctccgttagttgatcattagttgaccgttaaatattttaaaataactatattacccatcctatacaatggtacctacctaataaattttcatatgaaaaaattaacttatacaaaatacaagcaatataatcatttaatgcccaacttaaaaaataaaacttattattttttattttttaaaacttatgattaaatccatacattagtttcaccagaaaattaagagcaaaaactaaatgttatttaggtttaaattttaaatttgttttctaatttgtgataaactaattacatcccctttgttttttcgcaacaaatcttttttcactaaatatttgttgaaaagtaattttgaaattttatgcagaactttttttacaataaatcttttttattttaatgaaataattttttatttttaaaaattcataacaaatatttagtaattttccttattggttttcacaactcaaataatttacacataaaacatttctagcttttaacaatataccaaggacaacaaagtaatttctacaataactaacggtcaaactaatggtcaactacggaatgggtatgtaagggatccaaataaaaactcaggggcatataagagatcaaacaaatctcagggacgtagaagggattgggtgaaattacatgggcacgtagggaattggcccatatttcttgcccaaatttctcaatcccccaaccatattctttactactccctccgtttcgaaatgtttgacaccgttgactttttagcacatgtttggtcgtttgtcttattcaaaaacttttgtgaaatatgtaaaattatatgtctacataaaaatatatttaacaatgaatcaaatgatatgaaaagaattaataattacttaaattttttgaataagacgaacggtcaaacatgtgctagaaagtctaacatgtgctagaaagtcaacggcgtcaaacattttgaaacggagggagtacaaatttaccaccccaatactgcactgtgccactgtctacgtgtactcgaatagcttgaacaaactgtagccaatggcgagacggatggttttaccttcttgagggcgagggcgaggcgcttgctgtcgagccgcggcatggcggcgacggcgtcgaaggcgaggcggaccgcgcgccgctgcatcgccagcggcatgtcggccgcgcgcacccggaccgacaccttcctctcctccttccccttctccatctccttctccttccccttccccttcccagcttggccgccaccgccaccccctcccttgacctccctcttctccaccacggcggccaccgccgccggcttcttggcggcctcctcgactcgctccggctgcggctccatctccagctgcagcttcgtctcgggctccgggggaggcgtgggcgggggcggggcgagcgccggcgcggcgtggagcttggtgcggcggatgagcgagctgaggtagcggctgcgctgctcgagctcctcggacgccggatccatggcgggcgtgggcgtcggagtcgtcttctgctgctcttccttccagggtgcggggacgcgcgcggggcgtcgtgctcacctgaggcggcggcggcggcgagcgttggtcaccatcgctgcctgcgccgctgcgcggtggtggggggaatggaaatggaagtggccaaatgagaggtcgtggtcaaagcacaggagaagtagtagcgccggttcacgagacgaggcggtgtggggtccgtttcccctggccttttcccgatggtgattggtgacccggcgaatgtggtgagcgagaccggtttgaaactttgaactcctaacgaacgtggtgattcgttgaggccttgaggggattgtcgcagaaatagctacattttgtaactgagagtactccctctatttttcaatagataatattgttgacttttaaatatatatttaattatttatcttatttaaaaattatgtgtaaatatataagatataaatcgtacttaaagtattttaagtgataaaacaactcacaacaaaataaattataattacataattttttaaataaaatgaatggtctaacatagaaaaaaagtcaatagtatcatctattagtatgtcattgtgaactgtggagttgtttcgagctggcatttttactttatgttcagtgctactgtgcgagcaacacgaatggatacagatcaggtatagttgtacttgtatggattcttatcggaattttagctcttaaatttaacttgaagaactagttcgaagtggagttgtgaagtagttgaatcgcgctctatatctttcattttgtgggaacactccagcagtccaactcgagcattatttaggacttgtttagtagagctccaactcttaaatttagctccaagagttgagtctggagtggagttgtggagcttcctaaacccatctccacctttctagttcattttgtgagagcactccacccagcttcgctcccattttaggtggagctggaactggttcattttgtgagagcactccacccagctccgctcttattttagatgaagctagaactgctggaactggttcattttgtgagagcactccacccagctccgctcttattttaggtggagctagaactgtttggctggactctagctcaggaaaggtggacttggagctagagctgtgacaaacagattctcagactctagctccagaaaactgtttgtttcgactctctggatgagatgagactctgctcctttgtctccggaattctcaatttcaaggcttgtttggacatccgagtgtcatcattgcaacagcgctcatattttctaaacaagcacagaaggttaccaaagagatactctctctgtcccaaaatagctctaggattgaatttagtttggaacagacgagtacaccataaaacaagttttcgatgccagtatgctccatcagtccatcatcgaacttccatccctcaagagttcccagaataaacattagcaatttaagatcacataaaagccaaatggcttcaaaatgtagactaaactacgatgggtaaagaaaactgggctcttctgacattttgcctaatcttgtgcataaactacataacattgcttaatctcgtacattaattacataaaagaaaatcaacagcaagcaaatcataaaccatacttcttcccccaattaacattaagtacataccagaatcatggctgtgttctccccccccccccctccaacccattttcccaacccacctctctcattttccgcgcacgattttcaaactgctaaatagtgtgatttatgcaaaagctttctatatgaatgctgttttagaaaatcatattaatccatttttcaaaaaaaaagttaatacttaattaatcatgcaataaaatgagcttcattttgcatgccaggagaaggggttcccaacccctcctaccgaacacagccatagccacatccaactccgtgtttttgagtttcagaaacaggctttactatttgttgtgcaatgtgatctaaagcaaaattcgtcacagaaggcaaagcccaataactaactgtaataaacgttctcaaatataaatgctctcaaatcaacaacagtgacagtcttactactgatttagactggaagtttggaagctaacattccggaaaagtttcagatcagtaaactcggctagtaacaatcttactgagtactgaactactgaccatgctaatgccactaagcagcacactacaggatttgaattcaatgccatgctaccataattctattcatcgcatggtcctcaacgatcggagtagtaatatactccctccgtttcgttt

SEQ ID NO: 23613 - DNA, 1890 bp, Oryza sativa
aaacgaaacggagggagtactgatttgatcatattcagatcaacccatcaaaatgggccaacaaagcgcaacaatgatcccagacaaaacagatgtttatgaaaaaaaaaaaaaggttctctatacattgttcagtgtttctagtggttcacttaaccaagaaaatgtaccacagaacagaagaataccaggcaaccctcatgataacggcagattgactatcataacaacaaagaagagggggaaaaacagccacaatatcaacaaggcaatgtagagctttaaccagacaaacccaattagagcaaacaatttcataaacaaagttgctttagtgcaaaatatctgatacctgcattgcaatagtcgaaggatcacaaaattcaacagactaccacaggcgagagtgggcttgccacaatttgtaaagaaatcaggggttatctgttttttttttaactgccgagtacatacagtactgtagttttattgcagttcattaattaactgcataacaaggaaatcaacaaacaaatgataaaatggaagtacacattgccatctccctgcttccaatttttccgaaacagagtttagaatttgctgtgtgaccggaactaattcacatctttgtcgtggaaagcaaaagtgcaaaactaaataactgactgaagaaaatgtttaagtcaacaacgctaacagtcttacaaccttatcccaccatcgactggaagtttggaagcaagataacctcaaaatatttcagaccagagaactctgaggccagtgcgaaggtcacaaactgaacatgttaatcgcactaaagcataaaacacactacaggattccaattcagtgacaattagcataattccattcatcacatactccacaacgttcagacttcagactagtgatttagactaagactaacttcagacaaatcaatcaaaatgggcaaacaaaagctgcaacaaactggttatctgaaaaaacagggggtcttctgttctctttatatacattgttcggttcattattcctaagggcacatagatgcaatcctcgtgataagggcagaaacatgtcaatccaatgctaaaagaattatcatagcacaaaattggataaaacattcacagcatcaacaaagcaatgtagatttctaaatataagattcctgcattgcagtagttgaaggatcacaaaattcaacaaattgccacatattttgggcaagacaaatgcagcaattgttcgacaattcatctccatcagtggaaaatttatgggatccaataataccatgaagtgataataagatctaaaaggtaatgcaactgactaaagggaaagatgatgattcattcaccgagcgccgctgagaccaagcagcatctggctgctgtcgccggccgggatgtacgagacattgggggagcgcgcaagctccccggcgatctccttggcggcctcgatcctcctgagctcgatcaggccggtgcccgcggcggcggtggcctcggagatgaggcgcgcggcctcgctctccccctcggcgcggacgatggcggcgcgcctctcctgctcggcgcgcgcgacgaggaacctggaccgctcggcctcctgctgcgccacctgcttcttctcgacggcctgggagaactccgggccgtaggcgaggtgcgtgatggcgacgtcgtcgaggacgatgttgaactcggcggcgcggcggatgagggagtcgcggacaagcgcggagacgtgggggcgctcggagaggagctggtcggcgttgaactgcgcgacgacggccttgagcacctcgttgccgatggaggggagcaccttctcgtcgtactcgaggcccagcgaggtgaagatgtccgg

SEQ ID NO: 23614 - DNA, 5850 bp, Oryza sativa
  unsure (1)..(5850): unsure at all n locations
nnnnnnnnnnnnnnnnnnnnnnnnnnnnnnaaatgccccgtacgtgaaaacaacaaaacaactcatagttgattcatgctctcgagaaaacattctctcgttatttacatggtatctaaatagttatgaaaaaatatagaaaaaatcaaatagatagattaatatgcagtataacactctacaaatatgtagattaaaatttaacttttacaagttgtaaaaaaaattaaaactatgactagttaacgtatatccacaatattttttttgcaacttatagaagctaaatttgaccttacatatttgtggagtgatttatcatatattaatttattttattcatgtttttcttatttttttacaatcatttagataacttacaaacaacaagatttataacaactcttgtactccaccgaaacaagaacaatggtcccccacacgacagttccacacatatcgcacgcttccccttccctccgtcccttgagccatggcgcgcgtttaggctttgcaaagagccaaagccgcgcaaaaagcctacacagctcatccatgcagctgtgacgctgacgcagatcaaccaaccactactaccgcccgcaagctcacgcagctccagcactggcctcgtgttcgatcgatggacatggcggcctgcgtcgacgacgtcggcaagccgcgggcgtcgaggaaggtgtgcgtgatcggcgccgggatggccgggctggcggcggcgcgggagctgcggcgggaggggcacgccgtgacggtgctggagcaggccggcgacgtgggcgggcagtggctgtacgacgacccgcgggccgacgacgacgacgaagacccgctcgccgccgccgccgccgccgcgaagccggtgagggtgcacagcagcatgtacgcctcgctccggctgctcggcccccgcgaggtcatgggattctccgacttccagttcgtgccggccaggaagagccgctgcggcggcggcgacaaccccggcggccgcgacccgcgccgcttcccggggcaccgcgaggtgtacctctacctcagggacttttaccgcgcggcggggctcaccgactccgtcaggtttaacaccagggtggtgcgcgtcgccgtggcgccgccgccatgccgaggtggccccggcgacgcgctgagatgggtggtgagatccatggacgccggcctctggaagcgatgcaccgatgaccagatggcggaggcgcactgcgtcgaggaggtgtttgacgccgtcgtcgtggcccccggccactactcgcaaccaaagctgcctagcatccaaggtgcgtagcgccgacgagcgaccaaatcagcaaacctgctcttgtctcaggcagaaatcgaaatgctaatctcgccggtaattaccctggtcgaaatctcttaattaatcaggaatgggggattggaaacggaggcagatgcacagccactggtaccgggtcccggactccttccgcgacgaggttaattaactaatttgctgccacggctgtgatttgtgactaatcacaaccacagtgcccgttaatcttggattaatcctggcgtgcgtgcaacgctgcaggtggtggtgctggtgggctgcggcgacagcggcatggacatcgcgctggacctcctcgccgtcgcgagggaggtgcacctctccgccaagtctgtggaggcggccgcgacgccggcgatgtccaagatgctggcgaggcacgccaacctccacctgcacccgcagatcgagcgcctgtgcgacgacggccgcgtggtgttcgccgacggcggcgggggcgtcgtcgccgccgacaccgtcatgtactgcaccgggtaccgctactcgttcccgttcctggacaccgaggggaaggtcgccgtcgacgacgacgacaaccgcatcgggcctctgttcgagcacacgttcccgccgtcgctcgcgccgtcgctgtcgttcgtcggcatcccgaggaaggtgatggtgccgtggttcttcgaggcgcaggggaggtggatcgccggcgtgctgtccggccggcgggcgctgccgtccgaggaggagatgacgcggtccgtggaggagttctaccgcgccagggagctcgccggcgtgcccaaggcgcacacccacgacgtcgagcctcacgtaagcacatcccatggcggtctaatctgttcacttcttgatcgaatatttgaatgatcgctcgttttggtggtcagaaaatgtatgagcttggggagaagtactgcgatttcccgcgcacggaggagtggaagagggagctgatggcgatcatcagccggaacacgagcgacgacatggagacgttccgcgaccgcgacgacgacagcgacaacgtccgcaggtgcctgcaggagtggtacgccctggctgagcaccaggctcaagacgaagaagacccagctgccgctgctgcacaagcacccgtgcacagctcgctctgaagcctgtacagctgtgtgttctgtgctctgcacaatcataattttcttctacagagcatgaaaatttctgaaataaaacagagcatgcagaaatttcgaaatttcgctgcatgatttgggtctctgcaaggccattgcccaatgatacggccgttggatgagatagtgtgtattcgtttggaataagtttacattaggttcctcatcttgaaagtcaagtttgaatcacgtccttcaatcgcaataacaatacataatgcgtctctcaacttcaaaatcaatacaaacgtggtctcaaggtggtttggacaattgtttagctgacgtggcgccaatgtgactggtttaacttagtcctcatcccacttgacgaaaaagtgacactagaaacacgattaataattttaaaattaagacaaaatatgtatggcttataagtcagtaaaaaaagataaacaatatagtggggcccatatcttctacctctctatatcgtcatgtctttatccttctctcctttgcaagcggacgtgctctcctatctagccgccaccttttgatccaactcgctgttcgtggtttcggctcccgcacttccacaacgtcattgtgcgctttgccccagtgcctcgttcttcttctccgcatcatcaccagtttgccacaactcgctggcacaaccatgcaatgcaaggattggattgagttggattggagagagaatggcaatgtatttgtccctcgcgccctcccacctctcttgccttatgacctccgccacggcgccatcgtcgcaacagtctcataccccgcgccctaacaacttcacctcaacgtacgttgataatcgctatagccagatttggcaaggtacgatatcgttttgcttacactgggggtgattggccttggtctatgtcgtctttttgctcattggctaattagttactttccgttgccttgtggtgatgccgtcgccgtatcctcgtgctgcccagcctcgctggccgccacattgttgaaaagacctggtcagactaccacgtggacatcacataagataaaactggtgttgaaaccgttaaaggactcgatttgtgccatttttaatagctgagtaacgttcaatatgcggttttttgcggttgagggatgtgaatgaaactcgatgtattgttgagggataaagtagacttatttctattcgttttcctcccggaaaccggccagctacatgggctaatacaactatacaagcccaccagacctgggcccatcacatacattacggtcccagatttgccacggtcacacgcacaacctgcccgcgccgcctctaccgcgcggtcgaccaaacgctgacctccagggtccacccccaattgggcaattcggcgccagctgggggaggggccctcacgtacgcacgcctactcacgcgcgggtggtagcctctctcgctgccacgttgggccccaccgttgataaagctggactccagtgtagtaccacccgctaccgccactgccagcgtgggccttcaccttgacccgagccaagcgaaaccaaccgcggtcaaagggtgggcccacagccgcctgtttttctatacctcccctgctgctggccgtccgatccgttctcatctcaaatttttgagccgtcggatgtagtaatggggccttcgcgtaaccaccgccgtagcggaatgggagcgaggcgaggggcgcgcgcacacacagcgcgaggcaactgaaacgaaacggcggaaaaaaaaatcagcccaacaaatccagacgttttacccggagggaccttgcatttcctcgtaattacaagttcgtatccgttggttggacctagtaataacgacttgacagtagcatgccatcctgtttctttcctctctttcgagtgttgaaatgggggatttaaatgggttgccatatacattgatgctaagtttagcatcttgacaacaaaggatagttcttatttagtacttcaaatttctttaaccctaaacgtgagccgtcaacagtcttttcattttctcactataataaaagaacatcacttgttaacagcgtgataatttatttttatcgtcctcgtttgatattatgaaaacttattttatttttccacgtaacacctgtatgtagattcttaagtattgtttgtaataaaatgcaacacacaaaaaactattaatctaaagctaataacatccttctcgtatcggtctcttttcggtttttttaattgtttggatccttctagaaattggcgcgtgttagactactttgtaaaaaactcctcaggtatatataaaatcttatataggctctctaccacctaacgtgtatatagtataggtaatagatacacccgcacaacaacgcttgttcattggagagcaatgaaatagtagcaagttagcaacgttgataacaatgttagctttttaagattcacatatagcagtgtcaccacatatgtgcctatcaattcatccgtctgtcatgaatgatagaaatgttatgagtacgatgacacattaaaacacagtcattcaactacacttctcttcatgaatcgtttacttgtagatggtggtacggcatatttctcttggttcataaaaaaaatgctacatcttatctaaatctaaagttatcattgcatttaaaccaacactttcaattacaggattttaaatctacgttataccgaaatctcaagcactacaactcataacgttcacagagctagcgacattatcgagcataagcgactaatagtgtttcttcatgacctaccacttctttatacgccaaagacaatatgtagtgaaggtggcgacgatggagccagacgatctcccgacctacctgagagctgtctccgccactacatatcacccaaccaacttccattgatacacacacaatatctgaacctgggtgattaatgatgtttttatatgacctaccaatttgtttatacaccgacgataatctgtagtgaagatgctagcgatggaacccgactggtcgcccgacctgctaaacatctgtcgatatatgcacgctgcacgctgcacgcaatatctccaaaccacagggtcctctccgcgacgcggagaaacattagggaagttgggcttccgctttccacttccgccctcccgagactcgaagccgcagcagcagcagcggaggaggaggaaaaaacggaaacgagccccccttcaccccaccccaagtccccaacggacgcgagtagtgaaaaaggcgagagcgggagcgcggccgcgcccaccctccctccctccctccgcctccacccccattcgat

SEQ ID NO: 23615 - DNA, 2717 bp, Oryza sativa
gggtttttgggtgggtgggtgggtgtttgtttgcaggtggaggggatgagaaaggcgtacgcggagatcatgctgaacatggcgcagaagtcgccggcgcgggtgctgccgccggagcggcgggcgacggcgctcgcggggggtttggcgacggcgaggaaggacggcgtctccgcgctcgtcaggctcaaggccatcatggaggccagggtacgccacgcccctcctcctccccttccgctccttaggtttttttttcgcttgctcctttcgttggttagttggttggttggttgggtgtttccttcgggtttggttgttcgtaggtgtggttgcgatttcggccccctttcggggattgcgagtttccgcgatttagggaggtttttgggtggtggtatttctcggaattctggtggatgcagattttgcgtttgaatgcggggatttggagttcgaattagagggggtttcgcggttccgtactctgcccaaatgttggttgggaaagctggtgctagtgctttttcatgcttctgcattttggtttatgcagtggtgttgattttgcacagccttcaaagtagaaattttcccttttcggtatctatttcggcagcctcgagggcaactaggctaggctcctttgagtgggtggtagaggggggaatggaagcacaagtttgtgtttgtgctctaactcaaattggtagattttgggttcctcagttccccaaagcatgcaaatagtaagattgttacaatgagttttgagacactagctttggtgataactgataataggtacataacgttcccattttaatgtagtgatgaatcacatttcacttctctctacttatttgtgcttttttcccctgtggtagggtgatgcatgctatttctatttgctgttatacattgaagtgtagtgaactatctagatggcactggtatttttgtgtgtggccaaatttttgagtcctgagagcaacaataggatactatatattttacatttttgtttataacctgctgataaaccatgctcctgcaaagagtgttataatacaaaaagaacactagtgcaatataggctaccatgttgtttatgcaattatgccaatttatggggtaatctcttagtacataataatataattccgatagctgattgaaatttaattgagcaattctctcaactttagtaaaccctcatttgtaaattacattaccatattttgttctcggttgatttctgcagtgcacaatttcttattgggaaatcatatgttgtagcgtcttgcctgaactttttactttttaagtcaatttttcattatccagtccatgtttaggtcatatatgtgtatatggtcaaggtttatgattgttccataattgttccaaccagtcattgtgaccttgatactttattgtattttaaaatgtagtccgtgtttactttgcgtacaaggcatcaaattgatagtgttattggccaagtctgtaccagacatggtctcctgctgctttttagtaccttcagtctattggtgcagttctgctaacaaataataactgtagagtttctttcagtttgtgtaaagcccagggtttttgttggatagcaatggcagaaagtctgccatctttacaaaagttagttaactgtgataagctaactgccctgttgagacctttatttgttatgatggttctaagaggaatgcttcaaagttattttaaatctagtgatttgaggcaaatttgcatacctgcaacaccactattgtgcctcatattggctagctatttgttaagacaacacatttgtgatatgtatattaattacaataactccatgttctgaagtagtggttcttctacctatattggagtacttacttagggtgagtgcagctgccccataggtactctttggccactctagactaaatgaactagattccattcatgaagttttcaaaaattaaatgtagttcacttagttgaactagagtgggtcaagaagtaatcgtgagttggtccttgctcatccgtactatactaatttgtatcattttcagtctttctaaactgttttctgtctgcctcgtgctgtgttcaacattgtgttgaagacaatagatgaaaagaatgcttatccgttatgtacttgatctgtttgaatggtgaaatgttatacatgtggtggcgcttgtattttgtgatatattttaccatggcctgtgacctttgttccatttgttcggaacaacctttttcaattaaattatagtttttaaatctttttttggtaggtagaaccattgactatgtattagggctatccatattatttgggaaatgcaaatcatggttgtaaaattcattatggattctaggcctataacctggatgattgccgattcctgtaatctattctagtactggtggtaggcccagtcactgcgtataaacatatgcatatgggcatgtacgtgttaaagattagaggacaatcatcactctctgtttctgtaggccccttcttttaccagcaaacgtagcatgtctaaataaacttgatttgtttcccattaactaagcattaagggcctgtttggttggtgccctgaaggatatttgcctgaccagacgtaagcctgagacaagccgggaccttgtttggttggtgccctgaccttagtttc

SEQ ID NO: 23616 - DNA, 4051 bp, Oryza sativa
ttgccaaaccttgtcaagaattgtaagcagttgatttacatggttaagcatgagcatatgcggataagcggaccacttacccggttaccccacatacaaggctgattaataggcccatgtatgactttcatttattaaaaggcccatgtacttctgtatgacttttattctttaaacctatgtttattgttcataaagaaagatgtgcctcgcatgttagactaaagaaatttaaaatctcttacacggccactttccgcataagatctacaaggtggggtgaccacactgcacagctcactgtcttagaacattgaagaaatttaaatagttaacctaaaaagaattgaatacacatggtatcatttgaaaaggtcaatgctgattacatatggtagaaatccttgtagtttattcaatggcatataagtacttacaaaaatcatttggtaaaaatctggtgattttgatcctcttttgtcctgcatcatatcctgccaaaaaaatcaagttgagttcccttgcagttatctgccatttataacatatcgctaatcattctttcgttgtttaatgtgtaagtaatcagggagagatggaaaagaccgccttccatttgaaactctctagatcttatatattttccagcaatctatgtcaaaagagcgtgatggattgggtcagtttgctgggccctagccaggtggactcgctaccgtgccaagggctgggcgtgctagttacaagggttccctgcatgctctttattttatacccaaaaaattaaagacactgagaaggggctagggtaaaatgcgttggtcagcaggattcacatgctggcaacagcttatgccaaattgatttaaaaaaagttaccttttttgtacataaagcagcttagttatttctcttttgaaccttgcttgcaatcatttgttccaaatgtttacaactttaaatagatgtgtcctttctctcatgtggaactgaggcgtgtcaaaacttgtttgtacatgtgcagataaaagaagcagagtcacaatctttggcaaacattaataagattaaggaactacaagagcaattacatggtgctcaagatacagtggcctcccttcaaattgaactgcagagatcaaatactgaactggagcaagcaaggagcactttggctgaggaaagaagaaataaccttcgctcctgcaataagatcaattctaataaaaatagcagctcttcttctagaaagcatctacaaggcagagtatcctcaaagagtaaaaatacggcaaaggaaagtggagctgttgaaaacttggagacactgtaccgttgtgattctgatctgggttcattcatggctagaactaagaatcctgagctgtatcgcaatgggtgtacacaacgtatccgtgcaatcaagcagcgaagtccaaattcggatacatccctggtagaaaacagcaagcaaactagtgcactgaatagccgttctaagactggaaaaactgataccaacagaaacccacagagcacaaggtccatcatggaacagatacttcaaacaaaatttctggccaactgcaagagaaagagaggtaggcgaagcaggccaagttacatgcatgataattctggtgagcatgggcaaacagagtacaagtcgtctgatacatctgatggaaatgggtgtttgctgctacttcaggctcttgaacaagatctttcacctctaaaggcgtcttctggaagtgttggtgagggattagctgaccagaaggatgaattgctcaaggatgaaaaggatgctgacttgaatcttcaccctgcttcccctggaccaaatgatgtactttcagtaaacaacatgcagatgaaaaggaggaaaaggtctaagactatgagagtctttgaatctgattttgaggcaaaagctgcccctgaatttgggaacaccctgccaaaatcaagtaataataatagcatgctaaatagtgaacagagctctgatccacctgctggaaacaatggtcctgttttgcaatgtactgctgaaaacttgatgcacgtgactgatgctgcaaatgctgatcaattaaagtctgagaacagctccccgctagtccctcagtcaacagagagtgaaattggagatgaaggtaccatttagaaactttgtttttttaatttacaacatatgcctctgttattactttctgaatatgtattgagccctgagcatggttaatatgatgcaggtaactcgcgagtggatcacaaagagtgtagaacaccagataataatgcaatagtcttggaagaagtgaatgtggataaaagctgcattattttagcttcagatggagctgattcttcgatagtcagctccctggacaaagaagaaaatgcaaaagaagcaacttctggagttgccgtgcaagctgaaggtgccagatatatcaaatacacattcaatcgcaggaaacgcaaggccgcgcctttagacagcactcctcaaggggctgtccctgagaaaagcagtagtgtggtttgcccatctgagaatcatgagcctcatgcaaagcctgagacgcaagatctcgtcatagagtcacctccaggtgacaatcaactaatccatgttgcccagcaggtatgtgctcctctttacatttggcaccatgtgtgaacttgttcaacatctctgcactcgcttctgaaaaatattctcaccgtccaaaaccgtattgtttttcagctcatattgctgtcagcgcaaaaatgatgaaaattttgtgatacatcaaagcggaaagagggattggttcgaaagaataatgcttaagggacggctccaataagtggatcatggatcgtttgataatatgctaaatgcagttgagttcttcaacggagggggagagacttgtggtggtagcggcagagaaatcaagaaagctagcttcatagtgtagttatacctctacctaagaggtgttattatagtagtgtataaattaggcaggagttactatttattttgtagatgataaattttgaactattggtttaagaaggttataaattttgaagtggtactcagttattaagtcggttcaaattcagaggtgaaacatctgctcatgtaaagcaacttacttttctctagttttggggaaaattttggtcatttgatgggaatattcgcgcagatcgttgcacagtatgtgtgctacgttggaacagtacaagatgcgggggttcaatcaccaacgcgcgtgcattccatcagaagtactctgctactttatggccatacaattacaatcgatcttccgcgcctatgtaacatggggaggtgacgagttagtagcagtaaccgtagtttttttagtccatcacatttatgcatttacagtctatgaccgtattaatacttttgaaaggtatgttattcctcgaaatttcttcagtgtaggccagtatgctttatcagcccatacagatcggaaacagtacagttggacatcttaatacaactaaaatagttgaagtatctagatacagctatggcattataacctgaacccaaatgataaatggtatttcgtccgtttcactgtagttgccataattcctctttatagcgatcgcagagggtaaagctgaaatagccgactcgtaggtcgacttgagacgatatattatatatatgcttagatcgttgatgcgtttgtcaatcgatcgcgttgtagcgagtgcgactgattgattgcactaatgaacaactccatccatggtgaaaaaaaaaaacaatttctaactttgaatctatacaccctctatattcaaatttatagtcaggaattgatttaattttttttaaggatggagggtgtgctcaagtacatatctttctgtgccgctagctgaaaagcagcctgaactgaaaacattcaccatatcatgcataacatcagagtcagacacatcaccatgctctagcctactcgatttacttcaacctaaacatgagatatacctccgg

SEQ ID NO: 23617 - DNA, 3740 bp, Oryza sativa
aattttgaccaaattcaaaattccggaaaaaataaaaaaaaattgaaaaaaaatcatggatatggttcttgatttgtaattgtcaatggtgaagaatttttttgaaatagagtaagctatattcaaatttgagggcaaaaccgagaatagtttacaaattagaaaagggaagataatattgggccttaagtatcctacatattcttccaattattcttaatttctagttttctacacatattcaaccgtattttttatttttttcccctatttattttgtatttacataatttcagctacacagcccgcgataatcgtgcgaataccgtggttatcgcggtaaaccatgcgattatcgtggtgaaaccgcgaaaccaccgagttttgaattcgaatttttggatgtgatttttgtgtgattttagacgattatcacgcgattatcgtgtttatcgcgctaccgcagggtggtggttatctcggcccaaacgataaggtaaaccctgatacaaggtctatcagttttaaatagacttcaatactgaactttgacagttattttctttcaccatgtttcatcaatagtacaaaattaacatgataagaaagcatttatataaatataaatccaatggtatcacttgtgtcactaaacatattgtattgcctttttttttccaaatacataacacaccttctatttgattcaacaaatgaagtagccttgaaaagggcaggggaggtccttaactagtaaactctgacattgtgtgcaccacgatatcacattagagcacccttggtttcaatctgtaaatattaactgtaaatagatttgcataatttcactgtcctacaatatggaaagggaaagcataaatcttaaagcacaatttatgcacatggaagtacctaggttattctgttgatcatttgctacccaaaatttcagaaaagagggtaaattagctcaacagaagcaattgtgcatgagatacgcaaaggaatgtagtaccattcctatgtggtcacctaattagttaagtactcacaatgaaaagacaacaacttcatcatatgacggagataatttaagtagcaaatccagcccaacaaataatgaaccgtattttagagagaaatagaattttaaaacaaaaacgaaaatatcttgtaaaaacagcaatatcaaatcctttatcaatacatttatacactgtccaaagtggtaaacaaacatattttcttcataatccagaacaatatgaaacccaaagcgaagaaaaagaatgcaccatatgagaagtaaacaaacatctttaccaagaaaaaaaagtccattttacttccccgaactatttcgcctgaccacttagccccctaaacaatttttcagctcattaaaatggacctttttctttcaatgaaatgaacttttttctttcaacaaaggctgatcttacaatataacccatatgatcgatttaggaattcaaggtttatcaccgtggttacatgttaacccattcacccattcactttactaggattttcaacaaaggttgatcttacaatataacctatttgattgatttaggagttcaaggtttatcaccatgattgcatgtggcttactgctacctgatggtgcttgtgcattctatgaaagtaaaaactaaataccaagagggaaggagcaaggtaccatactcaattcgaatgactgagatttaattccttgggtagatatcttgaaaagatggagggaaagaattactgatgagcagcctgaaacatgagccaagcgatatctaatagaaaataatagcaaataacaaaacaagtaaatgttgcacgctggaacagaaaatgacctggaaagagatgcatttgtccctagataacatactactagctccgtcccaaaatacttgttgctttattatcaaaagtactttaagtatcacttatccttttttatatttgcactaatttttcaaataagaggaatggtcaaacgttacaagaaaaaagacaaagtgaccactaatttaggacggaggtagtactagataaatccaatttaagtacacccatagacaaaggcatgcataattcgtcaatgataagattacctattaagaaagaccagaaaaatgtaactagaaagtgcagaagattgaaagaaccataaagggtttacaagctaatacaacatagttactgagtagataatgtggattgtggagaacaaatagcagatttcacaagtcgacaacaaacaccctgtatagctattatttatagactcccaccccatgaataacaaagggtcctctcagcaacatattcaccatacacaaagcaaactcatcaaaagtcaacaaattactggggaactttctattacgattaaacagcctatgccgatattcacatttctttatatgaaaaggcaaacgtaggtaacataccaaacagtaccatgcatagagaagaactgtgatgattaactaggtcataaccctgccatcttagtatcttggacccatactacaagaacgggacagacgtaaattccccatctcacgttcacttccaaccgtttctccacctgaagaagctgagatgtactgcttcctgcaggcaggacagcgcccatctgcctcaagaattctcttgtggcagaacagacacagatgaaaaccgcaggggcaagggaggaagcttgaatctgttggatcaaggtcctcgtagcatatagggcaggatgtcggctttgaggggactcccttttgtgcagatcctatccccattgccacccaacagttacccatgctagctggaaagctgacttgtttggagaggctgggtaaactctgtggacggaatgcatcatctgggctccaagctcttgtactactcttgattggttcttgccttgttgctgcattagcgggcactggacaagatgcaggtacaactggtggatctgccggcactggatcctggtgattatggttgtcatccactgagagtgcatcggcaacagcttcccaatcatccaaaactccatcatcatcattctcggggctaccaccagtgtcatcgtcagaatcagtcacactccgagagctggaccaagcactgctgccgctgctgaagctacggccaccaccattgcccgagcagtgcttctgctgcaagcagccaataggagggttgtaggagacagggctgtgcaacggagactcatgatcactgctaccaacatcctggctagcgccaactgaatcctccttgaaatcctctggatccccttccctcgtccgaatctctgcacgccggcgagggagtggagggtgcggggatgcgaggatcggcgacccggagttggctcctgccgctgctccaggggataccacagccttcacctccttcccatccttcactagaccaatccaaacagaagatggatcagattctgagcaaatggccaaatgatcaactaatgattgaagctttctcaccccagatcccaaatcaagcaaaacacatcaaaatgggaccaaaagaccgaaacaaagattccaactttctcacccgacagcgcagaattcatcaaaagcatcgcctaaaaacccatcaaagcaaaaaaagaatagctctctttaggcagactccaccaatacaatgaaccgaatttgagggcaaattgaaacccaagatcccaatttccc

SEQ ID NO: 23618 - DNA, 6478 bp, Oryza sativa
  unsure (1)..(6478): unsure at all n locations
nnnnnnnnnnnnnnnnnnnnnnnnnnnnnnnnnnnnnnnnnnnnnnnnnnnnnnnnnnnnnnnnnnnnnnnnnnagagatcagaccctgcaaaagccactgctcccgccgcacgtcgagcttgctctgcttcagcttcgccgaccgattcccctgcaaaaacagaaacacccaccaccaccaccaccacccaaaaaaaaaaatccccacggatcagcacccccatctcatccaatcgaaaacatccgaactcgaatcggagagaaccccccacccttatccgcttcttcttcgcgtcgcgcgcggtcgacggtgaggacgcgtcgtgggccatggcgtcgtatcccatcccctccccttcccttctcccttctttacacactgccgcagcacacacgcgctcgcaacctcgccgccgctggagccggaggaggaggaagaggaggaaggagaggaggagtaaaccctagcgcgagccgagacgaggcggaggaggaaggaggagcggaagctgcagctgatgaggataatacggcgtggagaaaaacgagtcgatgagctgacgcaaaaataaataataataataataaataataattaaaacaaaacgttttctgcttccgcacgacgagctggacgacgacgacggcggcggcaacgggagaaatgacggaaatgccctcctccgccgcggcggagcgcgaagcggtgtggggatgcatctgggccgtcggattgatacggtcggtgccaatacgtgtggccgggcagcatgccacgtcgtcagcattagtaagtgagagggaggatggatgtgctggggagaaaatagaagtgtttttgttttgtcccgtttagattctaacttttttttttcaaactttcaacttttccatcacatcaaaattttctacatacataaactttcaacttttttgtcacatcgttctaatttctttaaacttctaattttgatgtgaacaacacaatccttgttgaaggaaaaagattggaagtggttgcgtattctgtaggattttctatcacacttttcttttcaagagttgcagggttgacctacaggagatatgattagagtatttggtagtacgtcgaatgagttttatgcgtctcgaaatttaagtaaccattcaatgcaatgtcctaacataaaaaaaagggtgaatagccaaagtggttctccaagtttcatctgagactcagtttagtccttgatgtttcaatatatccatattagtccttcaagttttcactttagttcaaacttatccttgaaccaacaactctcttcataaatgacacttatacccctcatcattcacatgtataagagagaaattgcatgcttgaatttttttatagataatgcatagtatattatgtaaaacgaaaaaaattatgtactagcaagtgtatacaatagcaattgcttaagtttcatgtgcatatgttgaaataatgggaagtacatctgtaatattgtttattcaggttggctttctcttttctattctagtatatagatgtatacaaattaagggcaaaaatgacattttctaatagaaatattgactagaaatagccatatggcatattaagtggacccaaggatgatttcaaaccaaaacaaatatttgaaggatctatgtggacaaaatgaaacgtgaaggaccaaattgagccttcgctgaaacttgagggactaaattagctattcacccaaaaaaaacttaaaatatgccggacggatatgatttagtagtgcatgcgtaactgtgtagatataaatgaagatgcaatcctcactgacttatacaacgatagtggtatattcttaaaaaaaataaaagaagcattttcaatcctagcaaaaagaaaacgaaatttaagtagttattatagtgttattacattcttttataaactacattctgatacctatagcttctctaagaatcactctaaaactacattcttttataaacaaatgttttatggtctatttacgggagtttctgatacctatagcttctctaagaattacaaacttccataaacaaatccatttttctttgttgtacaaagaaaatgaacaagaagtcacaagctagttgcttaagttttaatttttttttcaccatctagattctcacgaggtgcttctcgtaatataaaactctacaaacaagcccttaagtaaaactacactcttctatagatctttgagagagagagagagtgtgtgtaattttatcacaatcaaatacatacattttccatgtacacttattatactatattcctcgtcataactatttggcgtgcatttagaattcacctaagattttataattaaccattaattttatattaaataagttataaatctaatacatttatgatattatgatagtacttttcaaaataattgtgcacatattgtttttatttttaaattaattatcaagaagttatcgaggataaatgtcctaaaagtttaaacatgccttgtcataaatgtactaaacaaagttttgaatctacaatttacaaccaactaaacctacaactcaacgtacaaacatgtcacgtcatcatccactagctataattgcatatcaaactcacaagcatgtaaaatcatcgacaatttattgagttctacaggtcatacatgtatatctaatcatcacccctcatatcattttcacaatatttcaatatatctattcattatttttacaatacttaacaaatatttatcaacatattctacatcaaagtgcgaggtactatttagtttgtttcataattagagcatgtttggtagagctcgtctggagtggagttgtggagctgcctaaatctaactccatctctctagtttattttgtgagagtgctccacctagctccgctcgtttaggtggagctaaaactgtttagttggactctaactccaaaaaggatggagctggagttgaagctatgccaaacaaaaatactaataaaaactgatcgtatttaacaaaccgatctccgacagttaaaaaaaagcgagctgttttagtgaaaaccgatcagttttattaacattgacaatgtgttttcatagaagtagttctgaaagcaaaattgaaagctctgggaaatttacaacacttttttttttcaaaatatcttcacttggcaaacattacctcagctcatctatctccattaacatttttcaggagattgaagctagcatcatatcatatcatacactgcactctgcacgaaaactgctacgcacactacctcaaaaacccaaacctctatactacgattgcacactaacattcgtacacactacacgtctacacatccatcccttctacggcctccttgaccacgacgaagtcgtccatctccttctcctcgccggcgccgccgtccttggcagcggcgggcgccaccaccacggcggccgtgccggcgggctgcttgtactcgtggcgcctcgcgaacacgaggaacacggcgaagttggccaccccgagcacggccagcatccagtagaagaggtccagcctgccggcgtcgaggtcgttccgtatccacgccccccgcgtggcggcgtcgacggcgaagacgaggaagctgctgaggaagaatcccatggacagcgtcaccaggaagagccccgtgctcatcgacttcatccgctccggcgcctcgcggatgaagaactccagctgcccgacgtacgcgaacgcctcgccggcgcccaccaggaagaactgcggcaccagccagaacgcgctgatcatgccgccgccgccgccgtcgttggcggcgtcgcgccgcttcttctcgacgagcgcggaggtggccatggcgacggtggcgaggacgaggcccgcgccgacgcgctggagcgaggtgaggccctgggggcggcgggtgaggcggcgggccgccggcacgaggacgcgctcgttgagggaggtgaagaggaggatggagaggaagaggaagacggagagggagcccgccgggatggcgaacccgccgggggcggcgcccgggcggaggtggcggtccatgcgggtggcctgctcgacggagaaggtggtcatctgggagtacaccgtccagaagaggatgcaggtcgaccagatgggcagcagcttcaccaccatcttcacctcctccacctccgtcaccgtcgccgccggcgccgccgatgtctggttcgtcttcgccggcgacgctgccaggtccgcctccatgatggccgccctgtccaggcacctgcatggcaaaaacccagtcagcaacgtatgtacggatccaagtatctaacaagctaggtagcaagtaaaaaaaaattgacacgtgtgtacatatatatacgacagagatcatcagatgattttcagttgtgttcgtgttagcaaaacgcagatgccagatggatgtgaataagtgattttcagatggagatttaacaatagaatcgttcttttgataagtgtctctctcttcttcgatggtggccggattttatccattatacaaaaaaagatggatgtgaatgattgggcatcttttgtgatcaaaatgaagcgaattctttaaggatctgaacttctctagcaatgcacgtataggccggccggtgcaccaatctgactgtttcagatatgcatctcgagcctcagttaatgcaatttgtgttgtgtacacaacacatccctgtgtcaccaccccacatatgctcgcgggcacaatgtcaaatttattctttttatttgcatatatgaaatttggtttacatgcttattaagtgaatatatcatactaatacatcttgtattttttttatatatttttacttttaggtgacggaaataaacgacaaaaaatccacctctagactactgaattcacggctcgtcactctacttgtgatctgcttcgtccatcagccggccgcccaatttggtgaatgttatctctaattaattgggtgtctcacatactaattgggtgttctaatcaattcgatgtctcactcactttgaccactcattcatttcatctagtaccatgcatgatttgctcttgcgtgctgtgttagcaagagggcgaactgagttgtcgtcctcagcttcttctctatagctcgtgtccatctcagccttgacagtgacctaaccggtgaagccaattaagtaccgtgctaataatagattatagacttgtgatcgatagctagattaaccctcatgcctaggtagaagtacatactactagctagcaagctctaccagttcacatcctattggcaccagttgatactaaccatggaaaggctatgtggctagagctgaaaaaacggagtgttttgaaagctcagttctgccatgtattttcaaacgatacgatcgattgatagaatttaaatagcaagcaaatgttttggcaaaatcagcagccacaagaatccaatcctgaaatctgaaccctgatctcctatatgcaccggttgacagcagcagtattgtactatcagcagagcacatcgtgtcacgtaaactctgaagaaataacattcatccatgtctacttagcaatataatgcattttgcatcccaaccaaaacatgtttcttccagctatatattaatcaatcaacaaagctaggacagcaacgagttaactactaacggatgatgcctgatgacaaccacgagtgtatgatctgaagctaattttctatagtcgaggagatcatatatctaactgaactttgtatattattaggagaaaagagaaccacgtggcgattatacattctacggtttgagactgaggtggtattcttttcttctgaagatgaatattaagttttttttacgtaaaacgagatgatattaacatataattgattttgagttttaattatttcaaatttaaaaaataaattaatatgatattttaaagcaactttcatatagaaagttttcacacagaacacaccatttagcagtttgaaaaacgtgtcacgaaaatattaatctccattcaactcttgtgggagaaaagagcgggatctcccctcatgaaagattgtgcgttgattacctgaggcggtcggtgtaggcaaccttggatgtgtggtagccgtggagctcgccggcgtcggcggggagcggcaggcggcgcttcctccacgccgttgccagcacccgcccgatcacggtgagcgggctcccctcggggcggcggtaccggtacttgggcgtgccggcgacgaggacggcgacggcgaggaccatggcgacggcggagacgccgtagccccagccccggccgacgttgtgctggacgtacaccagcacggcgaccgcgaagagggagccgaggctgatgcagaagtagaagcggttgaagaagaacaccatggcgcgc

SEQ ID NO: 23619 - DNA, 1903 bp, Oryza sativa
  unsure (1)..(1903): unsure at all n locations
nnnnnnnnnnnnnnnnnnnnnnnnnnnnnnnnnnnnnnnaccgcgcgaggatgatcgaagatgtgttgttctgtgtgtgcgagagcgagagcgtacggtggcggcgatggtggcggagatggcgatggtgaggtagcggccgagcttggcgtcggcgaggaagccgccgacgagggcgaggaggttgagggtgcccatgaagttggtgacgatgttggcggacttggcgttggagaggtgcaggtcgccgacgaggtacgtcaccaggttcatcgagatgcccatcacgcacacccgctccgccagctccgtccctgcaaattaacaaccaccgccgccgccatggcatgtcatctcgagctcaaatcaaccaaactttttcccacgatcgaactcgcgagtcgcgaccagcagtgaagacgacgcgtacctaggataagcccggcgccgagccatcccccggtcttggacttgtccaccgggttaccccggtagtcgacaaccatgccgtcgtcggcgccaccaccatgacctcctccggcagcaacctgcacaaacatacatccagcttaacaactcaatcaccaaaccaaaccaccaatgaaaacatgcatgcactgtcggtgtgtgcgtggtggtatatattttttttctagttacggctttataggcttacaggattgtaatcttgttatttttttcctgctctaatagaacttcgtataaaaaaaatacatgcatcctgctgcatgcacagatacagcacaagcaagcattgtttatgttaccattttcttctgctgctgagatgcactgtctaccgctgctgcaagcagatgagaagagaaggcagcaggcacaggatagtgaggagagaaaacgtttgtgcagtgaggatgaggaggccggcctgatcgatcggaggatttatagagtggaggcgtgcagaggtggagaggttttgatcgcgagattttctctcgcaacttttttccttttccgcttgttggtttcgggtaaggtgaggtggacgagatgattgctgcacgtacgtacgtacgtacgcacgctgcctgcccccgcctttggcgcggaaaggacaagtaggtgatgacctgctggcgagttgtgtcgtgtggagggtggcctggcaaaatctctgggtgagggggattttgggccacggattgcagggctgggatcctctgcatgtgcggccccggtgaattgaatggaggtgtttggtttccgtgtcttttattatctacagtaaattggattcatgtcattgcaaatatacttatttagatgaatactttataactcatctatttgtagccatgtcactatcatcacgtttttcatccatctatttttttttccgttttcttctgtcttcttcccttgagcgatggcgatgaggtggcaacacggagaagaagcacagtggtgttgtccttgccgcacgacttgcatgaccaccaggccgtggtggtggtgtcgtcattgggtactgcagcggcgtccgccttcatctcgaaacagtaggactgggcattgtcgggcacggcggtgggcagtgttgagctcaacttccttctcaccacaaccgtcgcgctgttgacgccacgtgcaccaacgcctggcactactgcttccaggcctgctctacaccaccacgtcgacctctgtattcgctccaccaagtggctcaccgacgtagcttctccagcctggcgtgcatccactcgttctccatccgcaccaccgcgtcaatctctgctctttgcaggcacaactccgacactagtgcatctcccaccgctgtagctgaggcggccgaccaccctactcatcgacgtcatcgtcgactccaccagtgcagccgacacaaccagcttca

SEQ ID NO: 23620 - DNA, 4959 bp, Oryza sativa
ggcacagccaccgcggggactccgtcgtcgccgtccgtcctacgtgtgcgcgcgcggcaggtgccgccccgcccagcggcccacacgtgcgccagccgcgtacggcaccccggccttcaccacccacgtgccagcctcgggttggccgagagaggcgccggacgacgtggacaggtccgtcctccgtcaagcagggagccgagccgaggactgcggagatggacagcccgtctgctgtatgtacgcgcgcgcaggcaggtccatgtggctgtggcctgtggcacgctgaaaatctcgccggtgaacgcgagcagccaaacagcccaaccaagtaaccaaactgcatgcggtgggtggcatatggctagggtgcgcagaaaaagatcgaaccaaaagactgaaccgaaaagaccgagaccgagaaattcggtcctaggtagtgaaagaccgaattttgttcggtcaattcggttagtctcatcggataaccaatagaccgaaaagaccaaattataaaaaaaagtctaaatgcaacctacaatctactatgtttaataggattaaactctaattttcacatccctacttcttctaggcatgcagcttaataggagtctttactcataagtgcttacgaatttttttaaagatttttatgttaaaaatttccattatttctttgcatatatgaaaatattgttgaatttcggtcaggactgagaccgaatttgtcggttctgacatttttgcgctgaaattcggtcttcactttttaaagaccgaagactgagaccgaaattttcagttagaccgaatgcccacccctgcatatggcacgcaggcgcagcgttctttttgtcgcgtgttgcatggctgaaatgtttttttttttctcatctgcgtggtgtgttttttttcctcttcggcgtagggttgaaaagtcaccggcacgcaggcatgtggaggcagagccgtataagcgtacaaccacatggtattttaatttctttcgaaaacgagccaccacatgatcttttgctcaaaaccggcaggggctctgctccgccgctgcgacgtgcgtgcgtatgccatcttcttttgtctcttctccttttgtggccgtgcacgcatcggcgcgcgtctctgtctccgtggcgagaacgcgtcttctgaaccgcacgatcgccggctaattccacgccgtgtactggtgtgtaactactcctacgtggtaatgcatgatgcaaactacagaacttcatttgttccaaaataaataaatttaatataaaatatgatacattctaataccataaattcagcatctgtaatactataccaatcttaatatcttatactccctccgtattttaatgtataacgtcgttgactttttgacaaacgtttgacatttcgtcttatttaaaaaatttatgtaattataatttattttattgtgacttgatttatcatcaaatgttctttaaacatgacataagtatttttatatttgtataaaatttttaaataagacgagtggtcaaacgttggttaaaaagtcaacggcgtcatacattaaaatatggaggcagtattaaatttgtttactttaatatgacttaatatagaagaaaaaactccactaggcatgattatgccatgtgtcacttgatgctgcctagtcgtgaccatttttgaaaggatccatttgtcgtattgaagtaggagcaactgaggaaggcacaacggcagattttttctgtctccttttttgctgatatttttgttctcataagcagcatatgcgagctttatgattaggcccggtcgattcacgataagtagataagaacacacaccaaaacatttatcttcattttattacaaagagacggcacagcagcacaacgcacaaagagatgaaacgatagctcgtggaacacttgtaagcaaaccgatcgaccgatcatcgatcgttagcactgcagcacggtcactcgtttataccttccaacatctcttgtcccaatctttatcacgatatctttgttttatgctttcccctttgggtcatcctaaaagaagaaaatatagatatggcctaatcatgatatgttcttgaatattctcaaaatggacacattaccccatctagaattctagatgatcaggtcggcacatgcctatggattaaagcatatgctttgattttggaatatgatatgcatggatgcttcaattaaccagcctatcacaggggtgaacagtagtggacgataaaaatgaaaaaacttcaccccagaacaaatagcaaagaaattccacttgattatttgactcacacaacctgattgaccgtccggatgtttattagttattactttctccgttctagaatataaaaaattttagagttggacacgaataaagtaggtagagttaaatgaaaaaagttgtgatggttgagaaatggatgtagatgaaaaaagtgaatagtggagggttatgattggttgggaagagaatattggtagagaagttattatattttaggataatttttaagtgttagaagttgttatattttgggacggagagagtacctctaatccttgattcttttaaccacgactacgatttcacaaaatgtcacacctaatgacctatcattagtttagctctgggttctttttttttttcttttcataaatattacaacacgacatcccatccaaacgatagctcatatatccttttttccctagctccctcttcctctcccactccctcctgcctttccccacttcctcctgccttttctcctcttatgcagggaggccgtcgaggaggacatcacctaatgtgggctcctcctcccgggtgcgttgtcgaaggtgattgaagggagaggccagtgaaagctactagatttggagcttggtcagcaacaatgtagtggtgatgacatcatgctccttgctagtattgtgtgcgggtacatcatgtagcgcagtagtgttaatgtcaaaatttgataagcccgaaatcatcattagcttagagtcaatattagctttagagtacaggaatcagccgatggaagtcgtcaagtcaccagtagttgtgttcttgatggagtcggatcaattaaaagaagcttatctagaagagtccgagttcaaggataatgcggcatggcaagttatctattaattaggaatagtttattagttttcttttatctttaagaaagtgtgtttagtgtctgataaggactttatgttttccttttatctttgggaaaatttatttcttgtcctacaaggaatattatctccccatgggtataaatatgtacacccggggtcattgtaatatatctctccatcaatacaactgctctcggcgcatcgccaccttctttaccgaggtttttacttatcatccgacggaacttggcacctgacgcggggctgcattggtttgcgatctccggcgaaggggtaagtcctacgttctgccggccctggtgaatctattgactacattagtgttgttcaaggctgcatcgcttcgatctcttggatcgctctggtttggttgatatatttgcttacctgatatctcaattctatctctaattgcattgtgtttagagacgcatcggtttagttggaactgtcttggttaggtctgatcttctgtcttagccgatatatctctacaatcacaatgctgttgtaaatagatttgttatatccatcacattagacagatctatcggctcatcgagtattagattatcatatacaatctcgtgatgcatcggttaggttcgacctactagattgttgttgataatataaatcttgttaagctgataggttcatgctaatgttttatcggggtgctagccgataagttatctggacgttgcatcggcttgtaaggattgcatgtatatataagttggatttagccgatcgcaacaaaggttttactgtttaatctaatcttgtggattttatgacatcagacatccagccgatgtatgctttaacctttggatcagtgcttattctactatatcatattgttagctgattggtttctactggattatattatcatcagccgattgcctttatatcattatctacattggacatatagccgatctctcaaaaccctatcgctatcggctggcatcggctatcagctggaattactccatcggcttgttagccgatcggctatttgattttcaatttatatcttgtcatttacagggtcaaactggctggcacgcccgcatctcatcaacctttggtcctgcactggagctaagcagatctcccaggccagtgtgtgtttttcgcgtcaacaagtagaggtcgggttgctcctttgtaggaagtaccaagtctaccagtggtggcggtggcggcaacagtgacaagagggcgaaagagagataagggcaactacacacgtcggttgtgctggtagttgccactgtcctcatcgtcggcaggttgcagttgtcgcttgcggggaggacggggaatgccaaattggcatggaggacaacagggaaggcgatgatgaacgacgacggcgaatgggaaggccatggcaagagatatgtaggagagagggggacggggagaaatccgttgtgggacccacaaatggttagccaaaatagcatggggctagtgcataagagagtttggctagtcgaatggcttatccgttcgattggtatggctgttaaagttgatcttaattgacatataaaatcgacccgccagatttttgtgggtgagctgaacccgaatatcagtggaatattaccttttgagccaacccatcccacctagtcataaccaaaaccaaacatctataaaaatataggtttgacccaacccgaccccttcaaccaaatacatgcaaaca

SEQ ID NO: 23621 - DNA, 17884 bp, Oryza sativa
  unsure (1)..(17884): unsure at all n locations
ccaacccatccaacctagtcataaccaaaaccaaacatctataaaaatataggtttgacccaacccgaccccttcaaccaaatacatgcaaacttatctatgtaaaatggttaatagtacttggggctccgaaaaaatgaatggtgtaactattttttttttttacgaaagagtaactaaaaagttattagtaatacatcgaacaagagacatgctctaaattaacctagaaactaaggctgtgtttagttcagcgtaaagtttggattttagttgaaattagaaatgatatgactgaaaaattatgtgtgtgacaggttaatgtgatggaaaatgactgaagttttggatctaaacacaacctaatttaaaacctgctaaaacttgcgagaagcaaacagagtccaaacctgccccaactgtcagactgtcagtccaacacccccattcccgctcctccggtgatctcccagatccaccaccgcgacggcagcgtcggcgcctaccgcgcaacgcaagcaatggccggccgcgcccgcccgcagccgcagccgcagccgcactcgccgtcggcctccacgcggcggcgcgagcggtggctggtcgtcctcggcgtcgccctccacgccgtctacatgctcagcatcttcgacatctacttcaagtcccccatcgtccacggcatggcccccgagccgccccgcttctccgctccccccgccaagcgcctcgtcctcctcgtcggtgcgtcccccctctactcatccccgacgattgtgaccccccgatttggttgcgatgtttgattttggtgaggattttttggttgcgtgcgtgcagcggacgggctcagggcggacaagttcttcgagccggacgagcgggggaggtacagggcgccgtttctgcgcggggtgatcgaggagaagggcaggtggggggtcagccacgcgcggccgccaacggagtccaggccaggccacgtcgccatcatcgccggcttctatgaagaccccagtgctgtcaccaaaggtgtgccatcccatctcagctctaattctggccatttcttcatgttcaatgcaaactaggatgtcagttggtaagaattcaaatgtaggggttattactagcttgttcatgtcatagctggtagacacagatatggtggtccaaactccaaactatttaggaaaaccatcaaacatggtatcttcggtgctagctagactgctacagtaagttcagtaggactagaatgcaatgcggtggcatggtactcagagaagtttcagctctagttctagcgtgccgctactggttatttttcatgtttgatgcaactaggatgtcagtcggtaagaattcaaatatatgggttactacctagttcatatcataaatggtatacatagattatggtggtccaaaccatagaggaaaaaacaccaaagatggtatctgcagtgctagctagactgctagagcaagttcagtaggactagaatgcagtccggtggcatggtgctcagagtagccgaaacctttaattggctctgatttagcgaatccttgttagtagctatgcttcttctagaaaagttaaatataatttgcttataggttaacttctattttgcagtattgtacttagcggctgattttcttagcctttttctgtggtgttcagagaaaaaggctaagaaaataatcattcccttaccagttacatattcattttttctttgaatttctaaatattctggtaaagttcaattaaacttgctgtaactgaactttaccataatatttacaaccattcccgctgatacctgtggtcagtgtacaactatagtattagtgctactagttttccgctgacatggcatgtcaaaactcatgtactggtatttgttcagttgtagaaactgtgagcattgttctacccattgatatcctaggttatcttgtgctggctgtggcctgtgggctactttacttgagatttattaaggacctattttgtgttgaaaatttgggatacacggtccgttcagacataatttagaaattgatgatatgttttaagagaatcatgttttaattccatatcaaatgtctgtaatgttcacaaaattttcttattacttttttgcaggatggaaggccaatcctgttgagtttgattctgtattcaatcaaagtagacacattatctcgtttggcagtccagatattgttcccatattctgcagcagcctacctcacagtacctggggtacttatccccatgaatatgaagactttgcgacaggtcagatttaatgcagtacatttaggttgctgaattatatatttttttatttccattcggtttttgtgatttccagagaatcatcttctgtttttattgacataattagaaattttttgtacctactcattacttgtaagttgtaacacacaccttttcggagtattccaatgactctaaaagtttatcggcagacttaatgatgataatgtgtaataaatggaaaaagggctctatagctcttctcttagttttggttagagttttttttttaaaaaaaatgaaaactcacaactattattgatgaatccagcaagcttttgtacaagtcatgggtccaaacttgtaaaaattcacaagaagggatttacacgtccaccagaaaaataacaagggatttacctgtccacaagaaaaataaaagtatttttaccaaacatcgcagagtatgaagcatcaaggctctaccttttgaatttggtttgctttggaaccttgtgtttacttgttctgagaccttgattgcagatgcatcattcctggatcattggtcatttgaccagtttcaaggtcttctcaacaggtcttttgaggatgctaaattgagacaattgctcctacaggataaattggtcatatttctgcacttactgggttgtgatactaacggccatgcacatcgaccctattcaaacatctatcttaacaacgttaaggttgtagatcaaatagctgaaagtatgtacaatctcatggaaagctacttcaacgataaccagactgcttacgtgtttacagcggatcatggaatgagtgacaaaggtacgcatactcacaatggtttcatcaattaatttcaatgacccagccttatatggtttgacaattcatgacatgagatctaaatactttctaatgcacttatttttgttgaactttccctgagacagcctcatcagaatggtgactgtcttttacctgctactaatagcaatgccttattcttttcatattaggttacaccatgttatacattatttatgatgtcaatataactcaaagttctactgataggaagccatggagatggacacccatcaaacactgatactcctcttgtagcgtggggggctggaattagaagcccaaagttcttggcctatacagacaaacctgatgatggctttcggtttgttgatgaccacaaacatgatatgcccacaccacaggattgggccctcgaaggatttgaaagagtggatgttaaccaggctgatatatctcctctaatggtttaaaattttccctaggcaaacatattatcatttttccttcagcataattgcttttatcctcaattgtttacaaaaactgcaggctacacttgtgggtctgccatgcccgctgaattctgttggaagcttacctacgcattatttgaaattaagcaaggtcagataataaacactgaaatattatgaaaaaaaatatgtttatgcttccgttgttttctgctcttttggattttctgtttatttccccattatttctgttcaggctgacgaagttgaagcggttctagccaacacaaagcaaattcttaatcagtttcttcgaaagtcacgtatcctttcagaacatgatttaaattttgcttactccaattgtctaaggtccttggatattcttttcttgatggtctcctgctgtcctgctgaagtgagttattgatgagactatataattattaatctgctgttgaagcccacagtttactagctgtgagcctgtgaatatcatgtcaattactttctatatttttatgcaacattatactgcctccgaaatggatatggtggatcatattcatactcgtgaacatgttttccctaacctgtctcagagatgaaacaatcaagttcactctacttcaagccttttaagccactggcaaactattctttagtccttgatcaaattgaagatcttatatctgcaaaggactatgaaaatgccatgaagcattctgaagaactccgaagtatggctcttgctggtctccattattttcaaacatatgactggttcatgttgatgacaacaattacccttggatatattggatggatggtgaacctcattctacatgtgctacagtcttatacatcatttcctgctaatcttcaaaaaaggactcaagtgtatgctaagaacacctctgtgaaagtaagatagccaacctacctgaccttcagttcttcacttaatgagtttatgtctaaaattgatgtgttatgcatgtatttttatgttgctatcttttccagattactcaatctggagtgtagtcaacattttttttccaacttcagtatgtttgtttctatccatttttccaagaaccttttctttaaaaaatatatcagaatttaggttctgttaaacttcttattgtatttaagaggtttgctgctgtctagagctacaggcatttggtagaactctgtgcacagtataggcttgatactagttcattgttgtgaactgttcaaagttgctgttcgatattgcagaattttattggtgtgtgtttcttattaatcctgatgtgtttttcttacactattttggtctatctcatctctcctggttgcaggtatacatagttggatgcttcattatgggtttttcatccattatactacttttagagaaatctccacttctttatcatgcttatttatttatgacaatattcctttggacaagaattgttcaaaattttgaattcatcaaggcagtatggagagaattatctaatatgccattcaagtacaccatgaatcttctgaacatttcagtcattgcgctgttcatattggagtttctggtatgtaccttttgttattggcacccgaagcgtttgaggactacctagatttggcatgaatttcgatgctttctgtgcaggttatgagcttctttgataggaagctttatacttggtgctttttgatccttgggatacttgcttcatcttgtgttgcaatatttatacaagctagctctgcacttgcagtctatgtgtggctttcatgctggttcctatctttattcacattgatgccagctgaaattccagaaaacaacaacttggtgtatgcttctttggccgacaaccccccacccccttccttttttttttccattttgtcaatattagttgcgtgttcattctgtcatataaaattctcttttctagagttaatgcagctggtagcccttattttttttataattattacgagcgtttggttgaaactttggtctgatgaatttttatatgcagaatttttagtggggccttgataatactgactgcaatggcatcgagatggatggccacaaataataacaacttttggctatatcttactcgagcaaataaacgggatcctcaattctctaagctattttttgttcaggtgaaaaatgcaggcaattctttcttgatgttggtatttgttttgtggaagtaatattttggaacaatgttgactgctgttacaatgctttaggttgtatttgttgcgatatcttctataatggtgtggatatcgacctcgcaccggtctcagaacaaacagctgcacccattgcaccagatgatcaactggttaatagctggtaagtgatgatcaactgcaccctctcatctctgctgctaatttctccaatgtttccctggttgacttgtccatgtcccttttcagtttttcagggccatatctgatatgttaacttacaagtgaaaatggctctttaacagataatcttctctagtagttcaatttcctaacatgcgtgcacattgcgccaagcttgaatatggtttgttcagagcattgacaactataaatattccctcagattacatagcattgttgtaacagaagtacctctgattccaaactaagccgttctagatttatcaattctttcccaaatataagacatccaagaacctcaaggcagttttcactcctttttttccccttctttgccctagctaaataatcgttattattctcatcaataaacgatacaccttttccaatgtggtataaatggaaggcaacagtcatttaatttcttaatcttatgcacatgtcttggaattaaaagggagcgcaaacttatttatgcatcaacgatccatttaatcaggataattatatcacagaattgagaacttccccagacgatgttcagtaaccaccttctttcacggtaacagcaggggagagtcataccaatatacacggtacacagaaagaagcaaaacttaatttatcccaacctattggaagttgccgtgaccttagtcagagtcattttatcttctaaaaagtatatatcagttaacaaagattttttcatctaaataaagttatctggcagcttaaatatgaattgatttgtctgaaatcacaggccaactttactctttagttaatgttatggcctggtctattgctcttgctaaaattctaagagttttggttgtactgattttgtgctttaactgattatgttttgacaggttttgctatggtgctaccacttttttcaccatcaagtgttctatctcgccttacatctatcttcttgggatttgctcctccatttctattgctctctattgggtatgctgttaacttctcttatagtgtccacatatatcaagttctggttgccgtaatgttcatatattcatatatcatcaaatcttgacatctgcagctatgaagcggttttctatagtgcttttgcaatggtacttatgggatggatatttgtggaatctgcccacctggaatggtcaaaaccaaaaggttttggcccccggaggagccatgtggaagggtccaattttgggtaataatgaaaaaggcttcaccaatttgatctccgaatccctctgttatttgtaagatgacattctctttcccttgttatattgtgggttgctatgatttatgtaaaatactcaatacattctgtatcttaccgcctttgcagacgatcttatttaatgttgcgttctttggaactgggaattttgcgagtattgcaagctttgaaatttcatctgtgtaccggttcattacaatatttagtgtaagtgtttgtgtcttatgatttcctctttctctataatattaggttttcttttctattattctattactgatcgtctttcatcctctttccttggcagccgttcctgatggcagcacttcttatcttcaaattgttcattccatttatgcttgtcatgtaagttttctcagtgtttactatgatattggaccatcctgcggtgcagtggcggaggcaagatttttgtcatgggtgtacaaaaccgattaaatactccataaaaacatgaattttttttagcaaaaaatatgaaaaagtagttctacatgtgatatgatgagctgaaaattgttgtttctagtgaaaagacaggtatttagccaaaattatattatgtatacccaacaaaaatatcatagttttgacttgaagtaaaggaacttgggtgtacatctgtacactcatgaccctatacagcctccggccctgttgcggtgaatggctgataaaataagttgatacgttgaacatattttgtacttctgtacatccgcttcacaaaatataacgttgaatcattttttgttgcaaaataggtgatgttttaagattcaaaaataagaaaagaatacatacttttagcgaaactaaaaaatgtatccacactctacgtttgtttgttttgtgcgcgataagctatctgaagaacaatatttagagtttggagaagattaattgttgtagcgacaacatatatatttgcctttattccttcatcatgcttttgttccgcagttcataatataccgtgtttgattttaccttcgttttgatatcctaatgggatttaatataagatgcgtaatcttcaaattagttattagtggactgtttaagattgttttagagttcctttttattccttactctgaactctgaagcataatagtaaaggaaaacataaacaaagatgagccaccagattagatgcaatttgtgattaagctgattcatatgttgcgacttattgcagatgtacatttagtgccataaccaaggttgtacgtataccacggctgggctgttatttccttgtaatactgctgtctgatgtaatgacgattcatttctttttcctggtatgtgttcttttcccctgtgtactttgaattatcctttatagtactttgtgctgtagctcttgcttgtacagaaaattgtaagccaaatgttcttcattttacccacaggttcgaaatacggggagttggatggaaattggcaatagcatcagccatttcggaatcgtgagtgcccaagtagtttttgtgttgctgcttttcgccctcacaaatatattcacaaaagatattgaggtctcatctcggcaactaagctcaaggaaagttatgtaattgttccatttgtttggagatcgacattatactttcagttttgttagagtttaacttttgggcgtggtttcgatttttctgcccaagttttgtaacttagctagtagatggtgaactttgtattagatggttccagttatcatcttctttacatgtaagagcattaggagcatagaaaattttctcgtcgagaatttagttcaggtttgtcttcatgggctcacggctaccgtagtcgtcaacacgcatttttttcctccgatatatttcacggctcgctcagtttgtaaacatgcagtagtgtagtgttggggaggcgagcagagattggcctcctgcattgattcaagatttccaaatggtaattgctgtaacttgagtgatttctaagcaagattagcactaccggttttgtatgtaaatgttgttgttttgtgatttcttgctctgctatcgctcgacaaataaaatgagtagttactactgatcgcatgtttgtaacttggcgtaatccttcacggcgagctatgcttttgcccccacgagaccacgaccagtggaagcatcactgcctcactggctcactgcatcagttgatcgcctccgtgcggtccgcccgttcgttatccgaatccacccaaacatcccgcgttatccagccacgcccccctcccgccccgccacgtcaccacccaccgccacgtggctcctctccactggctgagcggcgcccacgcgggataaggcatttctccctccccgaaatcctcaccttaataaccaagcatacacacccccgcgccgccaaaagccgccaccacccagctcaccgcatcacacgcagcagcggaagaagcagcagcagcagcagcagcagcaatggcgtcgctcaccatgatggcgtccctctccgccgtggcgccggggcgcgcggcggcggcggcgccgcggcgcggctcgctggcggtggcgagggcggccgccggcagggccgagtgccagcacgaggcgcaccactgcggcgaggggtgcgggtgcaggggcggcgccggcgccgagggccgccgcgccgtgatgttcgcggccgcggccgtcgcgctgtcggcgatcggtgccggcgccagcggcgccagcgccgcgttcgccgagtcggacgtgaagcgcgggacgcccgaggcgaagagaagtacgcgcagatctgcgtcaccatgcccaccgccaaggtctgccacaactgagctgtggttagagggaagaggggctatggatgcagtaaatacatgtacggttttttaatctcctgtctattaaaaattcgagctctgattagactgtcgccatggatggcatcgaaatcaagttgttgtaatatgatgatcattgcgaattcgaggtgaaaccgtacgttctcttgtttcgttcgttgcgttggcgttgcacatgcattcacgcatgtatcgtaggacatgcattggctgacgcattcacgcataaatcgcagtaaaaacagacattgtttgtcacatttatgccttgaaataagtctattttacctccctcatctcttgccccctgtttgaattgtctccctcaattgcaaaaccggatataacgtttcccccatcttacaaaactagttgaattgtctccctcaattacaaatccggatataacgtttcccccattttacaaaacttgtgtaaattaaccctttaggtaatttggaaagtagtttttctgacgtgtcgaacccacatgtcatagactctcctcttccctctctctctcttcctctctcttctctttttatctctctcgtcggccaccggtggaaggaggacgcgggagctcggggaggccgtggtggtggcatcccagctccgtcctcgttctctgagacgggggactcgacaaggtcgtggcggagcaggagctcgtggaagctgcggtggcaagagaggacgcacgagctcaaggaagggggagcggatcatcgatcgcgaggtcgcggccgccgcagacgaaccccgtgttcgcggcgtccgcgccnntgctcncgtcaaccacgccgagctcacactaccgtagcgtcgcctcctgtgcgagcggctcgtgcacgtgaagcgtcgcgccgaagcagacggcgccgacgccgtctccgccgccggagtccatgacgaccccgtcgctcttgttcgcgtctcgctcgaccaatgcgacgcacgcgcgctgggctgctcctcgatgcgctccgcctcaatcgaaaggggtcacgaaccttgcgatcctagctgcggccaatcgaaagggtgcgacgagaaatcccggtgactcctctcgcatggtctcgattacgacgaactgcggattattggcgagcaaagaactgaacccatggcaacaaatttggtcaagccaaacgagaaaaatcttttgctgctaatgggcaggggcggatccagaacaagatttaagggggactcatctccttcttccttcttcagtccccctactcttcattttcttcctattttttccctttcatctccacttctatcaatggtgatccagcggggtaggggggactcgagtccccctagcacccacgctgaatcctcccctgctaatgcggtaagattcctttcgagagaatccactcagcaccactgagtttttgttcttggcgagagcgagaagggggaagggacacaaaatattagaatgactgccatgtggagttgttaatttttatttttttctcacggacaggtatgggtcccatgagcaccacttaggataaaaccatttctgaaatcaccgaaagagacgatttacaccagattttaaagatgagaaaatattatatccgattttacagttgagggggccattcaacctgggcaagaagtaagggatgtcaaatagacttatttcttatgcctaacagggcctcaaggagcccatcgatcaagctctaagccttgtttgtattacataacatatatctcttctagattctactcgaaatgaatacgtactccctccgtttctaaaaaacaaacctaatacgagatgtacatctagtactataaatctagatagatttatagtattagaatgtatatcatattttatactagattttcttttatacgacggagagagtacaagttacacacttgaccattgtttggttgaggccttgagagaccatggcaacatttgccaatcttgtggccaccaactttgttgctactccctccacgtacaaatatatatacaacactattgacatggtctttaatatactactttaacaaataatatctataaaataaattattttaagaataaagagttacatatttaatagtaaaaatattcttacgaaattaatctatgtttccttttttttcaccgatagtaaaacttgaaaaatgtttaactctacactgttccaaaagtccttataactagacatagggagggaacgttcgataaaaaacaaatctagggccggatgtgacatattctagtacaatgaatctagacagatgtatatctagattcgtagtactagtatgtgtcacatccagtattatgttgttttttatgggacagagtgagtatgcaatatgcccaattgaacatcgctatcctagtttaggctttaatgagatttattgtagagggctaaatagttccactttctctgtccgaaaagtatgctactagaagggaaatgctacaagatgtacggtatccggttaagactagatgatacctcagaggcatcgcctaatacctgatagatgtcagctgataccccgttcgaacgggatggtacctctgaggtattgtctggtacctaataggtatcggatgatacccaggtatagaagatacctctgaggtatcatcccgtctgaacgtaataccattatgtactagaattgaactcgatcaaacaccaaacaactctcaatgacaaatcatcaatttttcccccaatctatctcactaccttcggagttcagacacataaattttctgaattttcatgtaaatcagttcaatcttcacacaacaaaaaatcatacatttaaaaggatgcatgaccactatactacccgtatcagtatggcatgcacatccaaacaaacgggccctagcatccacatacgttagcctaattaacggcctaacagtacgacacgtttgacctgttgaacgattagtttactacgactgtgtcagctgtgtctcaacaagtagcgtgtatacctaacaagttcacttcacgtacggcgccgaacattcttccagctacatatattcaaagttgcagcgttgctttgcaggccagggcaggatttagaattaattaggcaatgcaaagttcttagaaaaaagtacgcattcagctggagccgatcgatgaaacgatccatcgatgggattccaacaaagcatatgcacgccggacaaatttgtactgaccttcctatacgggacattgtgtacatgtgttattccaagagtattctcgagcactcttgagtctaatacttgccattttgttttctctgaatacctttacgtctgatgactgacggccagctgcatatatgtacctatacagcatgcacatatcttagttcttcgatctgcaccctctgttctgtttacacacaggaaaaacgctagctacgcaacaattgcaaatatcttggttctttttccaaagactcgcacgagacggtgcgaagttttattgatagagcaggaaaaaattacaagattacaaccctagagggtcgtaaccaggcgaaaggaaaaaaataccaccacccacataccgacatcgccaacacacaagcccaggagaaggttagcaccggaccgaccgccgctaagcgtgaccgacctccactaaaccaacaaagggacacagatgagatcgtcccctaggggatgccaaaacaacgtcttcaagaacagaagcgacggaaaaaccgccgccgccgtccgtcgggactcaaaggagccaagactgggctttcgcccggcaatcacccttgaggggtgagacagcaacaacgccctcaggaggggaaatgaaccatcattgtcggtccggccaaggccggactgggttttcacccgccgctcaccacctgcgaatgcacggttgacgcaccgatgctccaccaccacacaagctctgccaacatgtgggacccctgcaccggcatcccctgccggcaagccttcgtgtgtccaagaccgcgccacccactggcagctcctcctcacacctaggtcgcctcctccactgccggccgtgcctctcgcgccaagccagcctccatctccgccgcccgcgcctctcgcatcgagccggcctccgttgccatcggctgcgcctctctgtgccaagccgatctccgacttgattgacaaagcaagagtggtgaccttgcagattgcacggctagcacattacaaaatttctcatacataatagatatacttacacattttattgtgaaaggaaaatactaaaagatgacaatataactttaaactctggtccaacttgatcatatatatattttatgcctgatgttccaattaacatgtaatttatttattccctatgtttatttattcatgtttaacatgcattattcattaatatatttaatctatattcagattataacattcaacaaattttatgaaatttgcatggcaattcaattgctaattttcatattaaagattcagctatattctccattgaatggtatcggtatggactcttttgttcaaatttgtaatgtttgcaatttttttataccaattcttagtgttttagacattttctatgaacttctcagtggaatcaattaatgttttattttttcaatttatagttaaaataactctaatatttttacatggactatacttttggtattttaattgtaacttcagatatttatataaaaactgtcaatgcaaaatttacattttctttcatatttatttatttatttatctatttattttgtttctaatgttggtgattttaatttggaattcatattgaaataaaattgatggctttattttttaattttgaattgcaattagtaccatattgtgttgtacattgacttttcttttttcttttaatttaactttatttgattatcatatattttaaattgtatttctttatgaactctttgctttaatctatactgccataatttagacccacaatttaatcatcggcttaatattcttcctttacctcaaatgctgttgtgtttttatgctgaattgtttaataccaacataaccacactatcttatcacaaatctgaaatctccagctccaatgcatctcgagatgacctgttgacacatgattaatttggaagcttcacgatcaggttggtgagatatataacacactatccaaagttcccctgttgcgtttcaagccggtcgatatgatgcagcgcaaacgacgacagagacgcacctaattaagccaaagccccaaaaatcaagataacgcctttagattgctttatgcgatgccatacggatcgatgcatgcacaaaacagcagctaagcatactgtttgccagtacacacatgtagctttatagtacttgtgtagctatacttaatttggagagatgggatctgccttgatctagcatatgcttagagcttaaggatatgaacattatgtatatatacatgtatccatacaggcgtacatggtatagatgcatgtaaagtagtaaaactgtatctagctggttaattaagctgtcactgaattttacatatgtccttggcaagctctagctgacagatggaggaaaagcatacaggtatatatgcacgcagcatcagagcaaattaaaagggggattatatatttgatgatcgacggtgtgatctgatctgatgagatgtacgttcctcgttctttccagtggctgagatgcgttccccagaaagactatcactagaaaattagtttaaagataagactacattaattattgctccttatattccttaatagtttgctcattatttgtatattaatgcttcttcttcttcctggtggcttcgtggctcaagggaagggtgtcggaagagtatttcttttcggcatagtcagatgttgcctgcagcacacagatcgatcaccggtttgccagctactttggaggcagaaaaaaaatgcattaatcattatgtacgcgtacagagcctgatactggaaaaggaggctgatcacccttgatcagtactgatcaccgctgaacaaactaatcaatctagcttctgttccgcttaaatgctttaatcagtacttatatataagtagagtgattttaggtgtataatttgatatctctttataccattcggtactaatagataccaaaattcgtattaaaaattttgagaaattttactatcattgggaggtaataagaggccggtactaatttttttttatactaacattggtaccttttaaaattagaggtagcgagaggtatcaaattttacactaaaatgttgtaccttccagtcgaggtattgtaataaatcactaaaaaatttagtacctcttagtattaaaaattataaaatttctcatataaattaattccatggctgatctaatctagacatatgacagtataatagtatatactcccttcgtacatcccgaaaaaagccaatattgtatgtccagattcgttgtattacgatgtgtcacatcctagtacgagattatatgtctgccctaaattaataagggatagattacgtgtacccgtctgttaatgttataaataagtcatacccaataatcttgggttagtctctgcgggacccaccatatacccagttctatacggaatcatacattatatacggaagatattttggataaggaaggggaagtaaagttctactcgggcactataaggactactcggatcatattcatactttgtctctctagttctatttggacaagggggcacctgagggtataaatacatgaccccctagaaggagatgagagatggcaagccagaagatagatctagaacaaatctacacaagccaatacagatttagagaatccaagacaagccaacatatatacaccagaacaagcctagacaaatccaatctgaagctacaaaggcaaacatgagggatctagagctacctccaatctcaccgagttcacattcgaagaaaaagactacactagctgttggctgcatgtaagggtgcaatgccgctatgctaacaaggattggattaagtcatccaattattgtactaatgagatattgatatataaaggtaactctggatttggctaatatgagtagggctattacttgtcagttaagggggccgaaactatatataaattcttgcctattgtctcttttaccctaatatcgcgtacaccctgataccgacgaacaccataccctacaaataccgtagtcacgatatagcctatcgacatcgtcaaaattgttacttccttcatcttaaaatataaacttttagttatctaaacaactatatatctaaatttataactaaaagttgcttataatattataggacggcagtaatactaccaacaaaagcacccatgcgctagtctatgactagggatcatcggttggcctaataagccaaagccaaatttaaattttttatcttaattttgaagctaattttaagatatttttaattttttatattggtatttaaattttatatataaattaatttttattttttaataaaccgttttgatttattagaaaatgtggacaaccggccgtagaaccccgtggtatgtcgcttcgtccagaactatccagacctcccatatgcatgatcatggag

SEQ ID NO: 23622 - DNA, 10050 bp, Oryza sativa
gggtaaatatagtattagagagttattagtttttcttggtcttggtgtaccttacaaaatatgtaaatcaatttagaaaattatgtagatcaatttagaatggaggaagtaaattacaagcgaggagaaaaaaatgcatgcatgggtgctccttgttaataagaaagtagtgttatcaagtgattacaaggtatgtgaggggtgttgaaagaataaaacttcttgctttatgactcgagagtaggtaaaaggacaagtgataacaaggtatgtgaggggtgttgaaaggataaaacttcttgctctatgactcgagagtaggtaaaaggacaaaatgaactatttttgacaaattttaaacgtaagaaaatttgaggatattcataatttattggtcttgaaaaaagaatctaacctattcttgtttaaatgtaaaatatttaggcaaattttgctatgcggttcaaagtttgggtaatttgctgatggatatcgaaaaacgtgtcacggttggagaacacccaaaaactggtaatttgctaaagaattaatatttttgtcaaattggagagagaaattcttttagaaaaagagagaatgcccctggggccataagtttcgaacctaactgagatgcagctctcaatttgccttcaccccaactacatattgctaatatatatcatattttatttttattccagcgtcaggttagaaacttgtacctctagagatactttttttaaaagaatttctctcttcaattggaccgaaacttttctctaacaagttattagttttctgggttctctagccgtgacatgtttttgcggtatccaacaacaaattacacaaaaatttgtatgtcatgtattacaatttgctaaatatttatgactggagcaacttatgtaaaatggtactactcgagactgtaggattgttcaaggaaggctaaacgagaccaacttgcagtaacccttaaatcaagtgcttccttagcagctgcatgcctgcatgtaaggtacagattcaaagggtaacctaattaagttaactaaagcagattgttaaattgaattttgaccccctttgccttttcaaaggaagagcattccacttttgtgttaattaggagagagcatgcacgcagctagcacgcagctgcaagctaaactatagtacaactttttacactgcatgttatgtacctaattaaactgcaaattaagcttatttcatgctatgtttaactgcaagttgcgaaatgcaaacaaagccagcccagtacacggtaccacacacagcttaattagcaacgcacatgagatgatgagatattcttttcttggatatttttcatatgccctttctgcatagtgctctccaaagctctctttgagagtgagagagatagtgatgtatatatgctgccaatgatcatcatcgatcatcgattcatcctgcaattcaattaagcatcagttgaatcaagctgtgcagcagcaaggacggcccagagagagatagccagtgagagagagagagagagagagagagagagatcagttcatccatgcatgctttgcctagcttttttccaagttcttttttctccttggtctctagcttagctatagcctagcttagcgaaaactaaagcagaggactggaaaccgcgctgccctgcccttttccgccatagctaatctagctatcgccggtttcgtcatcaataatcttctctgcctcttcctctctaatccaatagagagaattaaacatacatgcattcgctttagcatcttgccccttttcttaattggcatcgtttttcgcgcgctcgcgatcgatctggtccgtccaatacctgcctcctccctaccccgatccccctgccgcgtatacgtacgcgtgctccttaattttttttagagccctagcttaattaatcagcttagctagcttgcatccaccatagtacatgtacagttccatccatcagcctctataaattgggggtttgtgctccaagccgagcacctcagcctcagctcaccttgtgattagcatagccactgcagatatcgaatattgcattaagctagctagcttaattggcatcataagcagcagaagaagaagagaagagaagagaggaagctagaagatataggagaggaagaggggatgggagggaagtcgtcgttcctgtgcccgatcttcagcttcctgtcgtgcaagtcgaggaggtacgaggacgacgacgacgacggcgagctgagcggcgagtggccggcgaggtacgggagcaaggtgaggtcgagcgacgaggactacggcgcgtggtgggtcggcgagcgcgacgtcgaccgcaaggcctccgactacatcaacagcttccaccagaggaagcaggtcgccgccgcctagctagctcgatctacacatctcgatctccaaccacacccacagctcaacgataccaatctttcattggatcgagggggactagcgtacgcgcgacggcgacggcggacgacggccgccggcgcggccatatatatgtactgcatctgttgtctcaaccggccatttgtgtaccgcaccgcatgtacgtacgtaggtctccgtttacataattaaattcttctcatatatgtatatgttaaattgttatgtatgtttgttgtggattattatgttatatatgtttatttagaccacgaataattgtaatgccggttcacagatcgagatcttgccatgtgtatatgtatgtggagcatgtgaactcttttaatcctactgtcctatggtactttgcatatcgtttaaatagttatatttttttaacaaaataataagataagtagtatgtgatacatctcactatatatataaaatatagggttaaattaatttgacttatataagttgaaaaatcaaatatgactatgagcatatgtatactagattgacttaaatttattatttttgtcacatgtgagcatatgtacaacttatatagagattgaattttaacatgcatataatttcgccttttattaattcgttgcaattttcagaaaggagctagctatgatatacctccaacttttttaataatagaatagaaatctcaaacgactctacatcatatatatgacacacagccgacttcggccccgtatacctaaaattaagaaacacaaacaagaatgtggaaattaattaagcagcaacacatattaattatatataagtaattctcaaaaatatatatataaagataataaacatattttagcatcacacttttgcatgcatggaccatctttaatggaaaatatttatgaatttgatgtttctagatcatatcggagtgtatgtcatgcagactagaaatacctgttttaattttccatgttttttttttacgatggacctgctgccttctgatctcccttatatatttactgctccctccgttccaaaatataagcatttttaacatagtaacaagttaaacatttttaactttgactattaatagaaaaaaataaaaaacatcaatcatgtaaaattgatgttactagatttatcattgaacaactattaaaatatgtaactatttttatttaaaacatcttactttgatagatattgttggtcaaaatagcatttcgaagaccgtatcagagtaaaaaatgcttatatttttagatgaagggaatatgtgtttttgtccgctctgtgttattgtactgactgatactactaatcattagttcgatcatattgttaaaagggagtcaatatataccaccaatacttcagtcactcatgtcagtccgatccgatcgacttgaatagtgtctttttcgagatatacgtagctttaacatagctatatatcttcttttctaaccatccatatatatcagtgatgctaaatagccgaatccctcaaaaaagcctcaaccagaagacactctttaatttgtactcccctttgactccaaatactatatatgaatatatcattttagagctgtacatagaaaataagagaactgttaaaatgatcttgttgtcatatacagttatcgtatacttgaaaggatacttcatttatatatttctaatttctatactactaaaaaataatagtgatgatggtgattcgccaacaccactactacttttgcaattttacaagaaaaaaaatcacctatgacatattattatatattttatttaattaccaatagtaaagcatgggcattttgctagatttttaaaacactccattgatatatgagagtggtacgtagcatttaattaacaagagtatgaaagaatattatactaccttcgtactcacaaggatgttttgaacatttgacacaatctcgaatttacgtggttaattactttctcaaactatatgtctataagaaaactaaaaataaaactacatgacacaatctttcatgacaaatatgttgaaaatctaatcataattcagtatattttaattcagaaaattattatactaaacatgacataaaagtaatagatgattcaatgatagtgctaataatattaatatcatcatagtaacatgtttaacactaaaataaaaagggtgcgtaatgtacagaagaataatctgattccatagacggtggtgttggtgtagtcgccccagtggtcattgccgccattgtctctgtttccggtactaatcaacatggtccggaggttgatgcataggaagtagagatggctcggtgtagataaagtagcgtcagtttgacgcagagcagtcgcatgaaggatgcgctccccaaaaatttaatcaccacctgcccttgcaggtactctggtggatggagttaagacctgctcgtccgaatacttgtgtgcgcaagtgctcaggatcggggagaacctaagtgcagcttagaaccatatgaatggaggtgtctaacggaggagagccaaaatcaagggagatagaatccacgcctcgcccggctcggtgcgcgttcccaccaccattttaaccgctcaacagacgctctcaattagcatcatacttttaatttgatacactactaattagaaaggtctagaaaattctgaaagacattttaagctgcaaatagcctttgcaaagctagccgcaaatgcatggggagcgtctcctccggttgattccgcggcatcgtcacgcgcagacacgtacggcaaagcgggagcgaacctgccagaaagctctgtagctatgcatgaagagaccaaagcggtgggtagtttccatgcatcgctttggtgagcaacggcctgcacatagcgcccagaaggaagctaggctagcctcaaaagccgcgatgctatcactttctgcctcgggcgattcattaattaattgctctccccgtttgaaaatatacctcggtgacatttcctaaaatttatattcgttgtacatgaaaatatcttagtttttttttattttttttaatgagagaagtaagtagtactgtacccatctcaatataaatgtaatctaatatgacccagttcttttctccaacaagagttgaatgaagattaaaattttggtggcacgtttttcaaactgctaaacggtccgtttcgtatgaaaactttctatataaaagttgctctaaaatatcatattaatctatttttaaaatttgtaataattaaaactcaatcaatcatacgttaataccacctcgttttgcgtaaaaaaacttaatcttcatcttcatctccatcttctggagattcaaacaccacctatatatgtgatatatctcaacatagggttgttcatcgacggtttttagcggtttggtcagaaaaggcaaaccaacccagaaatactagtaccggtttatacggtttgttttgaacggttttgacaggttaaaccgggattaagcagaagaacagcaacacaaccatggatgtccttccaagctcaacagcgggcgattgcaccatggctcttagcctttccatgcgatggaggcaggcaggcaggaagccagcggcggcggcgagctagcgattgtttcctccttggatgggagccgccgtttggctgcctcggcatcctcgccggcatcggcgccgccggcaccaacgtctacggggttgttcacttacgtgcgtgctaaatagccgatgcttgcttggtttcctcgatcacgcagatgccttcgccatggcgtcttgctgccgcggaagctatcaggtaatggcagcgcaggtcctgaaggacgagacatggccgggttcaatgggttaagctggtcccaaaccagcccgtgaataaatggaaaaacggtttgggttggtttggtttcacgggttgaacggtttgagcccaaaccgtgaacaggctgatctgaacacatatcgcacgttcttttctcctgaagatgaagatgaaatgaaaatgaggatttaagttttttacgcaaaacgatgtggtattaacgtatgattgattgagttttaattttcacaaacttgaaaaatagattaatatgatattatagagcaactttcatatagaaagtttttttacacgaaacacaccatttagtagtttgaaaagcgtgtaatcttcatctaactttggttggagataaagaaaggaccatatactgcacacggacgtacacagtccaaaatcttgctgagaatgctgctcctctcctgtacacttgtcatgtcgtaggtgtaggggaagaaataccgggtgaatatggcccagctgcccgcggtgccgtggtggggggcatgtgggcgagacggtgtgtggcccggtggtggtgggcgcgcggtgcgtgaccggccggccatcagcggagctaggctggcaggctgcctgcctgtgcctctggctcgcttgctttccatcgccgcgcgcgtgagctagcggcgtgtcgatcgatcgatcgtccatgggaagattgaatttgcgctgctccctagctacccttccgacgtcacggtcgtggattccctctccgagaccatatttctcgggggaatcttggcctcttggggttaggagtagtcccctactccgagcaaatatcggccagctttgctttcgcgatttgggtgaaaggagagagagggagagatgcagcggcgcgcacacaggttcatcgattctccatctgcttttctgcacaagcttacaacgttagcgcctcccttcggaggtaggcccgtccggaaatcgcgagacgtttttttcagcttagttatcgaattatgaactattattgttaccacggttctcaaactacaatttctctgtcaaaattttctgcaacagcgttgcttatataacctgttctaaactacccctattattctaaactagaaatgtagctcacacattctcacggacaccttattgaaattgtcataattttttgctattggcattttgaccattatgatattgtattattttgaatatttttttgataattttaatatttgtattaaaattattttgaataatttggataatatttgaatattatatatttttaataatattgtaaacgtgcgcacagtcatctttatgaacgcacaacatgcacattgtaccctcttaataatctgttagacatttttctagacaaacgaagtctactttctttttagagatgacgaagaagatagtagataattaaaggatgctacctccattctaaaataagttaatctagaagagaataatgtgacacatactactgctatgaagaagctatgtggctgcttgaaatccttttggagaagattaatggacttttagtatatacgtgacagtttgggagtgttttgagaaagccacgtgataacataagagcgttttgaggaagtttaaagtacttttagtatataaaatagatattgacgatatttctcttagttcatatcgacttctctctaagttaataatatttgtcgttttatataaggacagtctccaagaaacaacaaatggtcactattttataatatatatatataaatatcaataatttattgaagtatttttttaagacttatctataaatatggtttccatatttctaagataaatattttagatgttataaagatcttaaaatttgacaatagtcttattcaaatcagagtattatcgaccagagggagtagctcgtgtgctttactatacaaatccatgtggcttcattcttcacataagactggttacaatatggaacctgggaagtgaaataattatcgcttcacacttcacgattcgcagttcatctcgcaagatgcaaactgcacctcccagcatacaaagtgatcgtgggcagctgtaatgtagtttaatactgatagaacgatagtaatagtacacaatttcatataatggtcatatggtatacgtatcttacacaaatgaccaagaaagggttttagtatatgtagactgcatttctggaattatatactacattttcgctactggtacacctttcggtacatttcaatctctacaagaactgagaagtcaaagaatatcttctgtgatgatcagccagagggaaggttcggagtgcgacctctcgtgcatacaatgcatcaacacacaaatatcctaccgggacagaggaaatgattgctcggctctgtagcgaattcgcatgaacaataatactcatatccaaacaatctgcacatgttccctcatccaggaaaagaattcatcataagctgagatattggcgttcctagcatcatgagaagatagaaaccagatggttcagcaatcaatcttcatgctcgtcttcaccttcagagtctgcacataaagcagaacagttttagatggtagcaaactcaaaataattttcaactcacaatggtggttggagtaatgcatgttataagcagactttgtcttgtcccaatgcagatgggactgaaaataagaccatgcaattttgcatgctcatcctgtgcaaaaacaagattctaagggggcagagcttaccagatcgaacatcatctccaacatttcttgtcttgatttgtctcacaagcatccgatatatcagaacccaccaatatatgtgaagaacaagtagtgaaaataggagagaattgaacacatagtaatatataggaccatcaaaattgtgcttcttcttgtccaaggtcaacaagacttcatagctgaagcaatcgggacttagtcagctcatgtaacttctaataaataaggaatgaaaacaccattttgttacatgctgggacaatgggacagcaagatactattgtacatagtattctagtctgctatcacacatatattttgtacaatataagtatgattatcatggcatagaaaggatcggaaataaaatccaaaattaatttcagcatgcggtggcatgatctagataagtttgttttcaagaggcataagatactgtgctatgttcaaaggtctttttcctactggatacaattactgttttctaactgaattacttgttggcttgggtttcttttctccccttaaaatgaaggcattggcaagaacagcagaattcaccatccaaagttcatatggtacaaatttcgcatagtaaataatatgcttgcttttgacaattcacaacatctatagtacttaaaatgttagaagtggtggtgtccatccccacaccacccctaccactaacatctgaaccccacaactattacaccacctttcaacaagtcatcccccatttcactattggctcccctaaatttcaaaatcacttgttcaataagaaaaatcatagtattacttagaacaaataagtgcttattgattgatttaataagctaaaaactcaatttgttttccattgcaatgcacgggttctaggctagttttcaaaaaaacttctttctcacaaaattctggctgacttttctaggcatatctcaacaagg

SEQ ID NO: 23623 - DNA, 2197 bp, Oryza sativa
gggtttcttttcttccccttaaaatgaaggcattggcaagaacagcagaattcaccatccaaagttcatatggtacaaatttcgcatagtaaataatatgcttgcttttgacaattcacaacatctatagtacttaaaatgttagaagtggtggtgtccatccccacaccacccctaccactaacatctgaaccccacaactattacaccacctttcaacaagtcatcccccatttcactattggctcccctaaatttcaaaatcacttgttcaataagaaaaatcatagtattacttagaacaaataagtgcttattgattgatttaataagctaaaaactcaatttgttttccattgcaatgcacgggttctaggctagttttcaaaaaaacttctttctcacaaaattctggctgacttttctaggcatatctcaacaaggtcagtacatcacatttaccttgtacttctgagaatccagaacggaaaatatgtgagacggagaagaacccatgaaacgacgaaaagaagaaatgcaacattggcaagcaaatcacaatggctatatttggccattttccctacttccaggaacacatcacttgcatcatgaattgccaatactactgagccaactctagcaaacctggttcatgaagaaaaatttcagaaataaattagttaagtgttaataaaaatgagtgaaataaactcagtgaagataaaatattaaggccctgtgctactaactcatagagtaatgcttgaatcaaggtaaaaaaagttcatattcaagaaacaacaaaaattaaaagttagacaaaaagagacctgaacacataagataaaactatcagcgcaacagttgcaacatgatgtgacattgacacgccaaaatctgaacgccttgtttcccaaaacataagtgcaaatatggaatatgtgtagaatccagcagcatacatatagacagccttaagtttccatctgtagataaggggaaaattgttagatatacaccagcctgagaactagtaagaacatgaagcaataaaggaccaattcgtattactttatcttttggtcaggccaaacctggtcaccaggtccaacccagaaatatttagtgtttgtgaaccaaggctcattatatgtaactgacaaagataaaatctctccagataggaaatagacacatttccaagctgattccttaaattttcttatcttctttcttgtttcctccttctcataatcaaccttttcctttccaaatataagttttcttccaatccactgaaacgaaaataaaagaaaaacaatgaaagtgtcaacattaagctttagaattacattaacaattgaaaatgttaattatttaaagtaaaaatatctatgatacaacgtggagcctgagagaatctattagaactatacaggaccaagagtaattttctggtgggttcggaatacagaattaaagtagctgttgtgctcaacctttcaccaatcatgtatttaagaagcataaattactttagaatcataataaccctcatagtgaagcaaatgatctcatctagcaaacaaaaaaaatgtctcaaacaaatacagaacaaatggtaaccagatggccatgtgccataattgcagtaccctgtgatgtctgtatattgtagtcatgcatctgtctaaataattttcttgtgaaaaaagctatatgtaatcaacttaggtatcgcactccaacctagactttgagttagtaaatgttcataaagaaggcatcattgtgtgcttgtgcttaagtccatccatattagaagtgaaagaactctccctcactagtgtcttagttctccgtcctgatgacttgtaatgatcagaattaccttttaaataacataatggtatgtaacataaagatgaatagcatgctaacatatacctcaacatacatatcaagattatctaaaaaaaatctcaagaaaacatcacgacacaaatgttttcctggttacagatagcccagtggaaaggtatactactcatacaataaatgtggcggttgcaactattcttactgcaatgagatggttgcaatttgcaaatttataaccgcgaggtatttctagtttttgagggatataaattacattaaccttgctcaagatgctcacacgagagaaatactg

SEQ ID NO: 23624 - DNA, 3764 bp, Oryza sativa
tgtcttagttctccgtcctgatgacttgtaatgatcagaattaccttttaaataacataatggtatgtaacataaagatgaatagcatgctaacatatacctcaacatacatatcaagattatctaaaaaaaatctcaagaaaacatcacgacacaaatgttttcctggttacagatagcccagtggaaaggtatactactcatacaataaatgtggcggttgcaactattcttactgcaatgagatggttgcaatttgcaaatttataaccgcgaggtattctagtttttgagggatataaattacattaaccttgctcaagatgctcacacgagagaaatactgctctctttatgccagaaaccactcagatctactcgtggtctgttgctgcactgagctgctgacaacctcaaattcgcagcacatcgctgccttatgccactgataaacagtaaattgtatagtcgtgtgataggttatgagagatatcaactcaacttgcaatccatttctctgctcgcaaaacccttctccttgcatgaacttttaccttaataaacttgtgttcaggctggcccagtaagtccgtcattgttcgcctcgaaaaatacattatatatgtattttcttaatggaagacaaactaacccagggaatcatatatggatcttgatagctaaatcactaaattcttattgtttaagatgttgaaactgtataccattattgttatagttgatgcgcctatgcctcagagatcacactattcatcaccaaagaacaaaccttaaatcttaaaccattatactccctgactaaccactgcagcgcaacacaacaggggcccctccgtaacaaaaaatcagattcagagtaccagataatcattagacaagagaagaggacgactctccaatacagcaatgccatgatgtaccagcacatctctcctgagaatccgagcgtttgatctctccccccacaattccaggaaacgcgaaacgcatgccaagctagcccgacaagcaatcattaaaacgctaaaaagctagcagcgcctttgtttccccccacacacataaactaaacccagctagctagctatccaacgcgatcggattggttggtgattcctccaacgcgaaatccagcccggagaagaagaagggaaaacacacacacaccagcaaaacaaaagcttcgctgctttccgcacccaacaggtcaacagtaacagattcacctcgaagacgaagcagtcgaggaggtagcggacgacgaggaagaagacggcgaacaaggggagcgcgaagaagtcgcggtacgccgggtaggcctcccgctcccagtccaccgccgccaggagccggcccgccgccgccgcgacccccatccgccgccggaggccgaatcgagtaggagcaagaaatcgatctctcctccgccgcgccggccgcgaagctggatgaagaaggatcgagaggggaggggaggcgaccccggttggggccggggtggattccgattggacttccctcctctgttcctcttcgccctctgactcagccgacgcctctgttttaccactacgagtctactactactccccacttgtttatttttattttatatttttcctttttttattattagtctcgcagtggttgcacggagtggtacaatagaaagcgcgtaatgaaccgtgttttataaggggtgtctagatagggctaaaactttttagcccatgttacatcggatgtttggacgctaatttggagtattaaatatagactaataaaaaaactaatttcataaatgagagctaatccgcgagacgaattttttaagcctaattaatctataattataaaaagtttactgtagcatcacattgtcaaaatcatgacataattagactcaaaagattcgtctcgtgaattagtccaaggatatggaatatgttttataattaatgtatgtttaatactccaaattagtattcaaacatctggtgtgacatggacttggaataagtccgtggaaaccaaacaggcccctaatcccaggaagctgggaattgtattgcatctaccgttgaaaagaagagatgggaattgtagccaggttgacttttcaaccatttttgacattttttttttgacttggtgtactatgattaataatccgaaaatggttatgataacttgtttagcgagttttgtgggttttttatcctatgggtaggattcatcgagattcaaaaataattgtatatttcttgtgtgtttgtaaataatcaataggtgaattatttgtaacttattcatacagctgaatataaatgttatcatacaaaggaaatgcatttggagaaaaaataagatcagaaaaatattagaccacaaggcaatgtcggtgttttttttttggtgtaaccttaacatgtatcccataaataattgatcattgttaaagcaattctcacaattctatagataggatttggtcacaagatagacccacatgagataaaaaaatgctttggctctgattaatgaggtgaatgcgagaggaaaataatgatttctttttcttgtggtagaccttaagcataagcataaggtataccataaggtaatactactttccacaatgtatatgactcactttataacttcaatcgttattttaaggttatcttttcatacattgtggttgtcctaagggtttataattattgttccttaacagcactgatacatcttttgttagagatattcttaaaagattcattttaaaagtattcctacaaagttagtttaacttctaaatcatgaatattgcacatctaggaattgtgagtgtattaatctactatataacaagatttagatcatagtgcccataagcatgactatgtgtagagtattggttaatacattcacccgaagttatacttctattgtaaaaaaaattaaagtactcaagtacaaaagtcaataagtgcatcacatatgaggattacgatgtaaatagaacattgcaaaagaacaatacatgatgtgtgagaatatatagtcgttttcccccttaagtatgttattttaagtttctaaaataaagtatttaaagatataacttgtacagtaaagtttccccttatgctatagtaattttttttcttatgttttgtaggcataggaactgttcgagtgttgaactattgtctttatactcaattctaagtagtagagagtcatatcaatccaaaataataaaggtctcgactaaagacgcacaagaataaaagagttaaaccttagcacatcttgatattgtcccttttagttagaggcttagagctatatcgtcaacatgatcaccatttgtttatggtcttagcaatgttgaagatggaggagcttgagttgtatggagtggttgctccttctactatgatgtgacaaggctaccgacatcaagttagatcaaccctaataacccatggataatatagatcaacctagaaagcgatgtttatctatggattagttttggttccactaaaaagttaagtttagttttggttccactcaaaagtttaagttcagtatgaaacctaccaggcatggatgcaagtaaatcaaaccataaattcacttaatagattaatcaagtggattgaccctgtaaattacccgggtatttagtccaagttgatggatcaacccatctctaaccctattataaccagaat

SEQ ID NO: 23625 - DNA, 725 bp, Oryza sativa
  unsure (1)..(725): unsure at all n locations
nnnnnnnnnnnnnnnnnnnnnnnnnnnnnnnnnnnnnnnnnnnnnnnnnnnnnnnnnaaactggtgttgaaaccgttaaaggactcgatttgtgccatttttaatagctgagtaacgttcaatatgcggttttttgcggttgagggatgtgaatgaaactcgatgtattgttgagggataaagtagacttatttctattcgttttcctcccggaaaccggccagctacatgggctaatacaactatacaagcccaccagacctgggcccatcacatacattacggtcccagatttgccacggtcacacgcacaacctgcccgcgccgcctctaccgcgcggtcgaccaacgctgacctccagggtccacccccaattgggcaattcggcgccagctgggggaggggccctcacgtacgcacgcctactcacgcgcgggtggtagcctctctcgctgccacgttgggccccaccgttgataaagctggactccagtgtagtaccacccgctaccgccactgccagcgtgggccttcaccttgacccgagccaagcgaaaccaaccgcggtcaaagggtgggcccacagccgcctgtttttctatacctcccctgctgctggccgtccgatccgttctcatctcaaatttttgagccgtcggatgtagtaatggggccttcgcgtaaccaccgccgtaacggaatgggagcgaggcgaggggcgcgc

SEQ ID NO: 23626 - DNA, 537 bp, Oryza sativa
ggggaaggttgtcgcccgccaccgccaccacgagctcaccaccgtgtgcacgccgctcacggttgccgagcccgccgctcccccccaccagatccgggcggcttgggaggaggggaagaagatgggagatggagatgaagatgggcgaggaagatggaaaaggaaggagtgggcgtgcggccggattaaatggtgggcacctattttcgcgtgcgggccacttaacatgtccgcacgcgaaaataaggctattttcgcgtgcggacgtgttaagtggcctgcacacgaaaattgatttttgtgtgcaggtaactgctcggcgccggtcccctgattatcatgtgtggtttctcttacggggcccgcctgaaaacaaaagtgtcccatgtccaggaaaatgttttgtgtagtagtgacggcatcaattttctaatctattatatgttagtattcagccgaagctctataccctactttaggatacaaggcaatacggcaacgaagtcttactctattacataatacatggattcggtc

SEQ ID NO: 23627 - DNA, 1200 bp, Oryza sativa
  unsure (1)..(1200): unsure at all n locations
cacctattgtgggggcctttggaatgggtggctgttaccattggccatatttgcgatgcattattatgcccaccatcaacgatgaatagatgatgcatggtgcctctgtcctttcaactttggttgccttttcaccagttatattgcacaatttggttcagtgattgtttcttgccctgtgattgtcccacatggcctgattagctgactgaaatagtttatttcacaacccgcccttttgacataggtgcacatgaaatttccttgttcccttgtgatcgtctgatctcttctttgtagttgcctcctctttgtgtaaagggggaaaaacacttgttttcagtattttgcatcctctggtatcaatatagtactggccacatttttccaatattgccatattggtatagactttttttggtgactatgtgtttccctgtggtgggcttctgtattttgattcagcaacgtagatctgcattcaagttgtacaaacatcatagctaatcagttattgagcctgataacattatttgttcacttttcatgctatgccttaatacaatatgggtacggtttgcactgttaattcctgccgtttgggagttgacatggtttaatttgtgtctgctggatataggtaatgcacatggtttgggagttgaagccttgcgaatgctcatgcaaatggtcctcaccaatgaggaagagcttaaactgaaatatttcaaagatgatctatccaccaaactttgccctgtggaagcttttctaaaggcagtgctggatattccatttgcgttcaagagaatggatgctatgctctatgttgccaacttctatttggaggtcaatcagctcagaatgtcatatgctactcttgaggtatagttgagcccttggttgaatatttttgacaaattgttttgcaccctttgttgaaagaagcaaaacataactttcatatgcaattgggtattatgcatatcaatatttacacanatgatttgaatctgtgaacggaatagaccctcacttacttgttccttgtttatagtattactcatctctgagggtttcttatcgtttttcatacaggcagcttgccaggagctgaaaaacagcaggttgttccacaaggtccttgaggctgttttgaactttggcaacttgatgagtatcgatacaggatctccgaat

SEQ ID NO: 23628 - DNA, 2011 bp, Oryza sativa
  unsure (1)..(2011): unsure at all n locations
tttaacaccacgccggattgtatagcggaggtgtacccctatgttgttgttgccggggactccaaggtagatgtctacagaagaaagcccggcgcacatttgcaggctattcgtttcgcatggcctggtacaggtggactaattgtagcgagcgaggatgccggaattggcagcgacgtagttgtgattgctacggcttataaggtaacgtaggtatgtcaactcatccatcggtgcaacttgactcaaaatttccaatctgctctaccggattgcttagctactgagctgcgttctgtgtttgttagtaatactcaataattacaatttccaatgacaagacaatgattttgtatgctcaagtgaaaccctgacaatggattctctcataaatgtgcagcgccattttatcatgtcgattttgtatcacacactgtacttatggacacatttattggcttggccaggtattttgctaccgtaaagtatcagcggtggaacagatcaaggcactactacgaagaaagagttatgcagaagctatttctttgttacaagagttcgaggccgatggggaaatctcaaatgacatgatttcctttgtgcatgcacaacttggattcttgttgtttttcgacttgcgtttcgaggatgctgtaaatcatttcttgctctcggaaactatgcaaccagcagaaatatttccattcatcatgcgggaccctaatcgttggtcagatctggtatgcctcattaccacatgttaattgtaatgctgtatctcctcgttgatttctataaggcatattttgatttaaaaagtcaaacgttgtagattttgaccaaaaactagacaagttacaaataccagttcaaaatgttttcacacaattttggttctatttagaatatattttatgacaaaaaaaatccatgctcaaggtttaacactgtagactctttgaaatcaaaatacgccttgtaaaatccactggccactgggtataaataagacaactgttttaacacattccttgttttatgttttatcctgtaatgtgctcgaggagctgactaactgcacaacctttctcatgatactctcttaaccttttcttctgtatgtgaaaagttcatgttgaatgctgcaacttcttttatctctttaatgtggttttcaatggataagactttataatttcttgatatatgaacccgttcctcttgagtatcaacatgagctggttccttcaaatttgagcgtanagcttatattggtaggcacatctgttaagttttgatctgctagattaatttgtcaacatatttttgtaattgtcaaatggaatctgtagttttcatcacctaacatactgattaagttctcaagacaaactgctcatcttccactatgactggctgccttttgtattcagcagttttttatctgattgtgaactttgtaaattttaggtgccaagaaagcgttattggggcttgcatgctcccccaaagcctcttgaagaagttattgatgatgggctagtaacacttcaacaggcattgtttctcaaaaaggcaggtgtggacacagttgtggatgatgatttcctttcaaatccaccaagcagagctgatctgctggaagtagcaatcagaaatattatcaggtttgctcattcacgacattttttattcattacgaattgcaaataagctgctccatccagctgatgtctgaatgctatatgaaactaggtacctgtgtgcatcccgagagaaggatttatcttcttcagagatggaaggggttgatactcttctgatgtatctttatagagctctcaatcttgttgatgacatggagaagcttgcatcatctcagaatagctgtgttgtggtatgtaaatcctttaaacatctgcaaccttgaagcgtttaagactgttacacacctacgatacttaaatcgacattaactcttcatttgagaacagtacataactacata

SEQ ID NO: 23629 - DNA, 1482 bp, Oryza sativa
  unsure (1)..(1482): unsure at all n locations
cttcacactaaggacttcatgatcaatgatctgttccactttgtgtacttctactgactatttgcgtttaggtggcagacattgatcaagagcttgcaactgcaattttaacatctgaaatgagggaaaaacagctttctcctggtaattgctttgttttagataaaccactataccagtgtgccttttatggcttatccatggcagatcaacacaatttccagttttttttctccttttgacttatgaatgtgtatataacatagtgtggatggtagtaggcatatgtaatcatggatcgatgggctctctttctcctattttagaactaacaatattttcactatatcagcctatattgcatccagaaaattgtgtttgctacttagggctgctaggaaacttttttgggtgtaactaacatgcgttaacatttattctggatgattgttattctacagaaaaggttgttgctgccattgatccagagaaggttggcattcaccaaaggtacatataatgaatcgacaaaatcattacaagttagaactcaagattccatgatgatcctccaatgatccttgttaaaaaaatgttaaatagtaacagagtgaattatgggtatacgttgtgcaagtttgttcattatacaattgcatgatcataaacaatgaactaatagcagtttgtcaggcttcttactaattacttggtatcttgggatccatcaccactgtagagtgacctgaacattgatacgattgattgatgatcttgtctttccatgccagattattcgagtaaatgctgacaataatagttgtaaccaaggggggcctgtttggatcaattccattcctagtgttaccaatttttttgggcaatgacaagatttgtctattgccaaaaattttggcaagaatgagtgggttctaatttgtatgggcataagagtgatgccaaataatttggcaatggcagttctttaggttgcaaaccaaatgggtgacaaatttcttggtgttgccaattatttggcatggttgaattggggtataaatcaaacaggacctaagcgtattctaaatatatacgaaggaaacataatgaggctcaatgaaataacatattatgacttgaagctactgtatcatatgcgtattatattaggtagttcttaatcaaatatagttaccatttgcatgtttctttgaaagctctatgtgttctatgccttttgtactcttgctgaataaattcctcagcttttatgaaatctgaatatgctaagttttgcagatatttgcaatggttgattgaggaacaggaatgtgatgagcctcactatcacacgtcatatgcattgtccctctccagatctgccatggacgcagtccgtttgggatccaacaatgaagagagaaannnnnnnnnnnnnnnnnnnnnnnnnnnnnnnnnnnnnnnnnnnnnnnnnnnnnnnnn

SEQ ID NO: 23630 - DNA, 523 bp, Oryza sativa
agggtttctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagtgcttagaacctcacctagcgcccccggccgaaccggcaaggggggcccgcgcggtctctcggtgaggagccccacgctccgtcaccggcgatcacgtacccgagcgcaaggtattcctccatcgcttggacagacaggccgcccctaatatctgcaatctaggagttgttgcagagagcggcagccactgtgatgtcactcagcttgacgaaggagaaaagaattgggaatctgtactgcactgatcctccgtctggcaacaagctatcgcaccaaaacgaggtagaggctccgttccccagcagtactttgctactagcggcaaagcagtgcagtgactttctgtcagctag

SEQ ID NO: 23631 - DNA, 2471 bp, Oryza sativa
caagtgcctgcacatgagacggcgcgaggggtgatttaaacagctccaggtaccgcaagaggtcctgctcttcaaccttgttctcgttgtcgacgacgccgagtcttttcatcacgacgcgttgcgcccatggcggtgtgtagggagctgggcgagagcggtgtcttggctgccgaggcctcttcccaaggatggatgtcgccggcggagtcggcctcagacatggcggcggcaactgaagcactgagtggctggccaggctgcaaagctgggccactcgagggtgaagtgcgctcctccagcccagacccagacggctgaagcgggaaaggtcgtgggccttgaagttctctccggcggcagtagactcggtttgggccgaagaagcgccaatccggcccatcttgagattcctgggggacgtcgtcgaagtaaacaagcagatagaagagaggaagcacgcacacacttgtgagttgtgagtcttccactaacgagttcaagtcaaagcggttggcgccaaaactgcatactcgatccatctgactatatatacttactacacgtaccaacaaccaactcaggatataaattaactcagcaaggaaaggaaagattaagattatattggatggaaatggcgcgcgccgtcgtcctgctcctgctggcggtggcggcgttgagctgcactagtgcggcggcgtcggggccgagctgccacgccgacgacagcgccgctctgctggccgtgaaggcggccttcaacaacgcctccttcgagtactggacgcccgaattcccctgctgcgactggtacggcgtcgactgcggcgacgactacctcccctccgacgaccgcgtcatcaacctcgccatcacacgcgacgacaacatcaccggcaccatccccggcgacgccatcgccggcctcacccgcctccggtacatcaccttcttcaaggtcccaggcatcacgggccccatccccgccgcgctcgccaacatctccggcctcagggtgctcaccatctcccacaccgccgtctccggccccatcccgtccttcatcggcgacaagttcaccgacctcggaatcctcgatctctccttcaactcgctcaccggcgccatcccggcgagcctcgccaagcccccgaagctgaactccatcgacctcagccgcaaccgcctcaccgggagcatcccgcggctgctgctgagcaaggccgggcagcaagcgttcctgacgatgtcccacaacaacctgacggggaggatcccggcggagttcggcgccgtcaacttcgtgcagatcgacctgtcgcgcaaccagctcaccggcgacgcgtcgatgctgttcgggtcggggaagaaggagctcgtcagcgcgtacctgtcgcgcaacgcgctgagcttcaacatgtcgcagctgcagctgccggaagagctgaatttcctggacgtgagccacaactccatctacggcagcatcccggcgcagatggccaacatgacggacatgcagctgctcaacgtcagctacaacaggctctgcggcgtggtgcccaccggcggcaacatgcccagcttcgatgcctactgcttccagcacaacaagtgcctctgcggcgcgccgctttctcactgcacccattgatatactcctatatgatatgaggaccataatcatccacctacaattaatgcagtcttaatttgctgcttgcaattagtaatcgaataatcctagcaaagcaaagcaagctaggagtagtatataaataagaaccttcgatcggttcaggttcatgcgtgatgtaatgttttgttcgtgcttgatatggagtacctatctcaggccaccaacacatagtatgtacaccattcgtttcaaaaataaatcaattcctagctacaaatttagacgtagtgttatccagattaattcatagataggatttgattctttttataacggagggagtatgttttaaaggttgggatcaggttttgctttttcgaattaaccgatttgatcggaagtcactgatataccaaaattttgaacaaaatttagttaaatttgaacaaatattaccaaaattcacaaaaaactaaaaattttcagccgaaataatatcgtattagaggggttcaaaatgaccgaaattttggaaattttagtccgaaattttcagccctggttgagatgcctgcgggaaataatgtctgattcatactaagagtatgaagctacgtttatatggacatctttggcatagatttggatcccaagatttgtcaaagctgggtattcttaggttcaaaaactatggatgcagatcgacgtttacgttgataacgtttaatatatcattttattttcattttagatgagtttatttttaaaaagttaaatcactataatttagcgtaaaaactttaaatatatcgtgatttgagatctgaaa

SEQ ID NO: 23632 - DNA, 539 bp, Oryza sativa
  unsure (1)..(539): unsure at all n locations
actatagggcgaattcgagctcggtacccttgcgattcagttcacatgttcttttctttttctttccttattattatttgtcatggtcttggctatgcactactgattatcattatattattcgctgcattataaaggttcttggacacgtgatagtttttataattgctaataaactttcatcatgctcttttgcctttaaacatacacaattacatatgtttgcccctctaggttacacacattctttctcaaatgtccttgaacgacattcatgtaaatccttcttctgtaggacctggtacatttactataacagcggtggttgttgctggggctgttggctacgcctacattaagtggaaggtaatgtttgattctttcacctcaatggaagtacagaatgaggaggacataatctttgattattctagttgctatcttgatgtttattgttctgtccgtcattctagatcatggacgcannnnnnnnnnnnnnnnnnnnnnnnnnnnnnnnnnnnnnnnnnnnnnnnnnnnnn

SEQ ID NO: 23633 - DNA, 686 bp, Oryza sativa
tcacaatgacgaaaagcaacggcgagagtggatccccttgcctgagtccccgagctagcttgatcctttgagtgtctctaccattgatggtgacggtggttgacgaagtgaaaagcaaagcagaaacacagtcacgccatcgagcgccgaagcccaaatgtcgaagcagctccaaaaggaattcccaagataccgtatcaaaagcttttgcgatgtcaatcttcaacagcatggcaggcgttttggaccgatgcaactttttaactacaccatgaacgtagaggaagttctcttgtattcttctgcgcctaataaaggctgactgtgcaggcccgatcaattcatccattctcggggcgagacgaagtgctagaattttggtcaggatcttggcgaaactgtgaatcaaactaattgggcaaaagtcagttagttgattcgggtcctctttcttgggcaggaggatgatggaagctgtgttgacgagatgtaggtgctgggaattcgctctccacgcgtccccaaaatattgaggaaatagttgtatgcagcctgtagcttatcttcttcagtggtagcatagacaccatcatgacagagggtaggaattgctttctttcttcgacgtgcattgatcttaaggcgaaaaaattgtgccgttgtgccgctatgcttgaggaataaca

SEQ ID NO: 23634 - DNA, 1123 bp, Oryza sativa
  unsure (1)..(1123): unsure at all n locations
nnnnnnnnnnnnnnnnnnnnnnnnnnnnnnnnnnnnnnnnnnnnnnnnnnnnnnncatggcgattggagggaggcagagagagcagtggtcctggaaggtgataccgtagctggcggtggtcgaccagaaaccatgatgtttttttgtccataggattgttgttttgttttgataggataagatgggctacataattttaggtatcgctaggatttaatttacactgtagacaaaacataaggccttttgtgtctaatagaagaaagaaagatggagagcatttgcccctgttggaacaattaatgtgctgcaggcaataacaatccagttggttggccattacgattcctgactcctgtgctgagtgatgagaattcagtgcctcctccctcactagaagggctgttaatccgtgaagcatgcgtgaatactggtgttgcaattggccgtctgcaactatctgtccacgcaagtaagcatccatcgatggaaaggccggcgaaatactagtaaatgcatatccatgtcagtcagattcagatcacatgaggttaggtccgcaatgcaaatgctactactgggtgaaatatctgagcaattagtaagtgaatgtcgctactgcattggcgttgcatggcctggcctgcctccatgtatctttgtcgcgcacttgcctgcgctttttcccaatattttaatccaaaattatctatcttaattagcttctttatctctgtctcagtagtgcaggtgctcccaacttaataaccttttaacacctgaaaaagaagatctcttttcagtcgagagagagagcagggcccaggcgaggctatatatacacggcattgcatgcaccatatgcatctcaatatctcttgcgacctcactccaattgcacaaacatacatacatacatacatactcgatcagtcggcaattgattaagcagctagctcaagctggtaaaattaaacgaccaatatatatgatgatgatgatgaccatggatgtgaagctcctgctgctgctgctgctgtccgtcctcctcctgtctgctgcctccatggccaaggacgacgatgagcagcagcagaaggtgcaatgccatgaggacgacga

SEQ ID NO: 23635 - DNA, 547 bp, Oryza sativa
ggccccctgccgccggcgctcttcagcaagctcaacaccacgcagcagggcggcgcctacctgaggctgtcgcggaacaacctcaccggcggcatcccggccgagtacggcggcgtggcgttcgaggtgatggacctgtcgcgcaacgcgctgagcttcgacatgaccgggctgcggctgcaggaaggggtgagctcgctggacctcagccacaacatgctgtacggcggcgtgccggcgcaggtggccgggctgagcagcctgcaggacttcaacgtcagctacaaccgcctctgcggcgagctgcccgccggcgccgcgaggttcgatcagtactccttcttccacaacaagtgcctctgcggaccgccgctccctactccctgcaattaagctcccattacttaattactagctatgtggtgaaattatacatcagcaatgcaagcaaaataaataaataaatatatatatatatatatatatatatatatatatttgtataatgattttaataagtcaaaaacagattgatgcatttggaagg

SEQ ID NO: 23636 - DNA, 2164 bp, Oryza sativa
caaatgcgtttgagcttgttcagaaaggaaaagaagatcgagtgtcattaggtgagcactagctgagtcaggctcaggcatgcaagaagcatttaattttttactagtttagtttgctagttgagctcagcatgaaattatatatattcattcattgtgtgtccgttatcaataaatgtaaaaataaataaataaagacgagcgatggtactgctgcctattgtgacaggagtatatatgctatatagacaggagtccgtccttaattccgggtaatcagcaaaatgatgactttgacgaccaaagtaatcgctgcaagtgcaggatgaaatcaatcaacgagatatataagcagataatacatacacatatagtaataatactatagattaatagatgggatgtgaatagagaagtagtatagtaagtaacagcagtagatggttgctgcgagtattatgtggagaaagaggaaacggtagcaatgagtcgcaagcagcatgtgcaacagaaagcgaagccgcaccaaccgcatacaaccggtacagaaagaaatatggaatggcaatgaaagcatgatcaacaagtgcagttgcagttgcagtgtagagcaggcaccggtcgaattcgagcctaataacttgcgcttctcttctcttctctgctgtgctttccatccatccactcccacgaaccgcacctcaccttctttctctttcattctctctgtactgtacgtacgttgccaatactagtacagtgagtgagtcatttgcatctgcataccctaccttacctgctcctactactgctcgcctcgcttacttactaccctcctgctcctaacaacaacaacaacaacaacaacaacaacaaggaagctctatcgggaaagaaataggaggaagaaggattaaggaaggaaagcaaagcaagcattaattaaaggaaattaggaaggatgtcagactgggggccggtggtgatcgcggtggtgctgttcgtgctgctctcgccggggctgctcatccagctccccgggaggcaccacttcgtcgagttcggcaacctgcacaccagcgccatgtccatcgtcgtccactccatcatctacttcgccctcatcaccctctttgtcatcgtcatcggagtacacatcaccaccgattaatttttacttcttctttagtttcttcatttctgcagttcgtctgccctgccctctgtaatctctatcttcttctttcttgctcatcctgtcttctcccctcctccatatatatcctacctcatattaattctactatctacatggtgcttccttgatgttcagcacatcaaaccatgcataaaccaagactgttttaaattattactgttttctactagtattatatatgcatgggcagttggcactgctatcaaattcagatctcatagctagcttaattgagcagtttggcacatatattctcccaaattttcagcctctactcttattactcatgttattattatcatctcctgtataaatgtaatcattggatggcctgttctcgatctgattcaattagctagttgtacagtttaaaggcgtgtgctcagaatcatccatgaaatggatcaacgcgatcagtattcggtggtgtaagtgtaaaaatatatgcatgtatgtatgtatgtatgtatgtatgtatgtatgtatgtatgtatgtatgtatgtatgtatgacaggcaaacaaattaacacaggcgttgcaacaacatttagttataataatggataaccacatcaagcataaagtcgttgaagcgtagaatcagagagtccatcaggacagggaaattgcaaggcgccagtgccatcaactttacgttgacactgcaagtgctaatgcgtagtacgtctctcatcactgctcatgatccatccatccatccaaccactccatctgcgtgtgtgtatatgtgtactactctactttatacgctacctgtttgtactcccagctgaactgaagttttataccattctgttttcccaactgaagcttcaagctgaggttttgtacatatgcaatgcaccacaggctttacctagaggatgaagctgacaagcacaacaagtaactaatctcttgacagataccatactatcagatag

SEQ ID NO: 23637 - DNA, 414 bp, Oryza sativa
caggcgaacacatgcttcaaatctcttgactgcctcagcacacttgagtgggtcctgtgcattgctcacgtaacactggcggcagtttgacctctcctcagtgcatggcgtggggttttggtacggcagcttgaactccttgtcacgcaggtcttttgatttcttgatgagttcatcacgcatcccagcatgctgcttatccagcttctcctgaaccttttcgctctcttccagaacggcacggatggcttccagctctgaaaaagcaggtgggggtggtggaggagcaggggttacggggagatacatgggaggctgcagtggccagccaggaggagccttgggttcagaagctgggagttcccttgagttgtcctggggctcttgttgatgttgtttgacagtcttcttagg

SEQ ID NO: 23638 - DNA, 2059 bp, Oryza sativa
gagtccgtacttctggagtcgagagaaatcccggctgtcggtgacatgggaccgggggtatcttgactagaggtttggggcagctgcagtcacccacgtggcctgaccccctcgggggggtcgggcccgagggtgatgtggccgcccctccctttgtctccccgaggggtcaggccgctcccgtttcggccccgagggctggggcgccccgaccccctgtgggtttggcgccacgtgtgtgggttaggtgagcacagcggggctcacctaaccgcatttattgtgggttggacgagcgccccacgccctatttaatgcagcgcaacacactcgttcggtccgtgacaggtcacagtgtgtgaccggtcatagaccggtcagatagagggttaggtggtaacaggcggccttttccacgcctagccccgttcccgttgaatgatgagagcctatatgcactcgtccctagccggagcccgcgtgctgactcctggagttagcacgtcagtcccggctagattcataccaggcttcatcgcaaccattacaaggaagtcattttatgaagaagggttgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcagagggtcattcggacaacagccatggcaaatctccgcccattaatgagggagtaacagggagatccccggtgtcaggcgagtgatgacgctgggcctcactcaaagacaagctgtgatttagcttccaggcgaaggcgcaagctagttttttcttttttgggaagatagggtgagtccccacccaaaagaagagtaggtagaagtggtgcaggtgggatccccttgagatataaaaggaggaccttgcccacttaagaacgggggagctggggaaagaggggggagaagacctgagctcgtagaggagagaaagaggaagagggtttctagagtttgaactctcttgctctccagctctttgtaactccttcatacacagatccaccagaacacaggagtagggtattacgcttctcagcggcccgaacctgtctacatcgcccgtgtcttgcgcatttgctctctcacgaaacattccatagatcgagtgcttagaacctcacctagcgcccccggccgaaccggcaaaggggggcccgcgcggtctcccggtgaggagccccacgctccgtcatctggcgcgccaggtagggggcgcgtgtgtttttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgcccccctctcgccgaagtcttaggcgggaggaggcgctcgagggggtcgaaagatccgcgacttcgccgcccacgagcgatgaagaaggacggcgagacggggagcgtcgcctcctcgtctacggcgatggcagcacgccccagggcacgctccaagctgcgggcgcgctcttgcgtcacccgcccgtcgtccccgatccagagactccagcccgacgttggctggatgacgtggccgacttggtcatgacggcgcagcagcgcctaggcgccggtgggcggtcctccgccgccaaggcctctggcgctgctaccgccggctccgtgtcgtcgaggggcgccattccctcgtcaacgcctccgacccaagaagatgtgcgtagggggccggatgcccgcctcagtatcgagcgccggcgcaatggtcgtcgtgctgcccacgcaacggaaggcgcttcctcgtccggagcgccacttcggttcgggcgcgggggccagccccccgtgcccccgcttggtggtgtcggctgtcgagcctttgtggcgagcattcggaacgtccgttggcccccaaggttccggcc

SEQ ID NO: 23639 - DNA, 883 bp, Oryza sativa
ggagagaaggcactgcccctatttaagctcctcaaacgctccgggccgtttacctggacggaggaggctgagcgggccctcactcagttgaaggcgtacctcagttctcccccagtcctggtcgccccggagccagatgagccgttgctactctacctggcggcaaccccgcatggggtcagcgcggcgttggtcgtggagcgcaacgaggacaaccctcactccgtgcatccccaccctgcgtcgactcgacccgggagagagcaggcaggagaggcccccgagccgaatggcggcccgaggcccccgacggccggagctggccctccgcctgcttgtccgacggtgccaggcgcccccgacccccaggatggccccggggccactgcgggaaggccgcgcctgtcgccctctgaccccgaggtcgtcggcacagaagccgagtgcgccccgcgtggcctctcggacgaagaacgccctggagatgcggcccctggcgaagaggatcggccccgccgaaaggtgcagcggcccgtctacttcgttagtgaggccctccgggacaccaagacccgataccctcaggcccagaagatgctttacgctattctgatggcttcgaggaagttgcgccattatttccaggcgcatcgggtcacggtggtcacgtcttaccccctcggccaaatcttgcataaccgagagggtactggacgggtggtgaaatgggcaatcgaactctctgaattcgatttgcgctttgaaccacgccacgcgatcaagagccaggccctcgccgactttgtggcggagtggaccccagcccctgagcccatctccgtccccgaggccagctcgggcccctcgcagctgcctcacaccg

SEQ ID NO: 23640 - DNA, 185 bp, Oryza sativa
ccctgggcgacggcccgtccaagaccacacgaatcagtggtcttctggacggcaaataggaagacgcgcttgtctccttcctgcgggcaaacgccgacgtcttcgcctggagaccggcggacatgcccggggtccccagggaggtgattgagcaccgtctcgccgtgcggccgagcgcaaggccg

SEQ ID NO: 23641 - DNA, 772 bp, Oryza sativa
aaaaaaaaacatgagctttctactcacctgggtgtattccagactcacaagctttgattcctgcatgatacaagatacaaaaaatgtacacgagtaatattcagtaaataaggtagaaatctggatattcagtaaataaggtagaatctgttccggtacgaggcacataccagactccgaactacaaggttaactgattgtaaatcctcttggaaagcactcagatccccatggatgactgtgacctacaagtcagtcatgaaatgccattaggtcgccgaaaatgcatcaaaaactataaaagtaaacacaaaaaataaaaggaaaaacagttccaacctcatcccttgtcccttcaataatttcttgtgtttcatctaaactgatatccacacgatcaatccttccagcgagatgtttccttgcagactgaatagtgaaaatcaaaggccagtaagatgttttggttggaacaatgaaaacatggaatcacaagtaacacatttgagttcagcgttgctgaaagaagttaaaaacttacagtgacatcatctgaaaccttgtccaattggctgccaactacattgcaagcatcagataagccacgcttcgtgacaaacatcaaatcagaaagtttccagccctgcaaatctatgtaactttagaaactagctagaacagtgaaacaagaaatggcaagcagataggattgtaataatatgcacttgcgtccatgatctagaatgacggacagaacaataaacatcaagat

SEQ ID NO: 23642 - DNA, 580 bp, Oryza sativa
ttccattagccgtatgatcctaaaaggattttaagaagatagcattaggagcatgtcgatgagtttgttggtaatatgtagtggtaacatgagcttctacttttcctaaaaaaaaaaacatgagctttctactcacctgggtgtattccagactcacaagctttgattcctgcatgatacaagatacaaaaaatgtacacgagtaatattcagtaaataaggtagaaatctggatattcagtaaataaggtagaatctgttccggtacgaggcacataccagactccgaactacaaggttaactgattgtaaatcctcttggaaagcactcagatccccatggatgactgtgacctacaagtcagtcatgaaatgccattaggtcgccgaaaatgcatcaaaaactataaaagtaaacacaaaaaataaaaggaaaaacagttccaacctcatcccttgtcccttcaataatttcttgtgtttcatctaaactgatatccacacgatcaatccttccagcgagatgtttccttgcagactgaatagtgaaaatcaaaggccagtaagatgttttggttgg

SEQ ID NO: 23643 - DNA, 830 bp, Oryza sativa
  unsure (1)..(830): unsure at all n locations
cttaagataaaaagaaaggcaggatcagcctatgtactggggaagccactaagttgggggggatttgacagtggtgtttcatgtagcagtgggatacccaggtaataagttcccctctggtttgaagcgaaagcttagttgaactaaacaaaccccggccccggccctaaaaggctagatcaatctatgtattggaatctggtaaagcaaaatactccgtacaagatgagcaaataagttgggatttggtagtggtattccctagaagtgggagggattggtttggtaatctatctatgactgcgccatggttgcaagtggcatctactcctatctatctatcaatctccaagtcgaaagtcaaccggctgggctgggcgacgagaagctagctagggctgcgggtggacctcaggagggagcagacggcggaaagtgactcaccggagccgacgaggatggcgacgttgccaagcaccatggcggcgcgcgaggagaagcccctcctgcctgtagctctgcttcaatctaacggcggcggcggcggcggggacgagggcggcgaccggcgagagggaggacagattaaacctctcgatcgatcgatcgactactttttttttttccctagactagtagaataaagaaagaggaaaattactcctacttgtttgctagagagagaatagaatactgtaattattaacggggcagggaggccaaggggagatctcaatctgagacggtcacctgttgaagttagacagtatattannnnnnnnnnnnnnnnnnnnnnnnnnnnnnnnnnnnnnnnnnnnnnnnnnnnnnnn

SEQ ID NO: 23644 - DNA, 1922 bp, Oryza sativa
agccattattgtacaaaaccaagtgtcatcggttcagtatagagggctagaggcggacatggagccaattctaaaccatgttcttaggatcaaaaccaagtgtcatcagttcagtatagaggcggacatggagccaattctaaaccctgttcttaggatcccgcggtggatgagttcccagcatcatttttcttcatgtcttcaaacttatcaatggcgacctgcagctcatctgtgcctcccaccgctctcatggtgtagtaatacacgccgaggacgaaagcagacagtcctccagccaccacaaagttcttggtcttgggtgccaggctgccgaatcccgccatctttagtttgcaccggttgttgcagaaactgaagaagagaatgttacagaaacaggaagaagtggtgccacactgatgccagttgacctttagccaaggcacagagctatatgggatatatgaatttaaactgaagatagatatggtttgctgatgtagcctcaagactaagaccctgtttagatgcgactaaaacttttaagtccctatcacatcggatgtttggacactaattataaatattaaacgtagactattaataaaacccatccataatcttggactaattcacgagacgaatctattgagcctaattaatccataattagcctatgtgatgctacagtaaacattctctaattatgaattaattaggcttaaaaaatttgtctcgcaaattagcatttatttatgtaattagttttgtaagtagtctatatttaatactttaaattagtgtctaaatacagagactaaagttaagtccctggatccaaacaccacctaaactagtgtttgtctttaaatcacagtataactaaaagtgggaatttgtaatacaagttccgattatactagaaaacactcgagctagtcagtgctagaatatcaatcctggacagaacccatctgctacaagtgcagctggcaatggcaagttcgagagcataacattagcttacttagcagtggggaggggattgaaccataccagaacatagcctagattgatttggacatggaaaaggaaaagacttacctcacagcagtaaattttgagagattaataattttagaccaaagaaagattagagatttaaactaggtttgatggttggagtttggctagactagtaatttcgggtgtttactgtttagggagagtatttgatctccctaaaataaaaaataagctatcatattcagagtgaagggccttagtattagagcgtagaaactcatcatcacctgtttcagctactgatgatgttagtacactaaaatcataaatatctcagagctccttttatactggatttatagtggtacccaaaaaccaaaggcagtaattgtgtagaaagcaaagattttcatattatcggcacagacaggtctctgtattgtttttttttgttcagattcagagttggtttgtaaaaagactccctcgctctaatatactcctaggcagagtaggaaattgactaggaaaggatgtaagcaaacatcagatccatcgcaataaactttggcctacaccatgcatgagaatgagatgaagaaatccccaaaagatagataaggatgagcaagtctccagatgagagatccggctaagttttttttttacctttggcgaggagggagggagggctgttgggggttggtgaggatgcggcggcggaggaggagagagtggggtggaggaaggcggcgccaggcgagcgagagagagaggtcttcgtcttcgaggatgaggaggtcggtttcctgttcctcccactcccagtgggccaatgggccttgctgggctgggctaaactgcaagccggcccgatgagatgaacttcaccg

SEQ ID NO: 23645 - DNA, 14816 bp, Oryza sativa
  unsure (1)..(14816): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggtggtggatggaagacagcatatgaggttgttcttcagttggtcacccaaggtaatgcagaatcagttctgatgcttctaatttaaacaataagctacttctaccaatctcaaatgccaagctcatgatcatctatatcagtgaaaaatggtgtgggtcggatgggtgaggagctggaggtgcgtggatcacatcacgtgctatgtgatatagatagtgtacaatatcacatctctattcctaagcacaagacacttgctaggtttggcactccctgagttaataaaaggaggccatcatttcgaatttccaaacatacgtacaatacataaaatcagaaactctccatggagtagggttaaccttttaagcttctagattctaagagacctcaagcctctgatagtctgatactacaaagatgctgaagtcatttttcatcagctactgagagaagaccaacttttccaaatatggccttgaagataaacctaacttgatatagcataataacagaaatatttatacataataacgacagcaagcccataagaagcagttcctttcccagcagattagcagggatcaaatcacttaatttgcatctcctaaataaactgaaccaactctggaaaagttgggaagcgtgtactggcccgcaactgcgtgttcgggaatatatgaataatatggaaaataacgtacaggtttaatgccattgagaaatcctgaacaaagtctttcagaaaattggtcatgtaccacacaaatcttatcatcgtctaagctaaagattggaagtcctcaaaacaacataactaattctccctttacgaccattttccagagttataacatacagtccaaattaatccagagcgctaaactccgctaattgaaaaactggccacttagagcaagtttaatagtatagccaactactggctctaaaccatctataaccaatttaatagccaattcatataatagttacctataaacatatactacaatattaatacatggtcccacctatcatacacacattgtgtcttggagctggctacatatctgtagcccggtgctcctctctctcctattttatcttctcaatatgtgtttatagctagcttatagcctactattttacctgctcttagcaccaggtgaaaatacagatcaaaacaaaaataaacttcactaacaatggaccagccaaatgaagaaagacgagaagaacagaggaccacagccaacagtgggaggaaatggacaaacaacacgctaagcgagcaccaattcgtaccagttcaggagctaattcaacgttaatgttccatccaatccacagaatccgcacgcggaatgacgcaatccaactaactatccaatctactacaagccaaaaacgcggacaaatcgaatacccagatcttcagaaactcgtatgcatcgctcatccatcgtcagcgtttcttgccgcttctaacgcgtcggtggcgggcaaatcaatccatccacagtacgaaaagtactactaccaacatccacaaacagccaaacgtacctgattttgagccaacaaaacatgactgatattgtcttttgaccagcagaatagtcagggggtgagaacccaagaatcagggacgagcaacggcctactgtgaaaacgaccgcacaaaagtcttgaagaaaataaaaggtggccaaaattaacaccccaagaacgaaatcacgcgcctgaaaagttggcaagaacagatagatagatagatcgatcgatcgttcgtctaaaatgcaccggaatcatcggatcgaacatggaccaaatctctttctaccctaatctccctctacatatttcaaaggatgttcccaagcgcatagatgaaacttctctctcttttttgaaaaccttaaattgcggatcaagaacaatagatcaagaagaggaaaaattaaaccgagagatcgaggagggaggcagggaggggattggagacacgaatgggaccttggtgtcgagcatgacggcgcagaggatgccggtgctctccatggcggcgcggaggttgtcgagcgtctcctggtggtactcgtgggatccgtgggagaagttgaagcgcgcgacgcacatcccggcgcggagcagccgcccgatcatctccaccgacctcgacgccggccccagcgtgcacacgatcttcgtcttgggcctccgccgcatcacccccgcggctccctcctgctgctcctccatcaccgccatcctcctcctcctcctcgctctcgctggatctccccctcgacttggtcggcggcggcggcggcggaggcggagatggaggtgggtgtggtttcctctttcttcttcttggtctccaagaatggaggcgagatgggggaagggttaaataaataaataaatagggttgggcgaggtgaaattggaaagggaaccaatgggtggggagatgcggatgcagcggtgcggtgggttgggttgggtccaacgggaaaggcctccacaatgtcggtcaaaactgtggggaggtgtgggccgggggactgacaggtggggcccaccccgggtgtgggtgggggctggtaaaaagatctccaggaataggatgtttcttgactggagggcatatttgcccagttgtccatccatgctgatgctggggggcggtggatacaaccaaggttgtctctcaggatcgagataggaagtatcattttgctcaaagtaatatcgtatcgtagtatcgggatactatgagattttctttttttaagtttaattaacatttatattaattatatatatagccattctatataaaaaaagtagtaatgatatatgtcatgcaaatagagagacatttatcaagagaaaccatgttggttttgatatatttaactgattttcatataaatttgagcatatttagttacattattttcaaaccatgttattttaaataatattttgtagtatcctagggattgtacgtttcggcttggtaggatcgtagtatcgtaagatactgggatacgaatcgggatactgacaaccttggatacaacttgctgccgttcgatctcctcttttggagatattttcagcgcatgtaaaacgagaaaaataattaatatataattaattaattattaataattataaatttaaaaagtatttatttaaattttttaaagcaatatatatatatatatatatatatatatatatatatatatatatatatatatatatatatatatatatatatatatatatataatttttttaaaaaatatcatttaacagtttgaaaagcgtgcaaaccaaaaacaagaaaattaaagtttgaagttgaagaaaacttggctttgtgttattttgtttgatagaatgtttaaatatattttgcattaatttcaaaatattaaaatgaaccaggatatgatgtttctaatcacgtaggttagtagtatattttaaaacagagggagtaataccttttatgtccgttcgagcacgtaaaatgagaaagccatttgtgtataattagttaaactttaatcattttaaacttatgagactatatttatatgatattttacaataacttatatataaaaagttttcacgtaaattatactgtttaacagtttaaaaagcacactaccgagtgccaaaataaaatatatatctttattaggggcatttaacatatcccatccacagaaatggtgttctcaaggaaaggaaagaaaatccactgaaatggtagtacatctatcatatctggtggtttgccctgctggtttccgttggctgtctcctgcaaaccgtgcacgcgcgccttgggagcgaagccgagtcgcacgcagaaattgaccgggcgcgtcgtacgacacacacgcagaaattaaatgcgtctcgttctagaagagttggagtcacgggggaatttctcgtcctctttttttgttggaaactttgaacgtctttgaacccaaaaaaaaaaaaaaggtcggtgggagaacaaaatcgcaaatggcttatgcatttcggatatgattaaaagaactcttttgatttcaatctccatcgtacaaatatcaagtttggcaccatgatgttacaaccgtttttgtatttttgcaaatgtatagtgcttcagttgtcagttcgataaaaatagcccttttttaaaaaaaaaaatcggtggagcatttcgttttctctcgtgtttaatagtggtatagacgtatagctgtttaaagttaatataataaataatatgtccccacagccagcaatagcgccccacctgctggtcgagatcaattagtacttattctattaaactaaaccatatgttcagattctcttctcgagcattctctctttaatctatgctctttccaccgaatcaacttaagtcctgtttggttacatgggctaatgtttaaccctcatcttttagtctcaaattagtcctcaaggatttaaacaggtgggctaattttgagctaatgtaaattagcccctcctcgaaacattagcccctccaaggggtgctaatggggctaattttgtgtggggaacatcaaaaagcagctctctctctccttctctctcctctctttctactctctccaccttttagccttaaattataccatggatccaaacataccaccctaggctaatgtttagcctaccaattcataactaaacattagctctcaaaattagccctgagctaatcttccaaacagggctctatacatatgccacgcgtatcgtgcatccgttctggcgaacattcccaacaactatatataaaaaaagaaaagacaaaatatttaaccatcagcgttcactaatttaacacctaacctacatatggcttacacatatggtaaatatctaaaatgataaatagttaaaatgccataaaaatgaactagtactagtacacttggtccaaattggtatccgtctctttacgaaacaatgagcttcaacttcttttagaatatccagctatcaaaagctcgtcagacaatttagatttttcacctaaaatctaactaaaagccagagattaggtttcctagcttgtccagattcttaccagctgtttttaagaattttaagttccacaaataaacccttatattcatccctaattggagtaatccaaagcgattttatcaaatttcacagtttcacttttcaaagatttttccatttgtcctattagcaaccatgaaaacgaccaaaaagcacctaaaaatctaaatttaaattcggcgttgaattttataattcaacaacgagccaagcatacaacagcgcagtgcaataaccacaaactaactagctccacctactagacattctggagcagtgtaaaaaaaaaaaaacaggcttgaatttgatcagaaacagcagccggcagatgctacatccagagtgatgaatatccaggatgtagttcataaatatactattcataactcagaaacactcagattgttacaaacaacagtctagcatctttggggtggcatagaaaaattgagcaaatacgtttacagggaagagtggtaaaagaaaatctaccgacaaatcagggtgaggaatttcgcgatatcctacagcttttgttcaaaaatttttcttgccaaactaatgctgcttcggtggcaatccgagtgctgaactccaagaattccagtttcatatgctattctattcatataataaacctgttaaacctctcttgtgagtatggctgtatggtgagagttgttttccttgtagcaagttcattattgtctcaccccataatttagagttcatcatggtcacgctggttcgaagatgccttgagcttctgttccaattcctgttacattagcacaattccgtaagcttcaacctatattgggaaaaagaaagaacagaacaaattagccagagggtgagaaagaaccttcagtttttgttcatcgcaaagcgctggagtcgataatacagccacatacctgtcacatgaagtaggcatgtaagttaaagagtaatgtgcattttcaggaaaaggtggaaggtgtatgtagagaaatcaacatactcgcatctactaggctcatcgacaccattaagttcattgttcagcccgcatcgaagcctaacctgtatcataaggcaagccatattttattaagtttcaagacctgcaaacagaaacagacaatccatcttaagataacgggcacgaaggcatgaaaaggagaagcacctttagacttcggtcagggccattccagcatctgtctccatttgaaaattgcattactctgtaggattcttcaaatttgtcccagcgcctgacagcagaaaaaaattatgttatcgcacaaaacaactgcaaaatcactattctgagagtaataaagtattgcttaacataatggttctgtacttgtatgatgcatgcacagagttggaattttggagccataaagcaaacaagaaaacaaaacattgcattcaatcagctcatatacaaccttttgcagtatgtaaagctaggtggcctgctagctaaaactgagcaggagagttattctgaactctacgactctttgcaaagtggtataacccattattaggaaaaactgaactagacatctgcagagcaataataatgaaaacttagtacacctgaaaggaggctaacaaacataccccaggctggtggtactatgtccttcaacctgcgaagctttcttgaatggacataccttgtaaacatacctatcaataagaataacaataaacgaggaattaacaaaatatagaatggtaataaagtaaaccatggaaatatttacgagagagagagagagagagcgcatgtgaggttggatgactaatatacgtacttgccctccttgctctcaaagcactgatcataaaagtaatagaactccttctccttacctaataagaatgtattccttcaattaatttcaatattataggcctatcaaataatatatgaactagacataactctgatgaagtcaacatctagaatacctatcaactcatataattcttaaaaatgcattttttcacagtaatgaagctcaatggtaaaaatataatcaagcttttctttacagctattaatgaaacacactgctgtctagtgtccaccacaaaggcgttactgctgaaattggatatggtaacgatagaaaaataggagaaaggaagaacaccctcaacatgccttgcctgcatgagaggtgacttgaaagtgcacattcctgcaaatgctcctacgacttgagtatttattttccagtttgaagacaggtttttcaatgcacaagttaccattctgggacaagtcaaatcatgctaactgggtgatttttgctaagaaccatcaatattaaaagtaaaaaaaactggatggcttaggcagtaattcaatggtggcaagcgctgccatatataaacttgcaaggccattatatagctaacaagaatatacgagtgacttgtgcattcaatcaccaagtaaacaaactttcaactgacttaccaaagtcgtgttttagcttatctgtcagagtggatatcctagactgaatcttggacagctttgagcttgcatcatcatactccttccgaacacgagaagcctctaaaaaggagatcaataagtgacacagcatctcacatgatttttgaaggatcatagcaggtagaatacacaacctaccagataaatccacaggggtcttgaaaaagttgaatgttcgtaaaacattctgtacagtttgctgaattttatccagccatgatgcttgcccagaggcagtgaaatctgacagaacaaaagaaaaaagaaaaatcgataaccaaatacagaaaggagtcaaagaagagagatagtgggcaggttacatgaaccatatacctgaatggtcatcacctttctgatcatcatcagacttgtatgacgcaacatgctcatcatgatcatcgacatattcatcatctgattcatgtgagaagtcttcatcatcatatttatgtctgtcatcctcaacttctgaatggtaaccagcatagctgtcttcagcagattctggtacatctgattcatcttcatgtgtttcttctgaatgttctggcatatcatgctcagcttcatgctcatttttatcatctttactgacctcatcaaccttttctccagtccatctggaagctaccagacgacctaactcctctcttgataaaccttctgagtcagcaggagtggattcctacaaaatttatcaatacaagttcacattgcttcaacccttgcagtgcattaggaaaaccatgaaaattactgcttgtactgatatttgtaatgtaacaacccctggaaaaagttttaactgtattcaaccaagtacaattgaacataagggcaggaaagatgtgcaagtgttgtacaagtagcaagtgctggtgttggcatggcttatggggcattagacatctagctacgaatgttggtttattacacactgcagagatcatcagttggactaatccaaagagagagtcataaatgggttgttatgacataatcagacttgaaaacatttaaagggatttgaatccataaattcataaggcttattcagtttggaggaatttgaatccataggaataggaaaggtgaaggaataggaatgtttgcacacatcaatccatatgaatttttccaagaggtttgagtggatggaaaaattcctatatgtttcctctatacaacttgtacgaaagggaattttcctttggttttcctacttcaatcctataaactgaatgacactcataggaattaatccttaggaatccaaatcctttgttttttcctccaaaacgaactattagaagggaaatggcttggtgcacagggaaacaggggaacctgcatatccctgttagtgaaaatacgatggatccagcacattttgatgtttcaaaagttccaaaaacaaacatgaatgcagtgcacataaaattatctaaacctgcaaaatttcaatttcaaaatccattgtattaagatccaaatttcattcttgtttaccgatgccattgaggacgagtatgaaactgatatttttgtatatttacttaattttcagagcgcaacatactacacacatggtttgcttgaatgtttcaaacacaataacatggcaaatttgcaacggaagtaccggttcttgggacaccaaaacagtcacataccaaagattaggtaaacaacattacaaatttagatttcagtaactatcattaatatgcatatgagtggctcatattccatcatgtagctcaactcacaacagcaaattagatttgagggctgttagattggcctattggagggatgtttacaaggagggcactaaacggtatagagttatatatatttaaagagggtatgcaggatatcagtttttgagttataatagagagaaatgcacaatacttttttgaaacaggttcaatccctggaaggaatatgctattattaatataatcaaatttatctctactattgcctccaaagaacagggaaaaacatatatcaaaagggcccaaagaatgactcagatgcaaagcagttattaagtcacctgctctttagtaggtgctgcagatgtctcctctggtggtgattcatcagcaggtgcggcttttatgctaatgtcatcttggctttcaggatcatgctgacatacaaacccaatatatatatggaaaaatccctcaatgtgatactccctccttccaaaagtctaagacctatttcattctttggtttttccaaaagtctaactcctatttgtagtcattatgtgctaaattaaattgttgaggaacccaagaagccattttaatgcttattggttgcatgttcattggttttgtcatatggtgaatgaattaattgcttcttggtcttggtgcaaaaagaaataggactcagatttttggaaggagggagtatgtagcagtagaattgttagtattttataataacgaagttaaattatacctgctcaacagatgactcgctttctggtgtgtgattgtcatggctcgtggcatgtccatcatgatgttcagctacctgtattcatcatcaaaaacaaaataatataaatatctctttatggcattgagctacctagttgtgcagtaagttcctacaattcataagtgaggaactgaggattagtacagcatagtatcatatgttaccacagtgatgatcatttttatgttctttatgactaaccattactggtaaattgtggggaaaaaggttataaatagcattgatggaacatccagttgctaggatacatggggactatccgttcttgatgtatgtatgtatgcatatggtatctctgttaagaaggcagtttaatggttcagatcatctagcccaaaacctaaaatgaagccaacaatttgaggctttaagtgccaccaagaaacttaaggttctgcacaattatgacataaatcctgtacttttcgataaaccattgttacaaaactctgtagaacattgatttatcttcttatgtgaatcattttgcgataaaaatgcactgaaaccattggaaggatggtagttctctcccaaagcatagtaatttcatgagtatacaacacatagctgcaccctattagacgtgtcaacatgctaacaccagcttaactcgattcaagatattaatggtgaggatgaagagttcatcagacaaaggtatatatggcaatctaacagatatatagaaagaatgctaaccttgctctcatcttcttgcacagtttcatgattttcctgagaatctacctcctgagaggcatctgacgctttcttttcatcagcagcttgcttttcggcttcttccttcatcctcttttcttccttttcttttcttaagcgttcctcttcctctgccttctctatcaatttcttttgttctgcacaacatgagaagtcatagtttaacacaaaataaactatccattgaaaattagcagcgccaacagcatttcccaacataacattctttggtaaatgactcaagacaaaccgccacgaagagcacacctgtgagcttgtcaacaaggccttgtagtattttctcttcacccttcagtttcgctagctctgcctcgtctttagcaaatgccacttttgccttttgaatttcctgatttcgaataacaactccgcttttatatgtagctacttttttcttcaatttatcccttgccgctttaccagcctcccagcacgtattcttgcaagtgacattgctatcatactcatcactcccgtcgcagcaatctaagaggcagcgacaaacacatatgggtaattagaaaaaaatatagcgggaattccctcaagcactatgtttacggaacaaaagcaccctaatctctagccttacaattgattttgtgtacatttactgtgtttacatttgaatgatacagagaatggccaccgattataatcctcttaccacagataccatcattcactcgcgacgagaagatcgtgatgggagaatgcccagcattctggcagtagaacttcccctccgggcacgccgatgtccctgcgccaaggcaaaaagtaaacacaattcgattaaacagctctcttagattgcctacagtaagtagattcgagctactagcacaaacacgagaacctaaaaccagaacacctccgcaaaaagctaaggcaaaaaaaaagggataatctttttcaggcgagagcaaggaagcaacctggctcgtcggtgccgtcggggcagtcgcagaagtcgtcgttgagcttgtccctggcgaaccttcccgatccgtccctgcacctgatcacgccgcccctgaagtacgcctcgtctgcagtgcagtgcagccagccacccccgcccccacaggcaccaaaacaagaaccgcatcaagcaccaagaaagagagatacaggcagatccggggggggagaaaaagaacaagatggaaccttgcggcgggatgccgagggtgtcgagcggcggcctggaggcggctgcggaggcggagatccggaggaggaggaagaagatgatcgcgtggagccccatggccgtgcggcgcggtggcagggggtggtgggcgacggcgtcagcgtgcgtgtgtctctcccctcctcctccgcctcccagggaaacgggaagtgtagcaggggagggcgagaggagcagtggtgccccgtcttcaattcaacacggggttgctgaaatttcttgatatgcagtttacagagcatgagattttaatggctgattgattgcagtttacagagcatgagattgtactgtaatccttccgtcccgaaatataagcattggattatacgattatagcttattcgattgttttatggttggtatggcgcgagattatccctcttatacatgcaggatatctaggttttctcgatcatcacattttattactgaaattgagatttatttgtttctgtaaagtaggcgattggctatttggaacttatttagattcactcaaattatacttatgtgctggattcactttatagttttcaaaaaaaaaagtcttaagttgatctatctaagggacagagcaggagcgccacgagtagtgtccaaggcggatgcacgagggggggggggacaagcgagctccatagttggcaatctttcctgctgccatgacaaaaagatatagacggcatatggactaaaaggatgagggagagaggatagagaggaatgaaaaaaatgattatatttactgtaactgacatgcaggtcctacttttttttcctacttattatgtcaagtaggcgtcacgtagacgtcatgtcaaatgaaaaccaaatcaaacatcacgtggatgtcacgtcagctaaaaatcaccgtctaaagcatcttggaactatatttgtactggttttgaaagataaaagatactcctatattggctttgttcggacggcttagctacagcagcattgtggctacgctgcagccaaccagccagtagctacaggagttataactatccagcagcaagcaacaacttcctgtaactatgtgtttgtgtagccgaacggctacgttgtacaacacaacttaaaacgctacagcaaagtcttaccgaacatgctaattgtatccagttttgcggttgagagatatgatttaaactcaacctataatgaggaaccaaatttgaactttctccacccgtaaacccacgtagggcatatgccatttaggtgggccttccccaaatccatgatgagcccagtagttggctgggccttcaatatgcatcatcagcccatcggtgcagttaggaacaaggtcactgtgtaaaaggatgtttggtttgctcccaaagtttaccaaagattgccaacttgccacacctcatgttagtcaagtttgaccaagttagtctattgtttagttcatagccacacttgtggcaagattccttctcatctgtttgggtcccacatgtcatcaactcaccaaagcgtggcacaatccaattttgctagctaagttgtggctcactttttgtaagccacaatttaggcaagtgtggcataaaaaatatggtgaatggtggcaaacttagtatagcatccaaacaacccctaagtacccctggttttgactggcctatcttttcgcttattcttatcagccaaaatttaaaattttaaacttaaattcaaagttgattttaagattttgttttcatttgcaaatatgttgtttcgcttatgcttaaaaacaaccaaccaatggatccggacatctttgtgtttgaggaaaagggaaaagagaagaatggagaggtatacaaaataaggtgagtcattagtgcatgattaaattagtattaacaattttaaattttaaaaaaatatttatatgattttttaaagcaattttcctatatttttttaagaaaaacaccgtttaatagttcgggaagcgtgcgcatgaaaaacgagataaatcttcaatctttcacctgctgaggaacgcagtcatattgagattcatatataaaagtagacttactttgagatgaaatggagggtgtatttttttgttgaaaaaaaagttaaatagcatccctttgcatgcccttgacaatttttgagcaggatcacattaagataatgtttaatttgatatgtatacgagtgttacatgtaatactactagttatacatgcggtactactaatactgtgtgcaaaattaattaattgtgtgataaactcaacacacgcgtttgctgcatgtgtagtattgtacaagtaggcgtatgcatcttcaccccatgaatcaacggtagatagatagcttccctgcacgaatctcaatgcg

SEQ ID NO: 23646 - DNA, 21559 bp, Oryza sativa
  unsure (1)..(21559): unsure at all n locations
cagcgccgccaggatgaaaggcaccgagcaccgcgccttcgccgccgccgtcctcatcgccggccagccaccaatccaatccaatcctagctagaggaagaagaagaagctagctagctaagccagagtactatggccagtgacgacgagctacacagattaattcagattggttgctcgcccctttatatagcggaagaagtacaaggaatgtgtgggttgctgtggccaggaagcagccatgggtgaggtagatatatatgtatgcaaagatcgatagatgagaggtcgcgaggtagaagaagggtcacatcaaatggaggtcaaacgagcacacaatcactagatcccactgacactaccaatgtgtacttagagtaattgtttagggtttattaccagcaagcaatatgtagggatgcggattttcaatctctacgtagggatgtggattttcattccttgagagagaggatatctccatgttctatgtatgccgcgttatccagaattttttctaaaaaaagaagatagaataaatcaatatgtaatatatttattgtacaaacatgttatcagggctatggataccacatacctaatagtagttggctaaatctcgacaggactcaccacataccatgttttatacggaaacaaccttcgggtatagaaggagttccggataaggaaagataaatagagttctacatagaaacgacaaggattactcggattgtatccatattggtttccctagttctacttggaaaagggaacacgtatgggtataaatacaagaccccctaggaggagaggggggacgaaacaatagatcaagacacaagatcaacatataagctaacatgcaccaagacaagacgccggatatcgacttcagagataagcatggctagtcccctacgatgtctacggatactgtcaggagagacatagcgctgtctttgatctcgctggatgcggattcgaggaggaaggctaccctggcgtcgactacgagtcagcacttcataccgccaagtcgacaacagttagataggctaccccaaatattgtactggtgtgattatggtgaataaaagcaacgaccggcttcggccaacaggagtagggttattacctgacaattcaggggcccgaacctgtataaaaatcctcgttcccatctcatttacctcaatcttgcatatatcctaataccaacgatccccatactatgcaaataccgtagtcgtgacatcaaacgtcgacacatgtaaattcaacttggacaaaaaaaagttgatatttctcatttatattgatctaccatgttatgtttaaaataaaaaattatttatgacaattggatttaccttaaaaatgagagcgaaatctccttaatgaataaagagttttccgctattgtctatctagtacgaatatgggacatatcgagaatcatagttctatcatatacttcatccattctaaaaaaaaccaattccgtatttagggatataggatgtgacaacgaatctgaatattcgttatactatatatgttatatcatagtatgaggttggttttttatttttggcggagggagtattagctaggatatttttagttagagagagtactatagctggtagtagactactagctaggttaggcttaggtgtagaatcattggtctttttggcgcgaaaaggtggggtcgtgggcgtgcactccactaacacacacaagggtcgatcacgcgcactagaaatgggcgggattacggccacgtatatacgaccatgcacatacatgcgtcgttgcgtttcactggcatccactacgatccaactgtttaattgcgccgtgattatctatcaatctatctaatcttggctggaatttcatcgatcgaaaagccaacgagctttaattagtttggccatggagatcgatcagaaataatggaattagtcagaaaataattaatggttaattatccagtggatgatcacacgttttcaacgtcgaaccatctcgatcgatctgacatgcatgtatgatgtattggtggcagtggatctgtatgtttgtgtgtgatacattaggcatgttgagatctccatgagagataaagcatggtgatctgatgacacagacataagcattgacctgcacatgatcacccttagctttatgctggattgattgacgggcaagtacagaaaaagggaaagccttataagtaatttccgaccaagatctagctgtttggcaatttggcatacattttctttaagaaacacgaacgcctcgtcgcccaaagatacatcgtttatatcattaaaaaaataattagacataaatgcgatcactcgtgtcaagtctaaaacttgaatccatgtgggctgagatttcaccaaacctaatcagttgagctatactcacctcgcaacaatttggcatacataattttagttctcttcatcgtaaaccgtaagtatttttagagctgaacgcatgagtattaataagaaactacataaaaatgatcgtaggaaatcacgattagttgagaagataaattagctaaagaaattaaataaagaataattataattgattgagatgagacgataactagagaaatagcttcatttcaaaacaaagtttaagtggtagaaatagcaacttctgactatatatgtatctagacattcccttacaaatacaaaacagaagaatattatattttggtacggactgtacaacttcagagtgagttttttttttcttttgaagaaatctctgaaagatatcgtctcttcgatcttgtctgaaagatatcgtctcgcagctgcaaagaaagttttctgacggctgtttcgtcgatatatccgggctagctccatgaaaattcaaggagacgcacccctgccgtgtgtgaagtgtcggtcggtatatcacatcatatatatcagtcttcaaaagaaaaaaaaactccctttaccccctaagggattttgacattttactggtattgtttgaccatttgccttattaaaaaatagaattattatttattttatttgtgacttattatccaaagtactttaagtacaactttttattttttatatttgtacaaattttttgaataagacaagtgattaaacgtcacaagaaatagtgaatatcccttatattacgatacggaggtggtatatcacatcattaattggacatgacctaatttctttcggccacggaatttatccaagccgttcatactgctaaacacgtgtggcaattagctgtatagctagctggagtagtactagctagaaccgttactaccaaacacagatctacctttaatacagatcaggcatgatcgagatcgagatggttaaattaatctctcacttgagagtcaaaccacttgcaaaaagtcagcatggaaagaaaagacgataaagctagatcgacacagtacatatatcatgttcagattgagatgatcgatcgaagagacggcgacgatatatatgtatccaatctagaattaattagtactcccttccgcttcagattataaaacattttaactttagtaaaagttaaactattataaatttaactaattttataaaagaaagtagtgctgctattgtaaatattactatttttttctataaaattagttaaacttagagtagtttgactttaacaaaatttaaaacatcttataacctgaaacggaggaagtggtaagttgcaaccggattaattattctgcaacacacttttaaagatacgatttttatttaaaaagaactttcttctgttatatacatgcatcatgcatcacttaaacgacagattatatttaattagattgctagattgattactgatcgaataagatgcatctcttttcttttattttagtgtgtgttccaaacttaacttttcgttagtgcccaagacccttacttgtaatacgagacactatatatagcttctgttaaagatcagatatcttatttcattacagaaagaaaaatattttctatataattaagtagatatatatgatagaacttttcataaaaagcgctagcttagacatgcagataaaattaaacatacatagtccatgcttagtccacacagtgagaatccgtgatacaagtacagagcatccgtagaaatgggcaacttgcaagtcgtgtcgtcaattcgaacagatttatgcgaggattcgggtatttggcaagagagagagagagagaggcgccacctttgatttttgctgctgctaattgtcacacacacacatacacatatatatatcgacatagtgtgggcccggatcctctgcaataatacagtgaacaatgtgagaagcaagataaatcaatgcagtgaacaatgtcgatctattgtagcaacagtaacagttgagtaccacaacagatttactgtagcacactatctgattcttggtttttgatcgaacggtctccatttcctctaataccaggtacttcctctgtattgtattttaatgtatgacgctgttgactttttaactaacgttcgaccattcgtcttatttaaattttttatgcaaatataaaaatacttatgtcatgcttaaagaatatttgatgataaattaagtcacaataaaataaattataagaataagatgaaaggtcaaacgtttgtcaaaaaaatcaacggtgtcatacaggatgcagtactatagattctctacattacaacttgcaattcagataatcccgattcacacagtatacgtacgtacgtacatatcgatcgcggtggcagtgatgaagctatagtgactgtagtggtggtggtgcatgcgtgagctaatcactcgcactgttagccacacgcatatgcccaacccccacacacaaattaaagtgcctctcgatcgatcgatcagtctctcaccacatcatgcatctcttggaaagttaattagttttgatacacgcaatagtccactactcccactgcttgtacatcccagcgctgcagctaataggttgccctaaaataaatcaactgttacgttctaaaataaatcacttttcaatgttgtctgccgattccctcgtcttaaaataaataaaattttatatattaatttaaacattgttaatcttctgtctcaaataaatcatttttttacatgaatctacatagaacgaaagaagtactccctactaattaattatcccattccttactaggttatcgtattttgggacggaagagtagcttgtattgcagattctaatatgaactagtataatctagttactacgagtatactctttctgttttaaaataaacgacctaaaatatgattggaaattacatattataacgaatagtattagataaagtatgttgtcacatcttattcgaagttgatttattttgagactaaaaaaagtatggtgtgtgatctttcgtggaatcatcccataaaatttaaggaatgatgattctgtcattcatctaacaagttagcatgtgcttttgaagaataagacagtgatggatcgacaaactcattctaatcctcaaatcaaccaacttgtcgatttaaagtggtgaatttatcatcccactactcgaatcaaataggccatatagaaagacgacatgcacgatataactgagctagctagcttgaaccaggacggaaatgctatatgtatattagtatatacagtataattaatgcgacctacctaggaggataacgaacttggatgacgtgtacatatgttgcatgctgagatacgtacgctacaagatcgctatatatattactatggctgtgtgtttagttactttcaaacttttgacttttctatcacatcaaatgttttggacacatctatagagtattaaatgtggacaaaaaaaataattgcgcaatttacatgtaaattgcgagacgaatcttttgagcctaactacgccatgatttgacaatatggtgttctagtgaacatttactaatgacggattaattaggcttaatagatttatctcgcagtttaatttacaggcggaatatgtaatttgttttgttattagtctacgtttaatattttaaatatgtgtctatatacattaattttttttaccaaaatagctaaacacggcctatatggaatggatggacacagaaaaaaggtttcttacgtctccttcacttttcttacctcgatcttgggaacttattactccgcacctataaaaaaattactgtgttcggttgtactacttgggaacttatttctccgcacctataaaaaaaataagtagctcattagcatataattattaataattagcttagatgatatagaaataaattaatatgacttttaaagcaacttttatatagttttttttaaaaaaaagggtatcgtttaatagtttgggaagcatgcctatacttttattcttctatttgtgtcaaaagttttagttttttaagcaagcagcatattattgtctctcttgtgctttaacaaatccgattaaatctgaatagtgcaagccgcataatatgtatatggagcatgcatgagatgaaatgaaggcccacctgccaccataaaaaaccatagaaaaggacaatgccttgagccgggtgctcgatgaatgatctaaaaatcgggcgtccacctcgcctcccccatacactactatccatgcacacgcatgttatatcatggctataaatgcatgtccacgcaagtttttatatctcatttgcacatttttgtgtcttcttcaaatgtattttcttctaaaataattgttcattctacaattcgattacatctttatattccttataattaaacctttataacaagatatcacacgattatattttgataaaaaattgaacgttgtttcaccccttgaaaaaaattgttttagtttaccgcataaagtgtttcagagaaatggtattaaaaaataccaactacaacaccagtaaccacctagtatatgaaaacactaagtcccaacaagcaaaacaagaaaagtcatatgaaagatacaatatatttgaaaaaacatgatattgttaaaatatttttatatcacatatgaatattaagttgtaactatcgaaacactacaaaatacttggtgaaacattccaagaatatcatgtgtaacatttgcaaataaactagtaaaacatcatacaatactagttgagactgtcacatctataaaacatgtgcaacatttaaaaaatccatgaaaaaaatctaaatattctttttatcgaaatataaccatgtagtcgtgtcctaaagatttaattgcaacgaatttagcgatgcaatcggatagattggagaagtaatttaagtggaaaaatagtttaaaaattgctaaagaaaaacttatagcaacccaaatactaaaacttatactgacttgtttctagtaggctctgtaggatgcatctatgccaagtctctgacggagtgatggagactcaggcgggcgtccgattcttagctacaaattggacgctcaatccggagtcacgtcccataaaaaaggctggtgtggttgatgtagcacgcaaattcggatcaaatggttttgattggcaaatcgggggttggtttaattacctacaactttttttttaaaacacagtacagcacactcatctttatgaacgcacacacgcataccctacccctatgaacacctctagaagacgggatgagcatatgttgagattcatgaagtcacctcagacgcctcgttatcaacaggtacatcgcttagcactgtaaaaataattagctataaatatgaacacccgagtaggctggttctaccacttggaaccaaaccagttgagttacgcacaccttgcaatgacctgcaaattttgatctattaggccctcaataatccctcaataatgccaaaatattagtatgaagcatatgggtatgcaactctgtatatattcaaacaacaatttagaattcctagagctccatgtaagatttgttggaaagctcgggccgtcgcgattcagtcatctttctaatttcaaaattatgttaccgtgagataaacatgtagattggggtcaaatataatctcatagactagtatttcaacattaagtgactgtatagcttctgttaaatgcaaagactagattttatcagttttcttaaaaatatatactgcgatagttaataaattacgtttaatttagcacttattttttatattactaaatattttagtatggtagcgaaacaaacaaactagccccacatgacctaatcgaacaaaccatgcataccagccaagggaaaatgcaaataaatgggggcttatgtgagatcaacctcaaaaccccggtagtggtttcttttgtaccatgatgtcatcatcagtattcatgtatattcctccctacatgcactctattgtatgtgttgggcacaatgaaatgtggctacaacctagctgatgtgcatctcacaggtgtcgccacaaaattaaatgctgtggcttcaatctgtttatgctcttaccaaacaattagagcaagtttaatagtatagtcaatttaataaccaatttatacaatagttaccaatttaataaccaatagagtactacacaattaatatctggtcccacctatcatacacacatgtattttagagtccatgctatagctggttacaaatctgtagcccgctgttcttttctcttattttttatctctttgaaatatctttatagctggtttatagtccactgttgtagctgctcttaacagtgcctattttttcggtcacacagggaaaatgctctcttaattatgagtgtgtactactactctaccagtacacatgcatgtttgttagtgaccgaaatattccatgtactagctagctagtgggttttggtgatgcacagagccagaggtgcatggggtcatatatgtgtgagattgtgaagtgaggatgagaggaagcttccaggtttgttggaccatatcaatgatggatcacacatactccctctgttgctcagaaactctaacactaacttctcgaggttgagatatataaggagaaagataaatgatcaaaatactcctattgaatggaacatttactagtacctgttcagatttagagtactaggaaatatcttatccaatactatgttcttatattttggacgaaggtagcaataaagttataatcaatgatgtgtacgtgagggttatataagagatagaatttttttttaatttacagaccaatagcagataataatatagaagttggtttattttaggacaaagttcaatctttagaaattacttcatccgtttcacaatgtaagtcaatctagcattttccacattcatattgctaatatgaatgtggaaaatactagaatgacttacattgtgaaacggatggagtagtttatttaggacggagagagtatttcattatttacaacaatgttaatagacgtcagattaaggtattgttgcaattgattatagtacagttggttagttttttaggctggaaccaatctatcttggtcaagggtagattcagtgtgggtgcggcagaaagagagaatgatgaggaagaagacgtaaggtggtgttggagtaagaagcaaccccacaactgatttcagcttaagcttttaattcagatgcttaaatttatagctaactatttacttttaaacgctggatgatatattaaaaatgaacagcaaactaataaatattatttggatgataaattaacaacaaactaaatactgttgcctgaaccgtaaaatcacttcctccacatatcctccctctttcccttacgcattgggctatgttgggcccaaatgcttgcagagctttttaattccgaagagactttcaggttggaaataacttatgcagcattttggttggaaataaatccaggccaatttatattgctaattaaattatgtggcaccattaaggcctcatttggtccagaccaaatttctggaccaaagttattatacaatgaataatcggtgcgtacgctgcatccacatcatacaatgacagatcaaattgatggaatcaaattgatggccacaaatccatttttttagataatggaatgaaatagcatcccggcttttaatcaaaagagctacagccaattattacaaactagcactctgtaagagtgaagtccaaatagaagcaaacacaccaaccaaactagacaaaataacattattccagtctattggtaaatctccatccatgattggcaaacagttgcataaccgtcacttcaagcttacgacatgcaacaattaagaaatctgcatctttatcacacttttgtaactgtgcccacagacgaagccaatatgttgccttgaaaatgacctgcatataagtaacagtaggtgatttgtcaaaaaccctatcattcctactcagccacagagcccaacacaaggcagaagctccaacaagtattagtttgctctttttgtttacaactccctgaagccaatcataaaaaatatgagatatgctagtaggaatatataaaacaaaagaaaactgaactgctctccaaataaacttggccacaaatccatagatcaatcgcattattggcttattgcaccttatacaagtacagaaaactataggcaccgaattcatcatcatctctcgatggactaactcatttagtatttgagcaaattgtcgcataaaaaatatcttgaataatgggcagtgcaaatcagcaaataagaagcaaagatcaccgttgaggcatgcactagagacactccatttgttcagcttgttgcatttgttacatcaagcttataccaaaagaaaaattcgtacatatttattcacttcttattaatttcaggctttcagcaaagatttatgttgtccagagaaaattctgctcatatgcagttctatgcaacttatcatgtcagtcattttctctttctgttttttttttgttctttttgaagtatcattatgtatttatgttagtttgggttacaaagaattctgaattcctgaatctgacgacaacttcagaactgacaagtgtacactgttgtttcttttttctagtggaagttggagtaattatgagttctgtccatcatcttctcctctatccggatgatgcatcaattaagtcaactgctacaagactcgttcttcgtgaaaacactggaagataatagagaaatctcgtcttgttggcattaaaggaaaagccaaaaatgtgggttgccgaggctcgttcaggtttcagaacttgcttcgtcagagtaggataaaatggctgctcctctccattttcataatagaaaatcactagtacattgataaagtattcatcatgtcaattgtccaaagaaaatctgctaatatgtacttagttcctgaaagctcatcctacttgttttgtcagtcaagggtctgaatgcctgaatctgatggacaagttcagaactacaccctgcaggtgttcattgatgggattcattgcttaaactgtttatgccttcagatatttcagaagttttactagcatctagttggagctaaatcttggcttctcttgccctgtttccggacgatgcatctatcaattgccaggatgaattgtgggttatgaaaacatgctgtctctacgcgttcttttggttctcagagacagtctgtctcctgattttgcattatttaggattattgtctggtttgctaacatgttaaaaacaaaagcaatgcagcctctgaatatctagctgagtggtcacatgctgaaaattcttttcttctgtgaactgtgatggttctgacaaaatttctttatgatctagctgagaaggaagttaacatggcggcctaacatgttcaacaggtgattgagaagttctgcccttgcatcaagattctctctgcacaagtaaatgcttcacatggcaacataacatttttcagacggtgctttcaatcctcatcttcccagtcattcaaattcccatggcctactgaatgcttccattaggataagaactggactagcttagccactgaacccatggttaattatgaatgctttggtaactactatggtctagtagggcatgtggacagcaggtgaagggctcaaagattcagcctcttgaatgggcattgcaaaccagatgcaaatcaaacataaattcagagtcgccgccaaggcacagagcaactagattactcacctgaaaaatctgaaatcttggtctactccaccacagtttcagacacttgacagacaggttacacttaaaaactcaaatccatataaacaccacaaatctttatcatacgtcagtaccagaacctcagagatggaaatttatcaaatcatctaatggtagccatcctgaaattgtacttattttttcactgtgccaagttgagtaaaggcttgcacaacctttaatttcccctgcatcaactttacttagctgagctgcaaagcttcttgagaaaaggccacatcttgcaaaatctcaaggccaaagtacagagcttaaatgcagatccatgcatgcaccaatgacctatgtaaagtaaaggacccggcttagcaaagagaaaaaggccagggttgggtagggccacacatcacatgatcattctgtactaattactcagaccatttcctgtacaaattactcagagcatctgctgtgtaattctgtacaacactatatagatcaatagatgcacttgagagaacttctaatccagtgtgtttattaattctgccgatctactccccccatttaaaattatgtcattctagatttatatgtatcatcaatttatagaaattcatataatttaacgtcataagatttatatttttatattcaccatgaaaagtaatttcgtaatatatactacatacatcccaaaatataacaactttcaagtacaaatctagataaaagtatgtctagattatcaccaaaagttagtatattctaggatggagggattaattaatatgttgttaaacataaaaacatcctgttaaaccacacaaatttaaaaaaatggttgttaaacttaggataaaactaaaacaataagtaattcgaaacggacggagtaattaaaatgaaggagcatcataggataggcatgctcgttattcagccgtgacttctgagaggttcttcaattcgctctaatttcattcatgcatgaccgaatggctattttctttttaaactaagtttcagatcatggaaaatagaattgtttttcttgtggatgaaaggtgcaaccagctttgtgtctttttctggatctaggtggcccatttgttggaggatcatttcgatcggctttggcttgtggtggtgaagagctgtagatcgatgcggatgtgtactggttactgatgtgaagttctcctattaatgacgtgacatttaagagataaacttatcgctttggcttatttatgctgagcattgaacacttctcgttaataaatttcctggggcattttctatttttcttgatctgtaatactccacccattttaaaatgtagctatttctaaaatttaaacatgtctaaaaaaatatagctattcctaggtcaatgctattatgtcaattataatcctatgaatccaaaaagccttattcgcgaacgtgcacacaattgctagcgaacacttcctgcctgtataacaacaataggttagggttaaggggtggaggggggctaagggggctgggctgtcggaacgtgcctacggcttgcgaacacgctcgcccattagacccaccctatgaaccacctcgcacccactaacctacatattccttcatgtcttttgtgttttaaagaaggcattgtggtatttttacctttattccttactccctcgaaaaacctagaaatagacattttgggatagaaggattatgcactacaccctccatcttttaattgtagttttagtcttagaattcgtccttaaaaatgtgtggttttagagtggtccactatacctctttaatgctactactaatagtaatctttttttctcatttgtagttattgaatcactacaaatcatttatttcggttttagagtagttgtttggaagaaagggatttgctctgtgcatttgattggagaagtacagaatcaccacttgttttctctcttgtccatacgggaaaatttccatgaagttttgatgtagcttcgttttcgatgaaatggtaggaaaagaagagaaaataaatataaaccttaggaatactattcacgaattcctttgttccaaacggcgcaacagtaaactcctccaagaggttgccctttctccatctcctccatcttcccatatgagcttttacttgttgaataaattaagagcttacataagctgattgtcaaataattaaaacaaatcatgagtatattaagaattgatgcactagaccttggattaaaaccacatgactcttgacagttgccttagcactgtcaagtactccatccgtattagaataaatttattttttggcacatcacatttattctaaaataagttaatttttaagtaaccattataccggagcttataaaaatacaagataaatacataagggtatcctaatatatttttgtattgatatatatatatatatatatatatatatatatatatatatatatgtgtgtgtgtgtgtgtgtgtgtgtgtgtgtgtgtgtttttttttttgtgtgtgtgtgtgtgtgtgtgtntgtntgtgtgtgtgtgtgtgtgtgtgtgatggattaaaaaataaatttattttagtacggaaatcgtactttactagcatccataacatcatcttgtctcaccattaaaagaaaacagcattatgctgtccccgggcctcgcataattgcgttgctcctcccctcctccctcgaaaaccaaaaaaaaaaaataccaccacgaaattatttctccttttcgttttcggaaaaagtacgaattaccccctgaaccacaaaaccgaacattttacaccttcaactatttttaccgagcaaataaccccctgaatcaatccggagtagttttacgcctacgtgtcagtcagtctagtcagtaattatttattaaaaaagtcggtggggaccacctgccagattctctctcctctctatctctttcccctctctctatctcgccgcgttgtgccgaagaactcctacatgcgctcgcccgtcggccatcggtggagctcaggggatgctgctgaagcacgcggcggcggccagcccgtcgagctcgccagccgggcctccacctccttgtcggcataacatcgcagcaagtcgctacgcggtagcggaagtactcccgcacggcggagctcgggcggcggcggcaagcccgtcaagctcgccggccgggcgtcctcctcctcgtcggcacagcagcacgttgtcggccgaagcactcctgcatgcgctcgcctggcggccaacggtggaactcgggcgaaagaggatgcaacgacggcggagccggagctcgcgcgcaggcagtgacgagcccgctgccgctgtcgtgctttctcacactttgtcagccacgcccggaaaatcctaacaacctacttctagctgccaacaaacactcagaagattggatcaaatcagtacacggaggaagacgagattttggtgccgcgtactgctgctgctacttttctggtttgttatcaacataaataggaaaactacatgcagactcgccatcttcttgtgggtgtcgttccaagacgatgagtccggccgccgcgctcgccattttctcgcgcaagtccggcgccggctgccgctcatcgaccatcgccatcttcttgcacaagtccggcgctgaggcccagctcgtgagcttgactggccagcgtccaccggcgcgcgcctcatactcggcctctgccgccaggaggctcgcagccgccggcgcgccgctcgtcctcggcctccgtcggcgcgtgggattcctcgtcggccttcggcgtgagagagatagagagcggtgggagaggaaagagatagagaggagatagaatctggcaggtgggccccactgacttttttaataaaaagtattgctgactagactgccacgtaggcgtaaaatcacttcggattaatttagaaggttatttgtccggtaaaactagttgagagtgtaaaatgtccgattttgtgatttaggggttaattcgatcgcacgatagttcaagtgggtaattcttattttttcctttcgttctcccccgcgatcgagcgacggcgaatccaatccaggacaaaggcacacccacgtgcggatgcctcgccatgccatgccggcgtggggcccactccgccagcgactgcgggtgggcccggataaaggtggggcccacgggtgggggcccgggggtggcacgtgggcgtgctggtgtggtggtggtggtggggccgaaaagctgacggcggcgaggcgactttcccgggctctccgttggccgtcgctgtcgctttatcctcgcttttgggtgtgggccccactcgctgaacgtgaaatggacgcgcagatcagatgtgggcaacgccaaaatatgccacggccacacgtaacccttacacaaatctcctgctctttttttaaaattttttttgaaaggttggttttttcaaaaacttattacgaaactagattgtaagaaaagcttcattaaatactatttttcggttgaagttttttttttgcacaatctagtttcacagtaagttttttttaaaaataaccaatttgtcaaaaagagggggggacacaactctaagcatagtagtggcggagctaaaacgaaatataggtattactatgcttgaagtgcacatatggtgaaaataaataaataaataaaattagcttgggttgttcgacatcccctagatacatatagctccgctcccgatattaggctcttgctccaaatattaggtgtagcataaaaagaaaaagaatactccaaatataggtgaggagtatatgcagaaattggaagacacgggcaaggttcacagtaccaacgaaaaccgatcgaattccgcaaaattttgacgtttcgacacggctcggaatcaagtttcgatttcgaaggttaaacagtagatttagtcaaaattcatcaaaaaccgtgataccgatggagctcaaaatttagtggtcaaccggtaatgtaaaccatggacacgggaaaatatgtcgcagtcgcatacggcaattttccgtattggtgtatttttatgtttgtcgctactactactatattatccatttgcactgcatttcaaagttgggcatcgctttaccacaagcgctcagattgtatacatactaatatatgctactcttagaaaattaagggcttatttagttggtgaaatgaaaatttttgggtgtcacgtcggatgtttgaccagatgtcgaaaggggtcttcggacacgaatgaaaaaactaatttcataacttgtctggaaaccacgagacgaatcttttgagcctaattaaaccatcattagcacatgtaggttactgtagcacttatggctaatcatggactaattaggctcataatattcgtctcgcgatttacatgtaaactgtgcaattagttttttctttttatctatatttaatgctccatacatgtgtctaaagattcgatgtgatgtttttacgaaaagtttttggagaactaaacagggcttaagtaaaactagtcatgtagtctctccttttgcaggacttttgatctagtttaagaacttttgtatatgatttgttagttagcttagcttttaagaaggttttgatatgagttaatgtatttacaaaatattgattggtctaatcaactatagatttagctaaattatgctatatttcttttaaaaaaaggattcactagaagcctcctgtgttttttccctcatagtctttgcccgtatcatgtaattcccatatgtttagccttaccgtttaatccaatgaacattgtttattaaaattctttatccaacagttttcgatgacatgaagtatttaggggctgttcagattgatgtcattttcaaccgtaccatttattgtaaaattatcaaaaaattaactacatttagtttattgtcaggctttgagaaatatataagaaattctgccaaaattttgataatattatcaacttgtcaaaattttaacattgccaaaatttggtaagatttattttagctataatctgaacaaccttagagtatcataatttaaagtgcaatatgaattgaaaaatggaaccccattgaattttgaaagtagcacaattttttttaattgctagagaggctggaagggcaagtcgaggagcaacgcaaacgcaagtgttctcaaaaaattaaaaacgcaaacgcaattagttcgagtagggcccacctacctgccaaaaagttcatgctctgaaattgcctcgtcaaaagcatccccgtgacgtggatccgccagcggctcacgtgaccggctgcagcaggtcgctgcccgttgtcaattcgggcctggttttcgaaaggacaacacaaaattcgggaaaattcgagttcataaatttataatatgattttataatttataacaaattggtattgtaaaattgtaagttcacgacacctataattacgtgtcagatcccttatgatttcatatacttagagcaagtttaacagtttagccaacttctagctctaaatcatttataaccaatgcaatagctaattcatacaatactccctctggttctatattaattgacgttttggacaagattgaggttaaacttttataactttgaccatcaataactttaaaaatatttagtttaaagaaactagaaaaacatatatagatttgtctttcaaaacactataataaaaataaacatgcatttatttattgtatatattataatagaaaaataaggtcaaagttatatcttatagaacgtgtcattgtccaaagcgtcaattaaaataaaactggagggagtagatgcttactacactattaataactggtcacacctatcatacatgtattacgtcttggagtccgtgctacagctgattataaatctgtaacccactgctcttctctctattcatttatctctttaaaatatgtttatagctagcttataatctgctactatacctgctctaatataacacctaatggttaagatttattgtctccatttaaaaatataaacgcttttagctgtgcagtgagtactgagggagtaacatttccctattacctggaaaagaccctcatgcatacacataatcacgcgcctacatcacacacacattaaaccttatgatttgaatgcaaggcatcctataattctatccactagtagtattcaaacttctaaattagactaaagcgaaatctgttttactattcatctgtcagaaaatgtattttataggttgtttagtatatattaaggttaagggaaaatatttctttactcgtctcagtggttaaaatttaggtaaattttgtaacaagatattgtggctgcgcggttttagatccgcgcaaagtgatttttaaagaaaggtaatctttaaagttagatatttgctggtgaacaccgtatccattaaaacaataattttcaggtgaggaagagagagtaatcacgtgaaacgtcaaaaattctcatgggcccacatgtcagctctcctatcactcttcctaaagaacttaacggaaagccgctaacgaaatctgttaggtgatggcatttctatgacaaattaccttgtacgataatattttataaaattcacgcttatcgatgatattttgtgaaatcgggtgtttgtcaatgacattatttgtattttctcaaaagagaaaaaaaatctttttagagttgaccggtgcagccggtctccctcccataccctgcaggctgcagcagcaatcaatcagaaagcgcgactcagctagtactacttagagcaaggataatggtgagctataaactagctaaatgcttatgtggaagagagagataaataaaagtggagagtgttgactcttacgcaagagttagctacacacaagctccaagaaatatacattaaatttatagagagataaagagagaggatgaaaaaaataaagctaaccttacagctaacattatatatgttagctttaacattaacttataataagtagtgggctgtactactaaacttgctcttagggtggatagtgagccagctcggctcggtaaagctcgttaggataacgagttggctcggctcgttaggaccggctcgttatcctaacgagctaaaaacccggctcggctcgtttaaaagctctagctagctcgttaagctcgcgagccaaaccatacaaaaactgcctctagccctcagcaacagccaacagcaagcatgcataatgatagtacgataaattgttacatgaaaatatcaaaggaggaggccgagcacgaggagcagcttcgacgccgacgagagggagccgaaggtcgacgtcgtggcgacgccgtgggagcggcatggggagaggaaggcgctgcagaggcctgggttaccggcgaatgacgtggcgttgaagtaggcgaactggccggtcgctgggacctcgccggagagattgttgtcggagaaatcgacggccgttaggctctgcattccggcgcgttgtgggacagattgagatagttgaggattcgtagcccggcggcaccgatggccatggggttggcggcgttgagttccttcggtggacggtggctgaggagtggccggatgcggcggcggcgccgctccttcggtggcgtggcggcggcgcttggcggtggtggctggctggcggcggcggcgcttggcggtggcgggcagcgagctggcggctggcgggtggtggtggtggctgccggcggggaggatgagaacgagagaaggggatggatcgggaatcggccacgccagatcgggatcgaggtgtcattagggttttcttggctgccgagttgggctcttgggcctccattctctaccaaaatccaattccaaaggcccatagctcatatgccctggctcgtgagcggctcgcgagtcagctcgattcgttaggaaaatcaaacgagccgaaccgagccgagcttggtcacgagcagagctagctaacgagccacgagcttcctccatccccgagcttcct

SEQ ID NO: 23647 - DNA, 10077 bp, Oryza sativa
acccccccgccgccgccgccgccgccgccgacgaggtgagccatcgatttcatccaatgccaatagggaagtagtcggagagaggaatcttttatctaactccctccccgctttggacgagatgcgacgcgcctcgctttctctctctctttctctcttttcctggctgctttttggggtatcgatgctttgggtttgctcttctagttcgtgtcggctaattaggagattgagaaatgagtttaaaaaagggattaattctttgccgccatggtgttcgatgcaaattctcaagcacattcttcttgttttttctctctccaaagaattcaaataccgccatggtgttcgatgcacggctctcaatacactttttggcaaatactaaattgacaacttttgcttagatccattttgtaaaaagtactccaaaacagcaaaacttttactacccccgtcccaaaataagtgcagccatgagtttcagcgccctactttgatcatccgtcttattttaaatttttttataattagcaattttgtagttataagatgataaaacataaatactaatttactcgtgaattatgtttttaattcttttcaaaaaattttcaaataagacgagttgttaaagttgggcgcggaaaaccatgactgcacttattttgggacggatggagtactattttggaggaactaaacagggcctaaatatactaatataactagagaaaagaacatttttttttcagttttagctcatttatttgaacaaatagagtgggtcaacggtatattagtgacccatgctaatccccaacctcatatttgttggtaggaaaattctgttctagaaaattctgttctatcctttcttgatttcttggcaacatttggggtaagattctgggagtttgattggcttatcttagctttctttgtgcaaagaaccatctttcgataaccatatgcagaacctagaatagatggtactaagtctgtttgtcctgaaacctgatagactggatagtccgtgcctttgaaccaaattgcttatcaggacttgatttcagtgcacttgcactctagtatgggttaacttttgttgccaaaggtactttttacgtactagtatatgagttattccagcaagcaattctggaaaaaaagaaaaaaaaaacagactctaaatgctaaattggagtctggaaaagtagtgttatactatgtactatgatagtggaactgagccttagttttcaaacagtagttgtacgtacctctgaaaaccgtattggtttgcaatttggtttcaaaacactggagaagggactctgatcagctctctgcaagaaggaactgaaaatgtgtcatatatcgtacatgtcgattgctatttgctacagagcaaatttgccatacatcaaacaattttgcatgtcaaactgactccaaagatgattttactaccagccttaaaaataaaatgcccactcattacttatttacatatgcacattgtattgttgctatgtaacaggtttgatactgagtagctctggtactaacatgtgaagtattgagctatgaaactgaagtaatgttttgctcgaagtgctgctttatgcttaaactcaagtgcgccagaaaacagttgcatagccacacagtgataacttgaaatgttaacatatggtatttttagcaaccccaagtatgaactagagttttacaagtgcaagtgaatactgagtataatagagaaaagatcccaacggggagaaattcttagtaacattaggcaataacttatcgcacaaacatggcgactctgattattcagggataacataaaatgatttatatttaactgaaggacattgaaactgcaacagaacattgtaatggcgatgtatcagttgtgccatcaggtagtttccgtgaccccacatgattcagctgaagctgaagaaagactttcatgaaaatttaggccagtagcacctgcatcattttgaatataacatggcttatatgcctcataataattgaatacttgacactatcacactatcacagttttaacattttgctatacttttagctaaatgatccaaaatctctgcttgatattttattattttcttacctcttatgtataatccatttcaggtcatgcctaatttaggaaatggtgtaaaaaccaataatgacttacctttagtctcagacaagcttttgattgtcaaaggtattcctttttgtcccaacaatagtaagaaaaatgatttacaaggcatcagcagaccggatggaagaatagaaatcgattccatgactgaggatgttaagactgagcctgatggatctgtccctgagaagatactcaagaagccagataagattctgccatgtccacgctgcaatagcatggaaacaaagttctgctacttcaacaactacaatgttcaccagcccaggcacttctgcaggaactgccaaagatattggaccgctggtggagctatgaggaatgtcccagttggtgctggaagacgcagaaataagcatgtgtcaaaatactgtcaggcgatgatgacgtgcaataatactgtagctcctggagatgtttctgatgtggttcaccatcaggttattacacatggatcttctctccttccagcaacactgaaggaaaatgaaacacctacagaattcatatcagaagtaccaccatgtaagtcttcagcttcaatccttgatattggagagccgaatgatactgaccttgttcccttggcctctggtgataacaaggaagaaaaatcatgtgcatcttctgtggtagtatccagctgttcagagaatctgatgccagataatgcaattatgaaagagccaaacaacaggtcaggatgttgtaatggtgtggcattgcctttccctactggacctgctttggtgctcccctggagtcttggatggaacagtgttgctctcatgccagctacccagtgctcgatgcagcccgttcttgggttaaaagatgggataccctgcccgccttcatggccaccgcaactgatggtgccggccccaggaatctgtactcctgttgttccaatccctcttgtgccacctctgtggagctgcttccctggctggcctaatggaatgtggaatgcacaatgccctggaggtaatactactgtgctgccgtcaaccgctccaaacaaaatttcttgttcaggaagcagttctctggtgttgggaaagcattcaagagaagaaagcttgcaggaagaagagaagacgagaaattacttatgggtacctaaaactcttaggattgatgatccagctgaggctgcaaagagttcaatctgggcgacccttggcatcaagcctgacgataaaggcatattcaagtctttccagccaaatgttgcgaaaaatggcacggcaccagaatcgcctcaggctctgcaggccaatccagcagcattttcgcgttctcaatcgtttcaagagacgacttgaggagcttttctgtttgttttctgacataaggatcatactgctacctccacaggaatggtcacaatgtttctatccagtgtgatcttgagctcatatgttgctagagccagatcaaatctagcaactcaaatctggcagagttgccagtgatgaacttggttctgtggtaatgtttatgttgatcaaaaatctctgcttctccccaaggagagaattgtgagcttgtgatccggagctcaaaacatgctccatctgaaatcattagtcaatagctgtcgctgtgatggaggtgaaaaggataactgtgaagtctcttttttcttactttctttgaatttttagactggcattctgacgtttgtatatagcttctcaaaattcatgtaatggcttctatgttaacctgcagaaaatgcataattttgtaactggatggggatcaactccgtttggacataagcaaatcagcctagttatctcatttgcagcattgaaatttaccccaaactaacaccatatctgtcaataccattgggtcaaaatgaacacccatttctaaattatcaaaattcatttacctcactgaatcaaagggtgtaaaaaccctatgttgtgcacttgtgtggaggtgacagatagcatgaataaactgaagctaagaaactaaaaatacaaagataaatcagcttatgcaataggacaggatcatcgtagtgatagagtaagaggtaatataggtatataacactcttcaccttacagttgtgctggtcgacacaaggatgagaaacttgcatacatcaaacaatttatatttccttttcagtaaatgttagatgaacacatgcctacatacatacatcttggaggctaaacctatcaccttagtgctaaatgaatttactcgtatacacaccaaagaggcgaaaaacaacagaaaaaaaaagaaatttctataaaggagaattttctatagctatctccttgggtcatgcagacgtgtcattggaacttctgaacggttcacctgatttacattctcgaatttttctatctctcgggcaacttgaatatcactgggggtaaaatactctgtaaaggccttgattacaaaatgtggtaccattgctgcaacaacaatgataagcagcagtaaccaaaacaaacctgtccccattatatgaaagatggccctgaaatagttatattgagtcagtatgcaatcaatcaagaaattgcaaaaagaactcctatttcactttaggagatccattcaagaaaacatgatcatggtgctcgcattacatgatggatgtagcacaaacatgcttgcaaagaaagaggcatttaatctaactatgtatcaggacaacttttatcccttttacataggagatattgagaggtagcagcatctatgttaattttctatatatcttaatctgaacacttatccctctcaataaatcatagttaccacttgaatatatctctacttctcaatatcctcctaggaataaaagaactctacaaggattaacgtgaacagcaacaaggcaacacaaaatactacaaatgagaaaatagagaccacatactccctccgtactcataaaggaagtcgtaacacaactttgacttcttgtttctataaaaatatttattgaaaagtgatatatgtatacttttatgaaagtatttttcaagacaaatctatttatataatttttacattttcaaactcaacgacttgagagttattcatgatttatattcccaaggtttgacttaaacattatcctaaacgacttcctttacgagtacgaaaagagtactcaggagctcctcccataacagttgcataagctcaaaagtcattttacttcctaggataactgatattaacacatatttcagaaatttacagttatgaaatttacaaaatgccttgcaggaaagaatttaaaaagccattgccagttccaaacatcaggttggttactacatttttagcaccaaaacattttaaaaaaaagagggttcgcctataaataaaagaaagctggaaatgaagtacttacccatatccaggaagaaaccaaatggagtcgatcacaaagaggcaaatggttgttgctgctattgttccccacacaaaagcatgtacgatccaattccaccgaaagatgtccatggctagtagcatatttacaacaatgacaggggcaagtgcccatagatctcccagactagacatatctatcgtactttgtctatatgcaaaatatggcatgtagaaaacaaccagactttgccatagcgcttcgagcatattgaggacaaacaaatttacattatacttctcatccctttggccagatccatatagctttggataagctagtagtgtttccttactaagatccttgtcaagaataccaacaacaattgttggaagggatgtatatagcacagtatacaaaaggctactccattctgtgatagcagttgtcagagtgaatgctgtataaagtacatacctgagatcacaaaattaagtgttatattttggagacaatgtctctgaatattgcaaaaattaagaaagcaacaactttggtaattcaactgaacataaatagagtccacttcttttcactaggtcttactaacatgggggtttccacagtaacgtttagataattttctacataaaaacagttttttttttcaaagtgtgaaaacttcaatgcaaaagggctcttaccagaaaagaaccaagacaaatgtcgcattcttgtaaaagttgtagaggatcatatatgacattctttgataattccaatggccatgaactaatagaagagggaccaagaatctgaattggcccatcgcaaaatctgatgccattacagcctgccgtccttcttgaccactgatgccaacaccaacatcagccatttgaatcattgaaacatcatttgcacctgaacaacaaaagattaattagcatatatcacatgtacataaattggttctcacagaatattatatgccataatagcagaaccaggagggaataataccatcaccaattgctaaggtcatgtcatctgttcggtttttgataagtgcaactatccctgccttttgtaacggggccacccgacaacacaatacaacactacattctcttgccactttgaaaagctacacaaacaaaagaagaaagtccatgcatcaactatgattttataccaaggatgaaaggaaatgaaaaaaaagaatcatatttagatgagtacctcttcttgcaactctgtctcaagtatgtaaaccaggctgttaccatctacaattaacgcaagagttacaccagcagattctgatgctaattctggactctgtgtgccagttgaagcaattctgagcttcttaatcgttgcatgtgcttcctcgagactcctcttacaagactcctttgagttgttgtttatcacaatttgtgtcatgtcattggtcagcagtttacaagagtagccaatagaaattgctgtctcctgcttatctcctgttaaaatccaaacctttatgtctgcttgtcgaagagattctattgtttctggaaccccatcttgaagcttatcttctatcccagtagcccccaatatgcggatattgttctctatattggccgcaactgatcggagtaaatttccccttccaagtactgacgtgctagcattttcatatgccaattgccactcctcaaactcaggttgactcaattcacgcatgccaataacgagagttcttagaccaaacgatgaatatttgtggaggtgtgcctctgtagcacgaacaatgtccagatctaatgaatttttggtaattccaaacaatgaactgtccgcacctttcacatatagcttaacagtcttatcggggcagccaactatgacagacatcctcttacgatcactatcaaactcatgaagtcctaatatatcaaatctgcacatcccataccagaagataaattggaactataagccattcttgtaaacaagatattgaaaataaaatttacacataaagaacaacgaactgaaagaatggagcagagtagtcaatgtagtaacaaagcgggcatttataaacaaagctagcgtacttcgtacatatgaggtaactaagaatgccttttggaatagtgttattaaaaatgttagataaacatttggtttggtgaaaaatgatatggttttatccaaattatccagaaattcagctgcaaatccatatgcacatcctaaatttgctttgtttataaatgccagcctgttcaatgcagctccttacaaatttatggccctagtgcagatatgtgctcatcacaataactgggttcaaagtgataattaacttggttttgcctatagcccaggtgtttgacatggacttacagcaaacacatttaactctctacagttggtgattaaccaataaaaagagctccattcatcaaatatattcaaccaatatattacagtattggctccacaaactagcttactataataggatatgcaagcatgtctataaacacaaggaaaagtcaagacatgcacttggagagttgtaacatatctccaagaggtaagcctgataaactaagtactgaaatttcgctcatgtggggtaatgccacaaatcatttggagttggcacgttgcatcccaaaatattccaaattattatttttattttgaataaatattaactgtatgctaagaataggaataggaagataactagcaagatacaactcaaagttagcattcacaccagcaaaccaataagataagacaaaagaatgacgtcactaaacaccataaagcaaagtgcataaaacacttgtgaaaatcgttattgaataagttatgctaccaactgttgatgactatatgacattgcagttgaataaagttttgtaggtataattttccagagatgtaaacatcatggatcaggtagcacactagcactgtagcagacatccactcctagtcacataatgatgttgatacaccaaaattggtattagctaaattgcataatgccactaattattattgaaaacacactcatgcagagttgaaaattagcatgtccataaagcaaatgatgaaagactaccttacctctgtctgtcaccaaggacatcaatcaccacataaccagatgttcgctcaacaagcacaatgccataagatgccgcagcatacactagtgcctgctcatcaggggactcaccctgataatcaatcaacttttgcttagaatcacgagtatctaggacaagtggcacaatggtattacatgcagcaagagcaaggaagaattcgaggacaagctttgtttcctcatctgtgccaccacccctcagtaacttcaaaagccgatgatcaatcttgactgccatcttgggtgtccataggagatcatcgactgtccaaaaccagaaaataagcagccatactaggaaagttcaacatgaaaaccagaaatatacattaaagacatcgtacctacaactgagtatccgcatgaatctttgccagaacagtaatcaaccccccgaattgatgcacactggaactccatcttgttctctgtcagcgtccctgtcttatcagaaaatacatatttaatctgtcctagatcctcgtttatattcagggccctgcattggaactttgaccttgatgactcatcatacaaatctctgtcagcacccatgaaatatgcctgcccaagccgtaccaactccattgatatatacaaagagatcggaatgatgacctgatatacaatcaccgccatgaggaatgtaatgaatatctgcatccccatgccatagtaattgtagttcttccctgtcgtgtaatccttctccctaaagaactgggtgaattccaaatccccacggtgattcagtatccaaatccccgcgagcacacttgcggtcgtgcacatcccaatgagcataatggacagtatgacagtctcccggttcaactgtgtctccaaccggctccgtttcgacggcgccccggagctattaagcatgaccttggtctcctttccagcatacacaacaacccctatcgcccaggtggtattcttgagctcacatccacggagcacaatgttcgatggccctagcgagacacgcttgccatcaatctccaaattcgcctgaaatccatagatgttcctgtttggccgctcacaatgaaggacaccgccgattccaccgtcctgcgagaacctcagttgcgtctcctgcttagcatacctcgtcttgaggttggtctccccgtcaagattgacggtctggacgtgcgcgacgccggaggggtcgctggtggcgaggagcaccatgtcggcagggagcgtctcgctggaggcgacgcggacgacgtccccgacgcggatgtgcttccatttcttgggcgcgaactcccccgc

SEQ ID NO: 23648 - DNA, 20171 bp, Oryza sativa
  unsure (1)..(20171): unsure at all n locations
aggcggtcggctcggaggggcggctccggctgcggcggcgggagcagcgatgacgccggcggctgctgcgtcggccgcggcgaggcgtcgagcagcgggcgcccggaagccatggagtcggggaagccggagcgagcagggctagtgggccaccaccggaggcatggcggcgcgcggtggcgtcggatttgggcgggaggtcgccggcgacggcgaggcagcttggagaggaagaatcgagaggtttcggtttggaattttttggggaagaagaagaagaagcgaagcagaggagaggagaggagaggaaaggggttaggggttggattgtgatttctggagagtacagggggtttactgcgaagtttggtcagccgatggaagactactgtcttttgaattcgtgtggcttttacgaacaacggacctgttcactttatattcatttttaatttttccagaatttggtattaccaaaaatatttggtaagttgctaacgctatcaaggttttaaggactggttaaatatgatgatcaattctctaggtatgataaatatttagtaacaaactaaataatatcatatatttatcaattttactaaataatggtatggtataaaataacatgattctgaataggccctaccaattacaatcgccgttcgaaaatttaggtcatgtttttttagagaaaagtaagtgaatgaattaatttagatatctcaggatgaaattttcatgtattggaaaacggtgccttaggagggaagtagtagtaaacggaattatttgcttaccttagctatgtttttttttatttacgttttgcagttaagtcctactagtgtcgagttttctatgccagcgacgtcacattgattttcgtagcaactccgtacgagggcatcggtgctcctgaaaatattggttttatactctgtaaaagacgaaaaatttgcgaaaaagaacatatctccaaattacatggaaatatccacgagtttcaaaaaattcaaattcctataacaacaataagaaatcagcgtcctacaaggtaagttcaataatacatatcactctttgttctctctataatagccggctgaagtctaccatctgcatgtcatataataaaattttaaacaaatataaatcacaaagtgtttgctaaaatgttatcatcacattttatgactgattatagtcaagatctaatggctagttataagttttccattaaatttgcactagcattttctatttacatctatttacgtcaacttaacttacattgtaaatacattaaaattacatatataacttagggacttacgatgtatgtacgtgttaactatattttatgaaaaatacgacggaataaatataggtagtcccaatcacaaaatcaactcattaaactatttgccttccaaaattttcaacacgaagaacatgattatatagccattatgtcaatgtctctaccaacgcacggaaataataggttcttgcaggaggtccactatgcgaaaaaaaaaaagcgaccattcttcccgtccccctactgctcagccgtttgctgttccgttttgtgattggatttcagagatttccgacgggaaaaaaactgaacctgattgactacctgatgctgcgtgagttggtggacggctctaatgacggctggctctaccaaatcggcatatccagtttgggttgcaagaatcttcagtttttcctcgtctggaataatgcgggtcttttttaggggaattctcagtggcatggtcaaaagggaggaaacattttcatcatacaccgtgggtttttttttaaaaaaagaaaacacataacactttattaaatgacagcatttagggaattgaaatcccgaatacttcgcccatgataaacataagagttgaaccataataagagagaggttaactgaaaaaagggaagcaaacttcctaatgaaactaagcagcaatgaaggagcaaatcgacagggtactgcggcaatgccgcgacgactgcatccgagggactctattgatgtgcacttcgcttgacaaacccgtaaacctcttcggctgcctccacaggaacaacacatatgagaggtttgttgtgaagccgtatatcaaacacgatacaacttgttatatactcccaccatctgagaaaagaatgcaattgtacagtattcaaaacatgaattagcagggaagcaaaatggcttagatatctccccttaaatggggatggtaggaagtgaaagggtgattgtgatcaggggtcataatttcagattgaaatttccaaaattttggttctatcggaccccccctcccccggcgatacgatatagtttcggccattttcttttcattttttcatgaatttgataatattttattcaaattttattcaaaaaatcgtaaaatttcggaccaaaatttcagaaattttggccacccttgatacaaatcagcaaaccaaaacattaaaccctaattgtgatacgattaagaaaagtaaataactagtattttttatacattagagcatctgcgcttcttatttgattactaagggtctgtttagttggcaaaaaatttcgtcccttcatgtcacatcgaatatacggatacacatttaaagtattaaacgtagtctaataacaaaacaaattacagattccgctaggaaactgcgagatgaaattattaagcataattaatccatcattagcaaatatttaatgtagcaccacattgtcaaatcatggtgtaattaggcttaaaagattcatctcgcaatttgctggcgaactgtgtaattggttttttttctacatttaaatatttaatactctatgcatgtgtccaaacattcgatgtgacagcgaaaaaattttgtttggaactaaacatgccctaagattgaacaaaagtttgtttctttcgttgaccgtaacgtttgacattaattgtggaaccatgtaaaaaaaaatctctaatcacatgcccacatccttccttgcgcggccagccaactacggcagaccatttttttcatcgctaagttcaactaattgactctttctttgtggtagattttttttataggcaacagttggttgtcatagcgtgttgtgtttttttttaatatatggttcaattttacttatacattcgagatgcttttataagaaaagttctagtatgtattggacagatgaattattgaacttctaatatttattcatgacaggctaaaatgtattagtagttaattttatttgactttttagactaagtgcagttacttgaagggtgcggttgcctgtgcacgcacgaatgcttcggcggtgagtaccaccatctatttcactcgtccacttatcattgttgttatgtgactgtctgaatggaccaaaatgacatgattgttcacctagacctataactatcagtggtggattcagaaaatcgattcgttagtgtcataacgtgtctatcggtgtcatagtatgttagttatgcttagatcatagtgttataacatgtggataaacagtttcgctatagattttgctgaaagtcgtcggtgtcgcctgacaccgctcatactactgtagatccgcccctgataactatccaaggcatgaaaaatattactagagttatcaatctctcacccttttcttttttgcttatacatagtgagttcatctgagctttcacccaatactaatattgtgcaaaactttagaactgttttcctggtacgtaaccaatattcaccggaagtgttatctttattttctttttccaaagaaacaattggtcttcttagattttgttgatctaatggggaaaaggacagcaaagaatagaaacgaaaatacattgagccaacttgatatcattaacatattttgatgagttactgtcatgcatacttttaaatggaagaagctaagttgatgtgtttattagtttgtcctttctttcattgtcaattctttctcaattgacattctgaagcggtgaaaataaaaaagaactgcataggagcaggcaaataggtggcgtgtcctttcaagtttgttgaccttaattctttttaattatactaatcacttgtggaattagcggctttgctagatggatagcttctttccagaagcattccagaaaattcacgctctccactaacttcagagatactataaaaacataattcaaaaatgttttaaaaggttaatgtaataatgctcatggagtgacatctcaatttctatttaaaagtctaatataaaataaagaatgatgtacataacattttgcttctctaaattaattatcaggccatctatagtgcaaataaaaagtgtagttccccatatcatctaaacagcctttgaaaagagttatttttaatcttattttgatggttctaaaatcaattaattcattttaaaaaaaggatcagctcaactgaaataaaggatcaaagactaaagtattaatgatgaagaactttttcaaagatctatctactcatcaaattagttctccgtgactcaaaatttaccttccaagcaacataactccaaacaccatatttttttctgtttgaatttaaattttaactggcctctactgtttaaaagagatagtcatgctccttttctttctctcccccacttcctcctaaaagccacttccttcctataaaaattgattttaaaaaacctattatatcggctctgttcggctgcactcattttcattgtgttgtagccaacagccacattgttttctttgtgcaacagcacaactgctaaacataacagccgaacaggcccattataaaaaactaatcaacctaatatgtttaaaccggatggtatcccacgccatcgataaatgatccagatactacaaacaattaaggtgatgaagtgagcgtagctcaagtgattagattctatgtggttgaaccagtttatccgggttcaagttctagatttgacatgggtgttcgtatttataactaattattctttagatttgacatgagtgctagtatttatggctaattatctttccagcaatagatgcttgtggcgacttcttttgaatctcaagattactagcctagtcttctgaaagtgcttatgtgtgcgtattgtgagcgcatgtatttgtaccgtgtttctagcaaaatatgatgtagtttatgagaggagagttaggatgaacctctaaagtcctttcacagatccgttgtaaagcacgggcctataaataaaaagtcagaaatatcaaaaattttcttttccatggagacgatcgacaggtttccacagttccacttccacagcaaacgggtaattaactgggattaatttgccataagccgaggtgaggtgggccccaccgcagcccgcttcgccctctcccacttgctcgccttctctctcctctcctcttctgcttctcctcccagatctctctcccacaccccaccgccgccagcgacgcgaggcgggatcaggccatggacggcggcggcggcggaggaggaggcgggttcggactgggcggcctccagtggacggcggaggaggcgtcgacgatcgggggcatcgcgacggtgtcgctgctgcactccttcatccccacgcactggctccccttctccatcgtcgcccgcgcccagcggtggccgctcttccgcaccctcctcgtaagtcagtatcccncaatttcccccccgcttccctttccccaatctcgcttctgctgtgccgctttacgctactaccggcccnccccccccccccaaagatcttcggggtcagtggtgagggggcacgcgccacatttcttgcaatggcgatactctagtttggtgtgctcgtgctgacgaatttgttgcattctaaaaaaaacccaatgttctatcgcaaaactgaagttatagtatttggattgtggctaactgcttgatgctgtgggtttcatgcaccgattagtaagtttcgcccgaaaatcttgagctgttactgacgaattggtggacaatcgagtagtctgctcatagtttgataggtaaacttctgagtcctctactgtgatcttttcagtggggatctctgttccatgggatgtatttctgtcaacaatgtgtagttatcatgttttccaacttcagggccatgcgccttttgtttcgtacataacggtagttcaggcaatacaactttcactttgtgtgactacatgggttgaatacatctaagttcggtgctgcttcgctattattatatgattgcaagatgtgtaccgtatgtgagtgcatggagttcgatttatagactgcaagcctgcaactatttgattgatccaacttggagttacacaatatcctagttgggatgttgatcaatgattaattcctgggaacaataatgcaaactgaatcaatattgcatctttctgttttgttatgctgtgaatatgttattttgtcataattacagggatatgtgtatttcatcgcaagtatggggatatttttttaaatcagaacacacagaaaatttttgattgaggtctattgctgtttatatttgtgtagattgatcattggcattggtgttcctttatcaggcttacttttctaattaatcttgtaataatatttgcagcttaccaacctgttatcccttaatcttgcacgattgttgtgatttcagtaaactacgcacaatcacttcttttttctgttcaactgtgcattatcacttggataacaaaaagtgcatttgaatgaccagactcctaactttgtagttatttttccatcctatgttgtatttattgtctgcaaacctccaaagcttactgtataattttttattaaaaaagttctaatttctaaatcttataaaataaaccttttatttctgtttgattccttgttcatgtgttactattgtgctgttagcctcagctatgatacgcgtttagaaagttacttgtattttgtaatttcatactgtaccctaccccctagtattttctacataaattagtgatgaatactcatattacttttccatgttcttattctatatatcactactaataaaatatcctaacttccgcagctgcatttggaggcgtccttcatgttgtttccactgctcttcttgggataactgctgttactatggcaaatactatagcaggcgaggaaacagtgcataaacttgcatcactgttgctgattgttcttggtggaagttatatcctgctgtttgcactgggaaaaggtggccatggccatgctcataatcatccaatggagaagatggcagttgcaggtcttgtacttgtacctgcattatcaccctgtgcaacaactcttccagtgtttcttgctgttggcaattcatcctccatgatgatccttgcgatcattgtgctcctctttaggtgggtacccctttccactgttttcagttgcattgcttgttttctaccgaacaataaattgctatacttttttttatagccgcaacacattatgaaagagggaacaataatagtttatccttccactaaaataatgggattgtcttgttgagaagtttttctaagctcttgttaggacttaggagtatcacactctaggcttataggaatctccttgtattgaaaaccctttttttcattgggtcaaatcatcaaggtatcacctaccaggctaccatagatatacaaaagcacattgagttgggacaaaatgaacatcgaaatatatccttcttagtagactgtatgttgtggtaaagtagaaagataaatactcctatacttccatgtgccacctttccttttgggatgtttctttttcctcgtttaccaactagctaatgttgtgtttataactatggattctacaaatgttttaatatttaattcacaatgaatttgctcaatatggcattctgtaacctatatgaggtgtaatatcttaagataagttatgtctcaatttaccctttagttgatgtgaaatgttcccacaaactgactgctttacatgtatggaaacaaatggtggtatttgataaatatttagtcttcaacggtgtgcctgacaagattaatagattcttaagaaccacttacattataaccctttgaatctcctgagaccctgcgtccctgccactgttatgaaccttcaagggtgggtcttagcaacacctcagttgtgaactataggtccatctctatgttgtgcactctattgggcattccggtcagtcatcttgaacacaagaatagctggattgaacgttataaaaataccttgtgcagtgcaatgtatgatcagtaagattgctgaatactagaatagctgaattgagtgtttttgtgattcaagatttcccttgtgtgctttgtgttaattggcatgtgaatagatcagatatttatcaaaatctttaccaattcttctgtttgattgtattttccccacttgcagtaccatcacagtgatgacatccttggtggccctctcattctacggtgctagccagattaagttccactgggtggaacgttacgacaagatccttgtcggctcggtcctgtgcctcgttggggttttgacatacgtattccatcaccatgacggcgacgaacactctctccatgaacacgtgcaccggaaactcgtgggtctttagagtatagtataagattgcggatgaaactttcctacacttgcgagagaaaattgtgttgttccctaaccactgtaacgggtttgctgtatacagatctgattattaatccatctgaagtcagctagccggttttctggcaatgcaaaggttgtgctgacttgtgttgtagttgcctgtacatagaggtattctatcgtttgcttatgctgttatgcacccccaaaatcagaatactacttgcaaatgggaaacatacttgaactgcatccgttgaatttggagtatttggtggtaatgcagaactggaaatcagatttgattattgcgagtgatttactgtaatagttgggggtaatggtttgagattattacttccaaagtgtttgtttccttttcaactttgtttgcgacttttgaagtttgatcagatctgtatctaccgtaacgaatactgatcaaggccgagagcatgttcaattaattgtcagcaaacagtaagagtttaattaattaaaattcaaactcggtaatagatttgacctaagtaaaaaaaaattcaaatccagaaattggattccactatatgaactctcgtgaatctcacacgcgacagagaaatccaggccgtacgccaacgtggggtttagacgtaggcacaaataagtttttaggtgtatttgtaaataagcttttagaaagggacaaattgtaaaaaatcagttgttaaagaagctgatcaaaatgtgaaaaaaacggctgggaaatgaatagattaataactggtgaaggagttgatagagcgaaacacctcctaattagagtcgatcaagaagttgatcgaacgtttgaattacgcgcgtgtaaaaataggggcttcttccggcaaaagagagtcggatttgactgacctataaacacaaatccgatcgaattctatcgaaatgtattactcgaactcagactcagtttctattcggactcgcaggcgaaatcaaaaggctacaagcgccctattaattgtgatctaaattgaatcgcttcgtatacagttttttggatcctaaattactgcatcgcgcgcgaagagaagctagctagcccgacacctcttgcagcttcgtcttcgtcgtcgacatcgatcaatggcgcccggcggcgacggcgactactaccggacgctggggatcgagcgcggcgccagcaaggccgaggtgaaggccgcgttctaccgcctcgcgccgctgcaccaccccgaccgccacgcggcctccgacgccgccgcccgcgccgccgccggcggccgcttccgccgggtgtacgacgcctacaccgtcctccacagcgacgccacccgcgccgcctacgaccacctccctcgcaccgccacctcgccgcccacgagccgcgggagcggcggcgccgccgcctcgggtagcagctacggccgctgcttctctcggcctcagccgccgtcgatgaagctgcccgtaatcttgttcttttcgctcgtaaccggcaggtaattatacttaagctgatcagctcgtagttaatttcgatatctccgtttttatattgtaatatgttttaacttttttgaagtcaaaattttgttttagaaacttagcaaatatttacgatatcaaattagttttctaaatgttgctttattttttttataatctttgtcaaacttaataaaatttgattaaaaaagcttaaaatattttataatatgaaatagagggagaattagttacttttttctgacatatatttaatttgactgtgggagatcgaagtgggagtaataaatcaggagggagcaaattatgtataagcaaatgcatttttataaattgttctaagaatatatttttgtattgcagcgccctgcttgtggctttgtcaagaggaaaaaacaaagcagcaaatgaggtaaggatgagtgtgttctttatagtatgccagctgatcagtgtgcattcttgtgttctagtcgaccttcagaaaattaatactgatgctgtaaaatctcataatttttttataagtgtgagaaaataccaaattcaagagaaaactgaaatatgattttttttcacaaaattatgcattatagatccgagaatttaccaattttaagagaaaactgaactatttttttattcacaaaaaatctgcaaaatgtagtcttccaatcaaaagttgtttttaaaaaagagcgagaataaattaaaaaaaaaattcaaaatagggaccaccattgagaagcgtttgcatacctagatatctttttttttatatttgcgaatatgatatctacacattgtaactaaagcattcggttgttgttaaatttgttctccagggagcaacgatggcacagggaaattgatggattgatcaaggccttgatagactacgtcgattaagaagctgagtctgttaaggaaagaaaccaattaatatgatggattcatcatgctagcttgtctcttaatttgtgaaatgttcatggctaatgcctctgaatcagtattttatatacacctaatgtgaatttggttgatacacacagttcatgtatatctcatgtacaccatgtataccattctctcgccctccacctggcgttttttttttttgggaaattcattttgacctttgcttctaagaagttataaccaattattataaagtctacagccaaaacgattgcagaaatacaaaatgcatgttgatacaaaacaagaaaactaactacaacaccaacctaaagacaatgataacgacctctaatgctaaacctctctccgcggaaggcgaaaatccgcataatatgtatgtagttcttatcctcttaaacctttgtagcaagatcctaatgtcaataaagcggatacacatcgtcaccacctaagttctgaattcaaactctaagcaacaaagactcattgaaatctatgctcgattcttcaaccgaatgatcacctacatatcaccactaacgattgctcttcaaccgaagcagaagatatcatcgaaaaattaaataaactgcaaatcaaagtctctctttaccatagagggagaactagacgccgtcaccaataagacaggatgggctaaaactcagactctaggaggcaagcctagggtaacttgggtttgagccataggcttaccttcatataatcatgcttaaattctcttaattcacaatgtaattttttgaaaaaaattagagactattaaaaaaccgcagcaagttttttaagggaaaaactttcaactataactataactatagtataattataatataatttcactataactatactataactataatataacttgtatataagtattaactagaaaaaaatatccgtgcgttgcaacgggtaaatattattttaattctattgttgttatacggtttagctagggtaaaattcactgtgggaattcgcttggatatttattttttagaaaatcataagctacaattagtagtccatatttcatctcaagttagcatgtgagttttttaaagagatttcttatcttttttatttccaaaagcaaatgagcttaaaatccaactcaaaaacatatctgtatttctaaaaatgagcgaacttaaaaaccgactcaaacacggacgacgtatcaaaatgccggcaaaaacatcctcaacttttataagtactagaaaaatacccgtgagttgcaacggatgaatactattttaatcttattatcattatacggtttagctaggataaaatttactgtggaaatccgtttgaattttttttaagaaatcatgagccgcaattgggagtctgactttcatcttaagttagcatgcgaagttttttttaaaatagatttcttataggactccttttgtatttccaaaagcaaacaagcttaaaatccaaccaaaacatggatctgtatttccaaaagtgaacgatcttaaaaactgactcaaacacggatgacgtatcaaaataccggcaaaaacatcctcaatttttataagtactagaaaaatgcccgtaaactgtaacgggtgaatgctattttaataatattattatacgatttagctagggtaaaattgactgtggaaattcaaaattaacgggtaaggatgagtgtagctaagtgcacaatattagagttctcgtggaccttaacaaaattaatagtgatgctgtaaaatctcaaattttaattttgttatacatagagatgcaaaaaattatcaaatcaattagaaatttgaactagtttttttttcatataagtctgcaaaatatagtcttccaaataagagtaaactaaaattcaaaatagggaccaacgttgccatggatatgcatatgtagatatatcttttgttctttgcgaatatgatatctacatattctaactaaaaacgtactgtgtttcttaaatttattctccagggagcaaagacagcaggcaaattattgatgtaggaattgagcaaagccaaagctgaagcagtctgttgaagcaaagaactaaaccgattaattctggtggattctcatgctagcttgtctctaaataggttgataatagaaagtgaactcttatccttgctctaatacatcttaaatagttctctatacacctggagttgatacacacagctcatgtatctcttatatatacgtgtacaccatgcatcaattctcttaatattaagaagatataaaaggggtgagtaattgaaacgtaagaaaatgaaaattaaagaaagaaatagatatttactatctgtttttataattgttatctggcacatgttacataatgtaaagttttcttaactttttctcaattttttttctgtacacttcctgttgtaacgcacgggcacctttgcttattttaattaattacataatataaatttttcttaactttttctcaattttttttcctgtacacttcccgttgcaacgcacgggcacctttgctagtatactagtgaattttgattgagtggtttggttggacgcatcctgggatatctgtttaatatacagattgagttatatgttgaattatgttgcaacttttcgtagctgaaaagttctgccgaaccggaaatcctacgtgcgtaatggaagaaaaaaaaagggttaccgtcctaacctttcaattttcgaccttcactaaaaccataaattcctaaactttcttatcacgtgacctatcttatcattctatattatcgtgaaagccgaggcgagattttcgtggtcgctgatcatgaatgacacactgcgattttgggagaggaaccggcgtagacagtctgggacgttggatcaaactgagatgatttccatcgttgaatttgataaatgaaggatgtagaactgcactctgcgattttgggaggaaccagtgtagacagcctgggacgttggatcaaactgagatgattttcattgttgaatttgataaatgaaggatgaaggatgtagaactgtagttggtgaatatataagaagaaacgttaaagttggaacttgttcaattgatttaaagtgaagaaaataatgaagattaaagtgtgaaaaagaaaagataaaaaaaaagaaaggaaaaaaaaaaagcatggctaccgcctatcctctctcaaacatattgatgagctgggagagagtgatgagtgggcaagagagattggggaagagatctccggatgccccgccggccctccgtgagaagacgagagaggagatgggcaggggaaaagtattttctacacctatatgctacggtgttcatatatatttatgtggtttaaatagttatttaaaatatttataaaatttaataagatatttgataatataagacactatataaacattaaatctaaattcaatctacacatgaagaaagaaaaataacgaattttatctacgttgtgtaggtactattcactccttgattttattattttttctctggttctaaattaaatttagtcttgtatttttgtttatggattcatatcatcctaattgatgttactattctttttccaattttttttagctattcgagttacatgtaaatagcgggtgatatgatgtcgagttgaaaaacctagcagggagtagacgataaggatgtcactgcaattttgtattttggtcctttagtaaattaaatttacaaggtaacctcagcgttaaacgtgatattcacctagttatggccttggtgcttcgtggctggtaacgatcaattacgattttacgctcccacataaataaacagttgacagaaaaataaaaataagatttctgttcttttaaaaaatacagcgaatgctataaaaatacaacggatttccttgagatgattgcaaatctttaggtctctacaagctactgtttttaaatccatcaataggccttttgaatgtatatacaattttagaatcaatttatgataattaaactaagtgttgtatcaatattttaaaaatcatgttgatctaaataaagtaccatgccatctattttcatgcgcactaaaaataaaaaagtgataaataaattaagaatagggtttacgaggtactaaggcacgaacgcctaaatatttaataacctcgaggcagttcagattcatgatattttcaaccatatcatttttggcatcaatctgaacaacgcctaaatatagagtgagaattaatatatatacaatccaaaggacaaaaataaagacataaacagggctatataacagggaaactttttttcaagaacaaatgtatattcaaacgttagatatttagattgatatcaaagcttaaaaaggagaagaaaaacaaatgatcgttcattactgcagaaaaccagaacgcaacatgtccttatatatacattatattgttccttgaccagaatgagtaaattagaaaaagaaacaaaagtaccgtgtacatgctagtttattttctcgtaattgataatcatggctcttggacaatctgcctccggccctccgacaactaatatatactccttctatctcataaaaactaacctaaaacaagatgtgacatttatacctcttcttctgctttcctgtcattgtatactcactcctgtggtgataaaaaaaaccccaaattaatcaagaacaagaagctagctgcaaacaacgttaatacacataccatgcatgatgatatagtaatatcaaagagagagagagagagagatgacagagatgtagctagaggagctcccttcaatccaatcaatagaggaagacaatggcgggttcatctcccgagtcatgcaaacccatgaaagggtaggactatttgccctgcactccagaggtatccatgaaccggcagctgcatcctaccacttcctctcctgaattggatcgaaagggagctcttcttcttcatcatcttctgatccccttcacatcacaccaatattatatcgtcaatcttctacttatcaaacgcaacaaaaaaaaaaggggggggggtgtgatataggtttcttctagcctaggaacacatgagttctgatgagtacgacgattgcttaggggttggtgatttatatagaagtcgggctaatcttggattgatgacttgccattaatttctttcttgacctttgcccttttttttcgattggcctcgtgatttttaatcggtatttatcatccatgcatggcaagtgaggctctggcggctggttttgttgctagcttatttaaaaatattttcgcgaatctcttaatgttgtatatatagaaagcaatttgatggccggatttggctgttggaagcgtcgatctcgttctcgaatcctcgtgtgttcgagcacttgtcataaaaagaaaatcgcgaaaagaatatcatacgtgcaaatttgtttcctttttacacatgattctcagttttctcacagtatttgttaacattgtcgtgaagtttccatatccattattcatttattcagctatttctgcttgattcacgcttctttgtatattgacttgatgttttgtgaggcatgcaaatatgcaaaaggaaacaattcccaccaaatggtgagacatttccagataatctgcgtgcatatacttggtggtagctcaggttacaacgagcctcctatatgttagtttaaatttaatctatctttgtttaggattgtaaaccagcttataaaccgaaaagttcaagactgaacaaacaatcagccttttcgtttggccttttcgtttatgtacagttaagtaaactatgcggagtctgaaactattcagatagtcatatctatatttatagacgactcgatcaaaaatcttatccacagtaactttgataggccaccccaaataaaacagtgagtatagttttgtactcccttcattctaaaatataagagattttgataggataagacatataatattactacgaaaagtaaattgcattcaaggtgcatcaacttggcaggtggatacaatttgatgcaataacttgagaaatgagcgttctagtgcaacaacttgatatgtaggtgtaatttagtataagaactttataagtgatcgtatgaatgcaacaacttgcaagctaggtacgattttgatacaataaatttgcaacaactcaattatttggagcattttttaatataaaatcaagttttaagtacttattttgacaatatactagcgcggatttgtataagtgtattatatttttatcctaataaataataactgaaagtcaattaaactggatgtagaaattattatattttggttgatatttgagaaggtgaagaaaacaaaaaaattcttaaaggtaattggatgtaaattgtactactatgtgccagtataattcttaaagattgaattcaatattataagataatatccgtatgattattatgtaatggcatattgaaatcatgaaaaaactcacctagcatatgcttagccaagttgatacaccaaaatactaaattgttaagttcttgtactagaacgcacccatttgtcaagttattacactcggacatttaattctcaagtttttacactctatcgtacccacttgccaagatattgtaccgtgggtacaatttactcgacatataatattactatgaatctggatagaggatatgactcatctaactaaaatctcttatattttgggacagagggagtaggtaacatgttggcccatcccacccaatttacaaggtggggtaagacaaaaagaaattttaaataggtaccattgatgggacatgtaaaaatactgataagttttaaatagcaaaatttattacaggacactaaaaatttatataatttacttgtagacataaaaaaaagtgtcatgaccgaaaaattaacctaaaaataggtaatttgctgaaggacacttttgtctcaattggagaaagaaatttttcaaaaagatgaaaagcacatagtgttaaaagatttttagcttaggctaaagtgaagatgaaatatgatgtatgctagtgatgcacttggggtgatggcaaatttagagttgcataatttctagatttttcactctaacgccatgtttgaagcatgtggtcctaggggcattctcgtctttcttcagaatttatctctctaatcaagcccaaaatataacctctagaaaatgactagttttttagagtgccttttagccatggaacattttcacaatatctatcagcaacagatttttgatgtcctataacaaaatttgccattttaaatggtcataatgattatgtttgtggacatagagagtatgttgagaaaaaaccatgcattcagttaaatgttttgaattctgagatgaaagttttcaaatttgatttgaaagtttcaaatcttcagttcaaagttgttaaatccttgttgaaagttttcactctaagtttaaatttcaaatctaagttgaaagttttcactctaagtttaaatttcaaatctggacttgaaagttttcaaatctgagttaaacattttttgaatctgagttgaaagttttcaaatcttgacttgaaatttttcaaaactgagttgaaagttttcaaaaatcttgacttgaaaatttttaaatctaagttgaaagtttgttcaagtcaactccaaaacaagataagagagaagaaacacacgcagaaggaactttttcctgaaagaaaaaagggaaggggcatgcgcgtgggaagatttctttttggtgaagtggaacgaccagtggaccccaccaatacctttctagtccaccgcacacgcgacttaggacatgtttggtggagttggagattttgttaaaagctgcaattgctaaaagcttccctcgaatagttcaaattatcactcggatactcagaagttatatattttagcaaataaattaaacttagaagttagaaaatcagcttctttatattctcagaagttggctatcaagtaccaacaaacaagttcttaggaccttaagctccccgtacaaggcccccgcgcgtggggtaggagcatcttgtagggagtacaattttgtagggaataagtccactttgactccctcaaatatacatcaaatctaatttgtatccctcaattgcaatgtcagatattttgaacccttaactattaaaactggtgtaacatatgactccctcgatggtttttagtgtggttttcgctaatatggcccattgacctagtccaaccgctaagtcatcattatgggggccacatgtcatcctctctctttcctttcttcctcctcccccctttatcttctcccccttatcttcctctccccttctggttcccttctccacaacgacgacggtagcgatgggaggacgagggtagtggcagcagttgggggcaagctcctgccggggcgaagcgaacttagcggctagactaggtcaatgggccatgtcagtgaaaaaccaccccaaaaaccaccgagatagttattttgcaccgtttaaatagttaagagttcaacatatctcaatgtcatgttgaacttagttattttgcaccgtttaactatttgccacttttagatttagtatttaactatttgccaccactatatcaatgacacgtgggtctacatgtgtctatgacatgtgggtccagtggcaaatagttgtctaaaagtggcaaatagttaaatatctcctcgacatgtgcgagatcagatttgacttattttttgagggagtgaaagtgcacttattccattttctaaactgactgc

SEQ ID NO: 23649 - DNA, 4288 bp, Oryza sativa
ctcctcctcgtcggcctcgtatgactacggctacggctacggccacagacgcggaggtggtacctggcgccggccgcctccgggcggagggggcgccgcctcggccggattcgattgggacttgctgctgaagtcggtcacgcggcgagggttcctcatcaatctgggtttcgccaggtgaagctgctcatatgcgctgatgcttttcttgctttggctgatttgatatgccgccattgcgtgattgttgtgctgatccgttacattgctggcttttctcgagggaatcattgtggaaaaagcaattgccaagttcataaataataggacagcataggatgttcatgtatgtctgaccgagatcaaaatagaaccaaacctgcaaatgttgccgagtacagataaaatgaataccgttgaaattgcatgcccatttatgacctacgaaagaagaggatttagtctttatgaccatttctgttgtgtcaaacatgaattcacttggtgtggattcaacggttccataaaaaagtattatcgttgctgttccataagaaaaaggatcaaatctttatgaccattgatgttccaatggttcttcgtaaaaaggaagctcatcaattcagtttgtattttaacgactgctgagacagttaaaccagcaagatagcaactaccaaaataaattagagtagctattgttggtaccagccagatctggtactatacatagattttgagcaaggtgacgggaagaacaaaatgccatgtattgggtcaaaatctgtcaaataacgcaccctgatgttggagactcatgtcattccacacactacttttttgcagcagttctgtgtattctactgctggaagtattttagtatttgaaatgtaacagcattttagagtttgagatgttagctcatgttgacaactctgtactgcagtgtactgctgactggagcagcttttcttgatggaagtattttagaaatctggaagatgaataattctggggtaagtatacaccttgttagcttatcattttatttggagcaccctgcataacgtttcttcaatacttctttttttccttgcatctatgtgaattatttcgcagctcattcaattgaccctctacacttttgaacttagtgatgtattgatcaaacacccactggctattgaattgagtggctactttgcacattgttgtccataaggatgtgataggctgatagcagatttttaggcatgcaattagtttgttcatttcatcggtaattatgaaatttgagctgaataaaagcaagtaaggagggagttaattggaaactttcactagtgtactctgaaaggtctagaaaaaaatggagataaatgtgtttaccaagtaaaagcggcatcacttcgatgacttgttcatatataaaatttcaaacagcagaaacagctttgctttttcccctattggttgtttactattgaaccttgcaacttgcaaggagccaaggactgaatgattaggacacttaattaaaatctatggcatttagatttgatttctaaaacctttcattgtaattgtgtaccatcgaacactatggaagagtttagggtgtcagcatgtgattttcatttgttttatagaaagagcaaaagttttctttcaggaaattaaaccatccatgtatttaacttaacaatgctggagagaagatagtatatgtttctttattgtcattgtttttgttttgtatgttgaaaagtatctaatctgcatatataatgtttgatttcacatggattacaaactgtattgtttttctcatatagcgcctactatgagagtcagagagtgtgtgtactttcttgtattgtgtgttagtagaaagtaaagggtgacccttgtatagtagattcaggttattctcacatcctatgctctagtatatatgccatttttcatacgaaaccatggcattgcatttttaatatgtccatgccttacttttttaaattactacaatgtgcatttagtctagttgcaccaatgactggaattctagaagagtaaagtgcacagacagttcttaaacttgtaatggtgtgtcatctaggtccttaaactatcaaaatgcatatccaagtcccagaacttatcatagtgtgtcatctaagtcccaaatcgccacaaccccttttgggatcctacgtggcgctaatgtggcatgccacacggacatgacgagacaaatggaacccatttaaaatttttttccttttcctttttccttcttttcttctctttttcttctccttttttttcctttcttctcctttctctgtaacccgagcagaagaaaggaaaggaaaaaagaagaattagaagaaaacaaaaaggaaaaagaaaaagaaaagaagaaaaaaaagagagagaatgatacgccacgtccatgtggcgtgtcacatcagcgccacgtaggatcctagaggggctatgtcgatttgggacctaaatgatacactttaacaagttctaggacctgaatctgcattttgagactttggggacctagatgacacaaccctacaagtttaaggaccgcctatgcactttactcattctagaatgtctgaaatgttcggtgcaaacatgggatgctatatcctgtcatagataacctgtttctattaagcatcccagggatgtttgagtaccgttagcatcctagggatgtttgagtactgctgggttggggtgagctgtctgcttgatatgttgttgaacacttgattgattagaagcatggcaggaggagattacacacgacgtgtgagaaatcagtccaagccatttgaaccatattcttcctgccaaatgtttgcttaattgttttttactgatgtaatgtaatgagctgtttgataaataatgtgcagaaatcatttgaggatgcgatggaatcaattgagaaggtcaaaatacagaagggaaataggtagaagttatatcgactttccgtatatatatacatatatgtagaaaaccaatgtgcatatactgttgttcaggtggtgatatgttgtaatgcgtgtgttctgaataatttatttctcgcgaagtcatgattgatccttgtaatctcattgatcagtattctctgctagagaaaaatgagtatctcatgttggagtactcatttaagttgtagccccgtatatgcttatgttcttcaaatgcaaaagagtgccggttacaggacttggcgacttgcagtgtgtacgtcaaagaggctcaaaccatgggtgactgaaatatgttgcggacttcataagttttcaagtcttttacttttatcttgtcttagtgcctgtttagttcccaaacaaaatttttcacgttgtcacatcgaatgtttggacatatgcatggagtattaaatgtagacaaaaaaaaatcaattacacagttcgctaggaaattgccaaacaaatcttttaagtctaattgcgccatgatttgatagtgtggtgctacattaaatatttgctaatgatggattaatttggcttgataaattcgtctggtggaatctgtaatttgttttgttattagactacgtttaatatttcaaatgtgtgttcgtatacatgtatttagattatagccaaaataaaccttatcaaattttggtaattccaaaattttggtaaattgacaatattgctaaaattttgacagaatttcttatatacttaccaaagtttagcaaaaaactaaatatatacacatttttgttaattttaccaaaaaatgatatggtttgaaatggcataacaaccccttaactatgggtgtgtttagttcacgctaaaattgaaagtttggttgaaattggaacgatgtgatggaaaagttgaaaatttatgtgtaggaaagttttgatgtaatggaaaagttggaaatttgaagaaaaagtttggaactaaactcggcctatcactatcacaaacaacctttaatagcagtatctcaaaatgattatttgctaatattctctccatatataacctagcatcgaatgaggcacattataatacattagtactacgaatctatccaacattagtactatggtgtgtctagatttgtaatactatcatatgtctattcagtccattatgtatcacattcaaccataatttcttatatttgggatagtagcgcactattcattgtcacgaatagattatatggtaaattaaatactttaagaaatacatt

SEQ ID NO: 23650 - DNA, 36274 bp, Oryza sativa
  unsure (1)..(36274): unsure at all n locations
cccaggtggcgtcaaggctaacacagcggttagccatggtgatggtgtggttgcttggtggatggattgggcgggtgggtgggtgtggttgggaaagggggagggagggcggtgggatttatagtcgaggggaaggcattcgaggcaaaaatgggtgggtgtacccagcggaatgtacccagagttgtcgctagattatagttttttaagataatggaagctttatttagactcaattaattacattaagatgatacctgagtcagcccccgccgccagattatggtaacacgttcaaaactagatacttgaattttcattatatttcgataagatttcagtggatttttaagactaagccttttacctcaaacccaatgtgtcccatttgtgtggtgtcttcgctactagtaagtaattttagagtagtatattttagtttcaaaaaagtcgggggaaattttctgatagaaaatattagtagagggaatttaaggcaaaaaaatgtgcctgcattttaaaaaacttgtacttttcaaaggcctaatttgagaaactaatacttttccaagaccaattttgagaaactcaataccactccgtactagtacttctagtggtactagaaccgtgggcgcggcacaggtagagaaaagcgtggcccgcccggggggggcgggggggggggggggggggtgggtgttcctgtgcccctggcgcgggttgtcatgcgcggcgtgtggagtgtgaaggagagctggagagaaacctcgtggagtgccgcgcggtgccacgcacgcatatgcctctgggcggctgctggctgctggctgctggtgaagccggccgttactaccgtgggacccagctatcctccctcttggctgccacatcgccgcatccgcatgtgccctgtgctcctcctcctcctctccttgcacaggaagccacgccgttttatttatttttacctgagcacacaacacaaggtgggagtacaactgtggcatgtgtcggtcaactgggcagtcaactcttcttgcggcccaagccatgccacgctggttacattgttaatcatgtactactagtagtaatattcaacaaataatatatgttccattagaactatataaccgcaaaaaaaaactcctctaaatttggtttaagttaatagagaaatattagtaacatctataataggagattagttttattaaatgtgacattggttatagtttgataaacatgtttgttttgtgttagggatattattatattttatttataaatttgatcaaactttaaaagattgactttgaaaaaaaaagttaaattggattataatataaaacaaagggaatagtagccaatattatattatataagtccacaactactacatgttttattttaggacaactacgttgtgttcgttacggtaggttgggaacaaatctcctccgcacggaaaacagagcgatacattagcacgtgattaattaaatatttactattttttaaaaaaagatcaatatgatttttttaaacaactttcgtatagaaattttttgtaaaaaaatacaccgtttagcagtttgaaacatacgaaaaacaagaagggggagttgggaacacagagttccgaacacagcttaagtacatgttcctttttaattctctccctccgtacttgttagtcaaggaacatagtactaaagctctttcaataacaccataatttgcattttctccaaaatagaccattatgttatgccacaatcctttcattccatagaaaaacaacgtagggagtgtgatgtttcttatttcccttctcttgtttccaatttttttgctcacatgatgcagagggcagaagagaagagaaaggtggggaaaaagaaaaaaaaagaaaatagtcaatgcccgtgtgtcatgtcacgtaggattctggtggtgtcacggcgattatcagagtcattaccgtaggatcctagtcaggtatattatccttggaatgttaaaagtttattttagaaagaacaatatgttagctagcagacctcattctttttatcctataaaaaaatacatataaaagcaaccatgagaagaaggaaaaaaaaagcaacgtgcaccgccagatcatcaaaaggactgtactctctctatgtcccataatataagagattttgagtttttatttgtattgtttgaacatacatcttattgaaaaaatttgtgtaaatataaaaaacgagaagttgtgcttaaatactttgaataataaaataaataaaaaataataattctaacttttttaattaaacgagtggtcaacccgtacaagaaaaactcaaaatgggagtagtaacgatgggggacgcgtcaggcaggcaagtgtgaacacaaattgattgtgcaatgggcgtcgacccagaccgaaacggtttgatcacctggttgttgttgcttcaaggggaagggaagaaagtcgcgggctcgcggcggcggtggtggtcgtggggtgggtcaagcagctgtcgcctgtcagtctgtcagtcagagaggcaggcgacaaaccgagaagccgcgttgtcagaggctcgacccgctgcgggccccaccggcccaccgagaaatcccgtgatcgattgattgcgattttgcgattgcgacagtttggctgcgccttcgtgcggatggcaaggggggctggaggctgccaggtgggacccacgcgccccagccgcggattagcctgctgctggcctccacctcgccgcccggacacctcttcgcctcctcgcaaccgtcggatcttacggatggacggactagatcgacccggccaccgctctacctcgacggatagcaattgactagtagcagcggatgacgctgacgcggctgcggctgagcttcatacttttgtttcttcagttgtagtactatagcaaaaaaaaaagggccaaaggggtgcgtggcgaactagacaaacgtgtttgcgcttctatctgattctatcataatacagnctagttagctttagctgtggttagtttctttcaaagatggaagttttgggtaaaattggtacgatgagaactgaaaagtacgtgtgtatgacaggttgatgtgatgaaaaaagttgaaagtttggatctaaacacagccttttctcccctatttgaacttggattaagaatacatctcctaatcaatttccttctaaatctcaaatttcaatcggaacctctcaaaagttggtctatttgggtataaaattttcaacccaatcgataaaatctacaattcataacattttcaactcgacgtcgaaaactttcaattcatactttagaaattttcaactatatactgaaactttatatccgaatttttgaaaagtttcaaatcataacctcaaaagttttaacttacataacaaacttccaaatttagaaaactcaaattttcaaccgaggggagctcacttatatcccattcccgtagctttccccacaacactgatatctcgctgggaggagaaaggagaatcgagtctccccaaagaagaagagacataaggtctatgagagcggcggctcacatgttgcgtcgtgtggaagttggtagcgaggtgccgaggtccgttcgacgccatcaatgtctcgccaaggatgagcaggaaggggaacttagaatcgctcaagaggaagaaaaggggggcagggtgtgcaaggtgctgggggaggaggaagaaatgaacctcgcttggtagtgtcgaggggagctaggagcggcatctcatctatggtggaacgaaacatcaaggttggggggcgaaaccaagggaatcagatggaggggtaaccgatcgagtgaacggataagtggataaagtgttcgccagttcggttgctagcacatttgcgccaaagtaggaattctagaaaataaattcattttactcctaactatttcgctgagcttttaacccgtaaatatttttttggttcatttcacaccctcaactataaaaagcactccatcttacttcatataaaaacgatcaatcttactccctaacaatattttgtctgtgtctatatatatgtcatattatgctccgaaatttgatgggttagtagatgcattataacatatacctcttaacatttttgagaatttctattattgtcgtttgcatatgttgaaagtacataggctgatctaaatatcaaggttttaaatttaaagtaaatagcaatagaaatatttgggaactttgatagggtgtcatttatgtcttaaaaattttagcttaaaataggactgatacaaagagaaacaaaaggtgataaataatattcagtactaaagtgaactatttttagtagtttagggtaaaattaggaaaaaaaatattgtagcggttaattcaaatgaaatagtttaggggataattaaatggactttttttgtacgtatatatacatgtttgtacataattgagtacaaattggaccattattaataccatctctgtcctcaaataaattcatctttagccattggaacacaaattaatgtggagtaaaaagaccaaagtatcctcgattaatagaaaattatagtattgatgggtagctaaggggtattgaacgagtaaaattgatttgcggactgcacacacgtatagataaaggaatgtacttattttaggataaatagtagaggttaaagataaactagtttggggacagagggatttatataccttagctttgcttttctctctacacatcaggtgagtagacaacatatcctatatgcacaagttcacagtacacactccgtatacaccaactaacaaatttcactaaaaattcaaaacaaacaactatgcgttacttctaatagtattatacctacatgcatatcatcttaaaattcattatattttatattttaaaaatacaaaatccttacacatatatactcttaaaactgtaggttttttgttgttttatagctaaaatataataaatttgaagttgatactttatatatgcacaactattatatttacttttttttaaaaaaaaattagtgacatttgttagctggtgtgaatggagtgtgtaccataagcttgtatatacgtaggattccaagatatgtcccggtcatttatatgtaacacaaaataaataattgatgcctatttggcacatgcatgcttaacacgtgacaacgaccatagtacctaacagtaatataacaaatgaccacaaaccatattcaccttaaaataaacgttatcaaactataaatatccatgtgttctaggcatgcaaacccatcgtcaattaatattgctttggtacgagatagataccaccaacgctcgtgctacttataaatgatctaaatatagttttcaagtcattaatatatgcgtaattcaagtatataatacactaaatatataaaaggacaaatattaaagagtaaagtatgttcaacctcgagaaaacgtactagcttcaacatcgttcacgtcatgcatcaagatcgatttactcaaaaaatcgggacatatgtacaaagtgatcatttttcacaacagaacacagcttagcgttctctcagagtcatcgtcctcgaggccatgcgtacgtgtggagcaccatagcctcctcgtcgtcttcctcatccgcgcggccgtggcgcacaagcacctcatctccaacaaaacttggataaaattttgaatacttgtggcacaatttttaaactgctaaatggtacatttcgtgcgaaaactttctatatgaaaattgctctaaaatatcaaattaatctatttttcaagtttgtaataattaaaactcaatcaatcatacgttaatatcacatcgttttgcgtaaaacacttaatatttatctttatcttcatcttcaggagaaaaacaccaccatagtcgttgagtccccatcgacctcgttgtcgctgttctcgagcacacgccccatccttgctgagcacgagcgtgagaagcgggtagctagatcggcgtacccaccgggttatccatttatttataccacaagtaaattcgcggatctgttcgcttgcatttctatctaagcttgacaattaatgaagagaaaaaaaagaaaaagaagggaacataaggaaggaaggaggaaagaaaagaatacgatgacgatggaatagttttaattttataaaatttcagaagcattagacctatatcgtaaatagtaatgatgaacttttgaaatagaaaatgtgagggtatgtacaatgtatttattagcgatctctctttattgtcatgcaagcatattcggtgacgtggaagagagaggaagaaggaaagagaaagatggttgctacgcatgacaacggcgtagagtcaactcttagcatttattaatggaaaatttgttgcatgagagtggagaaaaggaaagaagtataattaaaaaaatatttagtgcattaatggtttagaaatctcattgtctctactattgtaggaggatagtctctagtgacataattagtatagagagctcatattagactcacatttgtacatgctctaataaaagaaaaatggctagtaagaaaatattttggtacattaatggttagagactgtactgtcttaactattgtaacgtgatagtctctaattaacgtagtacctttgtacttgccctaatgatatagattaaatttatcctagtaattaaccgtatgtgggaccatgcaggcatgtggatgtgtcatcgatcgaccgacggtcggcgacacgctaacgttgaccgatcggatattcggattacgagtagccctatgaagtctgaacttattattatataaacttcgttaatttaataacttattagttgcttaaatgtattaataaattaatcgacgatatatagggccgtacacatatgcatgcagcacgcggagtatgtacagtgttccgtgtgtacctgacctacagtaacagtgaagaatataataaaaattctgggagtactcgtggcaagctgctacgatattatattttgaaaacatgtaggagtagggtgtgtttagttcacgttaaaattggaagtttggttgaaattggaatgatgtgacggaaaagttaaaagtttgtgtgtgtaggaaagttttgatgtgataaaaaaattgaaagtttgaagaaaatgtttggaactaaactcggcctagtataactagaacagcaaaaattagggggtgttcatcaggggtgtaaagttttagcgtgtcacatcggatattatatagggtatcgtatgaggtgcccgggcactaatataaaaaactaattaaagagtccgttctgtcattatatagggtgtagcaccacattgttaaatcatagagaaattaggtataaaagattagtatcacaaattagttgcgatctgtgcaattagtttttttagcctatatttaatacttcatgcatgtattcaaacgttcgatgtgaaaggatgtaaaatttttggtgggatctaaacatgccctatggccgagtttagttccaaactttttcttcaaatttctaatttttcatcacatcaaaactttcctacacacaaacttccaacttttccgtcacatcgttccaatttcaaccaaacttttaattttagcgtgaactaaatacatcctatgttaatatgttgatttttttaggacggagggaatacaccaatcaaagtcaccttttaacagtctgcgagtaggaagtcaaatagaggagcagcatagtaccgaacagtcaacatgtcgttggttgtgtcgatctgcatgcatgtgcatggcaatggccggccgttgatcgacagaacgtgatggggacggcttcgttgggtggctgatcggtccaggccgtacgtagtactctctctattttttaataaatgacacagttaattttttcttatatatttaaccattcgtcttatttaaaaattttatacaaatgtataagatataaatcacacttaaagtactatgagtgataaaacaactcataacaaaataagttataattacataaattttttaaataagacgaatgattaaacacgtgagaaaaagttaacggcgtcatctgttactccagaaaacaggatgtagtaactactccgtacgtacccttaccgaggcgactgattgattgactgtccacggccgacgtcatgcttgcgtcagcgtcacgtcacgggcaaccccaacggaacggaacggcggcactcccaattgatgccgaccgaacacaccgatccacgtacggtacgtacggacgctatatatggccttttggtgtgtgtggtacgtaacacctgatcaactccaatgttcgttcatcaacatcatctatggtcggattcaccatttataaaaggagggaggaaatggagaagagggagaggaggaagagtaggggaatgtgagttttctctccaatcttatcctagattcatccctggatacaacatctcatgtataaataatttatcagtgagcatggaaagtctgaaccaagctggattattactttcgctatcccaaaaatataatataagattgaacattttctcatatctcataatacaatgcgttcacatatgcatatattaattagtgtatcttcctcctctaaatttggtttatttaaaatcctctaccatcaagccctctaatcacattgcgtgcatatatcgaggtgatacaatctagttaattaaattatttcttcatttttgagtttgtggtggttatgccttatattttaggatggaggatgccattgttctagaccggcaataagaaaagggtgtagtgtacaaggtctaaaagtgaatgagtaaagaggtcaatggtttagacaggttcatgccctctacttctatttggggattgaattcgtcgggtgttgtattgatctaatgatcaatttgtggttatgtccttgtagggcttcatgcccatctaatattagttgggaggcagagttacaaagagaaaaacttagccagacacgcactactacaataacgatttttccgtgcagtggaaactcattttcgcgtgcggtggtttcacccgtctggaacccaacgtctgcgaaaatcacaattttttcgtgcaggtgaggcacccgcacgggaaaataaaaaattgaaacaaaaaaaaagaaaaaaaaccaaaaccctaaccgtaatccagccgccgccgtcgcccccgcggtcgctggcaacggatccagacgctgggagaccgctgccaccactgccgtcgtcgtcgcctgctcctgacgccggatccgccgcccgctcccgtcaccggctgaagacgcccctcccctccaccggatctgcaaggcaagggaagggaggggagggagggcccgcgcactgtcgttgtcgcacgatccgggggggggggggtgaacatgcatagatgtaacctagaggaggggttgaataggcttgccagaaaactcaaaaacaaatcgcagcggtaaaattctacaggcccagaacctccaggtgtagaacaccagaacttcctatctgctcaaaaagttcggaacttccggtgttcttataccggaacttccgggcaacagacaaattcaggaatcactaacaggaacttagccaaaattcacgagatgaatcacaggtaaacagagaggtagcaatatcacagacacatgcacagattcatcacagaagggacaaagaggattttttttcccgaagttcggatctcacgatcctactcttcgttgaggtgctccaaagagccgggtctcgattaaccccttgcctcatttgtgcaaaaatctcagaggaaatccacagccttcaaccccaacacctttaggtcattttctagaatttgagtgaccactaagatccaacccaaccttcttctagaaaacaccacactaggaaaacctctaggacttcagcacaagattctttactcacttacctcgtttccttgcggaggtgaggaataccttcacaaactttcccgggacatgcacaattgaaaggaagctcgcgaacaacacctaaccgtctaggagattatctccaagagtaataagcaccgagatgtcagcccacaagataccccaagtgctcacaccaatcctaaccttcaaaccttctccaaatcttctccttcaccctcaaaatctcactctctctcaagaatggctcaagatcaggtggaggaagcaaataaactcttgggagaggctagcaacggctatggaatggaaaagcaaaagtgaaatggccaaagagtgaactggggacggctaggtgatgccatccagctgttactcacatttttgaactggaaacaggttcggaacttcctgtcctccagaagttccggacaacacttaggaaattttcacccttcaatggtccggaacttccgggtccataggaccggaactttcggccgtcctgatctgtcctggatagggctattctcaaaaatagctctaaaaaatttttgacacttggatctcactaagagcacttgatgtatcccagaaccacacctggaacccctcttaatagtacggtttttcctaaaactcgattacaagaaataaactatcatatgcacacctcgagttccaattctgctcgaatatatgttgtgggggtctcccaagcatctcttgaccacacaatgccatcttgggactaaaacacctaagtattactcaataaaactcattagtcccttaaccctattattattaatcaccaaaacccgctagggggataaatgcaacttcatggggcagctgccagatccgggctaggggcggtcgcccgccgccgcgcgcacatcaagcagcgagcacatcccctcctcgtcaagggggcagcaagcagacagatcaagcagcaacacatccaaatccaaacaagcaagaaagatcgagcagcaagaaacacgagcactcnnnnnnnnnnnnnnnnnnnnnnnnnnnnnnatccggtcttccccttgcgcaccgtcaccaatgcatgcttaagcctcgctgcccctggatccacgccccgcaaccccccggatatgggcccggggcggggggggggnagggtgtcgcccgccaccgccaccacgagctcaccaccgtgtgcacgccgctcacggttgccgagcccgccgctcccccccaccagatccgggcggcttgggaggagggggaggagatgggagatggagatggagatgggcgagggagatgggagagggaggagtgggcgtgcggccggattaaatggtgggcacctattttcgcgtgcgggccacttaacatgtccgcacgcgaaaataaggctattttcgcgtgcggacgtgttaagtggcctgcacacgaaaattgatttttgtgtgcaggtaactgctcggcgccggtcccctgattatcatgtgtggtttctcttacggggcccgcctgaaaacaaaagtgtcccatgtccaggaaaatgttttgtgtagtagtgacggcatcaattttctaatctattatatgttagtattcagccgaagctctataccctactttaggatacaaggcaatacggcaacgaagtcttactctattacataatacatggattcggtccacctcctaccgctagtcggataggcaggccaagtgggtatgcggtacccatgatgtccacaaagggagtagcaataactaaggatgtaagtaactaatccgtgaatccacttatatcaaaataaacggattattctgatctataagggaatttgcaggttagccagtaataacactggtaatgtcaaaccaagacaacccaatgttaattgttttccttttgacactgaacagagttaattgttgactggacatgtgagagcgagaaaaaaagtgccgagagcccaaggctcactacaaaaccccctgtttgattcaaattaccaaataatctatactcgtttcactaaaatatcaataaaactcattagtcaagtgttagatttaattaggtaattgatccatttaaatcaattaaattctaagttttattatgctaggagatatgtgtattcatcttctcatgagttatcaatggttaagatgaagaattttttgagaattaatccaatgattaattaatcgaatggttgtttcatggtggtgtagtgaaggatgattgatggcttggtgatgacaatcagtttctatctttctctttacattacatgagtcctttccccttcatcttcctttttctcctataaaagaagatggatttgatctcccgcgtgtgagaatacacacattttcatccatttgcacttctgttgctgctacaatgatcacatcccgacgagtgtgtgcacacgcgctgggagagcaggcctccggaacccccaccttccagatcttgcaccgagaagaggaagcgaatcaagtttttgggagagcattgtgcaactgctcgcttgtgcttgagtacgactacgtcgactacttcttcttcatcatggctgatgacaagaacaggaacaacgacgggaacaacaacagttctctttccgctaccgttgcaaccactgctccatcaccatgtgttattatcctcttctttcctttttctttattctgtttattacgcaaatgaattagacatgcttgtttatatgatttacacctatagcatatctattttgcatattcctatggttgagaataatatttctatggtttttgcttacattgtcatgatttgcaatctttatttttggattaaatattatggtgaattgcttatatttccaacatcaagtacatgtagatagagagataactagatgatacccctggcgtaatttatagtagtcaacttaaataaactggaagtggttaactgtttttaagtaggaaaaaaaagcagagaaatgctaaaagcacacagcataatccaaatggaattagttgaatgaatctaagtaatagtcaaactgtacattctactttaaataaaaagtaaagcactaactttaatcggtttctgatgtggacgttattgcaaatgagcttcatggagccaaatagcaaatgcactcactagttgcagcacactgaaaatcaagtaaacaaaaactaatttttatcaaatctgattcttgtttatcagatagggcatgtttgatgaaacctccatcacaatcacaaaagaatatcaacgtttgaagcttgatgctttagtaagaaaaagcacagcaaacagaacatatgggttagatgaaagcaaatatccaaattcacactatacaatatatgtaggtataatgcaccttaatgatataataaacctatttgatcatgaaaggaatattatttcaaaattcattcgacctcatatttccacttattcttatacttctaagattaagttcgaattttaaaacttttgatttttgcggtttctttccaccaaggtttattttatagttttgcatttgaatcgctaaggccacatatataaaagtatgtcaaaaaatatttttttaattacaaataagcatatacataggcgagatgaaacaaattctagtacactttgaaaagtttgaccggaatttgatcaaagcatgatatatgaaagcatagtgcggaatctatacaaaccgccgtcataatagatataaatcgctatacatcctaatccaataagggactgggcctcgtatatatttgcattcgcatacacgattttagaatgattagttaaatgcccactctttgctatatataaaaactattacaatatgccataaataaaatatgtttttcattaaatatgttatcagttgtttaaaccaaatattagaatgctcttaacatcaaaggtcaattcggaaaaaaaaatgttgtaaaggcatataatctgtaaataaccaacttggtgacagattcagtgccatccactgtaacctttctaaaatactagtatataatagattgcattcatggcagtggcaatccaaacaaacactgcttgggctaagcatgatgtaacacataagtctaaagcatactaaatactccctccgtttcaggttataagatgttttgactttgatcaaagtcaaactgcttcaagtttaactaagtttctagacaaatattgtaatatttacattaccaaattagttttattaaattaataattaaatattttttaaaaataaatttatcttaggtcgaaaatattactattttttttctataaacttggtcaaacttggagcagtttgactttgaccaaaatcaaaacatcttataatctgaaacagagggagcatgaaattattgaacaagtacttatgcgataaaaaatatgtcattagggttcttcagcgagtgggtgacaacccagataaaccgataatcacacacaacaattaaacaaaataaatatgacagtatatatctaaatctagacatcgaaaagaactttcatttgatggatttatgtcacctagatagaaaatacatatgcaaaaaaagaaagaaaataagataaaaaagtatatcaagtttgatataaaaagaaatgaaaattaggccagacaatacgaacgagataatcgtgcattatatttccttaactaacatcatttttatatatgggcatcctatacctcatcctatacctctacccattcatccacacactatgtgtatgcttttaacatcacaacactatgtgtatgcttctaaaaacacaacgagagagcttagataaataatgtctatgcttttaacatcacaacactatgtgtatgcttctaaaaacacaacgagagagcttagataaataatgtctttctcaattcacaagttaagaaaatatagaattcctctacccatgcatccacacactatgtgtatgctttacccattcatccacacactatgtgtatgcttttaacatcacaacactatgtgtatgcttctaaaaacacaacgagagagcttagataaataatgtctttctcaattcacaagttaagaaaatatagaattcctaacatttctcatatatatacatgattatgtaaatataatcaaaacaaatgtcaatgtctaagctgattctttatagaatatgtatgaaaaaaatatttctaacaaaaaatacgtgtcaaacactatacataacacaaacctaaattcaggactcaacatctaagacaacaatggtcatcttcagcatattttaatttatgcttaacgaacaggaaaagcagcgatttaaatcaataaccgtcgtagtcattgtttgtttttttaaacacttttacaaaaaaagaaaataaaaaaattaaacacctaataatcagtgtacttacataaataaaattattttaaaatgtataacataaagagtaaagttggcatctctaaattatatcatatagtaaagttggcatcttcaaattcagaagtttcctaaaaatataattatatccttgttatatatttttttaccatggccaaaagaatactcatgatagaaatggacacctttataatattattatatcctctgtacatgtatgtttttaccatatatcctcgtgaacatatatgtttgatatgtatgttttaccatgactaaaagattacttatggtagaaacatggctaaaagagtacttataaaatataattatatccttatgagcatatatatttttatcataatcacaatatatacagaatagtttttctatatatatatatatatatatatatatatatatatatatatagaaaaactattctgtaccccctaaccgcgccatcccctcaatcccaccacctggcgccagccccaccacccggcgcccaaaaccgaaaagaaaaccgatgaaaagaaaagaaaaacgctctcccacccggatccagaaccctcgcctctccctcacgcgccgctctccctcttcctcacgagttgttttccgccgcttccccttcaggcgttgttttccttaagcggcgacggagcttcccagtctggattacttttcccctctcttttcggcgcccccacccccctccccgggctccttcctttctttcatcccctagcgcgacggcagataggcggcagcggtggctggggcggaccctcccttccccagccaccttcctccccctctccactaggcgcgacggcagtgggagcggagcctcttctcttaatatgcagcctatattgtgcatgactctgattttaatttccatggacatttctagtaacaaatatcttaatttgcagtgacaaccttcttgctctgtagtaacacatctttttttctaccttttccatgcagataagaagagtggcaagattttgacaataacaaaggttgtggttagagacggtgatgaaaatctggagatttcccttaatcgtactcaaacccaagtaactgaaccaaatcttctgttgtttttttatggaggaggatggaacacactttcggcaggaattcctctaccatcggttgaacaacaacaaaccgttattgcctgcgattcttgagaaatttaggccgtagattgacaccaagtagtattgtagttttctttttgccttcccactttgtatggaaaatacatgtactcagtggctcttagacagtaacaaacatttattttggcagtaacatatgatcaagtgttggcagtaacactagtagtacttgtacttggctctcagattatatttttgctagatcggtagtaacatgctgttcttttttttccttttttttggtttctctgatgcaacagatatgtgttttttagcggtaacagctatgtaatttcggtagtaacaagtatgtactttcgtagtaacatagtactgttggcagaaacagccgttctagcaagcttatctagcagttctggttttctgaatgcaaaacaaatgttatcagaatatatgtgtcacatttttctcagtcatatcggcagattttttctcagtcatatcggtagtaatattgttcttttgttctttttttcgatttctccgatgcaaaagatacgtgtttttttttttgcagtaacagctatgtatttttcggctgtaacaagtgtgtatttagctgtaacagctacgtaatttcggcagcaacaagtatgtatttttgatagcccacaaaagtagctttccgtagagtccaacgtgggctgaaagaatctagcagtaatgctgctaattatttgtagtaacttctatgtatgtctgacagtaacatacctgattttgtatttattttggtaccacaaatgtaacagtacgcccgtgtttataattaccaaggttgacgagaggacataatgacattgcagcaatcggcattacgtcgtgtatctattgttcacaacagcaatacaattttatattgttcttactttcctgcagtaacagattagtatttttgcagtaacatatatgtatcatggcagtaaacatactggtaacatgtcatttcaactggaatcatgataaaacattacaatatagcagtactagaagcatgttatatagcagtgatgtgctgccctaactgggcatcgtgatgaaggaaaacattttagcaaccaatatgcttaaagacagtcacagttatatactatggcagtaacatattacaaatgtcctacaagtcagaagcaatgtatctatcacttgtacacttattcttcttcctctttttcttcgtcataatcatctattgcttggcggttgattgtttttttgtcttttgcttctactaggacatgttctagcattgtgtccttgaattttgtgacagacgctgcaccttttgctatggtctttcggctgcttgctctcagcttgtttcgacaccggttgttctttgtctttcttcctcccctttgttattgtaaccgctcccctttgttattgaaaccgctaattatttgtagtaactcatatgcaatatcttagacagccgacagttatttcatacgcgatacatacaccaatgagcagtaaaaaaatacttgcagtaaccagtcagcagtaacatggagattcctagggaaaaagctctcttgaacaagttcacatgtaataaatcagacagtaaaatagtacaggaaatgtagtaacaaaacagttaaaatgtagtaacaaaatggtgattcctaaggcaaatgctctcttgaactagctcacatgttgtaaatcggacagtaaaatagtacaggaaaggcagtaacaaaacaattgaaatgcagtaacaagagctagcagtaacatggtgattgctagggcaaatgctctctcgaacaagctcacatgcagtaaatcagacggtaaaataatacaggaaatgcagtaacggaacagttgaaatgcagtaacaaaatctttctcttaagacaaagctcacatgcagtaaaccagacagtaacagggaggtatatagacagtaacgacacagtaaccacagatttctcctgacaaagctagcatgcagtaaaccagacagtaatatagtgatctatagacagtaacaacgagattttttttagggaaaaactcatatgtagtaaaccagacagtaacaagtagatctataaacagtaacaacgcagtaaccaaaaatttctcttgacaaaacttgcatgcagtaaaccggacagtaacatggtgatctatagacagtaacaacaagattttttagggcaaaactcacctcaagaaaaaaagaagggagtcatgagcggcgccgaaaggacgagctgagaggggtgcgtcgttagggttccccatgacggcacgacgctgtggaaggtatgagagttgttgcgagagatggaggaaaggagggaggagaaagacggaggaaaggagagggagggggacggagggaggaaagggatggggaaggaggccggccggagggagcctccgtgcggcggcgcccgaggttggcgtagctgagggcagcgcgcgactccctcctctcggcggcggatgcgggagttttttttctctcttttttcgcgttccttttttttctcttttcgctattttggggtgggccggtggggtgcgggggcggatcacgggatggtgggggcggccagtcgggatggcgccttggccgggtgtagaatatatatatatatatacatatacatacatatatatatatatatatatatatacacacacatatatatatatatatatatatacatacatatatatagaggagctggataatatgaacctaggtgcatatgcaccagcaatctggaccatccatatgcttgtgtggatctcaaagcatgcaaagcatgcacatttagatattgttgaattgtacctaccctgctcaattgcttgtgtggatctcacagcatgcacatttagatattgttgaattgtacctaccctgctcaatccctttacagtgagagtaagagatggtacactatctaattctcatgaccgaaatacccttcaagtagtactctatttcaatcaataattataaatggattatagtcaaatacttaaaaatatgatagtttttttatctttattagaagttgaaaagatattgcgattaaatcatatattaaataattgaaggaaaataaccaaatatttttttcccgatacatcgtacgggaactcaactaataaattaaataaaatataattactcacatattgtatttagatataagctatataagataacataaaaatatatatatttatattaattattttaaaagcacagtctcttcacatttccaaaaaaaaattatctttttactcttaacaatttctttcatcctccttcccctaaaaaaactttaaaaaaattataatgctctttcgtcctcctacctaaaaagttgattcctcaccgttataaaaactatcctctaaaaatatatctaaataaatgttaaaaatccacaacacatcataaaaaatatatagaaatgaaccaaattatatttttatctatagatctaattataatgcatgggcatgtaactagtaaatagcgaaagtcacgactcactaaataatatatatagtgcagtgtaatcgttggattcataacaagtgttagttctagtccggatttgtactatgatcattggattcgtacatatgaaacttatgttggctacctatccagatttatagtattatgatggttcacaaatgaagggcttagattggttgacaccggcatgtaaatcaatgcgttcgaaccaacacaaagtgaagatatcaatgtgtttgagtacctcggcttgcccacgcagaggacttggaatgaggcagattttggaagccgaataagggcatggcatgttctgattcctgcttaatagattaattaagttgtagtggaaatggaggtacactgaccatagggatgcgatccttattgctttagttgtcaaaatttcatccaaactgacaaagggaatgtaacatgtaacatgggacttcaacattaagaaaaatcaacttaattgggggactgcatagagtttgttagcaaatgatcttgcagtttgttcaacatacgctcctaaagaagtattcatttccaaactgagttttgttctgtacttttgttaatcatacaaaagtttagcaaaagtatatcgacttgtttgggatgaacacaagcattattcctctcgcacttgtttgtttgcgtttgcttaatacattttgatgtgacaatatatttaatgtatgcatatttttgttcgcattgctaataattcaatatgataagtcatgtctttctcaattatgttataaagattgaatgaaaatattgaggtcgtgctcttttttgttttgtttttggaactctattttatatgcgcaactaatgaagaaggactcgcaagaggtcttttgctgggatattggataggctggaaaaatgcttcaacgacaaccagcaagcgggttggcaaatcttgaccctttgttagttttcaactttttctttaaaacttaaaacttttcatcacatcaaaacttttctacacacacaaacttccaatttttccattacatcgttttattttcaaccaaactttcaattttggtatgaattaaatacaccctgaggcgatgttggcagtcggttttcttgtcggacttactgttggatccactttaactctatgaaggagatgtgaagcagcatccttccatatccaaagtaacctacctattatcggtcaggatcgatatgttgtcctcgttgtcagatgagcatctgcttgttaaatgttcaagtgcattgttgtttgtcgttgcatcctgactagtgaccaatggtagctactctcaagcactaatggggacattccgcattttgtctatttttgccatgttttttctgcctcctaaggtcagattgtgcagtttgccacattttggcgtgtttggttgcctccatcaggcttggcagatcgtgttttgtgccacttctatccttcgacctctgcatcgggtttaactgttgcagatgcagtttcttctctcttttttttttgttactgtctgcttatattctctttcccattagaatttagatgtaacacgacaacaatgtacatgtatatatcttgtgttatatgttatcccctttatttaaggcccggtttacttccccaaaatttttttttctcaaaaacgtcacatcaaatctttggacacatgtaatggagcattaaatataaataaaaataaaaactaattgtacagttggggggaaatcgcgagacgaatcttctgagcctaattagtccatgattagccacataagtgctacagtaatccacatgtgctaatgacagattttaggctcaaaagatttatctcgcggtttccaggcaagttatgaaattagttttttctttcgtgtccgaaaacccctttcgatattcggtcaaacgtccgatgtgatacccaaaaattttaatttcgcgaactatacaaagccaaattttccgtgtcacagggcttgaatgccccaaggatggaggactcagcgccggcactgtaggcccattgcacaactaccgtatgctgaagtctacgagggtgtttagatcaggggtgtaaagttttggcacgtcatatcgggtattatataatatatcgtatggggtgttcgggaactaataaaaataattacataatccgttggtaaaccacgagatgaatttattaagcctaattaatttatcattagcaaatgtcattagcaaatgtttactgtagcaccacattgtcaaatcatggagcaattaggcttaaaagtttcatctcgcaaattagtcgcaatctatgcaaattagttattttttagcctatatttaatactttatacgggtattcaaacgttcgatgtggttcgatgtgacagagtataaaatttttgtgtgggaactaaatagggcctgtagtgagagcgtaaactggggagtgatgtgccaatacagtgacactcacaaagacgttaaaatccccaatttatccattgttcagatgtttacttgttttagatttttactggttcttcctgtacaagtgcagtattgagaaggtattttcttaaatggaattatatgtaaagagtgagctaagcaatagtgctggaaaaattctgtgcttttattttaattaattattaagacgtactttatatgaatagtttgtactttcatacttgttgtaaggtaccgaattttacaggaaatatgggaagtttgaaaccaatcaagaatagtaacctgaatagtgtcaaaccaaggaaaccagaacagaaacccaactagctatattaacctataatacatcttaagagcaagtggaaaatcagacaatctaaacaatctgaactctgaagaagactaaagaacaagattaatcaacaaataccgtgggcaagactgaagaactgccttccataggtccataggcaaaaggcgccgtcgagctccaaaactctggacagcacctccaaaagaaaaatgctgtacacaacattagtccggggctataatgaaccgaaatatggagagccgcaaaaaaagacgttagctgaataaaaacctgtattgaagctcaaggagcaaatttaccgtctcctcacttccaatttgagcattgacagcaacaggaagcacaaccatttacaactttttttctattcttctaacctgttaacaaatgaattatattttgagcgatggctgctttcgccctaacaacttagggaaacagcgatcacaggctttcacatgaatattgctgtacaagcaaaaagagatggaattaacactaaggtataaaaagagaagaagaagaagaagaagaagaagaagaagaagaagaagaagaagaagaagaagaagaagaagaagaagaagaagaagaagaagaagaagaatcagagaagacctgcactcgccagtctagtacacgacaaggtaagagatcaacaactgcattttgccaccacgtgcagcaggagaacccttcatctttcagccaatccaaaccaaactgagttaaaccataactttccccccacgggaatggtggttcctaaaacgaagctaagctaaagtatttacagcacatgagtgcaccaccttaaagctggtagctggtcctgaacagctgtcatgcctgaatgttcttcacacggaaatcatgcctgaatgttgtaagatttttagtgaatttatctctgttctttggttccaagttcctagcaacatcagacatcagcttctcgaagcattgcgaaaggcgttgttgctggtctacaggctgcaaacaagacgtacattagttcttcaataatgattactaatgctgttattggcagacatatgttaacaaaacttaggtacatcacaagctggacatacagttctaatcaaaagatgtactagtagaatttaatatttttactgaaaagaaacttgtctcctaacacctgcacgctgatgactggaaacattgttgataacttgacactagaaagcttcaagcagaggaaaaaaaagggttaattggatccatgccactgcaaatatgccaattcgaaaaaatgccactactattgagcatatcggctacgtgccactagaatttggggaaattggaaccatgccacttccatccagttttctgtcaacctccgtcatctctctccctcttcctttcttcacttctccaccatggacaccggcgagcactccacctcgaactcgctggtccttgccactgcagctagccagtgatccccccccccctccatctctcgctgctccaccagcagccgccgcgacccgtccgttcctcgtcgtccttgccggcggacgcagcaccctcaccgccgtcgtcgagggaattagcagccggggagcttctccgccatggacgccggcgagcccaggagggcgacggctgaggggaatcggcagccggggagccgatggtgaagtgcggagggacgagcggcacgggggaaggagatgaaagcgagcgctccgggaggaggtcggtggcggtggcagcgagggttggccacagcgatgcggcggtgggcggggtgacgaccggcacgggggcgggtgaccggggaccttgccgggggagcagacgacgactatgcaggcgcagtctggctcgccgggtccgagacgaggcgctcgacaacgacgacggcgacgcaggcgcatcccagcaggcccggctccgagacaaaggtgcttgacgaatggtgccatgacggtctcctcgtcgagccccttggcttggtgctgcggatcgccttgggcgggcgcaacgggctcgtcggcctcgccgcccgcgccgccgcagctggtgcggccacatcacccatcgtcgcgagatcggtgagggtgaatcgcaaatcttccggctccgagacgatggcgacaacacctaccgcatctacggtggtggagagagaaggggaaagagaagagaggggagggagatggggcccacgtgcagttgggggctaacagggatttttgacggaaaatgtgaacggttccagtttctccaattttcagtggcacatagccgaatgctgaatagtagtgacattttttcaaattggcatatttgcagtggcatggatccaattaacccaaaaataaaactagaaagacaggactgcatagtggaatatcagaccagagagttcactgacctgtgatgctaatatctgtgctctcaaattactaaacatctgcacaaagaaaaacaactgattagaaaagatctaaagaccctcgcaaaaaaaaaaagaaaaaaaacaaagacaatacaaactggaaaaaagagtgcaaaagaaatgctaaggaacatgatttaaaagttttaaaaagacaagcacctgttcactgatcattatcagactcagtattggcctactaagactccattgattacccgcatcctcaaagatgatgatctcaaaaagcgtcttcagtatctgtcacagaaaaaaaacaaaatgtaattacatccagacctttctgcatatggtagagaagattattaacacaaacctgaggaaataaagtggggaactctccaatatgccgagcaagatttagtgcagctggtgaaggagggccatcagcagctgtgatattgttgaaataaaaggccgccaagctatcaatggcagaggcacactgccaaaaggaagcaacaatttacagattagtccaaacagaaagcactaaagaacaatgatggattccaatgtgatgaacatagttaagggcccttaggcttaatgaaccaagcagtgctgaggtagctgcataagggaaggagataaaaaagagactaaaagcttgtgtgtattgcttccttaataaacctctacaacccaaacctttacgatataccccgtatcgaagaacatggaaatgattaaacagtaaccataggcagatgttgttcccattactattcatgtgcacagtactgcaggcctagagaggttgactgctgcttctatgtgggccctaaccaggttgcacatgacatccagatccaagagaagaaactaaaagggaaaccacataaaagagaatagagtattatgatggcatcaattattatctaccagcaaccacagattggaagtatgtcttccccgataggacacagtttaagcagtgattcaccgatgctgttgtaacaagaagcggggaacattttacaagcagtaaaaagcatcatgtcgtatacctgtgttgatatccctgtatctagaccttttaagccagattcaagagtgctgacaatatgcacgaaggtgtttgtatccaaattgagaacaaaagtgatatggctgctgaacagaacttcaatatatccatagaatgcttttgacagctgaaataaagaaagagcctagtatgaatgcttccacggatgaaacaagaatatctcaatcatctggttaaccataaatcaatgtgggacaatgcaagacctggaatggtgtctaggctgtttatttgtctatgatcaagccagtaaaagcacaattgttggaaaacatagcactaaacctgtacgcatgttaccagtgggcaaaaattgccaggagatcacctaaataaataaactaagctcgcatgcagggtacctgctggtaaaatgccaaggagactacaaacaaaatgttgaaaaaaaatatgcaaagttcaaacacaactggagtacagttctaggggttggagaatgctcttaaaaaaatgtttgaaaatgtctggcataaaaataaaaaataacagcagcatcccatgttccaaagaaaaagtttcctgatagaactctggagcccactgttggcggtactcatttcatgttttctcctggtaattttactgtgtatattttcaaataaaaaaatgacagcgctgttatgacagaatatacaaatctttctagacaggctaagatactaggatctgatcaatttgtatattctgtcataacagcgttgtctaactggaccaagtgcgtaaatgcagggttctcagttagattagaagattggcactaaaatcactcagtccagttcctgaggcacaagtaattacctctgcttaattgatatacataacattcaattcactttcattgcgatataatgagaactttacatcttcaatgctataaaacttagaatgaatatatttgagatcttaataaccatattaataaaagcaatagcactacacagcaaaacaatagtaaatcactaaagttgcaaggaatacctttttgaatgccaatatgtcagacaatggaactgagaggctcatctttaaagatatatcaagggcatcagcaagtgctctgtcaccatacagctcaaatacaccaaaattgacatagtttccacataaagctgcaatggttccagtcagaataacagcaaaagaaaaaaaatacaaatctttagtctgcaatgggagataaggttcccagaagatacagtttaagaacaaataattgggctcggagttgagtggaactcagccaattttattcttataacattaaaagcacaacaaaaagtttgaatcagagatggtggaactcagctgtcaccctaaccgaaaactccaagtaacatctcataccaaattcaagtaaatcagtatcctcttgaataaggagatccatagatcataccacacatgaaactgaaaaggtatagaaagtctgccatatttgcaacagaatttaaccatagttgcagttaaatttcagtttagccaaaatcatcataaacccattctcaactactgcaaatcttatgcaattgaaatatttatcatctgccagggcctatgaggctacaattcaactcaaatatcacaaatcagtaaggagttaaatgattaacagaaatgaacaagctttcacagtccaggtaatatggcccatggggataagttaatattgtctgttggaaaacaatgatctcaatggggtgcaaaaacaaggttttggtcttgaaatttcgtagagacatgttggaattcaaataacatttcacagcaaaagtgtaacctaaagcacactttttcaaacaaaaaaattgtgcaatgagagtcgcacataaaattggaaaggatgaaatccactaaaaaaatcaagcattagaaaacagtgaataacagcaggtagactttactgaaactgtaataaaattgcagagcatacaggtgttttcaaaacatattttctgaactcacctcttgaaagaacagcaagtgatatccatatgcctttgtatttacttccataaatatcagtgccgtttggaagcaacagaatacgtgatccataagccacaatcagcttgctaacctcctggaataaaaggatcccatttggtgatgatgaatcaaatgtcaatctctgagctttgttcaaaacaaactcgcacataaacttgagtaggggtgtggtgacctgcatgaacacaaagtggtgattttgcagtagctgagcaaaagatttagaagcataaggctctagatattttctaaaaacagttcaaactttttcaaaaagaacagctacgcaaggaaagcattgcgatttggtagttacctccggctcatcagcacagagtgagatggctttcagtaaaagtggcatgcgagatggatatagccagtcaaataggaggccataggtcctgcggctggatcagatcaacaaagtagttagtgagttgatgcacatatataccacatataatcaaattgtgcacctgtttgtggccatagcaatgcctcgtaagtctctcatcaaaccaataaatgcgtacttcacaacatcagtccagaaagcagcatcagcggttgcctccaaattaactgcaacctatggagaatacgaagaagaaaaccatataagaatggagaaaaaacttaactagtacttcctacaccccaaaatgtagctatttctacctacgatctgtacaggtccagatatagctacattctggggcggagagattatgaatataagtagcaatgcacttgtaggagaggctccatgaaactcctgaattttactggggtgtcttccatgaaaaccaagcagccaaggatgtagtagaatgttgttctactgcgggcacatctgtattcttcaagaaatggaaaagaatccctctgaaaagattaataatgaaaatagaatcacttctaagaccaggaatggcacagggataacatgaaacagaagctagtgagaagactgtacagaatgatttgcaattataaattttgtactctccagcttgagaagcagttttccagtcatatagctgctacgaaaatacatatgaagaattgttaccataataagcatgagacatgtaaagtgaatacatatagctacaactttacccagatgcaagttcaaggaagagggacagagtatgatcaataacatcctcgcactgtaaccacacaaaggatcagccacagcatatagatcaaagtatgcctaaaatcagtaaatgtctaaacaataggtacctcagcatagcactttagattagtagctattttcccaacaatggcattgagtaaaactaaatggtcattcaatccaagaagctcagataatcttgcatacaactgctgcagcaaagaagtaaaacttgatggggatttacataaaaaggtacatcaagataaaaagaaaaattataatagttatgtcctattattcggtttcttctaacctttgaagaatgcatggcttgatctcctacatatgaccttctgaaattttgcacaaagataagaatagcacgaccaagtctttgcttacttaatactcgatatctctgcaaagaatgcacccaagtcatcattcacaaatttgtgaagctgtgaatggttataagagcagctaaaacaggttaatgaaagtaaagaacaaattggagagcatcctgtgatacgtagtgtcgcaatacagaaacagatttggtttatggggacagtatgtggtttacatgctgcacataatacaatatgaaatataactctcttaaagtgggctggttaccaaaggttaagttcatagggggacattgtttagatattttcgttaaataaattcaatttcagcctatttttaagtgcaaattcacagcttctattggtagcattctcatgataactgtaagaaacaccaaaacaccatcaacaaccacatgcgttgctgtgactccaagcttcacgacaaatagagaaacgagtaattggttatatatgttacagtattggcgataaaaataaagttgtaagttatttgcattacagtactagaaaatatctatgtttgtcaaaaaacaaaatcagtcctacctacatatgcaattatattctataatttgcagacaatactagaaaggaaaattgttgttgctacaagtacactagctcagcactcagcattgatgttagatgaccaaatcattttcatctaacctgtgcgtgcacccccgtgtcagtaacgtttatcaactgtaacacacgggctgcaagttctgcatcaattaactcctgtgattcttggctgcatgaaaaaatgagcattgtaggtgaaaaaaaaaggaaatcaaacagaatataaggaagcaaggaatgttaatttctcacctacaaccaatggtctgcctaatcttgagaatggcttcaattatgtggactagccatgtgagctgtccttcaatgacagagagctcattcgcatctccaggagctggtaatcttgacctttcctgtaaaaagtatttggctttgaaaaggcattctttctgcccaaaaaagaggactgtgaaataacactaacataccgtataagcttgtagaagaggctccataatatttatgatgtaaatgctactgttttggtactgcaaatcagcaaaagaaaatcatgttatggccatgtcatataatgcaactccctatcaaaaaaaaaaaggcctaagaacaataagggcatttcatctagcttcttcgtactattggtaactggcaaggaggttagtagtgactcaaaataattatataaaaattccatccggacaaaaataacagatatatataatgaagtggcgtaataaattagctgaaaacagcagaaatggtaataagagatcttcatctgtttgagaggcacaatgtagatagctaaactcacatgttggcaagctaacatacataataaacataggatgtgtacacaacacttgcgaaggctcaaaactgctaagttgcatgtctatccacagttgcctttattcttgaccatgtcaatcgggaagggctgacgaccacatgaagtgcttagaaaatttcaatcagccagtttgccataacaaaacaaatagctactgttatactggaacatgagcatctgatcacagccattgacccccccccccccaaccgcccaaaaaagaaaaatgcagagagaaactggtatctttccttttgatccatccaatagcatttctaaatttgtcaaattttttatcttatttactatattttctgcacccgtccagaatatgaagttgaacaactcaacaaagcacttaagttggccaaaaaattactctggttattcttgttttagaatcgtataattaaatacgataaaaaatgaatagcataatgcaacttaaatttgatgcatctactgttgttgtatcattctattagttctccataacttaaagaaagaaattctagtgccatatacaagaaattactaagtgcatgcagtaaactgcaagtagataaaagtaaaaccaatgtatatgttcaataaaaaaatcaattacataaaactatgaatcctgttatgtgaaaagctggaacagggttaatctccataaaagaaaacattcaattgattaagcaaggtatcttatctacaggtggacatgattacaaagatggatccaatcaaaagtttaacagaaaattgtctcttaaattggaaaccagaacttgacaggaaatggcgacctggaatctacaaaggtaaggaagagactccaactgctcctgaagaacatccacattatccaaagtatcatcggatgagtcgtttgcaaagctggcctgagatggatagaaacaacagaatataacaaacgttactcttcaactgagaatctgagatagaaagcagttccatcatctcattagaaatcagtacctgaacagaattaattctagaggtgataaaaccctccgtgattttgggaacagtctcatcaagcatacttggtgtgtcacttttcaagtaaggaacagatgtcaccagccttgaccaaaggctcaaaagatagtagacactattgctggcccactacaaatattcaatagttagaactattggaaattaattattgaataatccagtgctaagagaattagtcaaaaaaaaaaaagggaaacagacctgccatgacaacaaggatttagttgtgaattctgctactaaaccaatccattcaccataaaactcaatactcagaagctctgacaactgcaaagtacaacaatgcaagaatccacacttgatcacaaagaggtccattcatagcttgaatattactatgataataacagagaacttgataaaggatcataaatgagtgcagccaacactatctaatacacaggtaacaatcaaccaaccaaatcatttggtagtcaaaatgccgggagtattccgaatgtcacaatgaagatatgccaacagaaaccaaacataatacagttcaattttattttcatgatcaacatagactaatttacataactacgttattatcaaagttctaaataagaaggaatggtcattatggcaaattttgaatgtggtaagaaaatattgaaccatgctttttatttagaacttaacaaacagtaagttagtaataggcaattgggacaaggaatgcatatagaaaaatggtaaaagaaagtttggaacaatggccatcttcagttgacaacactattacacaggtattaaatgctccgttgtttattgaaactttgaaagctaataaattggtaccaaatgtctgtaaggcaaaaaattaaaagaagatgccaacaaaaatagcacttgcaagttgcaaacattaccaaaaatacataaaaacatcataaacacaatagttcacttcgtagaattataattatgatacaaattaactattccatcaactgttcactacaacatgcactgcatcattacgatatgctctacatcaaaaccaatgcactataaaaatgcaatccactatttaaaaccttgaactgcatatcagtatgactagttagtgctgctagtaaagccaaaagactagaagctacaaaccattggatttacttattactgttccttcaaagcaatagtacaaaagtacaaatcagggtaaaataacatcagtaaggcgtgtttggaatcccacaaaatccccaccatcgcaattcatttcagtcaggataccaaccagaattaatgcatcactactgttgccaactaattcatcagttgttacgtaccaaaaactagcaagtcaataattctgtaaaagaatgcaaagagagagaacgaagagcaaatccttgacacaaaacaaacaagaaaagttagcttcatccttcattttaagtaacaggattccaacctggaaattcactttgaaccgtccaagaagacggcagaactcgtggtaatttccatgatcagcaagacctgcagatgagcagatcacacatcagaataaattacgtaaagatatggagcatttatttttgttcctgcatggagctaatttgacagacaagtacctaagtttaaagattactattgcatttataatgaaccaatgtgtgcttttacttataaaaagcaagtctggtttctacagtgcaccacatagcgtgactaggcatgagtcaatcaactcatgttttaaatgcttcttcactttacataaaagaggcttttcactccatgtaagaggattgcaattgaaaccgctggtccaagtaactgaaatttgtaacaggagtactacaatagaacagaacttggcaaaaaaaggacaaagcgttataccttggccagtttggagtatctcctttgtgcctgacatcagatgagaaagaaactgggtccttgaagggtcctcaacaaaaatactgcgcctgacagaagcaagtctcacaagacattccaaagcctgcagaaatgacataaagaagtgcataggagagggaggcggggaagagtcaaggaaagagcaaatccactgaacatggcacattactcatatagaaagaaaaacgaaacagctgtttgtaagataaattcacaaggaaaatatttcttcttagagattcttgaaaggaataaagcatgcctcttagagatccatacattaggagaatattgctgcttcacagaggtgaggaagtcatgcttttaaaagacaacattggaaaaatattgctgctgaatggaagtcaatcaaaatattgcagaactgtagtgatagctaactagcaataagtttgtaaaatgtattaatgaaaaatcatgcgatcaaagtgtacattctaaacatgaggaactatgaagcaaaatatacctcttttgtgtttatggagtaatggacaaagcactcggtaaaaataatcagagattatatcatctatattattcaaatcacccaatcaatgtatacctcttttgaaacacatgtatcgttgactttatagtaatcgaagaagatctgaacagtagaaggatcttgaaggagaggcctccaagatgcaggaagctgcatcaataaaaattacacaaattataagaaatagaccaactgggataggtcaatggttttacagagaagataacaattgtgcaaactaacatacctgcactgtaccaaattcctcagagctttcatccacaggacaaccaacaaagtcaaatgacaagcaccttaatgcaagcgagaggggatcacgcctaaagtcatcaggtactgcagtttaattacagattgtatcagaagatggaagtgagaaagtgtgggcattccgatacactctactttttacaaaatgtggtccttgaactttaccttcactcttcagttggtgtaatgaggttaaagaaatttggaagatctgtagaagaaactggtccttgaacgaacaagcaatttttctgtgaagtgtcaaaggcatagcgtttgcctgcatgcatacacagacacaaaaagtcagctaaacacattacagtccacctgacaaaggaaattgaacaagagtggataaaaatgggcacagcagtataaactatattgaaaagatataagcaacaacataagtacataacccaatcagaattgaagatattaacgaacactatataattcataagcagaagacagcatgcaaaaagtatgaagccaagtacatactgagaaagcttaatggtccaaatcaactattcattgaaagaattgttaccggaaaaaaagagaaacagttcatagaagatatttgtagaactagaaccctttcttgtactaagcaagcaatctgtgttatttcatgttaaataaaatgaaactcaacattacaagaaatacagtgacacacaatcatattcaagaaactataccagaaaaagttaagacaaagaaggaaggcataaaaagaagtgacaggctaacagaaaggtgggacagtaaaaaggctgaaatgtgcatcacagctccaagcaggtaaaaaggaatgctaccaacactaccccaacacaatttagtaaggtgccacatactccctccatctcaaaatatttgacgccgctgacttttttaa

SEQ ID NO: 23651 - DNA, 13835 bp, Oryza sativa
aaaagtcaacggcgtcaaacatttagggaaggaaggagtatcatattgccgccaatactctttaaaataaatggaaattaatacagtaaccatcagtgtcaatgtttaactttgtcttgttaacattggttggattaaccattaatattttttcaataatactatgcctatatatgtctatctgcatgtttataactctttgttaagtgtcgcaaaggaaaataaagaacaacttttacttatgatattaattgattcatgcacaagttagtgcatatgtagtgtttcatgtacgtttgaccttctgtgtttcatccgatgttttataagtgccaacaacaccatgcacgttgtgcagttctaaacacaaaaaaaatactgttgaaatatttttttttcaacttttaaattaatctacgtattgccaaattgcattatcttatgggtacccttatcttattgattagaatcaatagttattgaacaattataataatagagaagtttctaggtggcacctggttcatttctcctacaagatgatatagtatcttcaatcctatgaaataatgatcctgggatgcctgaaatgaaaagcataagcagcaactttagtatgcatcaattaactcgcaatagagcatggaataaaacctataactgttcctcatatggattctttaatagaaatcaggttcttatgtagatttatctggtaggccggttatcctttttcatattacttagttctaaagaacgggcattggtcatagaaattgccaaggatttatgtaccaaggtgtatagctccactcaaatcgaaggtacatagtccttaaatatgttatcaacggttaaaaagctctcaactaaatgccaacaaaacagacaacaaacttacaagagataagaaatcagctgcctccttgacaatatctctgaatttatcatcatcgaaccatccaaattttgtaattcgacagacaagctgaattagggatttaatcacaaacgtctgcagtttaggtcccctcatagcaagatagtttatgacataattcacttcaaacagatcacaatatattggtttaaaattagcagtagacaagggcacaaaagtacacaaaatagatttaagcattgtttatagacatgtatttttgcaatttatctacattaccgatgcataaaacaacagtgggtaaatggaaataaatatttggccattctaacatgctgcagaggcataaatgaattcaaggatagaatgcaaagaataaatatttgtttgttcaactcgagccatattaaataagcataagacatcaaaggcaacagaaataagttgagtcaaggaaggaacaacaaagatttaaatatggccacttatactaaatagcagtacaaacgagtgcttactgctttctgtggtaacttgcaatgcagaaataatcataactgaataaattggtagagacgtaaatgaaaacatgccatgcagatgcaatagaaaagcaaaaacaggtgaacaactgatttcatgataaatttttggtaaggaacattacagatatcaagacgcaattgcaatgaaagactgcggtcgttgacttggttcaacaagcttgaactggccagcatcagggcatatggtgttgaggcattgtccaatatatattggcactgtgaaatgtagtcactgttctccgagaagcacttgagggtgctttctgcatgtgctcgctcagcggagtctctagaattgtaaagcttttcacataacagctctaactgtgctaggctctccattgatgacatgaataaggagctccaattttccagtagaccaagtatccaatgttaatatccacgaatttgcatgaatgtttgtcacaagcttagagttaatgcactaggtattcggttcaacaggaaacttgaaaagtaccacaagagctttgaagctgaaatatatgattctagcacaggagaaggatagtcacaaactcaatacattcatattacaagagaaatgtttcaacaaaagagttttctcatgtacagtcttttcaatgacgcgtaatcaaagatgaagaccaaagacacaagagaaaacagctaacaagcttatatcgccaataccagccacaactcagcctgggtagagttatctgcaagagtggaaatgccaaactcagtgacagctaaagcagcacaatggcagaataatcatctaagaagaactttttgttggaattgactaagcatttctagttcataacacgcttaaatgagcactaacacaaacatatgcaacagttacagcacaggtaacggaagcattcgagagtaacaaaaagcttcgtgctacatttggtaagctgtttcatactaaagcgcgcgcaaacatgcacctatattacatctgggccggaagtgtagcacgcgaagacaagatgaaaaaggacaatcatgtaagaagaaaatacatgccacatttgtcacgcaatcctaccgcaaaaacaacataaacatgctatccgcatgcatgcacatcagcagaagcatcacacggagttccaaacccctaatcaccaatccgattgcgcagcaaaagcatccgtacagcgaaatcgccctatcgcaaccacccctccaaggatgtaggcacgcaaacgcacatcaggcagcaagcacaagatccaacaacaacccgcgaaccaaaccaagctaccgtctacccaccaccaaagcgccccacaaaccaaacccaacaccgtcgagagatccgacgagcagagcgccaccgcaagatccccctaacccccccccccccaccccacacacacacacacacaccattcacgagcaaccaatccacgacaattccacggtattccgatcctaaaacccccacagcgaaggcgcccggagcccccgcccggggcccgatcaacgccgcccgcgggcgaatcgccagcggcaaccaacgcccggaacggatgacggcgtcggcctcccccaccccaaaccttcccgaagggagcgatcgggagggggggaggaggccagcccaagtataccttggttgtctcccccgcgcgcgcccaccggaatcgggagggggtgtgtgtgcgcgacggggggagggctcactttccggcggaggcggcggcggcggcggcggctaggtctaaggcgagaggatcggaggcgtgcgcttgggaggtcggggtgggtctgcatcgtctgcctaactgcctttgaggctaaaggcaaattttaccgttggcttcatctggtctatccgttgcatctatacgtcatcaacttttgtttatctgttttcatccgcattgtctttatttttttacattttctgtaattacccttcctatagctaaccattatctatcctgaaaacatggattgatctgcaaaatagataatgtcccaacacttgtctaatcaaatattaaaaaaatttagaatccctagattattgatagatgtaaaatatatatatatatatatatatatatatatatatatataatttgaactgtgaagtgaagatgatgttggtagatatatcgtcaaaacattgtcttatggttttaaattttcgtaacagttagttagaaagggtaattataaaaaatgagacattcaaaattatgtcaccggtgttcaagagatcgattagcttacaaaatataggtagtaataattagcagtacattttattgtacaagaagagctatttgtttatgtcaataattaaagaacaaactggcacatttagttcactacgtgattctccgcgctttgttgtagaaattactatgtgacttttaaaaaaattaataatcgagctaaaagtaaaaaattatattagttcttaataacaaataaaactaatttgtcaaactatattaatattaagagagataaatttagtaggctcagtataagattatagatgaaatatgatatcacgcactttgattatatggataaatatatgttaaatattacaaaaatgatggatatatatgtgtgtgtgttaaatattgtgaaaaataatgtgaaggaagatgattggatgttgatttgtagaattcaatgaattataaatgatgttgtatacttgcataagttttgtatttaattattgctaatggatgatgaggtggcatgtctgcatattgagttttagaattagtgggctatagctttataactttatagtaagataggactagctatactccctcttttaaggaaaattaaactcggtaactttaaggaaaattaaactcggtaacttttgactgataattattactatatctagacaaaacattatgcatgttatatcactgtattcatatttttaatatacttttatgtgatgctaatttcatatttattgggatcagaataaaataaaataccgatcaaaatatattattgaagaccgtgtaaaaaaatatataggagataatttgggagagagggagtactatcaatcaatcggtcgttaagcgatttagcagagctaattatgatgagttaattagttgttaattagttcttgaagtggaccaagccatgcagcgctttgatgaacaacggacagacccgatgaaaccaacggctttggttcctttttttctccaacaagaattggatgaagattaaaatttttgtggcacgctttttaaactgctaagcggtacgtttcgtgcgaaaactttgtatacgaaagttgctctaaaatatcatattaatctatttttcaagtttgtaataattaaaactcaatcaatcatacgttaataccacctcgttttgcgtaaaaaacttaatcttcattttcatcttcatctttaaaagaaaaagaacaccaccaaagtttgcctttgaggaggaggaaggcatgacggcggatggggaaggggcgatgcgggaggggagctcctcggcaagggcatcggcgagtagggcgcgtatccgctccgcacgagcacgagtggggcgatagccatggagcccgagcccgagctgcaccgcgtcgacggtcgtctcattccccccgctgtcatggttacagataaggcatatatctgttgatgcgaaaaacacacactggcatatatctgtttagctccagtgcaggtccaaaggttggtgggatgcgagtgtgccagtcagtttcatcctgcaactgacaaaatatgtaaacaacagatcaaacagccgatcggctgacaagccgatggagtaatcccagccgatgccgatatcagccgatgtcgatagggttttgagctatcggctatatgttcaatgtagatgatgatatgaaggcaatcggctgatataataaaatataacaatataatccagtagaaaccaattggctaataatgatatgatagataagcatcgatccgaagattaaagcatacatcggttggaggtctgatgtcataaaatccacaagattagatagatcaatgaaacctttgttgcgatcggctaaatccaacttatatgtatatgcaatccttataagccgatgcaatgtccagataacttatcggctagcaacctgataaaacattagcatgaacctatcggcttaacaagatttatattatcaacaataatctagtaggtcggacctaaccgatgcagcacgacattatatgtggtaatctaatacttgatgagccgatagatctgtctaatgtgatggatataacaaatctatttataacagcattgtgattgtagaaatatatcagctaagatagaagatcagacctaaccaagacagttccaactaaaccgatgcgtctctaaacacaatgcaattagagatagcactaagatatcaggtaggcaaatatatcaaccaaactagagtgatccaaaagatcgaagcgatgcagccttgaacaacaccaatacagccgacagattcaccagggtcggcggaacgtaggacttaccccttcgccggagaacgaactgaaccgatgcagccccgcatcaggtgccaaattccaccggatggtaagtaaaaaccacggtaaagagggtggcgatgcgccgagtagttgtattgatcgagagattcttacaatgaccctgggtgtacatatttatacccatgggtagatactagtccttaacaagaaagaaactttcctaaagataaaaggaaaacataaagttcttattggacactaaacacactttcccaaagataaaaggaaactaacaaactattcctaattaatagataacttgtcatgctgtatcctccttgaactcggtcacttctagataagtttcctttaatagattaattttcttaaccgaatatagtaagaattcgacaactggcgacttgataactctcatcggccgatcctaggactctgaagctgacactgactccaggtctatggtgacttcgggctttacaaaattttggtgttaacaacctcctatcctacgacttatgaaatatacggatatggcataccttcacgtacacagattgttcccgtgtacgccgtaggaatctgttacaaattatggaaaatatctctacgaatcaagcgatttccaaagtcctgctcggaggggatagagtttttgttatattatacaagatccgatgtctccgagtcttacttggagatcaagatgatccacggtataacaaggacccctagggaggggtggaaggcatcgaatctcatcgccaacacacccaccatagcttatgaagctggagtacacgaagtcaagtcgccgggagatctcgtcgaataccacgactacgatcttatcggtatcattgatttcgtctacttctattgtaatatgtggttttccatcatcaatcctatataaactggagtagggctattacctgataaggagcctgaaccagtataatctctgtcttctatttgcttgatatcgtattacatagatcctcgttccaacgtaccccaataccctaatcatccgctttacgagtatcactccaaagcctagccgccaccaactactactccagccgagcaagtcaacgtccttcaagcgctcctttgctcgcccgcctgtccaccgaggaggacgcggacgagcaaacgcccgcccatcggagtaggtcgctacgccagagttccttcgtgggctgccgaagtagctattcccgagccttcccgcatggatctgtcgaggccatccctctagagttccgtcacctgctcaagctccatcgtcggccagattcgagacctaacaacgtcaccctcatgtcgtccagtgttcgctggtccttctcgcgtcgttggcgtcgtccggtcgtcctccatgcgtcgccgccactgccgtccactctccatcctcaagccgctggtgggagcccatccgtcctgctcgcgtcatcgccgtagtccacttgccatcctcgcgccgccgttgcttgcttgtcctcctcgcatcacatcctctgctcgtcctcagcgagtgggcgggcgcaggagcgcctgaagggaggctagaggtcggaggaggaggaggagctccagtggaggcctgggcttcactaggcatgagaggggagaaagtgaaaggaagaaaaggaaagaggaagaagcaaatgggaacaaaaaagaagagatggatggaaaacgtgacggcagtggcacggtttcaattttgtaaaattttagtgacacgactacgaatagacgaaatgtagtggtatttttctaaattgacatatttgtaatggcatggatctaattaaccctaacttttattaccactttattctttcactcatcactttttgtccaatcacataatatccttttattatatagtaaaatcccttatattcacggatagagggagcatagattaacgtagaagcagtttcacccgaatagtaataatattgttgtgaattgtacggattcaactagaaaaaagaaactggtggtcagattaaattgaagataatcttgctcctctggaactggtgggataaccgaaataagataaatgtgggtgaacaagctagaacccccaggggtggagctacattgagaatggggttcctaggcactcggttccaaagatcattttatctatagtaatcctatgtttatcaatcccctcagttcagttaagtgtaccctcaacacagcaggcaaagcaggctgtgtacattctttgagtgtagaagctggtttaatccattatctaaaaaaacacagcgggcaaagcaagaagacaatagagactgcatacttgcagccttgtgctgtagaatgatactaatacttgctaatgcatgcacaccataaatcaataatagccaatgcatgtagcccagcgcttgcctctttcaacttttcttaattaatcacttcaaaatcaaatcaaataaacagaatgcccttgttattttctatggccagagaagagcaacactggcagtcatgctgtcaaaagctggtcaccagctctggagggaaatctgaagctcaactttgatggttcctacctggaagcaaccaaagatggaggatggggttttgtggtacgtgatcatagtggatgctgtatacttgctagggtttacaaaaccgcgtggtaaccatgcggttatcacggttaccatagacggtaactatttcagtttttgaaattatggtttgtctcgtggttaccacgcggttttcgcggtaaccgcgggggtgcggtaaccacgccaaaaacggtaaggtgaaccttgatacttgctggagctggacgaatgctgcactgcgagcccttgtagtgcagtgaatagttgatattggaatcgaatctgattcggcaatgctagtagcggcgctaaaaacgcaggactatgagccagctgcgagcaatcctattttccgagtaataaagctcctcatccaattaggacatgttcagattgtagctaaaatgaaccttaccaaattttggcaataccaaaattttgtcaatttggcaatattgctaagttttggcagaattttttatgtatttaccagagtttgtttaaaaactaaatagatgcacatatttgacaattttactaaaatttgataaaatttattttgcctataatataaacaggcccttagagtttgtcaaggctgatatttcttttattccaagatcttgtaatgtgtgtggtcataatttagctcaatctgctgtttggttcattggttggacccctcccagagtttgtaagcgactgggtggctcgtgatatcgctgagcacacggtttaaaggtcaaaaaaaaaagaaaaagaaaaaaaaaagaaacgcctacgactagcccaaacgcaccgacctgtcctccgaccagaattccgatcgccaccccgcggttctgctctcgccggccgaacaacgcgtgctcacgctcgccgccgccggtcgccgcctccaaatcgtcgccagagaatccgcgtcctccccagatgacgctgcgcacgggagaagcaacgccgcctccccaggcgcatgccgaggaggagccggggcgggggaagcgccggcgcgtcgtcgcccgtgagacgaggctgcagcaggaggaggaggaggaggagggcgcctcatccgagccggagaccagaccgcgccctccccccgccacccccgccactgcagaggagcccgccgccaccgccgctggggcggaggccagggctcagctggccataaacattcgccgtatgcttgctgtcgaggcagagagaaggggccgaatcgctgaacgaagtatgtatgacatctctgcctatcctgctctacttttaaatgttattaggatttgtcgtcgaactccagatatatagtcatcactaaaaactgtgataaaatgcccaagaaatttggattttgatgaacaaagcctatagggaaatcattgcttgcacaaataccggggcatatgaatgtgccttgtcaaattaatttactcttcatataatggagtatcggctagacagattaaccagcttgctcctcttattgttctatatgttctctaattcaggattttcagcttatcgatgaatatattgctaggattttcttgcttatatgctagacatggaagatcatttctgtatgtattacttgcagtgcctttgaagcttttcatgatttcaagtaccatggaagcatatgcatatttttatgtatagagggaggcacaattgaactcatgtttctactggaatgcaatttgtgcatgaaaattatatgcaagtaaagctattgatattctaattctgtctgagtaactaacggtaataatgttttattctagttggagttcaggctgagggtccaattctcactctggaggatacattttgtgatattgatgatggtagtgctaaaagccaagttgctcgaaaggttgctttgggtgtttcacagtcaattgtcagtttatcttcctttgcaggtatttttgtttctagaaacaaacctcttcataacatacatcttagacctccactaactttgttatgtaattcaggtcgaaaaaggatacgggtttgctcaggatttgtgatacggtggaacgatagtaccagcattggtacaatattaacctcagcagcacttgttagacctccatgcggagatgatgtcagggtaagtaataagtttctttttttctattttttttgtggggagggggtgtaaatttcacaaaataccaggtttgggggcactggtaacatataaccaccacatattttgaggcagtctttcacaaaatcacagaacccagctcaatcgttgcaacctcctgccatgaaccatgcatatccttaccgtgtaatcaagcagtagcaaaagcaattgaaccatctcaaactggactaccattttcctttggaataacagatgttaaaaccaattgaattatgcagtcctccggcctggcagaggcattgttcttaacatccccgagtccacactcccaagagtcttgaaaagcattaaccatcatcggacaggaaagatcatcaacaaagcaaacaagcagagcttgagcttgtgctggtggtttaggggaagaagttgtcaaccaacaggcagtacaacactgcggcggcaaggctgagccacagcaatcgtcgttgatagcaaatggcactgcggtgggaggtgtggagtggtggccagccaggtggttcctttccagagattgccaggctggctattgaggtggcacctgcaggtgggcctaatatgttgcaacagctgactaggatggaccctgggttttgtgaaacaaccgccacaaaacatgtggtttagtgataaaaatcacaaaattgcactattttcttgttaccaatgggccccagacatggcgtttatgaaatttactcttccttttttgttgaaatatgttaccacccacaatttatttttgtcctgattttttattacttacttaggtggaggtctttctacctagtggggatatatctatttgccagatttccatggtagatttccatcataacatagccttagttgaagtcacatccaatttcaagcttcaagaggctgttatccttaaatatattatcgacaagggagatgttttagcccttggccgttcttatgaaggtggtcttctgatgtgctcaaggggagaaataagcaacagagccagcatatttgagtgttcagaactgttagtatcaagttgcgagataacaatggtaaataatatctgaacacaatttgctctttgttgccgatatgatacatgcctttttttccttgcttaattcattagttggttatgcaaactactgattcaaattaactgagactcttttaattccttctctgttcagattttactactaaagcacacacaatcttcacacaactcatgtatgcaaacttgaatgaacatcagaatatgcatagggcatccaaaaactacctgaactaatttaatcacatatagaagagccaaacagaaattgtcagctgtttctgtggttttattctgtgaaatagtttttgttctcaatttatagattctgtcaatactgagatgatgttatatgcttctctgtgtctttcagtactgaacaattcaggtttcatttttgctgatgtgtccatcatagagcaggttggtctatgtgaatgtttaattatcgtcttcttttaagtagttgaaacacttggaacttgaagcatcgtccatcacatcaatctgtgtgaatagtttctaagcatgattgacctgtgtctcttaagatcattttaccagcagttactagtgtgatgtttgttttgaggaatcaaatcatttctgtgctggtggatgagattgcttgatcataggatgatcccatgattttggtgggacaacccaccaattcattgtttttcacatctggttttgaggcatgtttggtgattgacccatggcatttccaagaccaaacaactcgttaagtagagagtaggattgagtggatcctttgacatcttttttttaaaaaaccaaacatcctatagctagattgttccatagatgaatatcattttgtcaaaggtttctgtatgcaatgtttttcttttttcaaaggtagctagaattcactattctctagttaacttgctagagaatctcactcttgccggatgcaccagtgtttttccatgtgagcatcatccaacagtgtgatctagtttctgtactgttcttttcctcttgttcaaattgaatacctattctccattcagacaggataattttgttgttgctttgtcaaagcttgttttgtttttctttggacactaagaattaatactgaattgatctactgaagcaaactcagctactgagattagttgataattagggccagggtaacacaactttattaactgagcaaattgtgtgaacacttaatatttcgtggaggtgcaatccatatttttgtttaaaatgtttcttttgttgacctcctctactctgcgtgtttttgcatgttctttgatgcattttacatggacttttcccttttttacctcttgctattcgtgtacatatcttgacaatttattgtgattccttttttctaggctggcaccgggggaccccttgtaaattataatggccatgttgtaggtattaacttctttgaagagaaccaaacgccatttctttcgatggcaattgttttcaaatgcttggaacatcaccagatatttgggtaggtccagtccttatggtgattggtgatgaatattttatcctgatattatttttactttattacctgtgaaggtcaaaaacttgattgttaatttctatacattattatacaattgcctagtttatgtttactgctgcattatagtaatattcttctttactttttacagaagaataattcgaccttggattggattctggttcacctctattcaaatggttccgcttagtcatctagagcacatatacagaaaattctcggatgttgataatggcctatatatttcaaatgtgtgaacctcctctatcctatgtttatttttgcgatactttgccctagatttgtggacttccagaataggtatttaaaatttatatattgtcattccttgtaaattatgtttagaggctcattaacatttggatgagaactctataacatttgtttatactttgggtaccaaaaacttagatttttaaca

SEQ ID NO: 23652 - DNA, 391 bp, Oryza sativa
gaaagggtttcaatggctgtcattgggacaatcaatggatgtggaaagattgttttgattgacagtgctgctgtggagcatgcgaagttaaatggccttcctcctccaacccctgttgaggatctcgagcttgaaaaggttctaggagatatgccccaaaagacctttgaattcaagcgagtctctgtagtcagtgagcccttagatattgcccgtggagtaacaatcatggatgctctgaagcgagtattgagtcttccatctgtatgctctaagcgtttcttaaccacaaaagttgacaggtgtgtgacaggtcttgttgcacaacagcagacagttggacctctccaactttctcttgcagatgtggctgtgatcgcacagacataca

SEQ ID NO: 23653 - DNA, 318 bp, Oryza sativa
gatccagtgcggccctctcggcgcgggcgccttccagattgaggcgcgccagctcctcccgccgctgcgccgcagcctcggcctcctcgagagctcgctcctgctcagtgagctcgtcctcgcggaggcggagtgcggactcctcttcggcgcaggcggcctcgtgcgccgccagcgttgcctcccggatggcgacggcggcctcgcgacccgccagttccctctccttcgtgtccagggcgcgggcgcgctcctccagcaccgtggcgcgagcctcaagggcctcttcgcgctgccgggacgcgtcgagcttcttct

SEQ ID NO: 23654 - DNA, 644 bp, Oryza sativa
agaaaatgactgacatgataagttgcatagaactgcatatgagcagaattttctctggacaacataaatctttgctgaaagcctgaaattaataagaagtgaataaatatgtacgaatttttcttttggtataagcttgatgtaacaaatgcaacaagctgaacaaatggagtgtctctagtgcatgcctcaacggtgatctttgcttcttatttgctgatttgcactgcccattattcaagatattttttatgcgacaatttgctcaaatactaaatgagttagtccatcgagagatgatgatgaattcggtgcctatagttttctgtacttgtataaggtgcaataagccaataatgcgattgatctatggatttgtggccaagtttatttggagagcagttcagttttcttttgttttatatattcctactagcatatctcatattttttatgattggcttcagggagttgtaaacaaaaagagcaaactaatacttgttggagcttctgccttgtgttgggctctgtggctgagtaggaatgatagggtttttgacaaatcacctactgttacttatatgcaggtcattttcaaggcaacatattggcttcgtctgtgggcacagttacaaaagtgtgat

SEQ ID NO: 23655 - DNA, 317 bp, Oryza sativa
gacggagcctccccgtctggactacctctcccctctcctctccgcgcccccacccccctccccgggctccctcccttccttcctcccctagcgcggccgcagataggcggcagcggtggctggggccgaccctcccttccccagccaccttcctccccctctccactaggcgcgacggcagtgggagcggagcctcttctcttaatatgcagcctatattgtgcatgactctgattttaatttccatggacatttctagtaacaaatatcttaatttgcagtgacaaccttcttgctctgtagtaacacatcttttt

SEQ ID NO: 23656 - DNA, 618 bp, Oryza sativa
caataaagacaagcacggccaaagccgggtttcacattaccctttgcaggcttttcacattaaccctttccagctaatttgatttcatcacgtaggaggataacactgtccacgtcaccccctgcctgcgcttttatttgtggccacgcacgagtcgagccactagcgacgtgaacgaaagccataccacattaaaggcgttcacactacatcattacgtggtgccatcatcaccacggtggggttattacggcagctcaaattagcggatgaatcaagacacagtggtttagaactaattaagcatatcattaaactcgttaactaaatgaaggcaatgatgagcaacaaacagaaaggagtaataattacaccatgagaaaaagagagcgagagagagaggctgatttggtttctagtgctacgctacttggctacgacatcatcatcagcttggctaaggggaggacaacccgcagccgtccgatcctcgcatcggacggaccaaaaaaaaccctgaaattttatgggagaaaaaaaaagagaggagaaatcgaggtcagaatcagatcatcccccagctctccaatgtcgggaaggccgacgcgccgatcaact

SEQ ID NO: 23657 - DNA, 628 bp, Oryza sativa
  unsure (1)..(628): unsure at all n locations
nnnnnnnnnnnnnnnnnnnnnnnnnnnnnnnnnnnnnnnnnnnnnnnnnnnnnnnnnnnnnnnnnnattacttatccaacacttaatattttcatctaatacataaatcatcgctaaatctatacttcataataattaaagtactaaaatttacctctattttcttcgacttatatccctcttggcttggaccattacctcttcatttcttctctcttcctcaagctcttctcttctcttttttatggcatgagcacctcgtctggtgcaaactctcttctccttatatggcgtgaggtgagcaagaaagaggaacgaaaagagtgacgttttcaccgtgcttgattgctcaaagtttgagagcattgtattgacagcgcggattcctactctgtgcagcgcaactgtgctgcggtacgggcctagctcaattcaagagtattcagatgaatacccaagatttttagataaaaaatacaatatgaggtatatatttcgtatctgttttagatgaaactatcatcagaatggccagttttcagttagatcaatgtacttagctttaattaacaatggttacattgacagaaataagttaatttggaaacttaagatgccgcttaagatc

SEQ ID NO: 23658 - DNA, 570 bp, Oryza sativa
ctcgtgaaaaggaaatggagttaaaagaaagggacaagaggaaaaggtacctcttttccccaatagttctttttcctaactttcttggacatttctgttcaaaccttttaccccaggatttttgttacctgactttcttttacatttctgttgaaactgtagagaacgtgagggaagtgaagaaactgaagatacatcggaggatgaatcaactgagaaatatagtagaagaaaaaaaggtaaaaatgattgcattattacctggaacagtggatcttttttcgtgtttatgaagtcaaacactaccagtatgtagtaggttactttattttcgtcggaatttaaactgtcaaaacttttgtatattattaacaagaaaaattattctatgcaaaatcctgcagatcgcaaacgatcattaagaaaatcgagcaacaatgatgaaggcttcgaggaagttccttgaaggcatgttcccttgatctggcctttatgttaaaatcatcatcaaaagggggaagcgggaccttgtttaatctttcatgacatgttaatactgcacgtgattaa

SEQ ID NO: 23659 - DNA, 1072 bp, Oryza sativa
taaaattggaacgatgtgatggaaaagttagacgtttacgtgtgtaggaaagttttgatgtgataaaaaagtagaaagttttttttaaaaaaattggaaatatactcggcctatattttcctataaactaattgacttaaaaaagtcacgacgacgaaaaagagagagcagttagagcacactaaaagaagcagcaagaaaaacgagcttactccctccgtcccaaaatataaccacgtaggataaaatgaggcctattctaaacatatccagataaattattctgagatgagtctcatcccatcccatattattatattctgatagggaggtagtacatactctctctactccaaaatataagagatttttttaatattttatttacaccgtttgaccactcgtcttactagaaaaaaattgttcaaatataaaatttaaaaaacaaacactcgtcttattaaaaaatttgctcaaatataaaacacaaaaaacaaaaaattgtgtttaaagtacgttggataaaaaagtgaataaaaaaataaataataattctaaatatttttaataaaataaataaatgattaaaccatgtaagcaaaatgtaaaaatacgacggagtacatatttaggcaactgcaacactctcgtcaccctcgtctgttcgctcgcgagtagcaagtcgccacacgcgccgcagcagctgcctcgaagacgccgccgccgccactggctacctcctccgtcctccctattgattttcttatcgctcgaagccggtcgtcgtctcctacagttccggcaagatgcctccgcgccgccgaccctcccctgtctccgcagcatagcgccgccggatccggccgccgcctcctaaccactcgacttctcgttgcccccgctgcctactccgcccaccgcctgcttccagcccgcggctccggcggcgcctccacgcaccgccggtcagccgcctcgctggcctcccgctaaacccggggatccaccctctccccaaaatcccccttccctaaccccaaccccacctgaaacctaatccggcgctcttgcc

SEQ ID NO: 23660 - DNA, 908 bp, Oryza sativa
aagttggcacttccactgagagtacctcactgagagtaatgcggaaaatcaggatagcaagttcctgtttgtatttgacgatgtatgggtgccagacatggttcacaaggtacaccgtgcagcttctgataataaaatgggcagccggataatcataatcgctcggatgccagaggttgcttttgtaagaagtgaatcttcagtggagtcacagtcccaaacaccatctagttcgctggaacctgtaagaccctcggcgagagtccccaaggaattcatgaagcttacttgtttacatcctaatgacagttttgatatcttctgtacaaaggcttttggaagaccaagtgactgccctatagaactccgtgaagtaactttgaagattattggcttgtgcaattttcttccccaagcaattgtttctattggagcattgctcagctcaaagcaaaaaacagagtcagtctggagtgaaatggctcaacaaattgaagatattcaaaaaagcaagtcaagcctgaacaatgtgcaaaaagtactatatctcagttacaagaaccttccaatgcatctcaagaactgccttttgtattgtagtacttttccggctggttttctcctgttgcctgagagtcttgtccggttatgggctgcagagggtttcatcgagaaccagggatcattgcaagtggaggaaattggtgagcgctatataaaggagctaatccactggggatttctgcaggttgtagatgtggacgaacaaggtagagtagcaagttgcaggatgcctattgtggtgcatgagctggctgtatctatctctcaaaaggaagaatttggagctatctgccatggtggtaaactagcagagatggataccaatgtccgctgcctatttatct

SEQ ID NO: 23661 - DNA, 806 bp, Oryza sativa
  unsure (1)..(806): unsure at all n locations
nnnnnnnnnnnnnnnnnnnnnnnnnnnnnnnnnnnnnnnnnnnnnnnnnnnnnnnnnnnnnttattccaataccaagtgcgtgcatcacatcagcgacgacatacataccgtacttgttgtttagagataaattgaattcacaactttttaataggtctaatagttgaaaacaatggatccaccaaattaaatgataaccgatggctaaatgtcttaaatttttcttagaatttctaagatttattagaacaccatgtgacgatctatgagtgtttgtagggatgctatttgaaaaatatgtttatttgatttttaagaaatttctatggccctgtttagttcgtaaaaagaaaacttttgagtgtcacatcggatgtttgaccgaatgttgaaagagtatttcggacacgaatggaaaaaccaatttcataactcgcttggaaacgacgagacgaatcttttgagcctaatcatggactaattagacttaaaagatttgtttcgtgatttctcccctaacgttgtaattagttttttaatctatatttttttgccctatatgtatgtgtccaaatattcgatgtgatattttggggaaaaaaatttggggaattaaaccaggcctatatgaaaggtttttgaaaacaaaacgttttattagcagttttggaagcttgatagaaaacgaggagaattttcagaatttgccatcgaatacgcacggtttttaggatatgccatctaattcgcaatactttaagaatacgccattgggacgcgaattttcttattctacgccacttcg

SEQ ID NO: 23662 - DNA, 510 bp, Oryza sativa
atattcttaagacatgaacatgctgcaacacggatatcaacagaagcatgcttcagtgcatcaaggattaaggtagatgcctgttacataattaatttgttagtcacaaatgtttgatcaactgacaatcataaaatccacctttttcatgctactacacgccaggagcccatggagtcagtatattttcttgtcacaagttgcttaacaataacagtagatgaactctacaaaattttactcaaagggcaaagagcagcaatgatcaatataccattcaaagtcctgcacgtacctgaactgacataagttgagatcttgattcttccaattttgagcaaagttcaactaaagcaagcaatatggtcactgcacgccttgactccaacgaatttgctataagatgggtggttaacttctgaacttcggttgttgagagtgcttgcttctgcaggtccacactgtctttgatcaagggtgtcaatgccaatggagcatcatctctacatg

SEQ ID NO: 23663 - DNA, 55532 bp, Oryza sativa
  unsure (1)..(55532): unsure at all n locations
nnnnnnnnnnnnnnnnnnnnnnnnnnnnnnnnnnnnnnnnnnnnnnnnnnnnnnnnnnnnnnnnnnnagatttttggtcattagggtaagttcaacacgcagtgaccccttgctgtaattacacaacactcagttcatttgcaattaataaatattaaatgatgttctgttgatttttctttttttacattttacgtacagtttgtattaggtctgacatattcttgtgctgattaaatgtgagaggccacagacttgatgatattaggtaaaaacgttactaaagcccattgttagatgcgaaatataaataatggacaactagtttctgagcttttagtggttccacatgcaagatctctaaactcatttcactagcatcgctacaagttaaatgtgcttttagtatacataatctgcattctgcaatgctttacttgtgctctgactctgaaacaacccaatttgttaacgattacctcatttcttttattgttcaccactcaacttcataagaacagaatgcctattggctgctcaactcatcgttctgttgcttccttctagattttctcctctgccaatatctgccattactggcactggaactggagagctccttgatatggtgtgttcagagctaagtaattttgaggtactgaacttgcttagtttgcccagaggccagggaatgtttaattgtgtatgtctatatgcatgcttgatacccttttctgtttatggttggtaatggaatcattattataattttttgttgcaacactaaaatgttactcttggctgcggaaacaactcaagtattgcttctgacaaatggatatgctaacttagtggaatatttcactctctttcctccagtcctacaaacctagatgaatactgctagaaacacgtggtgtggtgacaccttgttatatccagcctacccattgagcttctagatccagaaccttgaatcataagttgtggtgtttgtcttttcagtagttctttaaaatagccttctcctttccaattttgattcatatatggaaatattttgtccattacctcacaaaatgttttacaggaactggatggagttgaagaagatggaaactatattcctgctattgccattgtcggaagacctaatgtcgggaaaagtagtattctcaatgctttagttggagaagatagaactattgtgagccctgttagtgggacaacccgtgatgccatagataccgagttcaccacagaagatgggcaggtttgttcagaatgcttatgaaagtttaagtgaccaagagcagcatcattatttcattattgaccctagctatgtccacttttcatgcatctttcatctttgtagcaaaacacaatttgaattggaagaaagaaatttacatctcataggaaagtaattctaatttgctgatattgcaatatgctgcagaagtacaaactcattgacaccgctggcatccgacgaagggcagcagttgcttctgctggcagcacaacggaaacactttcagtaaaacgtgcatttcgtgcaatccgccggtctgatgtggttgcccttgttgttgaagcaatggcctgcattacggagcaggtatctctaccccatcacatgcacatgtgcacccccaaacaattcaaagagatgttgtcttaccaatcttttctaacatggtgaatttctgtggtaccaaggactataaaatagcagaaagaattgagaaagaaggaaaagcatgtgtaattgttgtgaacaaatgggacacaatcccaaacaagaaccatcagagtacaacatattatgagcaagatgtaagagagaagcttcgcatactcgactgggctcctattgtttattgttctgcaacacatggcagcagcgttgacaagttaatcccttaactttattttttactccgcaataagcatttggtacttcactactatagcatttgatggtttaagctaggctatttgtagcttgtcggtgttattgtctattttcctgcataccagacctgaaatttaagctgatgtcattaaggcattaactaatgtttcatgctgaatcttcatgttcctctgttatctcccaatttcttgtaatccaactaattgcattgcatgtaggagattgttaacttcactagatatgtttttctgtattggcattgtaattattctttatacacaaatattcctcaggataatttctgctgctgcactagttgaaaaggaaaggtctagaagacttggtacgtctattcttaatcaagttgttagagaagctatagcattcaaaccaccaccacgaacaagaggtggtaaaagaggtcgtgtttattacacaacacaggtagcttctaacttcttattgaaccattctgtttattcctcttaagccaacaagtttatggtctcacctttcaagtaagtcgtaaaggtcactagcgttctcttgatctctactacaactaaattttcacttccttgtatgtcaagtgaagtccttaaatcaaatacagctccttaattcatttttaagtatctgaagatatatgattgattgaaactggatcccttaaagaagtatttcaaagtcagcaaaggatccactggttacccacttcaaagtatatttgatacactcactgtcctaagatagagtagtaatatgcattctgcaatattatcagggccctttgaaatccgtactgcttttagatttgtaaagttcaccttggggaaatgttttcatgctttccttttattttcgcaccaaaggaagcttattcttaacctgcaggctgccattcgtccgccaacgtttgttttctttgttaacgatgcaaaacttttccccgagacattccgtcgttacatggaaaagaagcttcgctctgatgctggattcccaggaacccctattcgtttattgtggcgtagcaggaagagaccagataaaaaaggtgagtcgatatcaaagtgcccacttgcataatctcaatgattttaactgaataatttttctactatcatacctgcatgcatagaattagaaaagattattttgtgattgaatcattgaaacagacagaacgacaatgctagataagtgaaaaaacacagaaggaacaaatattgtgctatcagcaagagagatttttgcagtcccattatatttgatttcaccaatttctatgatatatgtaggtgtaccgtgcacatgataggttaaggaccttggtccttgtattagaacaaatataatgctaatatctgctgaggcttgtagcatcaaggtagttgaccaaagtaataagaatacaaaatatcatgtgatgatagaacatatagaaaaactatttaattgatctgggtatatccaacaccgctatgaatttcatattaggagtaatgttttgtgctctaccatacctgctgttataagtcatatgatgatgaggttaaatagaattgtcatactaattactccatctgttcttggcaggtaaatctgcagacaacagcttgcagagctcagtaatcccaagcagaatggcgttagccacatgagttacacatgcttttcctttcttgagagcggaaaaagggagagaatacagaatgctttgcctgcattttttcccaagaggtcaagactgccggtaaaaaaagagtacaaattgtatatgtagtggacgagtactaggactggaggtcatctactaggtgttgtgactacatggtgctagtataagttctgtatccttggatgtctaggatgaccagcaatttgccacgtttggtgctctgacatttgcttgtgccttggacgaatactgaatagtactctctccgtttcaatttcaggttataagaagttttgactttgatcaaaatcaaactacttgactaaatttatatacaaatatagtaatatttataataccaaattagttttattaaataataattgaatatattttcataataaatttttcttgggttgaaaatgttattatcttttactacaaaattagtcaaacgtaaagcagtttaactttgaccaaagtcaaaatgttttgtaacctaaaatggagatagtagtatattgcgtaccggaatttgccacatcggtgcctccacatttttttaacgtctcgcaacaatgcaaagttcatattcatattgatagagtaagaaaaaaagaaaaataacccacacccatgcaccgacagctccaacccaacaaacctaggagaaaaggctagcaccgaactggttgtcgctatgcatgaccagtcgctgctaggccaacaaaggaactatatccgagaatgtccaaaatctaaccctaacaactgacaccaagcccactctagccacctcttgagattgagggagagagggggtgagagagaatgttggaatgctttcccccctagcccttcgtcatgtccaccttgcataagctagagcgccgacacaaggggacatgcatctagagcaagcttacaccagttgtctggaaggattcggcaaggggctgcctagataatgtctccaaggagaggagcaaaggatacaccgctgtcgtcgtccattaaagtctcaaagagagccgagactgggttttcactcggcagccccactggaggtgaaggggcggcacgataacgccctcaaaaggtagagacgttagggtttagaaattcatttcaattgatttaatttacctttttatttggaaatatttaaatattcacctcgaatactccagtgaccgcttcgtgcaccataccgaccgcctcgacatctcgaacgatccagctcagctcaatctcccgaggtaacgcatggcgcctcgttctccccgaaattacgcctactcgtattagagcaaggtcaatagtgcagcccactactagctccaaatcgtctatagccaatgtaatagccaattcatataatagttgcttactgtactattaatatctggtcccacatgtcatacacacattacgtcttggagtccgtgctgcagctggctacaaatctgtagcccgctcctcttctctctcttcctttatctctttaaaatatgtttatagctggcttatagcctgctattgtacctgctcttactactcctacgattcttttgaccaaatattttccaccgtccgttggaattgcagtcactgacaccctgaccccacacgcacccttacccctcctgtatatataccccctctcgatttcaccatacgttcccctccccctccctttcactttccccatctcctaacaccacggcgaagatgcaccgtctccgccgccggccgaccggagagcacggcaccttctccgccgcgcttgcccgccggtggctgccgcggaagacctgttcctttctccggcggacggcgggcgggccttccgcgccgtcgacccgtccatagctccgcctccgtgatggcttgtcgtgtcgccggcggcggcggcggcggcgggggtggggtttcctccgccgcttcgtctcggtggcgaggccgacggcccattggggcccaatggggaaggcccatcccccgtggcggcttcccggccacgccaacgccttcttcttctgatgaactctccctggcaactggggcccgcaccgactcgcccaacggtctcccccaattttcgcctcttccgcctctcctctcttccaactccgacgagcggggccaacgccgatcgccgcgccggagcagggctagggttccggccaccgccaccgccagaacggtgcgtcgcgtcccgtccccatccttcttctgcttgctttccccccgttgtgttgcgctgtgtttttgattccgttgttcttgttgattttcttgcaggaatggggggttcgttcggatggttggagtttctcttatcgacctcgcacccgtgcgaggatgatgcggcggaggagcttcccgtcgagccgccggtggcggcgatggatgccgcccatgacggccgcgatgaggtgcggggagaagtcccctccgagccgtcggaagtactcgctggagaggaggaggcggcgatggatgccgcccatgacggccgaggcgaggtccggggagaggtcaccttcgagcgggcgatcggtgcctcctcccgtgcgggttacgaaggcatcaagctgggggaggagccctccctcaaaccggcgatggtgggcgcgcccgagattaagatgatcgagatagcagaggcctcctctgttgcccagtgggacttgttggcggggacggaggattgcagccctgagattaacccgaagattgtcgacctccagcagcagcagcaggaggcctctctccttcctgatgaggtcatctctgaggcagacgcgtcaatcttggcgcagtattcatcggtgacaaagaaagacgatgatgctgagttcttgatttgtcggccaaactttggttttgttacacgaccacagcaacacactcccaagaaacggcaccccaagaacaagcgggctatggggattaacttggtaagatgtttaaagccaacactatttgtatctgtctgccttctttttggacatggaatttatactgatttcattattgatgtttcaggctaagtcttcttgttcttactgttttcacttatatcttgtattccagataatttttcttgatggagattgttgtatttagtagatatatgttattctgtcttgatggagattgtcaactttcatagacatgttattctgttttgatggagattgtcaacattaatagacatgttattatgtctagatggttattattaactttaatatacatgttatttagtgtaggcattttttttaatatttatttttgttttctctgttttcttaggttactctacaatctacatgtctaacagccattgataatttatattgtcattgtgttttaattaaattgatattttgtggtattgtgttttgtagtggttaatctttaattgttaattcatttctttcttcatctctgatctagtatgaattatcaatggtgtaagcaagatttgtgctgtaagcctaattgattttttccttaacaccagacttaactaagatattagctttatatttttcaatgcgattcgtgtttttgctctatatcttaactaatatagatggtggctctgaaataaaactaacacaagacaatcttgtaacaaatatagttcgtgcatgctttgccatattattgtagggattaaattccatcagagcttttactggttgattaatactgtcaatagtattgtatataaacagtgaagattaaggcaagtaggcaactgattttgttgatttaaattcactgagctttgcttttctgatgtttatatgtgctgccttgtgcccatgtctttttgctagtcctggacactgcttgctttggcacaatgcattcatacggcccaatggtgcagtcatacctttcccttgttgttaggcttagttcttaatccctcaacgtttgttgtacaggtttcgagccaaataaatgtttgcttgttgaatatgccttgaataattttgtactattattaaataatgagtcatcttttggttaatctgcgtttgtttgtattagatgtgtttgtacatattattgatattcagttattgcgtccaaaaacatgatattcagttaatctgaatttatttggttcatctgttttactatgggattgattaccattcatcgtgaaactaatgtttgatcttttgtttttcagttggatcgagagggaaatatctgcagtgatgataagcttccaagtcagggttgcttggttggtgaatacaataatcttttgctgcagttgtatcagctgctgttcgatttaaaagagctaatggagctttgtggccaagctgataagatccagagtgaggtgttccttaaaaaggcaatgaaaaaagcttgcagagattctgatgatgctgttgcagacatagtgtttcaggccctaaaggtagatggtttcattctgaggctattaaggtatctgaagagccaattcaatttttgccggacccaggcatggaagataaggaatgagatattgagaattggtggtacacccatcaatgatccactttccaaagattctccttgaactttttgcttctgggcccttgaaccacctccaatatgggacgttgttctagaatcattgagacatatgctcctgattaccacatattttgcactttggcttgtggtggtcgtaattgttttgtgctaaatgtaatcctctaacaggctgaatgtgaaacggtcagctgtggtactgtatatagacatgtatccaatctgaaatgctttgtatggttgtatacctggatggacatatgcatcctatggatagctggtgcccagctgtggcaatatgctcgttgtatatgaattagcacagagagtggtgaatatgaaacttcctgttcttgttgatatttcactttatgttttaaattctcggcatcactgcttgtgaaattgttgaaattgtcctggttattcttggattataaatatctgatgacttttttgtttctgtttctatttttctataattttgaaatgtaataagccttcggatatttttttaagggccctcttaatttgtaaagtcttctgtattttgtgatcataacaaatttcttgttcgcggatcggacaagttgtccaatctttttcaactcgatgcattgatgtcagtatgtttggttgtggacagacaccgtttcggattggatatcatccgacaaccttggtcttcagtgcccgtgtctcgtttgctttatttgtttcggacgtccctgtcgcttcgactccgattctgttaacttcaagcgtgaaggccctatataatgaatgcacttgttcgcttctctctctccctctctgtcaaaccaagatcgacgctctggttgctttgttaagtctgcacagggaagagaaaattgtacgagttaactgatttgggcaatggaaacctcaggctctgacgagatgcagcagggcgtaaaggttgatacgactcgggtcatagagaacactgctagcaccgtcgacagcgagacgcccgtagagcaaaagaggagaaagaaggtggaaacggagtatgtcctcggtgggaaggatctagagtttatcttgtcatacgaggacgatgaacttgagacatttgatgaggatatgctcaaggaccaggcaatggtccggcaacagattgagaattttggctatggtttcctccatagctggagggaagttatctgcactgatagtgaagaagaagatgaccccgtgtccgatgatgatgatgatgatgaacaagatgacttcttcaccaatgatgatgatgatgaccagcaaaatgtcgaccaaatggataagaacatgtatgctgaggcctgaggggctaaaaagctaaaaacgatcacaatttgtacttttcttacaatatatattgcatgtcttaacttagttattcaattgattcatacctaaaaaaaataaattgatttattgtcgtatatataactagatctgatttatttctagatatattttgttcttcatattattaaaacttggtgattctttactttttctcctaatttataacaatattggatatttatctgttggataaattctcctgccatcttcccctgaaaaaaaatatatgttggataaattagtttatagcatctactaatcctaatttgctatagatagcatcgaaaggtttggctcactttaatagtaccaaaagttggaggcgcctataaatcgggcgcccgatttttttatcaaaagtttcgaaaccctagctccccgatagcgacggcggcgccgggcatgcctcctcgtcggttgcggctccacccacttcaggaggagaggagagagaagagagggggtgaaaataatattaggagagtagaggaggtgaaaaaaaattgaagtgctaagagggaaaagagagaggaaggaagaaaaaaatgtggataattggggtattttcgtaagtgaaaatatgctcatttttacatgtggcctcttaagaggtccgtttgcgaaaataaattttaaatacgggtctcttaaggagtcgtttatgaaaatagagatcattatttagacccgatcaattacggttcgcttgcaacttattagggtttatgtacggaaaaatcgtttctacaatagtgaatttttaattttaaaaataaagcatacttattttaaatctaaacggtaacagtacggtttgaaaattccagctcacgtcgactgtatatctgcgtttactcggtctcacatccgacggaattgattccgatcacaaatcaattgtttaatcctgttctattgagctaatcagattctggtttggttaggtatcctgattctgttaagttaagccaacctgattctgttttgtttagatctaaagatggtctaatatatactacctgcataatcagttcctgctaatctcaaaagcaagaaccgtgactactccagactccagcctagcgagaagagagaaagagagagacagactcagaacagtgacaatttcagatttgcaagaagagacagcaggagtaagccaaccgattaatcgatggaaacattcagctgctccgaaaaattgcagcttgatgcagacgttgatactttggttgtcgaaatcacagccaccgtcgtacacaacgggctagccacgaaggtgatcgagaaagaagaggagaacttgaaaaagaaaagaaaatgtgtgaagaagatgcatggtggagtttgtcattgatggtgatgacttggagtttaccttatcatatgaggaagatgaacttagcttccttttcgagaaaagcaatgagctcatgctaaaggatcaagaaatgttccagcggcagatcgagaattttggctatgcctttatccatggtgtgaaggaagtcatcctcaccgatgatcgatgaggacgaggaaggatgcgatatcttaagtgacgacgacgaagatatctccatcgccagacaccctaactaggacgatttaaacaccatggatgtgacaactgacaaatactcattgatgaatacaagttagttctgcatgagaatgcagctagtgatctgtttctaatatactactccgtttagttccactgatttggtattttgcatcggttcttcgtttaatgtgcttcctgctcccacctcatcgcctcaggatgcagctagtttaggctgtgcttagttcctcggtcaaaaattttttaagtacacaaacacacatttgaaatattaaacgtagactaataacaaaacaaattatagattccgtatgtaaactgcgagatgaatttattaagtctaattaatttatcattagcgaatgtttactatagcatcatattgtcaaatcatgacgtaattaggctcaaaagattaatctcgcaatttatatgcaaactgtgcaattggttttttttatccacatttaatgctctatccatgtatcaaacatttgatgtgacggagtttttggaagttttgaaataaactaaacactgccttagtatattttcttaatttgtaccactaaacctattagtattatttaatttggagataattaattaagacggacaaaaacaattcggggaacaattgttggtatataaaaatagtaaagcaaaaggtgttattaagccctactgattggtggggccgtaaaaaatgtgggggggggtccaaaaataacaattttttatacagatgcttatatcatccacacgtaaaaataaaaaaaaaattccctggaacagaagagccttatctggaaaaatagtgctatacggatattctgctcttttctgtttatggttgctgatgaaattgtttcaataaataggtattataaggatatcatgataatttaatttttttttgagaattacacagtataacgcagacactcacaacgcgcgcacttagatcacccctatgaacacacgcacgcaaaccctacccctatgagcatcttcgaagactgggccgggaaatcctggagagattaacgaagtcaccgcaggcgcctcgctgtcgacgggtacgtcgcctaccactgaaagcacaacgcctctttgaagactgggccggcaaatcctggagagattaacaaagtcaccacagacgcctcgctgtcgacgggtacgtcgcctaccactgaaagcacaacgccgatatatatatcctagaaaattcactcccatggtgagtcgaaaccaggacctcaggtgctactaagactcttgtaaccactaggctatttttttaggttaactggacacatgccattacaaattgcctatttagaaaaacaccattactatccatcgaatcagtcggatgccactctgctcttctacaattggaaccgtaccactccgtcatgggttgacagaaaccgtgacggaatgacttggttccaattttagaatagtagagtagcatctaaccgattagtaatagtaatgatttgattttgcttttctccaatcctacaaaactgggaagcattgttctgcttagataatctacactgatgtgacaatttaacgccgtttgtgtaagttattaaaactggtcttttttttttcagttgggaaaagatggaaaggactgtagtcctgtgaaattcaaaaacaggatgactttgttaccgagttaaacaatcatttgataactgtttaccagacagcactcaagattagagaaatgattgaattgtgtgagttttacgcaaatatgtcaaactccaagaggaatgccattcctgcaaagatgctgaagaatgctcactgtcaggaagattttggtgtccttgatttaattgaccaggcgcagaaaaatgacaagtttttttttgctaacattgctgtgaaattgaagtgtttgctgggacgtctttgtactgcaggttacaaactccggctgataataatcaaaaacaatggcaggcctatcaatgatccaatgtcattagattctgctagctaggtagctccttatgattggaagtagtcctgggaatgctcttcagctttgatttggaatagaaaacaatgatagatgctcagtctccttccttaaagacctgtgagatcttcatattttctatttccctcttgtgtgtacaatcttctctttgtgttggtacttctgtttttaggtgcaacagatgtttgatgaccagtgcaatttgtattcgattttgtgtaaagctgcttttaggtgtagtgccattgtctattgttgcttgcctggtaccttgtgaattcttggtacagtatgatgatgagaaaataccagtataatcatttctggccttgaagatatatttgtttctgagtacttgtagtagtagaactctatgttgtgctgggatgtttggtgttcctaacttcgttgtgtagagctcgtgttaaattggtgtattctcctggtcatgtgttcagatcagtttgtggattcatattcaatcggtgaattgatataggcttcagactatatattcaaatcggattatgcttcggacttcgttttttctgttccactgttcctccgaattatgtcgtactggtgagaaagatcgattaaattagttagtagtggattaatttaattccgattctgttcaacccagtctcaagttctttatactactactacttattgctttctggtcgctgccccctgaaagcaagatcgacgcgagcgtacgtcacaaacgacttgcgagaagataaactgcaggagcttagctgctcgatcgatcaatgggagcatcgttctcctacggacaaacgcaacgggtcaccgagaataataatgccgctgcctccaccgtcgtcgccgtcgtcgatgcgccgggtaggggcggatccgatgtgagttccccctcccaatcaattctagatccgccccagacaccaggtctggagcggggcaggggcggatccaacgtgagttctccctcccaatcaattctagatccgccccaggcaccagatctggagcggaacaagaggaagaaggtgaagaagatggtggagcgtgttatcgatggtggggatctagacttggtcttatcgtacgagaacgacgaagaatgtttgttaaatgagagcatgctcgaggatcaggaaacattccgtcaccaaatcgagaatttgggctatgcgttcatccatgtcatgagggaagtcatcctaaccgatgatgaggatcaagaggaaggcgaaattgtcacctatgctgaggaggaagatgatattgttaccgatgatgatgatgaggatgattagtaattaagcaacgaggaaggggctaacaacatgattgaaaagggttcagaaggctaaaaaataacaagtgatcgagtaaagcatctatgcattttagttacacacttacactacccgtttcatattataagtcgttttgatttttttttctcgttaaatttatttaagtttgatcaagtttataatttttttaacaatatctataatgttaaattagtttcattagatgtaacattgaatataatttgctaatatatttattttgtgttaaaaatattactatttttttacaaacttatttaaactttagtttaaatagggaaaaaattcaaaatgatttataatataaaaaaatggattagtatattttcagttagttcttcaattgatttgctatatggtggtgtcgagtgtgatagtgaaatcatgggtgcaagattacttcattcatttatcagcgttcaaatcccgatattcatccccaggtaaaccccatatataagattactgtaggcattcttgattggtccataggttaaagttatgtactccctctgtttcaaaatatttgacaccgttgactttttagcacgtgtttgactgttcgtcttattaaaaaaaatcatgaaatatgtaaaactatatgtgtacatgaaagtatatttaacaatgaatcaaatgatatgaaaagaataaataattacttaatttttttaaataagacgaatggtcaaacacgtactaaaaagtcaacggtgtcaaaacattttgaaacggagggagtatatatacttctattcattatcttaaaaaaatatatacttgtgaaaaaggaaagattcagttattacggtatgcaaaattccccaccttgtcatttggcgtgctttctgctcccgccttcgacgtcacatatcacgatgcgcttgcgagactgaacaaattaagctggagtactatattatcatgttgtttgctgcacgagatcagatagatgcaccgcttcatcgatctgtttcgatgaatcgcgcgccgatcgagacgttgcccgatctccctcgtgtgcaaatttcagctcaagcactgcaaatccagtttgcgaattgcctgaaaaatttgcaaattgagctcaaacactccgtgtatagttcttcaaattgatttgcgctggcacgtaagatgtttatattccccagcccgcttccgtcgttcatttgacgtattccttgctcccgcctccgacgccaccgtacatcgcacggttgttgatgtaccggatgcatgaatggcttggtcgctctccctctctccatttcaacccaactgcgtgaactaaacttaatttgagcgcgtcagatatcaagctcctacttgatatcgagccggttagcggcaaggcgttggcgtggtggccgcgcgttgaaggtgtacagttagtggtggccactgttttcagaatgcaacggcaacacgagaaggcagattacaggcacaagtccaaccttgttgggccagcaacggcgatgcctacatacactgctttcccattggggcgtttttacgtgaactttctcaaccatgccacctggatacaagaacttctccgaggaattacttgcatgtttcctcgtcgatcggctggatgactacttcgctagaaagaacaagatacatgacaagcgcgtgaaaccaatcctggagttggtaaaaaaaaccaatcctggagttggtaaaaaaaaccaatcctggagttggtaaaaaaaaccaatcctggaggagcagagaggatttgcaaggagtacaaggaggaaggctatgccgagtactggatcaccgacgacgaggacgaagcagccactcgagctccggcgccgggacggaggaggggtcgacgaggggtcatgaataagaagcataccggaggaactaagaatctttaagtgaataatagaacaaagtttagagatatctgtgcactcgatgcaggtttgagagcttcttatgtagtactcccttgcattttaatgtatgatgtcattgatttttttatcaacatttgaccattcatcttatttaaaaattttatgtaattatcatttattttattgtgatttgatttattatcaaatgttctttaagcatgacataaatatttttatatttgcacaaaattttgaataaaacgaatggtcaaacgttggtaaaaaaatcaatggtgtcatatatcaaaatacggagggagtaacaaacatctggtgatcatctagttaaaaggtagcccgcatctcccaagtgttgttttcgttgtgctatgttggatggttagctagtataactaagtgcagtagttaagtgcttttacggttcttgagagttccgatactttatagtgtaaaatttggtatctaccgagagatactaaatttgcgctcaaaattttggcacttcttaatatctcttaggaactataaatatttcgcagtagttaattcaatttgcgctcaaaattttggcacttcttaatatctcctagtaactataaaatctttcgagtagttaaatctctaatcattgagaaaatttaatttgtgcccttaaaaatttgctcaatcccttatgtgtccatcaaattttgcctcatatcttacacgccatcgagttttcatcttgatcttctctgtactcattttgctggttgaccagcaatttttttttcaaaatgtaacatgatctaagttgaaaaaagtcattgtaaaaagcaaaggggatagaattatttaaccacaaatttgaaaaaaaacacaaaattgttaaataaatttcagatcaaccttgatgaacttcgttgaacattttcaacaaaatttaaacctaaataataaatttaaacttcgctgaaacaatttggtaccgtgaggtacggtatctcgagatactttttgatgtactggggcatatctcttccctacactaactaatgccaacacatcatgattaatcatcatatctttctaacgcttcctcctcctgacaggttcttcttcacggcgactccattgcggaaccttctccggctaggggagcagcaactcgagcaggaactttattgtctttgtcgtcgtcgtcgtcgtcgatgtcgacctcgtactcggcatagcctttggtgaagtactgcctgaggatcccctcccgttcaccccggatttcgttctgcatctttatccagaaagccttgtcctcttctcggctgtcgtcgatcgccttgagttcatcgatgtagtcttgaggacaattcgcgaggtcgtcgccgaggatctcaatgatactcggcatgttgtcgtagtcgggcatctcctcttccttgtacgtgatgcagttgttgatctgcgcttgggtaaaccgcaccatcttcgtcttcgccttcttcttcttcttcttcttctccatcaccggcgccttgccttcatcggaggtaaccggcgccggcgccggaatttgtccgtcactttttttccccgagggagcttcatcggaaggatccatcgttgtcgatggaatttggctttgatcacatgttcccttggatgtgctcgccattgtatttcacatgttcccttggatataggctcttaatttttatggaagcaccgggtcgatcagaaataggtaggattcgggatcacctcgtagttcaggttcagcaggagtccatgagatgcgcgactcatgttcgactctgactcttcttctttcatggtggatttgccgtacgtagttcgtgcgtacggatccggccctatggcagccagcacgcgcggccgtcgtggttgacgccagcggcgccgggacgctcgagctcgctcctaacggagatgactaacccatctctctcgtttttcgtgcgcacgcttttcaaatttctaaacggcgtgatttatacaaaaagtttatatatgaaagttgttttagaaaaacatattaatccaatttttttaaaaaagttaatgcttaattaatcatacaataatataagcttcgttctgcgtgtcgggaggagtcccgaaggtaatttgacatgctgccatgcatatgcaccaactacaaatttagctagtagatccgggtcctcctgtgcacgcgcgcttgtctaccgcgtcgtgcggtggtgtggcggcggtgcgacgcgcgcagccggaagcgcggcgatgcacgcggcgcgaatgtcgtcggtgccgtggtcggtgccgagcgcgcccgcctgcgccgagggccacttcacccatatcctacgccgataattgctcggctatttatagtgtagtcttaaaactactcaaagtgataaaatatttttaaaaacaacctattaagtagcattttattcttgtcattttaatgggtggcgttttgtcgaaaccacgtgaaaaaagagtgccatattgtcctttttctccaatgtttggtatgccgggcagccgggcacactcacagtcacagacggcatcgaatccggaacctattcggttcggagtcggatacaaaacaaacgggtccgacgattcgcggaagcgattccgaaaccgagttattgttggagttgcgcttgcgctgcctatatatattccggcatctacccgaacccgataactctatcgcaatcgggtcttgggcctcaatcgagaggagactcaggggaacaattcatcaggggcgcagctggccttgccttcgtgggcttaggattagatgccgcaccttttttcattcagatgttgtgatctgatgcgatgttgtatcattattatcatacaaatgacttagctctttcggttcggtttcaatggtgacggaatttcaggcgtcggggtgatggatttctccaagatagaatttagtgaggcgaagcggattttggcggcggcgctactaacctccgacgacgaagatagcaagcctccgacgacgatggagaagaggaagacgaagatggtgcgctttacccaacagcagatcaagaactgcatggcgttcagtgcggacatatccgacgacgacgacgaggaatccctgcccaagctctcggaggtgctcagcaaggatatcctcgatcgggtgccgcccgaggttcttgacagcttgatagagttcgagaacacccggggagagcgcaaggctagatgggagaagctacgggacgatcttcatgaggaacgggatgctatcctcaaacaatactacacgaaaggctacgccgagtacgaggtctatgatgacgaagatgatgatgaagatgaagataataaagttcctgctcgagttgctccccctggccgccgcagaaggttccgcaatggggtagccgtgaagaagaatcggtcaggaggaaacattagaaagatataaactgaatgatcatgttcagtgttggtccatatccatcttagttgtagtgtagggggaattatagtttctccttcatttatcagtataataataacagctgtgctactctgtggtttgactatagttctcttttagattcctgctatggtttgattctagtcgtgctatgtttttatcttggtcagcattgatctatcatcatggttcagggaacctgaaagtgacctagactgaagtcacagatcagtagttttgttgactgctctccctgagataatttcagtagtagttctgttgactgcttttttttggacacctgaaaaatgttaggttataatttggaaccccttgcaaaaagctcgcctgaaatatgttaggcctaatttaaagaagctaagctgatctctgttgacatgttttctcctacattattcagagttgcatgataaggattccaatggactaaactttttgacattgtcatatgagaatggcaccctgttaccatctgtttctccaaatgccaatgcaactaggatcaacaccggaaatgaatgagtcaggcaggcagtgtgcttgagacaatcagacataatattttcagtttagcttcgcatacattgagttggttcccccataattaatataccaggtcttagttggtccccatagagtagttatcacttactggtatggtgcccgtgcgttgcgatgggacaataaaaatatatgcacacggggtaaaattatgttaaatagtttgagagtacgtatattgtacacgatccctatcacatatctcccctataaatacattgccattgtcataaatcatcaccaattcacgacaaacaggatcgcgattgccctttttctttcctgttcacttccttttgaaagcaaaacacaaggaaccatgatcagctccaagaagcaagctcagtttcctaataagtggcactgaatgggtgccatcaactccattgctgactacttatgttcacttgtaacaatcttctggacaccataaaaaatcatgacatagtcaacaatcttctgttcaccaattcacgacaaacaggactttatcttatcatacgaggacgatgaacttgagacatttgacgaggatatgctcatgtaccaggcaatgatccggcaacagattgagaattttggctatggtttcctccatagctggagggaagttatccacactgatagtgaagatcgaagaagatgaccccgtgtccgatgatgatgaggaggaggaagatgacttcttcaccaatgatgatgatgaccagcaaaatgacgaccaaatggctaagagtatatatcattggttacttctatactataagtaaacaggtgggtgctttcatttgaatacgaataattagacatagctacattatctgcttctatcgttcgtgtcctccaaagaactgatcagaatagtagtagcacacgctgagttgcaggtaatttcaggaaggaaaaaaaaaaaccttgggtcagaccaccgttgtcactgtggggtaaactccagaagacagagaaagctaaagatatgtcctaggtatgttttctctaggaaactagtactttaaacatgaggtagacgtaggagataataacatcaaaaccaatagcacttattatattatttagttgtatctggtagaagaatacaaactaatgctagagttgacaacttttttcttccttaggaacggatttaaccgatttgcatcctattaaatctttaggcttatagaaatgatatagccaagctatatcatgacaaacggtgataatctacggcttgaggcgcctgataaaacgtgtattttatattgaaaaggatgttttcgttcagatattgtgttagtattttaacagtgttgctgctaatgctgatctgttatgctaaacaagaaatattaaaccaaaaactgataattgagattgagttccataatccaacacaggaagatactacgacaactagtaggtaaatcttaaaaaaaaaaaaaaagaacgactcgactgctaatcagcgaagtgtatcagcacatcgcttagtagctaattcagcttgttaacttttcctccattgatggaaacacccggtcgaaaccttctttgaccaggatgaggagcagggaaatcttcagcgcctgcaggagaggattcttggtcgccagcaggtaaggtttcttctccatcagcttcaccagaaggtaaggttttttctccatctttacctgcagatcgattcttcatcttcacctgcagcttcgtagcctttctgataagcgtctttctccacatagcctttctcatagtactgtttcagaacattgtctctcgctctcatatgccttgattcaatccggtttatatcacggatgatcttagcaaagtattcatccatatgatccccaaccttaaccatcctcctcacgaaactccacggtttggtaccggatgtggctatcaatctcggcttgagacatcaactccttcttcgtcgccgtcgtcttcttctttttcccttccgacgaactgcctgccatggtcgtcggctttttcccttccttctctgctgctgatgccgccgttgctttcttcttgccttgatcggaagagcttgacatgatcgctggctcgcaaatccagatgacaggaagcgcaccctgcgatcgattgtcgtgtgatttggttatgaaaaaacctgacctcgatacatctgctgcatatttattggttggtagctccagttcacaatcggagtcggaacctgcccctgccgatattcccaaccggaatcggcagagcttcagctgcccaaatctagtttagtttagggtctggattaggcatgactaatttttaggaccaagtttgggtatcggttggagacttgttttaaacttaaaattccaaaattagatttttaggaacatgtttggatatctcttggagatctctaggtgacatcatttattattgtaaattaattttctagaccctaaaagtactcaaaattgtgtctcatccagcctagattcgaagaataaatgtctcatctaatcctaagttggtatatactcctattttggaacggagggaatatatatttaatttttgggtgtaatttatgttatcctcctggtcctagttttgaaataatgttttgatcaccttaatctttcaatgttctatactgtattattgctcaattgattggagcatttgtaatagtacaatctcaggcagcacggaaacatcctaatatgcgtgcctttgaacaaggtctaagcacgtcatgagcaagaaaaaaaattgtgagctagcaccttatattactcagaagcatgccatagaatcaagctgcaaaaatattacacaactagaagatgagaagatgtcagtgagggctttttactgattatcatcgtccacagatgtgattgcaatctccatcttctctttcctcaagctgtctgcaagcttcaatggccgaagttcaatggtggctgctctcacgaaaccatcctctgcattgtccaagctgcgttcaatcaccatgcttgaggtactcatagctaaaacaagggacagacatttgcacaaactcatagctaaatagatttgaggccaccgagtgcttctgtgctaaagaaatacgagtaactttatatggtatgtttgctaatatcaagtgtttgttaataggaaaaagtaagctacattctgtctctagcacaactaggatccattttattggaaaacatcagaccaggctagataaagctacgaactgagcaacatagtactcatgcatgctaatgtgacagaagcagtatgcatggaatgaggtgatcatgactaatgacactgattgacaagtatgtacttaaattgaaaaggtagtaccttgcaatccaagcagaggtcgtttatcaggccttttacttgtgaaattaccccagcaatttgaagtctgacaactcccgaacagaaaaggcctcaaattttggaccaatcaagttcagagcacacataaggttgcaactcacaattgttaatccttgctctgcagaaagttaaccacaaaagatggtttgacacgatctgctcgatgaggtacaagaacattcatcacagccttcttgtttaattcaccaccaactgcaacatttgtaagcacaaacataccctgaagagaggaaacagaaaggccaatgactaactatgatttttgcattctttttttcagataataaatagtatcacagttaagaagcatgcatccgtatgaaaacaaaaaaaaaaatacactgttttattggaaatatttccctttttgccctccatagtttaaaaacacatatgaaaaaaaaaagtatagataaggtaagtcagtatactgtagtttaaggaatactgacctgtatgcacactcctaaggcatatgtgcattactcagctgtcttgaaatagcatttaaaatcatgccatcttcaccaataacataattaatggtgtccacatatccttcaacaaaattttgctgctgctgctgcacctcttcaccctactatttcaccattcgctcaaacgctcatgtgaatctatctgaaagtgccaagacaacatccttgacctcatgtattttgcgacaagggcagtgacggtaacaagctcaccgccactgctgagctgcttgacatgagaatctgtgctgcattgttccccacagcagcacagcatctgtgcccacacctggcagatcatctctagcgtgccagtgccatcagcaggcgagtcttgccggtcgatgaggaatgcaccaagcgagcatcctcccctcaacatcttgtccccaagtctattagtatttgtacaagttaatttaaacttcggtttagagctattcgtcctcaatgcatctgcgttaagttgtagcaagtggagcacatcctcagctgtgctgtacctcaggtgacgagtgatagcatagcacagcacaagataatcattgcggctggcatcgggaggcagcatgtggggacgtgatgcaagcaggaaaagcatgtgattggacagcgcctgagccgtttccataaggtcagcagctgaacctgaaccatcgactacctctggttgctcctctccagcagctgaacttgagccattggcaacctctccttgctccccttcagcagctgaaactgaaccaccgacggcctttgcttgatcctcttcagcagttgaacttgaaccactggcagcctctgcttgcccttcttcagcagctgaacctgaaccaccggtggccgctgcttgctcctcttcagcagctgaacctgaaccactggtggcctctgcttgcttcttctcctgatccttgtaccagcacaggtagatctcagtggcgatgtgccagatgaggatcctctgctccatcttggactcagcaacccaggctgggtccctgtacaatcctctgctttcaaattcctcctgaccccattgcttcgccttcatggtctccagcagcagctgcttggtacacgccgagatggggatgggcaggcccgagtaagccaacctgttccaccagtcctcgactcccatccacctcgcaatcttgctgcatcggctggccctgctgtgcacgcacaactgaatcaggttgagctgccccatggagcgtgaccagctgcgcctcctcctccaatatgccgcacggaccagccggcggagacaggcgggtatgtgagcaagaaaattacacacattacttccttccgatcccttctttaccaggagtgcacatgtccagctcgagaacatggccctcaaaagtgacatagtctccaggatgacggctccaacaaagaggacatatgtaacaatgacatctgctctgctgtaaccattcagcttatgctgatgatgatttccccagactagtagtatattaaacagaaagaatgcaacggtggtggccagagacgaaagcactcggatgcaaaggccataccaagtgtgtgtaatctcagacttggtgtagaagacgtcgtggaggagggagagttgcatctcagccaccttgtacaactcgtcctccccttgcaatcgtgatccttcattcatggggccacacaaaaacagacgaggtaatggccccttaaacctatccttggcaaaatccaacaataggtgagcatttaatagcaaggtttctgctggatccaagcgacgtatgaatgactcaggcaccatttgagaaaatcttcttctcgctatatcactctcgtactttccagttgggctactaccggcacatctgagcgcccagacacgctccccatacttggcaacacctaccattaacatgaggatggtggctgacaggagaagcaaggtccggctgtcgccaacaatgactatggaggacccatagatgacataggcagctggggccacctgcacaacaagcgtctgcaggtggcgcagccacagccggttgtcctcgatggcgtaggcagtgattttgtcctgcccaccaaggtgcagcagcaggaacggtgcccagagtgccaacagctcatgctctggtgacctgctggtaacagagaggtggccaagcacgtagatcgctgtcccgtcggccagcatgtatgcggaccatataaaggcccttagcacgccagagtcaatgtaccggcggaattctgccaagatgaggagtgtgacttggaccatgaggctgagaagcaccagtgcttggagagcccattctttccatgcagcgctcacagcctctgctcctgccatcgatttctccaccttaacatctgaaatgtatacaccaatcgattgacataagtcaaaactacataatatttctttttagtttatcaacactatcaaacctaattctgatggcaatctcaagttctaaactcagcatccaagcccaagcagaataatgacagctgagggggtgtgcttccattctgttggactttcccttgttccgtatcacatgttccgggttgttgtttctttaattgtggttgtgtacatctttattatgcagagaggttgtgagtaaacttttgtgtggttgtacttgtattagctagctgtaataatgagagtaataaagctcccttttccacaaaaaaaaaaaactactatcattataattgttgtaaaagcagactcataccctatttcagcctaagcattcacattgccatgagaacttctattagaatcattgtaattaaggctattgtgtacatccaaagaagccactgagaatgcatcagactctttaggggttgtgtgcttaaagaatttgtgattgacttcccaaacacttttctcttatacgtcagttgtttcattgctattatttcagttttcatttgcttcattcttaccatcacctgaggccctgagctggctcatggcatatatggcaagccaaatacatactgtattcaggatatataaacataataagtgatattagagccaaggcaatgtcaatctgatttacaaaagaattagcaatgcatcaggtgccacaaattcaggaacagccttaaacaatgtggccaagcagaaaaacttgatagcaatgaagtcgtattaagtgagagctacaaaaatctcccagtttttttggctactgatgtgataaatgaatcttgtgttgcatgtacttatgtgaagttgtatgttgatctagttgggaagcgcatgcggaaatctccgtcttttaacagcatgattattatctatgcaccacaattaaaatttatcggacatgcatttttctaacaagggtaatttggatgaaatacctcctgcagtaaacacatattacacagaagctagctatgtgaatagagaaacttacacacgataactgaatgggtggagaagtgatcgatgataatcttcagtttgacagacaagttatatatggtcagggattagccagtttgatatgtttgaggggatgaatgcaattcatgcatagttaagtgccacacacaaatatatcaacatgcatgcaaaatctgatgcaatgcctcccagagggttaaggaatcaagaaaagatgtcattcatctgatacctgcccagcagcaagtaaaggataaaagtaaactattctcctttttttccccaaaaagaaagtggagtataagagtcaaatcactaacgctgtatcactttataacgatgcctcattttccttttcatctacaataatatatggttaacatcacatcacaacccctctaaaagaggacctagaactgaactcgtataatctcattattttcccatctaattctccctaacctccattgctccacttacacatgggcccacaagtttttttctcaccaaacaacaaagaaaatagttgcatagattccaggaaacttggtcctgacatctcccgcggtcctgcggcatatgctaggttcaaaactccaggaaaaaaaaaacagacctccagtacatgttttgaagttgccatgggtagccataagcattaagatcccatagactgtgatgttaattgaatcatcaatctacagatatttaagacctcgctggaacccatgattctcaaggcatatgaatagaaaaggattagagtgctccaactcctacggagcgttgaaaacatagaagaactgcacaacaaatagctgtttgaatagagcacatgaaaaacacaagaatcatataagagaggccatcaacttacttctttggtcagatgaatcgggctatcgagctttgtttcgttggtagaatgaataccgatgggatgatctagtcttttttgtttggttggtagtatgaatatcggattgtaccaccccttcccacagttgttgagcttatgattaattatccatccatttgacagtgacacaagcaaattgcggtcatatcagaaacgaaattatgcaccgaggttggtgatcttatgacttattatccatccatttgacagtgacacaagcttcacattccagtcaatgaacatattagaaacatgttaaataagaaatcatccatttaacacaaggttcacagtcacagacaccctttttttttttttaccaaccatcgattcgtctacaagactacagcaacaaatgcaaccaatccttcttccatctatccattataccatccatccacgaaccaagtcagggccgcaaagggataatcgattaccttgggcggtcgtggggagaattttcagaatataacacccaatacgcactgcttataggatttgtcacctaattcatactactttcagaatacaccactagagtacgaattttcttcgttccgtaacactccgtccatccaaagacgcccgtcgtcagttcatccatctctcgccgtttgcccgcacgaatctggccgccggcgagctcgtcctcccccacgccggcgagctcgtcctccccacactagcgagctcctcctcccgcacgcatctggcgagctagctcgtgtcgtccccgagctcagccgccgccgcaccgggctgccgccaccgcgccccgagccggcgccggtccaacctccgccgccggagctcgaagccctctgccctccaccgctgctcccctctcctccggccctccaccgcgtgcgccgatggcggcgacggacgagcgacggcggggccgacgcgggtgacgacggacgagcaacggcggggctgacgcgggcagcgacggaccggcgacgccggagctgacacgggcacgagcggcggtggactgacaacggtggcgccgggaggacggaggactgacgctaggggacggagtgtcacggaacgaagaaaattcgcactctagtggtgtattctgaaagtagtgtgaattgggtgacaaatcctggaagcagtgtgtattgggtgttatattctgaaaattctcggtcgtgggagagcgaaggagggttcgccggcggccggagatgcgtcctccgatgccggcgcgcggaggtgcggcgtcgggcaggcggtgagtgaggacgatggccgggcgcgcctattggatctatcatctacgccgccgttttttccgaccttctccggcgagccgacgagataatgacagctctgctccattggtcaacgagtcaacggatttcggttgtgacttgtgagtactactatggtccatccataaaaaaaaatttggtatattttgactttccaatttaagctttgactaataattaaccgcaagtataatggcatactagtataaattaactataagcacacatagatgagataagaaaagaataaaaaagaaagtgggctgcagatttctatccagctacaatttcaaaatgttgtgtgtataagaggtgagaccatatattaataatatagtatatatttatatgcaactattgtatgaatgcgctattaaattagctatagatgattctcttagttaacgctatcgaaatttaaaataatgttaggatcgttcgttttatttaaaaaatttatgtaattaaaatatattttattggtagttgtttaatcataaaaatagtttaagcatgatttatatttcatatatttaaaaaataattgaataaaatgaataggcaaacgtgtatttaaaagtcaacagcgttaattattaaaataaaaaacggagggagtatttaggttttatcattattattggattcatgttagaaattacgttcttgtgactgattttgtaaatgtaggcaaaattaaaatacatcaaagcttttttacggtcaaatctttttacatcagaatacaaactatattaatgataagctttgttttctaaaagtcaaaatatgccctatatctttgaacagaaggagtacctccctttacaatatttgcacaagtactgcctatttatgaaatttgaccactcatcttctttataaaatattttataatcaactaaaagcgcagcattagagaagtgtgtttatatcgtaagtattataggttgcaataccctacccgcaccacaaccaacaccccaaagccatcgtccacgacatcgtcgtcctcgccgccgccaccatcatcgacatgcaccacctcgtcgtcctcctcttcctctctgcactcgtttttgtcgtcgatgtcgaccacctccccatcgtcttcgtcgtcatcatatacctcaacctcttctctgtcgtcgttgtgcacatggttaaggcggccaacatcatcggggtcaaggagaagggattgtccctcctcgtcttcttcggcgatgacactattcctttgttcacctgcgtcatcatgtcactggaatcctgtactctgacaggtggccacatgtatagctttgtcgggagttttacttttacctgttggactcaataatagtaggtacaatagtaggctataagccagctataaacacatttcgaggagataaaagaggagggagaaagccagcaggctacagatttatagtcttatagctagctgcagcacggactccaaggtgcatgtgtgtatgacaggtgagaccagatattaattatgaagtactgcctccgtttcaggttataagactttctagcattgcccacattcatatatatgttaatgaatctagacacacattcatatatatgtctagattcattaacatatatatgaatgtgtgcaatgctagaaagtcttataatatgaaacggaggaactatatgtttataggtaactgttatatgagttggctattaagttgactatagatgatttggagcccgcagttggctatactattaaacttgctctaaccaatggcaatcggaacgtacaggatcatataactagcatacgcaaaaaaaaaaaagaaacccctggtatttactaaattattttttgtgtaagaaaattaaattttgacaatgccataaattaaatctttgggtaatgccactagatctctgaccaaatttgacttgacaaaatttggcttgacatggcacgttgtggctttagaatctttgggtcaagcatgcatgtcgtgagcaataagattttttttcgtcgacgtgcataaaataatttaccaaaaaagcgcgcgcgcatacgcatacatacatacatacatacatatatatatatatatatacatacatatatatatatacatatatatatatatatatatatatatatatatatatatatatatatatatatgtatatatatatatatacacatacatacttcttcgtgttatattataagtctttttaattattttcctaatcaaacttctttacatttaactaagtttataaaaaatatagtagtatttttaacacaaaacaaacatatcatcgaaatatattcaatgctgattgctagaataataaaatatattcttaaaatgttacttatttttcattaaacttagtcaaacttaacaaagtttaatctctttgttaatcagaaaaagtcaaagcgacttataacatactcccttcatccacaaaaattacacatattacttttgacaccaagaccaaggagaaattaaattaccttggatgctacaaaatcaagaagtaaataaaagcatgcaaccaatgagtatttagatgacttcttgagttctaataaaacatttaatttatctcttcatttaagtcttaaatgcataaaaactataaataggaacaacttatttggaaaaactcaaatgtgaaataggtgaaacttttgtggatggagggagtaaaataggagtatgtataattaggctaaggctgaaaaatataggtactactatcaactttcagaaactaaattttggttacttataaggccacacgacgagagcaagattgtgatcaggaatacccagaagcatgtcaagagtagtatctttattgagaagcaaaagcaagcggcaaaaccattacacactgcttgctgggcaccgtcccatggccgaacgtgaaaaacatagcccaagagagtagtacaatttacagcagcagtagcatatctccctcaattatacactcaccactcatcgtcacagcacaagcactaggtttttggtcatgctaaggaatgaaatttctccagagctagcacctaaaacctttttccgtttcggaggaaatcagctcaggttttctgacgtggcatggttacaacaaggtttcttgcttgtttctgcaagagaaaccagtcatggtcctcatggagttcaccaaatttacaatgacaggcttggaggcgacgagaagatgtcggtgaaggcttttttttactggatgatcattgttcacagttcatggcgcggattgctgatgcgaagagatcaatcttccatcttctctttgctcaagcagtgtttgattctgcaagcttcaatggcccgaggtgcaatggcggctgctcacatgaaaccatcgtcggcattgtccaagcagtgttcaagcaccatgcgtactctaagctgcacaagggacaccttgggatgttagtttaagcacaaaccaaggtttgtaaggttcaagaacatatgccgacaaatgctaaccaactaccagacatgtttgtcatcttgcattatttttgttttattggttttaatcaacatccttatatataaacccatttgaggccatcgagtgcttgtgtgcttagaattttgcaggagtagattttaactatttgttttcctatagagtatttcaatatgtgtaaatttgctaatgtcaaatgcttgttcatagcaaaggtaaaatgacattttctttgcccaatcaagaatatacaatttagtgggcaacatcaggctaggctagataaagctacgaaccgagcaacaaaagtactcatgcatgctaatgtgacaggagcagcaaggatgggtggaccataaatatctaacagcagcaatgaagtaatcatgacgctgattgacaatcgtgtgttttttcaagctcaataaataaaagaacaaagaggtaccttgcaatccaagcagggatcatttatcatgccttttacttgtgaaattaccccagcattttggagtctgacaactcgaacagaagaggcctcacattttggataaatcaagttcagaacacaccacaaggttgcaactctcaattgtttgtccttgctcagcagaaagttaactataaaagattgtttgacacgatctgctcgacgaggtacaagaatattcatcacagcctccttgtttaattcgcccccagctgcaacatttgcaagcacaaacataccctgaagagaggtaacagaaatgccaatgattaactatgataataaatagtatcccgataaagaatgtgaaactaaaattacacggttttgtcagacaagatgttccttttgcccaattttaaataaggtaactcagtataatgtagtttaggaaatactgacctgtatgcatactcctggggcaggtgcattattcagttgtcttgaaatagcatttaaaatcatgccatcttcaccaatgacataattaaaagagttcacatatccatcaacaagattgtgcaccagtgccaaagtttgttcctggacaaaatgttcagaatctgcaagaaatgttgcattagcagtgtggctgattcagcaatgacctaatatcatagctgcacatttagacttaccacatatgaggcttgaaagagtagataaagttagttccttgagaataaagtctttatcctttggattcaaaaggaacataatattcctaagagcccacacagcttttaatctcaatgttggatccatagacttggacaaatgaacaagctgggagacagccccagattgaagaagaatcgatttcctgggtgttaaattcacagcaatattgcaaatagcaccaagggcagcaacctgtaataccattttgtgaacacagacatttagtagatattctacaaagtcccaagggattaaagacctaaaataatgacgtttcacaatcataatatagctaatgtagtgtcccttaagtggaaaggttgctcaaataaaatgagtccatggtaggtatgaacgaccaaaagagtttctcctaagttaacatcttactttttaagtcactaatacagttgattacttagtgatatgtaggtttacaatctaacacgaaaacagttagtacaacatgatgctttagaagaattacagtagagcccatgatgggcagaaagaaggtaaaattgcagagaaatcaggaaaggaggaagctgccatgcttccaagattttcctttcaaaaacccattgaccaaccctctacaaagaaggaaggcaattccaagcagtgtttcaaaatttgttttttgaaaatttcttggacatggacagatagtcgcttactggtcaaatctgaccaagttagaactataactcgacttgattgaattgctcaagacctttttattccaaacaacatataccaccaagtacttgccagatcatgtaaaaaaagaagccctaatctattagaatcatgcgctgtccagcaggagctggccagttccttgtggtttctgaaaccatgctttcaattacagattcattgccccttaaaaatgatactgaaggttgcttcacaattttacattacctgaactgacatagacgagtcatacaaaagctggactagtggggcaataaatgtatcacaggataatttcccagcactaagtacctgaaattaaacatatcaactcaaatcatgtaagatgaacacataacgctgaatatacataaggagtatgtgtcttaccttggatgacctagagatattcttaagacatgaacatgctgcaacacggatatcaacagaagcatgcttcagtgcatcaaggattaaggtagatgcctgttacataattaatttgttagtcacaaatgtttgatcaactgacaatcataaaatccacctttttcatgctactacacgccaggagcccatggagtcagtatattttcttgtcacaagttgcttaacaataacagtagatgaactctacaaaattttactcaaagggcaaagagcagcaatgatcaatataccattcaaagtcctgcacgtacctgaactgacataagttgagatcttgattcttccaattttgagcaaagttcagctaaagcaagcaatatggtcactgcacgccttgactccaacgaatttgctataagatggttgcttaacttctgaactgcgtttgttgagagtgcttgcttctgcagttccacactgtctttgatcaaggttgtcaatgccaatggagcatcatctcctacatgaccaggttcctcgatgagctcaagtaagaccaggatcaacttggttttaatttgtctgtcttgaaagtgacagggagaagcatggctaagcgcaatcaagcacaaacaagcaagtagtcttgtgcgtgggctccgatcatgtattaatgcaactattgagcgcaaagcttttccatggtccagcagtgcaaatcttgaagcaacttcccagttatttcttatgattgcagtcaaagaatctaagcaagcatcccgtagattcatggagcctccaaaatggttaacaagtctctgcggaactccagcagcacatagtgctaattgttctgtagtgctatcacaagagtgagatataatattggcagcaagctctgtgacattttcattctcgctgttcaaaagggtaagaagaaattccatgtttttctcattattgttgacatcaaactttggagctagtttcgattgataaatcattctcagagcacgtgcactagcatcaacaacctgtaatcagaatataacctcgggtcagatcatattattattattattattcatagtatgcattaatggttataaacaattcaatataacatgaaaataatcagaatatcagatagcaccaaaacaccatgtttcaatgaagagggtgcttggatatgaactcttatgcattcatgtattgttacaagttcaactgtacaaactagatgcttaagatagcatttagttattataaatgtttccaaaacagaatgttaaagcgaagcccagaagctagctggttaatccaaagcagcgagtatccctgctttgaataactgtatattgtggcctttcctggttatttatgtccttaatatgaatgtgcaatcttttttcaaatatcaatactagacaagataaggagcaaaataacaactggcaaatcattttttcagataaattggcatcccactatcactgttctaaaaggccccaggcatcaccatactggttagcacctaatatttgtttagcctgactagtcagtgtaggaactagacaccaccctgctgcatgtatatgcctaacgccttttagaacagtgctatagcaaatcttgaaagaattaatgcctgacaactcgacaagagtggttagggaaggatgttagagatgggacaatagagagctaccaaagtagcttgacttgtttcatctctttttcttgtttcaacccatctaccatgttttgccccctttctaattgtcacttctgtaacacaaacagctgccctatgcctcatcatcacttcctccaccttgaagatgcaacaaagggagagactgaagggaggcgacaagcaacatggggaaggaggcagtgggatgtgggatgtggtggtaatagtggctaccttgtttggtcagtaagaattgaatagggagggatggaagaggtagagctataactagtaattggggcataaaggcacaatgagcatatggtttgaggtatgcatggctgtatcttcaaaatactggagctgatctgggagtagctgacaacaatgtaagtatacctccccgaagttgtacattgacttgtcaccatatccttatgcaatatgtacttctataccatgtacttctataccagtaaagttgctaggagatatacctgggtaaccaaattttgagctacaacctatgcaagttacgagttaagtccatgtggattgtgttaggatgatacaactatcttttctagctcatacaaagaaggctttagtgattcaggatattcggtgttatggaagaatcacaagtttgaattgcctcatgactttgtttagtgttaagatttcttccttaaagtttccttcaactgtcaatttcaaatctcaaataaaaagggcacccacatcctacctggcaatcaagaacttccagttacacagcaaaccaataaggatttcagcacaaaatttccctaccaagaaaccattgcacaaaacatcacactactgccaaactcttagttcaagcatatagtatgagctacagttttaccatgacccagaggaagctatttaaacatcttatttcatgcttacatctgtaaagccaattcagttatcagttcagacaaattcatcatgaaactaacacgaaacagacaactttccagcacattcatccccaccactacacctaaccattgacccactaccaaactctgcacatttcaagcataaattgaacaataccttcagtactttaatcaaaaaaattaaaataaaatagagagaaaaggacattaaaaaagaaaaggaaaaagaaatgacaaccaccagtacctctcatcttagctaaaccgacagattagcctatagttcagatcaaataattcccctcattccaagcaaaacccaaaccaccaatcatgatccccctagtacaaatttctttccaaccaattcacaaagcaactatcgaattaccacatttattttcatattcttactcacctctaaaccttatttaccaaacacattgatgacacagtaaaaaaaaatgcattcatggcaaattggactagtaagcaaatactcttcacatcgcaccagtaaatttttctcaccctaaattacaatatcagcagtaaagaaaaatcgttaaccaatctaatcactaattcttcatagtatcaattcagttgccatccaacttttcctgttcccaaattgcaaacataacccaaattctacaccatatgattcccaagaaatcaagcaagaaccagttgcttgctgtctgcttagttccgagcaagtctcctctacgcaacagatcttctcccagacgaataattaatccacaaaaaaggaaaacaaatttctgctaggcgagaacaaaagatttcacgcccgatacaaatcggaaatccatagaagtgagcaagcaagcgaagcaagagaccggctaccttctcgtcggggtgggcgaggagccgcgtcaggtgggccacggccccggcggcgagcacggcccgcacgccgtcgtcgacgccgcacgcgaagctcccaacggcggcggcggcctgcacgagcgcggcgggggaggccccgggccccgcgagcgccgccacgacggcgggcacggcgccgaggcggaggtactggagcttcttggtccggttcccgatgatctggttcttgatctcccgcagcgtgcgcacccggtcgtgcttccccttcttcttcccttctccgccgcctccgccggggccgcgccgcccgcaccgacgggtcggcccccggggggggcggccagcctcgccgtcagcttcttcggcctcgtgcccatgcagtaggacgcggtcggcgacggcggcgaggcctaggccgccgtcttctccggtcgngcaccgtcgttcgccgtggccggcatctggtgggggagggtgggcgaaaggtgtttgatttatttctcctcttttttttttgtattttccgagcgattttttcctctttggttggtatttttatagagggagagattgagaaagaaattggcttgggttggaagccctaagccaatgggataacgccacgtggagtaaatatttcattattttgtactccctccattttacggtttacgacgttttgactttggacaaaatcaaattactctaaatgtaatagtatttttaacctaagataaatatattataaaaatttattcaattatatatttaatgaaactctgctagtgttgtaaatattactatttttttctacaaaattaatcaaacttagagtagtttgaatttgaccaaagtcagaacgtcgtataacctgaaacggagggagtatctctttacaaggaataattaacgttttaaaaactttggctggtaatgattaacaaattagcattagtgtgagctagtgtgtatgtgaagttgttacaggtggttaaataatttgggcagatttagggccaaatattttcctcttatagattataaattattgtgggcacgctttcgaaacttgtaaacgggatgttttttttatgaaaaagatttaaaagtgattagagtatttttaaaacagctttttaagtttgaagtagttcattcatcgttttgtagccctcagatgtcatcagaaaattagaaaatcaaactagaccttattgcagagttttctttttaaagtgttttgtttgttagaatttttctccaaaggcggctgcaatttgtactccttttttgagaaacaaattgagaggtgttgacgtatgcgaatttttatgtatttttctacagtatttttctcagtattgacagctatatgcatgattggatgatgagtctcacatgtggttttaaactcttaatcttcatgctcccattgtctgtatctgcagtcactgtcatcctgacccaagcaaaaacaaactaacctagaaaaattatagcacaacccattttatttgtgaataaataatcctacatgacagattgcacttgatagtgactgcagagaagggaatacttcaaatacacatgggtttttttaagctacatgtaaattttctttacaaaatttctacaaacaacgatatcagtcgtttgatttatttagatggaagttataccaaatctagatgaactcacacatgcctcgtcagagttagtaagaattcagtaaaaaaaaaaacttgtattcatgtaaggctatgtttagttcaaactaaaattggaacgatgtgataaaaaagttagaagtttgtgtgtatacgaaagttttgatgtgatggaaaagataaaagtttaaaaaattattttggaactaaacacggcgtaagtaatccaaattcttgatttcaaggtacagcttcaggtttgatgacaaccatgagcctcctatctatccattttgccaaaagcaagatgtcggcagagaaagggtcccacatggagatgcactgacgctgaaagcctattctactatgtgcctttttctatattagccttgcaatatcaacattttttttcatggaaagatcttgcaagaaatccaggcaaccatgtgtgtgacatgctggactgtttctagtaaacaatgatcatttgatcctgattactggtctgaagaaaatgacagttgaaaaaaaaggccaaaatatcttactgccctgatttatagcgaagggaatcacagacggataaaaggttagtacggtcaattaactattaactaggtatcagtaaaccttggtcataaggcaaaagaaactactgctattaaatagggatcgaaaactattcccattatctgaaaagatggctttagaaaaccgatccgttttcatggaaaccgttagttggttttcataatgtgttgatagaaagtcgtcgtttttttactagttttattggttttcggtaaaccagtaagaacggtttttattttcaaaacaaaaaaaataaatcctagtgagaactgaacaagcaacttataaaagttacttccccttgaactatgcctgaagctgacagctcgatcaactcaaatccttttatcttttttaaaggaaaatggcaggagctctgcctatctcaaatccaaaattcaggtgcaagtctgcaagtacagcggtaatatcattcataatggcttcttgggtcacactaactccaattcatcacatttttgttaactgagttcacattaaggcccagtgtcctcggaaaaaagacggacaaattatttttgcgtgcaggttgcaattgaacaaacaacaaagaacatatttctgaaaaggctgaacttatgcgggcaacaaagttaggtctggtttagttcccaactttttattcaaacttccaactctttcatcacatcgaaacttttctacacacataaacttctaacttttccatcacatcgttccaatttcaattaaacttccaattttaacgagaactaaacacatccttaatgtaagaagcaagtttaacaagaatcatctgtcaccaattcaccatctccatagtcgagactcgacaaagtaatctctgcaggatgcagaaaatcattggaagaacaataacaacagagggaaatatatgacagtgtttcataacagaacaagcaatgcgtatttactttagcttagctcaccttttacctttcaacctttaaattatgtgtttggctttctataaaagccaggcctgaaggcctctgatctaaaaagtacctttaaattatacagaaatatatcatatctcaatgtacgcaatcattcaccaaaagatggtcacgaagaaactagtccaggtgcattggattgatcaacatttgccatatcattcttcagcttcttttggattttctccccaatttcagttgctcttaaaatgtgcaatttttctcagggcgtgtactttttaaatgaatgaaaaagaatgaatttctactcttgaattttcgcaaaaactttctacatatgaatttcttaaaaaatgttttaaatccatttttcaactttataatagttaaaattcatttatttctactcttgaataataatcataaaattattaatttattgagcccttcagctatatgactgtacatatgaccaaacatatggatcaaaattcacacattccatggtacatcaatcatagtatgagcttatactaaaaaagctctacaaaaaatgcctctttatggaagcaatcaagagcctcaccagcctttgcttgagagacaggatgcccaaaaatccagaataatatggattcaatgtaaagctgtctggtagataaccattaaatcatgggattcaatgttgttgtagacatgtgcataatacagcttctggttctaatcgttctttcgctttcatggggaaaaggctgatgaacacatcacacgaattgtagctacctaaaccacacgatgtcaaactgccaatgatgcaaaagaatgaaggatatgtcccaattaatttagtggctgagtgctccatgtagcatactaattgtatactccctctgtactcataaatgaagtcgttttggacagcgacacggtctccaaaacacaattttgacttcttgtttctataaatatatttattgaaaagtgatatatatatacttttatgaaagtatttttcaagacaaatctattcatataatttttacattttcaaactcaataactcgagagttattcatgatttatattttcaaggtttgacttaaacattgtcataaacgattttctttacgagtacggagagaggacatgatttatgattaaagtctgttgaaatcaatcatttggaacatgctattatatgttttttttaacttactcagacttctctgtaatttttttctggttccatcactgacaatgatttatttgctagccagtagggtccggacacgtgtcatattaactggatatgcttatctcggagcatgttgagctgctgaccaggacaaattctttctagtaagctttgtcatcttctttttctcccatctgaatgaaagcgttgtcgcttttggggctttctgcatcatataatgttcacctgcaggtttgctgatctgtaggatttctcattttgtttgtgtctgcttgacaaatgacagccaaaatttattagtgattactccttttgcctcaaaagaaattagtgattgctcttttttttcctacaatgaagtacataatgtctaaaatttcagcatccatgttgtttttgataggtcagcattcatgtgttacctaacgtgaaaaggaaatcatggactgatagtccttgcatgaaagatggcagcattcgtctggaaaacatattcggttcagaaaattcatatgccatatgttagcttatgtccaattgtgaaattttatgcaatcattgggacaccattaaatttcattacgacaaaactttgaccaacaattattctattataacatattttttgtgaagcaaaattgatgtgattggattaattttcaaaagtacttttatatgattatacttttgtgtccataatatattagagaaatgtagggactaacatgggataaacaaaaatattcgaaggattttatacctctgaatgtatggacggagaaaaaaaaaactctgtttttagccccttctcgctgcttggagtctgtttttagccgccgtagtttctctatgcttaagtttttttttcttattttgctttttcttccttcccctagcataagccagtctggttgattgcgtggtgtaactaaaactctttttcttctaatatattaacgtgcaatttttttgcgcgttcgcgaaaaaaaaaccctactatctcagtagattcattactcgaaccagattgtaaactgtgaaattcggttcgatatgaatgaattctgcaaaattacatgaaaacccattcatctatgggccttctgttgctctcttcaacaactgtatgggcccaagcccaaaactgcccatgggctacaaacgaaggcccaatttggcctatacgatccacacctgaagcaacaagaaccagaggagacgacggtggcggcggctggggagagagaggagaggagaggagagagaggggaggagaggtagaggaggcgagagctcgatggcgtcgtcgctggggaggctcaaatcctccatctttgacaaggaggagaggaagatgtatttgcttttctgcccaatccccgtcccatctcattctgttcctgcaccaaagtttccccctttctttcggatttgtgtgtggcacgaatcgattagaaacctttgttttttctagcttcacatttcttgacgctgatgctgtcaaagtgtgattttgaaggggtatttctgtgctccgttatgtgttgggggtcagtgcgaataggggaagtgatgatgtcgatgaaccctaactttgttggttgcaatctttgcttcgagataggagttaagttaggctgatttgccactcaagggcaatggaatattagatagatgcactgctttttgttagttcgctcgctttatttttcatctgatggatatggattggttgtggatgcaggcaataccaatcgcacattcgggggcttaatgcgtatgatcgacacaagaagttcatgaaggattatggtatgattctttgctggcttcttttccacctcttaagcatttcttgattgttttaaaattttattgggagatctagggctactttcagttcagatttcattggaacaaaatataatgatagtggaatggtaatgtcatgataatatattacagttaatagcactgttttaggaaaatggcacattttaaagttttgcttctgcctttcttcacaatagtcagacaaatggtggttagcttgcactccgatattctggcacaactcccgttatcccagttcaatttgatttttgattcctgatgccaatgcatggaacggatggatcagaaagttgtcctttcacagtgtaaaggaaattgagacgctggcatataacgagttaattatttgctctgtctcagtttccaaaagcaactggatgacgaacagtcccctctactgtagaaagaattgggggctaccttcatccatacatgggctatgcttattgatatataacttcccacctagctttggatgaaacttattctgggtatgcatcttttccatatgggagttgatggtctgatatgccataccagtgacccaatctgttgaacaatgctgtcattgactagcagttcatcttccaactatactatgaatattatagatcagtttaaaatcattataaaagtcaagtgacttggattctattgcttgtgttagtaaagtacaaggaagcttttgttttagatatgtaagtggaaactactatgataaatgaagaaccagaatgtagcctcaccacagcatcctttatcgtggatgtataaataattgtggattggagatcatgttcatgtttacaaaattattgtttcattgattggctctggcattttattggtatctccctcttttcttgatattataagttcccactgaaaaaacaatgtgctgtgaacagttcagttttatggccatgacaagaatgtggataatcgtgcacccatcaagactgataaagatacactgcgagaaggatataggtaagaaacaagtccaataccctttgttatttatttatggtggaatgtgtgtccatgctttatgaaatactcctaaatccttttctttaattatttatccatataaaggttcatactttctgaggaagacgatgtggattctacttgggagaagaggctggtcaaacgttactatgacaagctttttaaagagtatcctttttggtggtgtgttccttacattcttttcattaagggtacagtgtatatttcttcagaaattttctgtaacatgttctgatttgtggagctgaggtgatttggcaagttcatcccattttattctgagcaatactgcaaatgtattgaagactgaagagcttgatataatagactaattgggtatgaactgtagatattatctcacaaactcattagcgtgtctgaaaagataagagttgcagtataaattgtaagatactatgagtgaaattttctcatcaaagaggtagacataacgcatatgtatatggttattctcataggcataactcgtatttactgttgtccgctgcatcagtatatgtctttgagagaatattgcaagttcgttccaaacaaatatagtgcttaacgggttatttcctaagagaaactatttacatgatatgcataaagtttcttgtatttatgccttaaatagttgggccaatattatctgtcagtcagtctcctatagaaacagcatgttttgaagttctgtagtacctattttagaagatgggaacatgaaggatgagagagaaccaggattgctatgtttgatttgaagcacttaagttctgctcctatctttataatctatctatattaaccaagagatgtagtccttgcaccttgaacttgttttgctggctgttttactgttcttgtaatgttcttgaaacttaaatttattgtgcctaggatccttaatttgatacagatactgcattgctgatatgtcccagtacaaaagaggcaaggtatggtgatacaattctatagcaataagccaatagttgttacagtatttatttgtgtcatttactggatacaatgatctcttgaatgatattcttgctgttttttctcctcattgctattaatgcaatagaaaagacgaaaaatgctcctagtatgatttatatctgtaacattgaggatttcaattaaaagaaagaaaagaataatacgaattgttgatttcgtatccgtaatattaagtttgcgtgagcagcatcgacaaagtgatcattcttgtttttggtcatggagttgcattatagtatcaattattgttgcacagagcagcaaaatcactagcacaaccatacttttatatatgttaatgtctgacaggcacacacttgatagtggggacgctaagaaatcctatttacttggttcgttactgaataatatctaagtatcctttagaatttagaacagcactaacaaggatatgctgctcatagatattagaggttttttttaattgataaaaccatcggttttattcttggaagttgagtgcacattctaaggatctcatttatttcagattggattgagatggagaactgaaaaggaggtgatatctggaaaaggtatttccctttataattccatgtgttttcaggtgcactaaactgtcgcaaaatgctaaatgtagtctatacattttttttttcaaatgtgtgctctgttttactaattttcttattggtagatgtgatattcattacatgttgtcttttgcagggcagtttctctgtggcaacaggatttgtgatgagaaaaatggacttggtagttatgaggtatgctcttggtcctttctatcttgtcactgatgctacaatgcatagatccttttgttcattaaagaactccttttctgctatagataactctcccccttgttttcaggtgaacttttcttatattgaagcaggggagcagaaacaagcactagtgaaactggtagcttgccagaggttagttaatccactacttcattttgggattatgtaacccagttgatccactatttcttttcttgtatttatcttgctgatcttggtattcatacattttgcatcccaactattttgctctggcccatcctctctctagtcttctcttgccatttttgttcaaccaaatattcaattgattattgattgttgtacattatgaaagatgtgcagaaaagcttgcttataagaggcaaaaggagaaggaaagagagaaggaaaaagagatttctcgtgaaaaggaaatggagttaaaagaaagggacaagaggaaaaggtacctcttttccccaatagttctttttcctaactttcttggacatttctgttcaaaccttttaccccaggatttttgttacctgactttcttttacatttctgttgaaactgtagagaacgtgagggaagtgaagaaactgaagatacatcggaggatgaatcaactgagaaatatagtagaagaaaaaaaggtaaaaatgattgcattattacctggaacagtggatcttttttcgtgtttatgaagtcaaacactaccagtatgtagtagtttactttattttcgtcggaatttaaactgtcaaaacttttgtatattattaacaagaaaaattattctatgcaaaatcctgcagatcgcaaacgatcatcaagaaaatcgagcaacaatgatgaaggcttcgaggagttccttgaaggcatgttcccttgatctggcctttatgtcaaaatcatcatcagaaggggaagcggcacctgtttaatcttccatgacatgttaatactgaacgtgattaattgtaactttgtatatgatggtgtattactgctagttgttccatttctagcctctaggtctcttgtgagttctgagatgtgagaactgccaggtgttgtctaactaatgaatttgtcaccacctgctcttaatctgtgatagcttgaagcaccttgaatgttatttatatgtggatattgtgtgttataaatatgcaaatatcagagtattaactagtttttttttcttatgcatggtaccgcccctttgtaagataatcctggcttaaccaaataatgtcagaggcattttgttacacaggtgaccaacctattgtgttcaggttaataatgttgctgatgcctcacaatatagctgggaatttcagaggagcaaattgatagtttctaaattgctacctaaatcattcttattctcatgcatttctgaagatacagtagcttgagaatttcacaagttacacttcacaagcattaaattcatgagttcccatttactattcctctcttctaaccacatccacaatgagaaatctagttcaattttaaaaataatctccagttgcagaaacagatcaacaggttgatcatgaaatctctgcttctgatcaccagttcaccactgtttttgtcttgaccaatgttttaagatcagcggtggaaaattggccttcccttaaatcgctgaactaatgtaaaactaatcttccatgacgactattcgtttgccctcgtgcagctgtttttcacacaataataagtcacaagtgttgaaagaaacaacttcatatcgtgccaattcaactcaagaggatatgtattaataactgaacatgagttcattcacttgaacatcaaaaagaaatagcaaggataactaattgtttatttaatctatcaaagctagttcaattgctttaagaatagctcaatgaaaatcagaaacatggctttccatgaacagagcactgatgacatacctgatggttctttaaaattggggcaatattcaacaataatgtcgctacatgttaggccttcaggaatggagtgcagaattggacagccagacaaacacattatctgtagaaaaggtaggttctccaaccattctggcaaaatctccaatttgttgcagttatcaattttcaagctggcgagagaggaaagatgctgcaaaccctgtgggaggcatgacaattcatgacaaccacatatctccaacttcttgaggcgatcaagagcctgtagaccctcacagcctgaagaagcatgcaactcttcacagaaagaaattgaaagattttcgaggctcttctctacacctctcagaccttccttcgagctgtacaacatcttattattcatccacaaaatcaatttttcaatcgatggaaactccatatgcagtgctctcaattttgggcactgaatgatgacaagttctgcaagacgaggaaacagattcatcctagatgactgttcccagacttcaaggctagtcatgaatgagagaatcagcttctccaatgaaggaaatgtaccgttctgaccatagaaattatcgtcaatacaactgatattctcaactcggcttatctccacttcctcgcaaaaaaaaaaaaactcggcttatctccacaatcttcagacatggcagtagcccaagtggaggtaaagcattttcacatgatctcagattaaccaaccttatctcaaccagagatgtgagatatggctcagtgcttgttatccaagatggaaatgcatgtccttcatacgcaacaatctccaaagttttcaggcactggttaggttggagggtttcaagtacttcatgatctattctactggcatttccagcatccatattccacctcaacatcaatgtctcgagcttttctttctcttgaagttttgccattcttgcatcttcagtgtctgaaaccttttcaaggttcactagtgataggctgtgtttagttcagcgcaaagtttgaaaaatgactaaaattagagatgatgtgactgaaaagttgtgtgtgtatgacacgttgatgtgatggaaaaggacggaagtttagatccaaactttggatctaaatacagccatagtctattgaggtctagcagtgattgaagctctgacattgcactactaccaatgttggggacaaagtaaccaagcaatgtgtgaagatgtgtaagttggcccatagcatgaggcattgctgtgagtgagtagcaattgagaacatttaggtactgaagctccttcattttactcttctttgtaggcaacgtgacaagatagtgacatccttcaaggtctagcttatgtaattgcacaagcttacatatgttctcatgcagtttccgtatcttttaacctaggtggggatttggcatttgttgttctaggtatatctaatcttgattaggttggtttttatgggacggtgggagtagaagatgaggcctggagtgtggtacttaatgtaagtggcggttgggaactcattgtctacgcacggaaaatagaacggtccattatcacgtgattaagtaagttttagctatttttttttcaaaaatggatcactatgatttttttaagaaactttcgtatagaaactttttacaaaaaatacactgtttagcagtttgaaaagcgtgcgcacggaaaacgagagaggagagttgtgaactccctcttacgaacagagccttaatgtagactagtagagatggaaaagacagtaagggtgtgtttagttcacgctaaaattgaaagtttgattgaaattggaacgatatgatggaaaagttggaagtttgtgtgtgtaggaaagttttgatgtgatggaaaagttagaagttcgaagaaaaagtttagaaccaaactcggcctaaggtgtcaaataaaaaagaacggagccttaatgtgaactagtagagatggaaaagatagtatggcgtcaaataacaaacagagagagcatttaatgtagactagtggtactcgtaccctagagatctaggttccattctttagagatctaggttccatttttttctaagggtgtgtttagttcacgtcaaaattgaaagttttgttgaaattagaacgatataacggaaaagttggaagtttgtgtgtgtaggaaagttttgatgtgatggaaaagttggaagtttgaagaaaaatttgtaactaaactcggcctaattaagatacaaaatttgcttcagttttcattagcacacatttcaaactgctaaatagttttttttttcaaaaactttctatgcaggagttgctttagaatattaaataaatccatcttttatgtttcaaataattaaaactgaattaactatgtgctattacctttcttgttttgtgtgtctgctcttaatcttaatcttgagtagactcaaacgctggtctcttatgagttctaagaagttgagaatcggcaatgctatttgcgttgcaccatggaatactccttccattctttaataaacaaatatataatggttttctagatttgttatactaatttaaataacatataatcctaaatttgtttttttaaacgcatagatcgtacgtttcacggatataattctaattttttttaaacgcatagatcgtacatttcacgggatgtcgctatagtatatctgcaggactgcgaggaccacgtcctattttaggagagaaacgcacaccaacccagatctacgacatactatagtcgtgcggccagccgcactactggagcccggcaatgagacaacgattagctggcaaagcaagttggccagtggcaatgagacaacgattagctggcaaagcaagttggccagtggtttctttttttaaaaaaaaaataattaaaggttagtcgacagaacttgctccgtcctaagataaataaacatacaccgtgtttagttcaaaagtttttccttcaaatttctaacttttccattacatcaaaactttcctacacatacaaactttcaacttttccatcacatcgttcaaatttcaactaaacttcaaattttggtgtgcactaaatacagccatagtactgaatttagcatattctatcattatgaatctagatggatttatttatttagagcaaatttaatagtagagctcactataagttataaatttattgtagagctaacatatatgatatgctacctataagattaactctattttttctctgctctctctttccctcactatgcattttcgtaaagaatgtgtacagctagttcctccatttcattgatcattatataaccaaaaattggatattctaaattgatcatcatatgaccatggtctactcatttgacgtgcaacattattgtatctatgcatgcaaatttagtatgcgcgcatgtatgcatatagacatttagaagtagttaaacccttgtttcttgtgcaaatggggagttaaaagtatgcatgtttcttaattcttccccaccacatactcatgtattaaataaaatacatggcagtttaagttttttttctgccttggtaagaaagcttactgtgtgtttggttcccggtcaaggttggatggaatatggcggtccatactttattggatatggcaatccggtttttttgtttggtggagtgaatatggcgatccaattggttgtaaggatgaatgtggatttggtgatccattttttttagttgggggagtaggatggatgagtggttgcaatcaccctttcattagtagtggtaagtatacccccttgaaattcaatgaacccaaaataataccaatctactaaaaaaatctaaatagaaactaaaaattagaatgaaataaaaggaggaaaggagaaaaacggaaaaaaaaataaaaaaaaatgtcctcttcgtcggccgcccctcgcctcctctctcaccgccgccgccctgcctcctctctcgccggctgctgtcctgtctcctctagatttggtcatcctcgtcgtcatcatcattgtctcctacccaaccggtcgtcggcacaccccatctcctccagatccagttgtcatcgtcctggtcatcgtcgtcatcggcagcggcaacgacgcaccctcttctagctgccgccgcctctggctctcgggctcgctgccgcctcttgcctttgggctcgccgcagcttccttctttccacgctgaccgccgagctcgcatggtgagaggggtgacacgacctacgatactcactcgccccgctcgcctgggtacttgggtggctgcatctgggcaaatcggccggatccctccatctggcatctgggaggaaaattcccctccgtgccgtcctatcccactcccgcccaccaactaaacaaccacaaaaaatgggccgccatgtcctatccacccaaatacctccatccgaacacacccttatatatgatgatcaatatggaacggaggtagtacatgagaaccaacacttctcaatttttgttatctcttttccatataaatatatatatattgtctgtaacttatactcctcctattccagtttgatcatcagctaagatttttgagatctttccaaaatgatcatcatttaacaaatatatctttatttatttatataaagagtaaattagcatcattgaatgcgctgcatacaactaaccaagattaattactattggtggtacaactacatgcaatattaaaaatttaatgcaatccatgggatacattactagtgtagtatcttaaccgatgtgaattaattacataatgatttagttgtttttgatctctgtgttttttcttagggcaggtacaatagcaggctataaaccagctgcaaacatattttaagaagataaatgaggagagagaagggtagcgggctacagatttgtagccagctgtagcacggactccaagacgcagtgtgtatgataggtgggactaggtattaatagtgtagtatataactattgtatgaatgaactattagattgggtatagatgaattggaggccggagtgggctacactattaa

SEQ ID NO: 23664 - DNA, 12446 bp, Oryza sativa
cgttaatattatacccacatttataacataatgatttctttcacctggacgaacaaatagtacaaaatccaaatatgacataacacaatacattataattattctataatcaactcttagtttcaggttaaacagagctaagtgttggaaaaaattcaacccgcggtgcttaattcttccctcacggcatcacacctttaattttctttacatgttatctattatatactaaaagtatatgaagcttccttaaaacgctctcaaaccgccacgtggcgctctaataaattagagaaaattctagaaaatctgaaaaaaaagaaaaacatctatccctcgattttcacttaaatcggtgggtccaatattataaaccgttagattagatttatctcaaaacaactcctctgttccattccatatataggtacgttactgcttgcatgcgatctgttaaagggggtgcatgcacgtacataacctttttttccaaggtacgtgactattctttctctttttttccggtatataattgagataataataataatagtactaataataataatactactaataataataattagtgataataaattttgaataaaagtcactttacaaatatagaatataccagcatacaaatctttacaagtgaacataaataaattagctctacaatatttgaaaataaagtttacaccattatattatattatgtacccattattttagattattttgtaacaaaaatatttgtccatcgatattcacttaaatcggtcctaagtcgctacatgccacccctacaaatgctcctaagctaccatgtggcgctctgataaataaataatagaaattctacaaaagcaaaatatctaacccttaaaatattcacttaaattagtgggtccgatattataaacccttggattaacgtacaacggccccagctctcccataagtccgtacatatgaagtaagtacgtacgcacgtgcgaaaccgctcacccttatcacgtccatatttctctcctttccttttataatttctaaggataattgaaataacattcattattaaaaacaaacaattataactttgcaaacctagactgcatcatcataaacgtatataatgtttgaagaaagtttactgcattatattctttacacatctatctatatattatatactgaaaatccattaaacaaaataattcaacaccaattaataaaattaatcaactccatatatgacttgatatgtggcaaagtggtagcgtagcggcggtcgtaatcaccttagatgccttagacacgacgctttgtcacgcgtgcaaatggcaaaaagtgcagacgtgcattgtgtagcgggccaaaaaagagaacttcgaacgctttatttataagaaaacaatagatccggtgatttaaataataggtccactggttctagtgtaagtgtaaattagttaatatagattttaaatttttaatttaatgggtatataatataatagtgtagactttattttgaaactatgcattattggagactaatagtccaatgtaataaaaaataaatccagtgatttaaataatgagtccatcagcttaaatgcacgtataaattagttaatatagatcttaaattgtttatttgataggtacacaatataattgtgtaaactttatttttaaataatgcattattggaaaataatagcacaaagtaatgagtacaccggtttaagtggaaattatcttacattataaattttatgggtaacatataatggtctaaattttattctttaaaattgtagagctaatttagttacatgcaagttgtacgatggtagattctctatttgtaaaattatgattatttaaaaaatatatatccaatatataaatagaaaaaagaagaaaaaaagggaaaaaataagcgaaagaagcgtacgtacacatacgtatacgtatgtatacaatataatgtgtgaactttattttaaaatagtgtattatttaaaaataatagtataaagtaatgagtacaccggtttaaatggaaattatattacattattaatttaatggtgtaaattttattttcaaaaattgtagagctaatttaattatctatgagttgtatgatggtagattctctgtttgtaaaattatgattatttaaaaaatatatatccattatataaatggaaaaaagaaaaaaataagcgaaagaagcgtacgtataactgtgtaaactttattttaaaatagtgtattatttaaacataacagtacaaagtaacaaagtaatgagtacaccagtttaaatcaaaattatcttacattattattaatttaatgggtaacagataatggtgtaaattttattttcaaaaattgtagagataatttagttacctctaagttgcatgatggtagattctttgtttgtaaaatataattatttaaaaaatatatatctattatataaatggaaaaagaaaaaaaggaaaaaaagaattgaaagaagaagcgtacgcatgaattatgattatttaaaaaaatatatatatctattatataaatggaaaaaagaagaaaaaatgaaaaaaaaaaagagaaaggaaagaagaagcgtacgttcatggtcgtatatatctagggaggaggagaggtggggcccatagtatttggtttggtttatgttaagatcaatttcatctaacggtgtataatattggacccaccaatttaagtgaaaattaaggggtagatgttttgcttttttcttagaatttctaggattttctctaatttattagagcgccacgtggcgacttgagagcgtttgtaggaagtttaatggacttttagtatataatagatagatagatagatagatagttacatactacactattaatatctggtcgcacatgtcatacacacaatgtgtcttgcagttcgtgctacagttggctgcaaatctgtaacccgctgctctcctctctttttatttatcttcttaaaatatatttggagctgacttatagcctgctgttatacatgctctaagagaaactatagattatccccgatgatggacagaatcacaggaggttcactagcagcttagcttgggagattgaagcccacaaggtggatagaggatttttttggaggcggagatgaacctgaggcggctatgggaggtgtggggggagtgggagatccgcgtgctcgtcctgtccagcctgtccctgcaggtcttcctcctcttcaccggcggcctgcgcaagcgcaaagccgcttggtggctgcgcatgccgctctggctcgcctacctcctcgccgactacatcgccatctacgcgctgggcaacctttccaagaagcagaagctctgcgacggctcattcgatggcgagatgcacctcctcgtcttctgggcccctttcctcatccttcatctcggggggcaggacaccatcaccgccttcgccgtggaggacaacgagctctggctgcgtcacttcctgagcctgctgtcgcaggtcgcgttagccgggtacgtctactggaagtcgcggcccagcatgcggctcatgtccccggcgataatcatgttcgtcgccggcgtcaccaagtacggcgagcggacgctggcgctcagggcggcgagcatggactgccttcgcagctccatggtcacgcagccggatccgggcccgaactacgccaaattcgtggaggagtgccagtcgaggacggagtccggactggtcgccaagatcgtcatcgtgcaggagcggcctccagatgacgaggaccatgtcgaagtcaagcgagaggagtacggcgacctggtgtacagtgcgcacaggttctttcacaccttccgccgcctcttcgtcgacctcatcctcagcttccaggaccgcatcgacagcctcgccttcttccggaggttggagatggagcaggcgtacaaggtggtggagatcgagctggtgctcatgtacgagtgcctccactccaaggcactcgtgattcatggtcttctcggccgcagcctacgcttgttcagcctcgccgcgccggtcgtgtcgctcgtgctcttcacccgcgcgttgggcgacatgcgagaaggctacaaccaggttgacatcaacatctccttcgtcctcctgggaggagccatcttcttggagacatacgcgatcctactgatcttcatctcctcctggacctacaccgacatgcgcggcagagaagcgctccggcccgtggcggcggcggtgttttggctgatcgccctattccagccggagaagaggcctaggtggtcgaacaagatatctcagtacaacctgatcagctattgtgtcaaggacaagtcccgtcggtacaagaaacccatggagtggctggagtggaggtggaacttccgcgtgaagacgatgtgggacagctggaggtacaagacgagcatcggcgtgtcggagctgctgaagagccacatcttcgaacagctcaagagcaaagcaagcagcatcagcaaggaccccaagagctaccggaaggctggcgagcaccgtggccagtgggcgctccagcgcaagggcctctaccagaagctgggctggagcgtcgactgcgagtttgacgagagcatcctcctctggcacatcgccacagacctctgcttctacgccaatcatccggcggacaaagatgatgacggatgctgcagctgctcctcgtcgtccaagtgtctccgttgcctctgcagctccagctcgggctatcctgatgccgaggctcgagggcgtgactcgaataagctggcgacgatgagcagggagatatcaaactacatgctgttcctgcttgtcatgcgcccgttcatgatgacggccagcatcgggcagatccgcttcggcgacacctgctcggaggccaagaacttcttccggcgagacgacgaggagatcggggacgaggagcggtgtgccaagaggctcacgaaggtggacacgtcgattgcagagccgcgggacgtgaagggggacaggagcaagtcggtgctcttccaggcgtgcaaactcgtgagacagctcaacgagctggagggcatcacggaggagaggaggtggaggctcattgctggcgtgtgggtggagatgctatgctacgcggccggcaagtgcagcggcaatgcccacgcgaggcagctcagccagggaggcgagatgctcaccgtggtgtggctgctcatggcgcatttcggaatgggagaccagtatagggtggagtctggccacgccagggccaagcttattgttcatcataatcatagtaccatgtaggcctgtttggtccattttctctgttcagccatccaccatggccagcagccgcaggatatgctttgagattcgaacgtacacgtaactgccccgctcgtatcactttctgctggcgccccagaatacatgccgtgggtcccaccgaactctgtataggttttttttttttttgagaagactgtatagggtcttggttttttgtttcttccccaatccccaacccccggatccaccgcctccggctagcaggttgaggtggggcgcatcgatctgtccgcgtgttggcggacgccagcgagccgaggagaaacaatctactttgtcccgccaggagcaccatttgttggcgtaagcacgacattgcattatattttcgcccgtgttgcctggaacatgtgtaattctcagaaaagaaaataccaagttcgaggaaatatttaaacacggctaattgcaacttaattcatgtggagcaaccaagacaaaagcgccaagtatatatcagtgtccactaggctgtgttccttggtcaaggtttccaatgatgcgttcaatgagtcgtgtttatatgtataaatctaatgatgcattcaatctagtttatatctgcaatgtcatgatttatttatggaataaattaaatcattatgtacttataatttcaacaggaaaaatgtaggattctaatagaaatgcaagtgcaaaacagatgattgcaaaacaaatgaaaaacccagaaatgaccatctgattaaaccaccggaaaaccaagaatcagatgagataaactcaaaggaaagtttccaagaagctgaagcgcttactaaattttcttcaaaatctctgtggttttatttagaaaatagggtaggaaaaataatatcccacctttcaaagggtaatattgtatcctaactatccattcttcacacttcatttaatcctagccattcatctatttttctttcctaatccaattgccaaacacaccttataggattgtctattttacaggaattttaaaaggtacgataggattcaatcatttgttttaaggggtttcatagaaatttttttctataggattagaattcttcaaatttcttatgtttttccttcatatcaaatgaccctacttgttgaagggtttcgtctgtgttgtaagttgtaattaaattccatcgggatttcgtaggtccgtgcaaacagagtaaaaggggataaaagcttttcagcagcttcgccgctgcagccgctttcctccggccgcattcgcttctctcttttccgccagccgccaccagaaaagcttcgtccacgagatcatgacgatcactgtcttcgtgggcggacgggaggggcatcggctcggtaaccggcgtgacggacgtggtcaaataacagatcatatgcatatgtggttaattacattgatgcatgcaattgggataattaaattaatgtaaaacacctaaacattcacgcatgcatgttatgggtttaattaccgagaatgctgcaaatctctatatacgatttcagggtccgatcccgagcctcagatagggccacgtggcatcaagcgttgcgctccattcgaattctcgatggagaatgtgccacgtattcccaccaatcccaggaccgttagatggtacatcaacggtgaaaaatcgtctggatgagttatttacaaaacgtaagatctaatcatctggaagattggaagagtccggagtattggacatgaatccagaaaaaaaaaatcgcaagaaaaatataaattcctatctcctactcaccgtgcctccgccctgcctctatccacatcgccagcacctgcatcggctgatgagcagggggtgatggcggctcgatctacacagcctgctttgcctagacatgcgtcgccttaggggggaggcgagaagcggcggtcgcggcggtgcaggagctcctgcggcacgtcggcgacggcgacgacgatggcgttctcaatcacgtcgtagattctgcgtggagtcagcggcccctcagaaaagctcgcgccaccgttccagctggttggccagagtcgcctcggccacggccacgcccacccgctcccctctgcccccaactccgatttcttgcgcttgcgccgccggaggccgctcccgttgggcaccggacccgccacgcgcgcgctcctcctgatggccgccgtattctcctctccgctcgcatggtggtggcctcgtgggaatcgaatggataatggagtaatacagggattagtttgcctcttcttcctacggtagtagtagacgaatagcagcatactccctccgtcaaaaaaaaaaaaaaaaaaaaccctggtttccatgcctaacgtttgaccgtctgtcttatttaaaaaaaattaaaaaaaaaattaaaaagacaagtcacacataaaatattaatcatgttttatcatctaccaataataaaaatatgaattataaaaaaatttcatataagatgaacagttaaagttggacacgtaaatccagggtttgccatttttttatacgaagggagtatggtctgcatttttttaagcctatcccttctcaaacgctgccttcagcatctggctggcaggtggcaggtagatacgctttaatcgatcggtgccgtgcggtgcgcgacttgtggggtaacctatcagtttgacgcaggtaaaaataaaaaataaaaaataaaataacgaatgcagacttttatgtagcgttaggagttcccataaaaaaattttataccttgtcataccgaacatttagatacatgtatgaagtattgaacataaaaaaactaattatgcagtttgcgtgtaaattgcgatatgcattttttaagcctaattagtccatcatttgacgatgtagtgctacagtaaacatttgctaataacagattaattagacttaataaatttatctcacagtttataggcggaatctataatttgttttattattagtctacatttaatattttaaatatgtgtctgtatatccgatacgacgtaccaaccctttacaaccgagatataaacacccctttaattaccgcggcgtgataggttcacgaacacaagaagcgcaaaaatcttgccatcttacgtgcatcatagatagatcgaaaacaagcaataaagcacaatgtggtgaacgagtcatgttggatggattatttttatttctctttttactaattcctccgtttcacaatataagactttttattattgtccacatatatatagatgttaataatctatacacatacatgtgtctagattcattaacatatagatacatatgttttacattgtgaaacggagggagtaatttaactgctcgttgtaaggctacattaaaacgagacaaatacataaaataaaagtcaaatatgagatatccctatatgactagatatgcgttcgatagtgtcaaaaggccagaaaaaaaatcccacgttttctatgcacatgctatccgaactgataaacaatatgttatttttataaaattctgttaaaaatttactctaaaaaaatattaatccatttttagttcaaataactactatctccatcccatattagttatcgctttgagtttttattcgtaatgtttaatcattcgtcttatttaaaaaaaatttggaattactatttattttatttgtgacttgttttattataaaaatgctttaaatataacttatccttttttatatttttactaatgtgaagtgggccctcagggtgtctacgtagttaattttctcatcaatggtttctaaggtaaaaaaaaatcagagaaatattaattaagaaaataaaaggactgaaatagaaagctgaaatacaaaatctaccataggtacaataaggctactgttaattactgtggcttgtacaaccttattctatatgttctatatctagaacaaggactaaaatagagagctgaaacatatgttctatatgtagcttattctacatggaatttttttttatttggccactcgtaaaagttacttccgttggaacatactagctacaaagagagcacaccaaccaacatgtttattttttccgaagagccggttcatgcgttcttgaagaattattaattatatcaacgacttgcacataaatgtttacataattgctctactaaaacattcaacatactagaattaatattttctacttgtcccattatgtagaaaagttctcttttgagatattattttgagacggctcttgcctactcgaagaatcgttaattatatcgaagagcactgcatgtgaaacatttacataattggcccattaaaacgttcatcaagctggagctttttttttagtttccatttatatgtttgtcgggaaataaacattttcagaattgtttccaaatagaagtatcacaaataccagctattatcgttgcttggttcatttaggatataagaaattaaaattctttcaaataactctacaacatttataaatcctaaatgaaaaatataaatattcataggttattgttaagttgttgcgccaaaggcgcgtctattttctagtcggacatctatggatgggtacgcctaataggcgatcgatagccatggggatggggtagcaatcagattcgctccccgcctcccccctccctccacctggtttcctttttttttcaccgcattatttttctattttagtaaatttatacaactaaagtttatacttctaaagtttacacatctaaagtttagagaccaaaagtttataagtcaaaagtttatatatccgattcaaatttgaatttgaattcaaatatttttttatatatagtatttctgtacatttaaagtttatacacctaaagtttatagacctaaagtttataagtcaaaagtttatatacccgtttcatatttgaatttgaattcgaattcaaatatccgattcaaatttgaatttgaattgaaatatttttcatatgtagtatttctatacatctaaagtttatagatctaaagtttatagacttaaagtttatagactcgattcaaatttaaatttgaattcaaatattttctatatatagtatttatatacatctaaagtttatacacctaaagtttatagacccaaagtttataagtcaaaagctgattcaaatttaaatttgaatttaaattttttatatatagtatttctatacataaatttttctaacttttgtttttcaaaaaaatttgtgtggtctactatagtagaaagaggagaaggagaggaggaagggggagaagagggaggagcgatcgctgggcgggtgggggagcgatcacccgtccattagcctttccgtctatggatcggactgatggatgtatgcgagtaagcagctaaatgtttcttctcattcctttcttctctctctaaatatttttctcctaaattacttatccgatcataccatgttgatgcgaaaaacacacactgggctggaagatctgctcagctccagtgcaggaccaaaagttgatgagatacggacataccagtaagtttgaccctacaactgacaagatatataaatagtagatcaatgagccgataggctgataagccgatagattaattccaaccgatgccgataccaaccgatagcgatagggttttgagctatcggctataattctgatgtagattctgacgcttgatgtaaataataatataaagacaatcggctgatgataatgcaagaaatcaacaatataatctgaaggttaaagcatatatcgactagaggtccgatatcataaaatccacagaatagattaaagcggtgaacggctaaatccaacttatatgcaatccttgtaagccgatgcaacgtccagatactttatcggctgaaacccagatgaaacctttattggcggtcaaaaaacaggctagggattatggttctaaacatgacttagtagatcaaacttgacttatgcagcactaagtataaaaagaaacacaatatctagataatcaagccgttgactgatttttagggtggtagatgccttatctaatctaatatagtaaaacaatttagccaataccggcagtaaccctaaagcgagagacaaccgataaagctaaattaagatactaagactagattaagacatatgataaatagccagacaaatatatcaaccaaaccagagcaatccaagaggtcgaatgtaccgatgcagccttgaacaacgccgacgtagacgatacaattgcctgggccagtggaacattggacttaccccttcgttagagatcgaaaacccccgcattaggtgccaagtcccgccggacgataaaataaagtagaaaaggtaaaaggtggcgatacgctgaattgtaattgatcgtggagatagtttacaataaccccgggtgtacatatttatactcatagggatatactagtccttgtaggacaagaaagaaactttcctaaaaataaaaagaaaactaacaaactattcctaattaatagataacttgccatgctgtatcctccttgaacttggtcacttctagataagcttcctttaatagattaatttccttaaccaaatatagcagaaatccgactattggcgatgtgataattctcttagggcttaccaaatttcaatcttaacacacggttgtattcgttttttattaaatctttacaatattatgttaaaagaaaaacatgtgtttcaaacctttaaaactcaatgtttcatactgttgatgcgaaaaacacacactggcctgaaagatctacttaacttctgtgcaggtccaaaatcttgcttttagatttgtgagcgtgccaattgatttgatcctacaatcaacaagaaagaaagacaagaaaaccgcggttaaatccataaacgatagccgatcggctaattgccgatgacatatcatttatcatcaagccgatgtcatattgggatcgattg

SEQ ID NO: 23665 - DNA, 5346 bp, Oryza sativa
  unsure (1)..(5346): unsure at all n locations
tcgcctccagcctcctcctgctttgtgccaacgcaacgccgtcgctgtcagcccgtcaccgtcgtcgccttacgtttggtccggccgtcccgctccctggcctggccggtagtccgcagcacaggcacaacagcagctagcaggctgcaggctagcgcctagacgcctggcgccaacgagtcagcgacctcaggggtaagccggtaggggcagcagtagcagttggaccattttaatcaaatcatcctcttccttggaccattttattgtagtcaagtaacaagcaaatttgtttgttcctcttgcaaatgatctgttcttgctgtctagatcagttaatcatctgtttaggttaatggaaatagtaggtactcctagttaacactgttctactgtgaaaatggaaagcatgcgcagttacttgcatattatttatttgtcctactgcattttttggtgtatgatgaatttatatatgatgcaaatattatttctttgttataaaatggtttttttgcctcaaatatatttttatgcgattacggcataaatacggtctttataaagcgaacattttcgccccatcttatttttaatcctgcgtccgccattgatataacccttccttcgatgtatatttaaactaagtgattacgatagatcggtcgccatgccgagacagtataaatcacttaaatcgaaatatacattaaagcaggggttatatagacgatcagacagatctagcatgtatcggttaatactccgatactactttagactaagatattaaaataagcaaaatatattaaacaagaagcctaatataccttaatgcgacaagatcttaatataaatgacagatctagcatatcaattaaacatataaaacataaagtagctaaatcaggtaagatcggctgaaaacccgatgctatctctctcgataatcataaaacaagccagatatcacaattatggatattactcaacagatcgaacccaactgatgtaacattaagcataaagataaatataaaatctaggcaagatgatgaaaacctctaagagatgatagatacacgatataatctagattaataacgaaacataactctatcgactactttctaatagtacaaaccagccgatgacaagttatatagcgcaactaatagagattacaaaacgcatatgataactcgacgaattatataaacaagattagagtgtcataaagatggaagcactaatcctgagaacgcaagccgtcatgataagtttacctctagttgaagatcgtaatcgatgcagcttaacccgaaaagcaagaactcgtcgaaatagaacgaaagtgaaaagggtggtgatgcgccgaaagttttattgaactgttgttgtaaattgcatgggttcgggtgatatttatacccaagatacatgatatgtccttgccggacacgactcttatctctaacaaactctaagatacacataaggctttgcggctgactcttgcctaaacatatctctaaggaaactattcaaaatatcctaactaatagatacaattgactatctgagagcttatctccatcatgacaatccttgtgtagcacgttaaagcagtttcataactgcctctagcaaaatcggccttatcggctgtatcggccatatcggctgtcctctgtctgatccatctcagccgatgcagtatccagccgatgcacattccgttcttcgaatctaactctttgccgaatccactttgattccaatgccgaacctggttcatatcttaccaaatttggtcgttaacacatacgcgataatgatatgtttcaatgcatgtcttgagcgtgtttcacaaaattcctaaaactactgccactactctctctcctctctcttcacctcgtccatgcatacatgcatgtattttaacgagcttcaaaatgatttttctcttaaattaattatccgatcacaccgttgtattcattgtaattaaatctttacaacaagatatcgcatgactatattgcgatgaaagaaaaatatatgtttcaaaccattaacactagtttcatatgtgatagcggcatgtttcaacgtgtattcaccatgtttcataggatttttaaagatttcaattgctaattttttgtttcaccatatataacttgatgtttcactcgttggttaattgaaacatttgaccgaccgaattatttttttggcatctggcgcccgatgggaagattcttcctttaattacagtaaatcatgaattagggattgattacaatcatgcatgtttccgccgtgaccatgtttgcgcgacgacgacagacgacagctaggagcattgggtcggacatgattctgctctaccggtgtccaactaaacccattaccatccctaattaggatatcatttgtgttatataaaacgtaaaatctaaatcgagaacgctctcaatttagtcacagtgagcgaccctatcatccaatcagccgttgtccagatatgtctcgaagaatcttactttactatagtactaattgatcaagcaagtagaacaaatattcctatcatctatgcttcaaataaaattttcttttaaattactcattcgatttacaatccgattacaccgttgtgttcgtaacaattaaatctttacaacaagatctnacatgattatatattaataaaaacccacaaattacttttataatatatctaaattacttttagatttcactaagttacttcttaaatatataaaagtaaattgaataaagttttaaagtaattaacatatattatatttttgttataagttacttttatattatatttttgttataagttttaaagtaattatttttaggttatattgaattacttttatatgtctaagaagtaacttagtgaaatctaaaagtaatttagatatattacaaaagtaatttatattttttcatcaaaatataatcatgtgagatcttgttataaagattaaattgttacgaacacaacggtgtaatcggattgtagatcggatgagtagtttaagagaaaattgtatttgaagtgtaagtggatagtgtttattatagatggagtggtagccagctaccactagcgctaaacaatagcgctaaacaacacgatgcacgctaaaaaacagagggagtatgcaaatagcagctgtgtagcgtagggcctgttttggggaggttatagcaggtgcagcttctcacgaaatcttcagctttcccaaacagtttagattatcacctagattctaagaatttgtaattgtagaatcttcagcttcaccaaatagtttagatagaattcagaaaataaaagttagaagcaaaaaaaaatccagccttttagattctcatagtctggctaccgaccaacaaattctcgtaaccttaaactttctaaacaagacggtaaactagtttcaaagcaaggctttgcttttttctaaagaaaaaaaaaggaaagaaaattgagaaacaattaaacaacacaaagttattacgattatttgatacaaatgatatcccatggtaagtgaaagtacaagcaagaaataacatacgcgacaacttgacgatcgaccgaatgtctgcaaataacaaaccagtaaacagtcgacgatcgaccgaatgtctgcaaataacaaaccagtaaaagtttatataggctcgtagcaatagaatccgtgctagctcctgccttcttgatgatgtgacaagctgttcatagacatgtagagttcgtaaggaacaattcacagtttgcaagtacatatataggtacaaagatacagcaatcgataggtaggcatatgaatacagaatacataagattttatttataccttgtgtaatgcttatgcctgtgaactgtgatatcatggcctcatggggcgtccagctggctgctactagctggcatttcgtttctctctggatagccataactgtggaaagtataggtccctgacggatatgattctctcctggtcatggatactgttcagctgacttatttttaccacatggagaacttgaagacttcccaacgaaccatttggaatctcaagttcatccactccatcaatttcatgtagtaaaagtgtcctcaagttggcaaaactgttaattgcttgaaataccagcttggagatgccactgatattatggaggcggagcgattcaaggttacacaaatttgtagatagtaggacgagcgaatcatcccttagcttgcacaagcttaactccagaactttaatctgtttagatttgaaaataggatattggaatgtctgctcagccaacccgcccctgataacaagtttttcaagactagtaggattcagggtttcaaagtcaagagactcctcgtccacacgacttgcactgacatgcaaactagaaagacaggaaagcttcgacaatgaagaaaacaatgttttgctggatcggccttctccaataacaacagatagagtagttaactgggtcagcttctccacatgcttctcaaaggtatcacttgcctgcactgtctcgagagtccgcaattctttcaggtagttcacagttttcggggctttcacagctcggtatatgtctgggccttggccatccaatgtgtcagcagaaagatgcctcaatcttatgagtttgcctatccaacttggcagttcatttattctgctccccctgaggtccaaagtttgcaggttgtagagattggccatggaagatggaaggcatcgtatttgtgattttcgcaagccaagatatcgcaaattaaacagctggtagccaatacctctgggcaattcttcaagtggagattcttgcagtttcagaacagtaagatacttaagtttggctgtcagtgatgccggtaaggacttcaaatttgcagcagcatttctgctggccataagagtccgaaggtacggaaaatctactaatgcaccaatatcttcagggttttccgagataaataggcagcggacattggtatccatctctgctagtttaccaccatggcagatagctccaaattcttccttttgagagatagatacagccagctcatgcaccacaataggcatcctgcaacttgctactctaccttgttcgtccacatctacaacctgcagaaatccccagtggattagctcctttatatagcgctcaccaatttcctccacttgcaatgatccctggttctcgatgaaaccctctgcagcccataaccggacaagactctcaggcaacaggagaaaaccagcc

SEQ ID NO: 23666 - DNA, 12957 bp, Oryza sativa
cttcaaagttacttcacggagttctatagggcagtcacttggtcttccaaaagcctttgtacagaagatatcaaaactgtcattaggatgtaaacaagtaagcttcatgaattccttggggactctcgccgagggtcttacaggttccagcgaactagatggtgtttgggactgtgactccactgaagattcacttcttacaaaagcaacctctggcatccgagcgattatgattatccggctgcccattttattatcagaagctgcacggtgtaccttgtgaaccatgtctggcacccatacatcgtcaaatacaaacaggaacttgctatcctgattttccgtcattactctcagtgaggtactctcagtggaagtgccaacttgccttcctagttcttccatcatcattcttttcaaagcatcagtgtcagcattgggacattgagcaatggaaatccacgcagaagtactgaaatacttcttctcactagcataaacatccttaacaagatgggttttccctgacccaggctgaccatacactgcaatcacagaaagagctccatctttcgtcatatctttactctttagcgattcaatcagttcttcctttctttcggcatatcgcttagtatctatgttgttgacatgaggaccaaacattgatgatgaagaagctaatgaggtttccttgtccacttgaacccatcgttttttcattttggaaagatgctccagctccacctcaatttctttcagctgagcagtgaagcgatgtgaggccagtataacctgtactctcttggtaagtcgatattgtttgctctgtacaatatagacaatatattcgtccattatttgttcaacaaggcatcctagtttccgtgcttccccaatccaactttgaagtacttgcttgttatcatatcttgtttctatttgagccaggaagcaaaggatcatgcgaagttcactttctattcgcctcaatctaccttgaagttctgcttgcctaagaactaatatatcattactattaataatctcagatattactctggtaagagatctaattagaaaggatcctccttcaaggccatgttccaaagctgatcttccttcaaggtcatgttccaaagcagtagcacttctctctcgtcctagggcaattcctatttttctgagagctaggtatattgcagtttctgccatttgccttctatcccttaatcttttgacattaaatggttcgtgaaaccaaaaaggatgcttccactacagtttggagtacaatacactgagtgtcacatttcctccctccctttttatcctgcatgcaacacatagtttggggtacatgttcttttcagtttcaaaaaaagaagaaaaaaattcagtaggagataatctaaagtaatgaaagaaacaacctttcttgaaaggacattgggctacgcaatgtgaaaaacaatgaccataagatgaatgtttcgatgaaagatggacatctgatcattaacatacatgcggtaaaaaaaaaaatgcactagacacttccctcccgatccttcgagtgtctcccctcagacatgtggcaagcaagaaaaagattactccatgaaaaatagataatgggctattggtttgcatggcaattaattggcatactttaatgggctgcactaattaagatcaattttgagatgtcaaataagtaaaataaacatgaacggttgttgtgaagaaaaataggaatacatattacggtagtactgtatgtaacttacgggctacttcagttgtaacaatcaggaaaaaataccactataactacaaggaaaaaaaacaatcttaagatctttcaacaaagatggcatctcatagtcgcgcgaacacgcgactccgagaggctaatctctatgtgaaatctaaaagtaagttataaaacaattatcaactagccaacagaagggcagtctttttatgactgatacaatagacttacaaagaatgacatcagaattctcacttgggaaaaaaatgataaaagtacgctgtttaaaatgtggtagctattagatgatccatctattacattatagggatttgctattcataactcaactgaaatttttttgcaagaaaaatcagattcctaacctttggatccggcagagattcgtgctccggcgagattcttgactctggcggccgtgcaacaacggcaagagcgccggattaggtttcaggtggggttggggttagggaagggggattttggggagagggtggatccccgggtttagcgggaggccagcgaggcggctgaccggcggtgcgtggaggcgccgccggagccgcgggctggaagcaggcggtgggcggagtaggcagcgggggcaacgagaagtcgagtggttaggaggcggcggccggatccggcggcgctatgctgcggagacaggggagggtcggcggcgcggaggcatcttgccggaactgtaggagacgacgaccggcttcgagcgataagaaaatcaatagggaggacggaggaggtagccagtggcggcggcggcgtcttcgaggcagctgctgcggcgcgtgtggcgacttgctactcgcgagcgaacagacgagggtgacgagagtgttgcagttgcctaaatatgtactccgtcgtatttttacattttgcttacatggtttaatcatttatttattttattaaaaatatttagaattattatttatttttttattcacttttttatccaacgtactttaaacacaattttttgttttttgtgttttatatttgagcaaattttttaataagacgagtgtttgttttttaaattttatatttgaacaatttttttctagtaagacgagtggtcaaacggtgtaaataaaatattaaaaaaatctcttatattttggagtagagagagtatgtactacctccctatcagaatataataatatgggatgggatgagactcatctcagaataatttatctggatatgtttagaataggcctcattttatcctacgtggttatattttgggacggagggagtaagctcgtttttcttgctgcttcttttagtgtgctctaactgctctctctttttcgtcgtcgtgacttttttaagtcaattagtttataggaaaatataggccgagtatatttccaatttttttaaaaaaaactttctacttttttatcacatcaaaactttcctacacacgtaaacgtctaacttttccatcacatcgttccaattttaactaaactttcaatttttgcgtaaactaaacacacccatagtagcttttttaacacaaaacaaatatattatcaaaatatattcaatagcatattagatgttagtaaatttatttacaaatttaatcaaacctaacaaagtttaaatagaaaaaaattaaaataacttataatatgaaacataggaagtagcttatagtctatattgtacttgttgtaattatgcctcgttcttttcagcaaattcaacatgcaactttctttttttaagcacgcttctcaaactattaaatatttgagtagaatttttctacatagaagttccttaaaatcaaataaaacaatttttcaaatctttagtaattaatactcacttaatcatgtgttaataacatgtctcatttcgtaagaaaaaaactaacaggatcaaatttataatggaggtgactaatatttatgtagtctatcaataaattaagaggggtctcgtatgtataataggttgtttctaatacataaccgttaactgctctaacactttcatatttttattgaaacttacgtagagattttcctttgtatgaggggtgtttttttctcttctccatcttaccgttcaggccacgttctaaactctaactattcaacttcctcgttttccataagcgcggttctcagaacgttaaacggtgtatttttttgaaaagaatttatataaaagtttctttaaaatatcaaatgaatctaattttcaaatatttaataattaataattaattaatcatgtgttaattgtttgctctggtttccgtgccggttaaaatctcaattcctatgcagaaacgaacgaagcctagtcctaaatgatacttcctccgtcccaaaatataaacatttttaacacagtgacaagtcaaacatttttaactttgactattaatagcaaaaagataaaaaacatcaatcattttatcattaaacaaactatcataatatacaactttttatttaaaacatattactatatatatatatatatatattgtatattgtattgatcaaagtagtatatcggaaactatgtcagggtctaaaactgcttatattttaggatgaaagaagcatcccgtatcttgtgtttacatgtatcactttatccagcatccacctcatgaactgccaggggcggagccaccgcctggctagcccaggcagcctgcctgagctcgctggcaaaaacttcattaaattttaatattgttgaataaattaatgatgtaatttttattaaaaatgatagttatagtgaagtttgctcgggctaaaaaatatttctacttgcgccactgcgacgcggcaaatttactgtcgtcagcgctgtaagtctgtaacacaactaaccatgtgttctagtagttttgaagtttcaactccctcgttttccagaaatttcaaaatttgccatcgaatacgcacggttttcaggacatgccatctaattcgcactactttcagaatacatcattgggacgcgaatcttcttcattctacgccactccgtccgccgacgtcagtcctcctcgtcgtccgtccgtctgccgccacctgcgccccgtccatccgccggcgccgccgcgttcttgttcgtccgccggcgccacccacgcgccaccgccctcctcatgctcggcgtcctctgccactcgctgtcgctcatgcagtcatgctcaggtacgcgtcacctccggcgagcacgccatcgtctccggcgacgccgccctcgacctgtcgtgtgcctgcagcatcgtcatgctcatcgcctacctcttcttccaactcaagacgcatcgccagctgtttgagccccaacaggttcgtgattgatcgatccgatgcatgtcctgtacgttcgatccatccaaccaaatggtaatcaggttgaggatgatttagtgatcgctcaagatgatgagccagtactgggatgatgacgatgatgcgcgcgggggcatacgaattggatgccggtgtcgttgaggatgctgacaccggcggaggcgaagttggcgcagacaagcaggttctcgcctcggaggtcggggctcaggtaaggcagcgcgggcatgtgagtcaggaagtcgatcccgtacggcggcgccgctcgcatccgtccgccggcgccgcccgcgtccccgtccgcccggcccgccatcgcccactacccctgttcaccgaatgtcgcgcgtctcgccgaggagcaccatcgcgcctccacggggaagatgggtgtgtcggcctcctcgacctacttgacgacgacctccaccacgagctcctcaactagggcgattttgtccagccggcgtgtcgggtgttcgctctcagtggccgcgttgagcaggccgtcgccgcggcggcggatggacggggactgacgcagctgtcgtcagaggtgccggctgtacggacggtgacgtgggtgcgcggcgctggcggatggacaggaacgcggcggcaccggcggatggacggggacccgggcggcggcaaacggacggacgacgacgaggaccgacgtcgcggacggagtggcgtagaatgaagaaaattcgcgtcccaatggcgtattctgaaagtattgcgaattagatggcatatcctaaaaaccgtgcgtattcgatggcaaattctgaaaattctcctcgttttctatcaagcttccaaaactgctaataaaacgttttgttttcaaaaacctttcatataggcctggtttaattccccaaatttttttccccaaaatatcacatcgaatatttggacacatacatatagggcaaaaaaatatagattaaaaaactaattacaacgttaggggagaaatcacgaaacaaatcttttaagtctaattagtccatgattaggctcaaaagattcgtctcgtcgtttccaagcgagttatgaaattggtttttccattcgtgtccgaaatactctttcaacattcggtcaaacatccgatgtgacactcaaaagttttctttttacgaactaaacagggccatagaaatttcttaaaaatcaaataaacatatttttcaaatagcatccctacaaacactcatagatcgtcacatggtgttctaataaatcttagaaattctaagaaaaatttaagacatttagccatcggttatcatttaatttggtggatccattgttttcaactattagacctattaaaaagttgtgaattcaatttatctctaaacaacaagtacggtatgtatgtcgtcgctgatgtgatgcacgcacttggtattggaataattaactatttaccactcttacaagtggtaattaaatatttgccattagactcacatatcataaaactgcgagtagcaaatttttaattaccacattttaaaagtggaaaaaagttaaattaatgaccacttggtatcgtccccgacacgagcgtaagccacccaagtgactcaaaactgcaagcctagtctaatttgcaaatggatggtaaagatacatgttgcaaactgaaaatatatgcttaggttgggaacccttctcttcgacatgcaaaacgaaactcgtattattacatgattaactgttttttaacaatggattaatataattttttaaaacaacttacatatagaaagttttttataaatcacacaatttagtagtttgaaaagcgtgtgcgcggaaaacgaaagaggtgggttgagaaaagggggaagaacacagccttagtcttggggtctgtttggttggggactaatattgccacacattttttactaaggtagctaagcttagtcttgccacacttttgtggcaaataaaatgacaaattaagcttaggcaatgtttggcaagaaaatatagtgtatgatatgtgggccaggtggctaagagttaggcaaaatagacttgtgacaagaaccaaacactatctattaaaactttggcttgcctaaggttaggtgtagtaaatttagttgccaaccaaacaggcccttagtcttagttcaatgtatcactttggtcactttaaatgctcaaaaagtgaatgttactctaaagagtcttaaaaaaaatttgtccccaaaggagggccgtgctggggccaccccgtgtcagagcaggtacaatagcgggctattagccagctataaacatattttaatgagataaaagatgagagagaagagcagcgggctacagatctgtagccaactacagcacagactccaagacgcaatgtgtatatgacaggtgggaccatatgttaatagtatagtaagcaactattgtatgaattggctattagatcggctatagataatttggagctagtagtgggctatactattaaacttgttctcacgggagcatgacctcgccaaaagcaacttgctagacgtgcctccacggcgtaagagcaggtacaatagcaggctattagccagctgtaaacatattttagtgagataaaagatgagagagatgcgcaacggactacaaatctgtagccagctgcagcgcggactccaaaacgcaatatgtgtatgacaggtggggaaccatatattaatagtatagtaagcaactattatatgaattggctattagattaactataaatgaattagagctaatagtgggctatactattaaacttgctctaaggacatggccaacggtggccataccccatcttggaagtgggcccaaccacacgaggccctcaatcccctaagagcaggtacaatagcaggctataagccagctataaatacattttaagaagataaaagataagagagaaggacagcgagctatagatttgtagccagctatagtatggactccaaagtgcatatgtgtatgacagatgttatcagatattaactatgtagtatatgtttataggtaactattgtatgaattggctattaagttgactatagatgatttagagccggtggttggctacactattaaacttcactggtggagaaatgatctttgctgggtcgacccaaaaccacaataatcccagttccaaaaagaaccgggactaaaaatgatctttagtcccggttgaaaaccccagaggcattgtatgatctttagtcccggttagtaacaccaaccgggactaaaaattatctttagtcccggttcatcccctgtcagattgatgtcagggggccgagcatctttagttccggttggtaacaccaaccggaactaaagatcaccactttagttccggttgggaacaccaaccggacaaaagatcaaaccgatctttactcccggttgaaaacaccaaccggaactaaaattcgaagcgtggtatataatccatatcccttatcctctcctcaacagatcgaatctctcccttctttccctccctcctccgcttcctccatcctcatcccgatccatcccctccaccttctcccctttctcatacgaccccctcccctctcctacaccgtctcctatgccgtggctgcccatgctccccttgccctgcacctcatgccctcccctctcctctacctcctcatctcccctttcctgcccatccacctccccttcccatccggcagccggcgggtccgtggccggcggcgggtcgggacagcggggccgcgccgggcggcggcaacggctttattttctcttttttttaatttgtgattcacatgtataattttatgatttattggatgaatctgagatgacctgtgatgtatttgatttgtgtgtaattttttaggatttgtgatgtatttgacctatgatgtatttgatttgtgtataattttttaggatttgtgatatatttgatttgtgtgtatatgtaaatttaagatttgtgatgttactttatttttgatgtggatttgggatgttactttcatttggggatatgcttctcacttgatttgggagaaaatagatatgcttcctacttgatttgggagaaaattaaaaaaaaaaagaaaaaggaccgtctggaattgccgctattctctctttactcccggttggtgttaccaaccgggactaaaaagagggatctttagtcccggttggtaaagatccatctttagtcccggtaaaaatagcgatctttagtcccggattcgtagtcccggttgaaaaaccgggactatagggggttatgattcgggagtaaaaagtacttctctaccagtgcttgctctaacggggaagtaccctcagatgagccatactcaatccaaaacttgcactcccgaacaagttgaaggaaccacagccatcaagtcgaaggcccgatctctccaatgcatgccttgacttaggctatgtgtagttccccaaaaaaaatttacaccatatcacagaatatttgaacatctacatgaagtattatataaagactaaaaaaattactaattatacagattataagatgaatgttttgagcctaattacttcataatttgacaatatggtgctacagtaaacatttgctaatgatagattaattatgcttaataaattcgtctcgcggtttattggcggattctgtaattaattttattattattatccgaacaacctatgtaacaccttatataatacccgatatgacatgctaacattttacatgcgtgaataaacacccccttacaccctcgcctcgaagcagctcgtttcataggggtgagccgtgagcgattgttgcagaagaatcgcgccttcttgcatcttgcaaagtccgtccttgttcgctttttctgccggggttcgtatcctctgcctttgctacgtaatggcagggagtaacattctctctatcctagccctctatccaatatcaacggctgataatataggatgtactagttggcacaccacataatagtgattgtagttagcaaaacctcacgctggttggtttctatcctgggaaaaatattttatagataaaattttgatatggatgttcgtatagatttaaaatataaatgatgaaaaatataagtatagtaaaaaaaattaaaattagttgccagtcccatctttaagatacccaacccgtcgtatactgcaatattttacacttcatctttaggttgtgttcgtcccaggagattgagagaagatttatcttgtttttcgtatactttcgtatacttcatctttaggttatttatcttgtttattttttaagtttgaaatgattaatacccaattaattatatagtcataacttacctcattttgcgtattatctcaatattctcttttcccctctgattaaacactccctcagccttaagcttataagagtaagcgaaaatttaaattttaaatgctttacacttcatcgtttagtctacaccttatatgagtaggtgacattttaaattttttattatactttttttcatcatttatattttaaatcgttatgaatatctatataaaaaatttatctataaaatattttttccccggctagaaacctacaagcgtgaggttttgctaactgcaatcactattacgtggcataccaagtattacgtgagtatgttatcagccgttgatattggatagagggctagaatggagagaatgttactccctgccattatgtagcaatggcagaggatacgaacccggcctggagagggtacgtacgtgtggccaacattaactgatgtggtgttgcggctcccacatttcgagccgagactatatgcggtagttatgtaagtgggtagtctcgctatccgtatagtaacctacttgctagtttatttttcgtatgttagtacaaaacttaaaagaaaaaataataaaaaataaactagaagagagataagtgggaaaaaacccgcttacacgtcccgcttgcatgtctacttgcggcgttctgtgttgtgcatggtcttattttttctaatgcagtgaggagaaatatcatctactctaaaatataaagataaaaaaattatgttgtttagcaaataatatctcaggtcattacttttacttatttcagttatcaggttttaaactttgaatggcttagattctctttctaacttctaataattggctttcaaatcatggaaataatgggcatcatgtgaatcagtaaaaaaaatgcttatactattgtataaaattcaaatattgaaaatacttttattttaaaaggaaggaaaccgtctatcgagtacaatgagcatgggtagtagtgtatacccatacctaccagataattttatgtgcacagacatacccattgcacatgtgacgaccagagatgaccttgcccatgcccattagccgcaggcgtcacgtgccctagatctgcacatttacccattaattatacttacataacataaacaaagaaaaattatatagctaataaattcactcatgtattaactatataattgtgtttaagaggataggaggagaaaaggagaagaagatacgagaaacgagatgagcaactagctcataatatttgagtattgattatttcaaacttaaaaaacaaactaatataatttctaaaataactttcgtattttttctaaaaaacatatatagtttagcaattcgagcaatgtgctcacaaaaagacaaccttttctttttctgtcattcaaatgaccctaacaaactaaggctgtgttctccggcacgcaaaacgaagctcatattatcacatgattaattaagtatcaactaattttttttgaaaaatagattaatataattttttaaaacaactttcatatagaattttttttataaaacacaccatttagtagtttaaaaagcgtgcgtgtgaaaaatgaaagaggtgggttgggaaaatggaggaagaacgcagcctaagggtaagttgttctagtttaatagtagagctaactactactgcctctgttttcaaaataagtttatttttcattcatcttacacataccaatacaaatacaaaaatacctctactttatcagatactaatgcaactattactcactttatttacttccaacacaattattcgctactttcacaaactacgatacaatgattactttaaaatgaacttattttgagacaatgtaaggaactaaaaaataacttactatgggactagtgaagtagctattaaagcaagttttataatataaccaactactacctaaaaaaattaacatatcatctacacttgctaaggccattcccaactcaagatactatggcccgtttggcacagctctagctcccaactccaacttactagagccggagctgtgacaaatagtccagatcctccatttttgagagcggagttggcagagctgttccacaaaattgtactatgggggtggagctgggtttttatgctccacagctccactccaccccaaaagacacactaccctttaatttttttagtgtattttcaccaaaatttcactgaactaccccttcctatccgatctcctcctgtcctctctcctcctccgtcttcttggatagcccggcggccagcggcggcgtcgtcggcgtcggcagtggccggcggatggc

SEQ ID NO: 23667 - DNA, 11351 bp, Oryza sativa
  unsure (1)..(11351): unsure at all n locations
tgcgcacggccggtggcgcgggttaccggcgcacggccggcgcgcgtccggtgacgncgncggcccatgggatgagcggtggcagcgacgcctaccaggtgtttgacaaaatgccaacaagggacgtggtggagtagagctaaccaatctagccaaacactttctattccacttcagctcttataggaaccagctctaactggacttggagtttagagttgggagttggagtttggagccctaccaaacggggtctacacatagtttctataaactttacatcatcaagaaactaatagtagacactactctttcaatgcaaacaccacttttccatatttaaatttaatgctacttatcttacatgatgtcttggatgttgtgtagaaaccatgtctcatgcaagacctggtttccttctctttcctcatttattctcttgccacatcatctttcattctaagtgttatgtataccatcctagtaattgggtcgggaatggtctaactaaatagtccatcatacaatagttaactatcgatacatattacactattaatgcataccttacatttctctctcacataggttatcggatctcgtgctgtaacttgctacaaatatgtaccccctatttcctctctcatctcttttttccttcacgtacgcacaaatataacgtgacaacctatatagtccgcttccatcattttattatgtccattttctcctcctctctttttctcttaccatgaatcaaatacatatatattataaaaatgtgtagagttaactttgcacgagagtgaacactttacagatgtctattattattctagtcatttgcttaatgcagtcatacgtaagtttgtggagaagaaaagcacctcaacattattttgtccagatttattgtactaggaggtcgtattctcttaggttggcttttttttaatggatggagtaggttagatggttggaaccctggaaagctcctcgataccagtgatgtcacatggaacctcatgttggagtagatctgctttatagggagagatgcttcacatagggagagataatagtccggtgggttaggatgaaatagttttttactaccgtcctactatttcctccaacttaaaatataaaaagctaaaattagatcagatattctttttagtattataaatctagaaagattgtctgtcagtccaaattcgtactactgaaaatctgtccagattcgtagtactagaaaaatgtcatatcttataatacgaattcaatgccaaaaatcagaaggagaatggtgccacgtggcaacaccggttttgcaggctcgacgaaacgtgcgtccgcgcgtgcagggatcgatgaaatgctcttgcctgcgtgcgtgcgtgtgcaccggtcgtccagaaatttctccccaatccggcgcctttacgtggatgagacgagatactatgcatacagtgcaaacacgttaatttctcacattcccaccgtagggctggcaaagctcagtcaggcaggccgctatttcttgtggatcaaagaagtaataatacctactttagttagagattaaaatagggttagcaggatataattaaatcatccactaaaaattcctacgttccaaagatccatctttttaagttttctatggtttttattcatctgttttacacacgtatttatgtgttttatattccaaatattttctttcgtgtattttgtttttctgagttccaaacataccttagcctatgtttaagaggagagaaagatattaaggagataagtaaaactaggtgagccattatcgcataattaattgactaataattattttaaacatgaaaaatatagaaatatgattttttttataaaagggtaacttttctaaagattttttaatgtaaaaacacgccgacatgtgggtgaaaaatgatggacgtttcctttatttgtccctttgtcgaatgcaaccttagaacaagtacaatataaagcaataagctagctattgaacaaagaaggagagagaagaaaagtggactacatataaatatttaggtgcagtatgagctccaagatagtatgtgagaagtaaccacccctcatgcaagtggtaatttcttcacaaactctaagaaaagaatggtgtggtttggatgcaaattgaaaccaatatgctacatcttaattaattagttgatgatgtgaataaatttgaggtcgtaatcacccctgctataaaacttgcttataaaatttgctcttagagcaaagataatagactaatagtgggctataaacttatgtggagaatagagatttaaaaaaaacagtgttggctttcaagtaaaatctagctctacacatgcttcaaggtaaagaaatagagagacaatcttatagtcaacttataagctctaatataagcagctttagttatctctactattaatctctggctcttttatatatgtgtattaatttgttacaggcccaattggccaggctcagtataccatgcgtggcaaagccgcgcgctttttctagtccaatcttaagtttttatattttgggaaaaatgtactatatgaaataagaatggtctaaatatcttttatttaatggggtggactaaaagcataagtaggaaaaagattgaaagaaattctgaatggtgaatgattgtggagagaataataatactagtagtctacaaaatgtaattattctcagataagtttgagtgctaaataatacttatagtgagatgaaggtagtattaacgtggactcatgtttagagctctttaaatctaggattttatttatttattgagtggttgcacgtaggatacgaattattaaatttcaatcatatttttcatcaatccagtggttctcagtactcctatttttatttcttattatgggaattgctaactgtctgttgttgacagaaaattgatggttaaatcttgcacttgttaaaccgttggatgtgttcgggatcgtgctagccgttcgatacaccgtgatttctgagaaaaagagaaaagcaacgcacaaggagggatcgatcctgtgatctcatcctatttatacaagttacagtatatgctaggtacatatgtaattataatacaattatacaattatagtgtaattatgaaaattatattgtaattgtattgcagtaacatttgatagatttttaggatacttttcagtcccttttcttatataaaaggttgacagatattacaagaaataaacttactatttatacattacaaaattatatgaaaaaaatattcaaaccatgataaaaataaagaaaaaaggtatataccaacaaaattacatgtaaaataccacttcaattttaggtatatgaatatgcaatcttatgtgaataaaaatttacaaactttcgagcacataaagatttagcattgccccgagaagaaaagcacctctattcatgtgcagtcatatgggagctcgtgatcacatcgatacatgagctcgtgatcacatcgatacatgtgctgtgacatgtaagctcttgatctctgctttgcacaaaagggagaatattgtactattggttgatattgtacttctattcatgtgcagtcatgtgggagctcgtgatcacatcgatacatgtgctgtgacatgtgatctcttgacctgctttgcacgaaagggagtatattgtactatttgttgatattgtacctctattcatgtgcagtcacgtgggagctcgtgatcacatcgatatatgtgctgtgacatgtgagctcttgaactactttgcacggaagggagaatattgtactattggtttatattccatgctttgatggggaatgcatgagagcaagtataatagagggctataagagcaagtgccacattggattgagtaataagatggaggagagaagtgaggagagagatgatgaaccatccctaagtcaagaatcaacctccacacaaatttcaagaagagtgtgagagtattagtgacattgatatttatgtactagaggtgacatattgtatgtgttgcctcttaatttacgagtgaatgatatggataaatttggatatggtaatcacatttaccataacacttgccctaagaaggctgaatactgaggtgtaggctgaatactggctcggctcggcttgcagtggctcacaacaagctaggcttggcttggctcggctcagttagggaaacaagctaaaacttgagctcggctcgtttcctagctcgagccagctggagctggcttgcaagccttcctgttaaaacatctcttcatatatattttgtaattattaacaaaaaagcaagagcaaatcatcgacatgtaaaattaaataagtttatatattcaattcttcaaaatcttaatgataaatttaaagttgataaataataactccatgaaaagcaaaataatcgatataaacacatgatggtctaggttcgcgagccaaaataagcggctcgcgagccagctcgggctcggctcatttcaacaacgagctaaataagaggcttggacttggctcgtctggcttacgagccgagccaagccaaccaagctcgagccaagcccaagctgagctcatgaatccgagcttttttttccacccctattgaggtggccgaaatctgtgagacagacaggtggaccatatatttatactgaaaagttaaccactatatgagtaagcttagagataggctataaaaatctatacagtaagcagttggctgtattattggccttgctctgaataaacataggttagggcaagtactataagcctctacatgttgctcctaaagatgtcacataggattaggtgatgatatgaaggagagaagttagaagagagagaatgtgccagcctcatacaagaggcaacctccacacaatctttaagaaaatataagacgatgtgagaattaataaaccaatattgaagtttgtgtattagatgtgatatgttgtatttgttacctattaattaatagaacttgcccttaagtagtagtgctactatcaaaatgatagaaacatgcatgttaaaaatattgtacaaatgatgtgcagttgttgacgtaaaatctaaaagaacagacggaagcgtgtgagttctgcttagctttagtataggtcctatggatttcagaatgtgttagttagtttgatcatacaactaacaagataaaatacagatagattagattaaaatgacccgttggctatttcggtctatatggaattgtgggcctaaccgaaaccaataagattcaggtcaacggctatataactgatagagtttgttattcatactatatattttcctcatttctcttactcgttcaaaaatcgtacacacaactaaagaaaattttaatcatatatacaatttttcacacggttttatatattaataaaatttatgcatgtcttatgtataatgaaacataatactaaaaccattttatatttctactacattcatactataatatttcttgagtcctaacatacatagtacctaaaaattctaaacttctcacataactaaactatttatatgtaatatatgcacactacattaattattacttatccaacacttaatattttcatctaatacataaatcatcgctaaatctatacttcataataattaaagtactaaaatttacctctattttcttcgacttatatccctcttggcttggaccattacctcttcatttcttctctcttcctcaagctcttctcttctcttttttatggcatgagcacctcgtctggtgcaaactctcttctccttatatggcgtgaggtgagcaagaaagaggaacgaaaagagtgacgttttcaccgtgcttgattgctcaaagtttgagagcattgtattgacagcgcggattcctactctgtgcagcgcaactgtgctgcggtacgggcctagctcaattcaagagtattcagatgaatacccaagatttttagataaaaaatacaatatgaggtatatatttcgtatctgttttagatgaaactatcatcagaatggccagttttcagttagatcaatgtacttagctttaattaacaatggttacattgacagaaataagttaatttggaaacttaagatgccgcttaagatcaagatctttatgtggtatttgcttaagggagttgtgttaaccaaggataatttagcaagacgaaatttgaatggtaatttaagatgttgcttttgtacgaaaaatgagtatatccaacatttgttcattgaatgtcattttgcaaagtttatttggagagcagttcagttttcttttggtttatatattcctactagcatatctcatatttttgatgatcggctttagggagttgtaaacaaaaagagtaaactgatacttgttggagcttctgtcttgtgttgggctttgtggttgagtagaaatgatagggtttttgacaaatcacctacaattacttatatgcaggttattttcaaggcaatatattggcttcgtctgtgggcacagttacaaaagtatgatgaagatgaagaattcctaattgttgtgtgtcgtatgcttgaaacgacggttatacaactgtttgtcaatcatggatggagatttaccaatacactgaaataatgttattttatctttattggtttccttttaattttaattttggttggtgtgtttgctttcatttggactgcactcttacagagtgctagtttgtaataattggctgtaactcttttgagtaaaggtcgggatgttatttcattccattattaaaaaaatatattttgtatctgtgcagagaaataaagaaaataaatactattgatcaaaagaagcctaacaagaaagcctagcacactggctccctcatcccacctgtcttatcttctcattatgtaggcccaatagcccaaaagaaggggcaaagtcaacctagaccaccactggtcgctgttggttgttccaacttccaagtcgcaacatgtccctccgtcttgctcatcaacgcaacgccgcgctgccgtcgtgcacgcgcagatgtggagtagcccgcggcgtgccgacgcctatcgaggcctcaccctcaacaggtcgcggacgcccttccctcgctcggtcaaaccctctctctctctctctcgtcatatggcccgccccacgcctccggcaccgttggtcgcgctgccgcggccgcttccgcacaacgcgcggtgcaccactgcaccccctactgcccctaccaaatcgcctcgccgaacagttccgattcgattcaataggtaacccgttcaatctacattctcccaatgtgtttaatgtgaatatctgaacccaatttattttttagattgtactacatatgttttttcataaagtatatcccaataaatcaagaaaattgctgaaaatcttgacgcaagttctaattcaataagcagtactaaaatatcatactgttgatcatacataccaaatattatgcttgtgttgtaaaacttttttttttacccctttccatttcgaatacctaatttcaaaatcctaggtccgcccctggcggtaccgcatggatgccacgggaccgacatggtcccgccctccaccacgttgccgcacacccaggccgcagcattgacgcggtgccgcaattctggcctacgggaccaaagcggtgccgcacgctcatcttacgtgaacgacccagccgactgtctcgcgtggctacgccgcaattacgtagcgctcccgcgtgcccatcatgccgtaaagagatatatttgtgcaaatctttcccatacatatatataaatgcaaaatcttaaaaaaagttatattttcaatctattatattattaaacagctttaaaatgaggcaccacgttcgctgtgggggactaaaatttcccatattaaccagagaaaaagaaaatgagagttcaagtaaaaatacaatttaaaaatagctgaaattcagaattaaaaataagcaatattgagagaagagtcaatataaaaacccgatacgagattaatcaaaatttagaataaaaataaaataaaatccaaaattagaaaagaaaaggagagtccatgtaggaatacaatttaaaaataactgaaattcggaattaaaaatcaggaatattaagagaagagtcgatataagaacctaatacgagattaattaatattcagaatctctatctctatctctactacttaaaataagaggttcttccgtcgtccgtaaaaaaaaaggggcgaaaaaaatcagtctaatccaaaacaaaaataagaggtgcttccgtcgtccgtaaaaaaacgggcgaaaaaaatctgtctgatccaaaacaaaacgggcgaaaaaaacggacgaaaaaaaccgggtgaaaaaaaaagaaaaaccaaatctgtccgatcaaaaaagggaaaaaaaaggaaaagaaaaacgaacccgattccaaggtaaaaaaagggcgaaaagaaataaaaaaggaatctgtccaattcctaaaaaagggcgaaaaaaaccaggtgaaaaaaagaccagcaaaaaaaaatgaatctgcgtggacgcggtaaaaaaagagcgaaagaaataaaaaacaaatatgtctgattccaaaaaaaaaaagaattatatgtgacgcggtaaaaaaaattgaatcctattatatttgacacggtactatatatctctatcttatctatatctactacttaaaaatttaaaatgtttctgttgtccgtaataatgaaaaaagggcgaaaaaacattagaacaaataaaagaaagttcgattcaatttacttccgtcgtccgtgaaaatcttatcttatcttaatctcaatctttccgaggggacgagcggtgccctccgtcctcacccgcgggatgaaacgccagccaaagcaaaaaaaaaacgaaattgagcaaagggataaactagattgaagtttccaaaattaaaagagggtaaacgatattgaaactcccctaactcgtaaagagggaataaaatagattgaaatttcccgacaaaattctctaaattcgaagaactctaatttcgggtaagaaccataagagtcaaatccaaatcaattaagttaagggttcgggttacttaccggatttgaagccccagagctcaccggagctttccaggaagcggcaccgccgcaccttcacctcctcgcagtcgtgtcgggttccctgcgcgcacgctgtcctggagcacccctccaccatcctttgctgaagacgggaagcgtcagcttggcgtcacccctaccgtcgacgaggtccaggctgctcggtgctcgtcgccgtttgcacgcccacctagccggaccgccgacgtcgtggcacggttttgcgtcccccagccggcgaagcaggagccgctcggcggtcgtcgctgcacgcgcgcaccagcttgccggaccaccgtcattccactcgctcgtcgccggagagaaatgggatcatgagagggatttgggagctagggttttgcccctctccccggtcggtgcttcattcggcgcggggacgattggagccgtccattagatcggacggcttagattcgcccagcgtcgggccgtcgccgccattgattatgctacgcccaatgggccgcggaagtgcatcggaccgtccccgcatatgtaggtcgcgcttagctgctcagcttgtgggccgtcgaattgactcaactcgccaaagatgggcaagcccaagtttgggccggcttgggaaggcttgggccgaaagcaaatttgatcaaacaatgtggctcacatttttcaaattaaagtccgtcggataaactgctaagtaggctcaaaaaataaatctaaaactaaatcctaaatcctatgctaattgatcaaattagactcggttctacctatttgttaatatatcaaattatacttgatttttacagatttgaggttttcaaggtgtcacaccatcaaacggtgtttttcccgttgcaacacacgggcactattgctagtaaaaataaaaataaaatccaaaattagcaacaaaaaaaaaagaagagttcaagtaggaatacaatttaaaattaaccgaaattcggaattaaaaataagcaatattgaaagaagaatccatataagaacccaacacaagattaattaaaattcagaatgaaaaataaaataatatccaaaattagaaaaactaaaagagagttcaagtaggaatacaatttttaaacaacttaaattcaaaaataaaaaaaataaattatgaaattagaaaaataaaaaagatttcaattaggaatacaataaataactaaaaattggtgataaaaaataaagactattgaaaaaaaaagatcatctaaaacacatgacgagataaattaagtaacaggtctataaagaagtagagtggtggcggttgatacgacatacaaaaactattaataaaacacaaaatagaatcctaatgacgattaaaaggaggaacgacaggcagaccgtgaagctaacgggcaaggcggttgctgggacttctagaaattaaaaataaataaatcccattgataataatattcgatatttaaaatctcaatggcaatcaaaaggagaagcagcagacggggtgtataggagtgtagttgcagagccgctgacggttggcgagacttctagaaaataaaaaataaaaaatgaattctaatgataattatgttcgacttttagaatcccaatgacaataaagagtaggcggcggatgggtcgtggaggagtatagtggcatcgtttgacgggacttataaaaattataaaaaataaaacccaacaagacaataaactctaaaaactataaggaccaatttttaaaggttcggaactttcaaaaaataaaaaaacccaatgataatcatgttcgattttaaaatcttggtgacaataaagaaggaaggcagcaggtgagccacaaaggagtacaatggcaaagccgctgacggtttggcgggacttctataaagtaaaaaatgaacccgaacgataattatgttttatttttaaaatcccaatgacaataaagagaaaagacagtggacgggccatagaggagtataatggcagcgtttgacgggacttctagaaattataaaaatgaaacccaacaaaacattaaactctaaaaactacaaaattcaatttttaaaggt

SEQ ID NO: 23668 - DNA, 1668 bp, Oryza sativa
  unsure (1)..(1668): unsure at all n locations
atagaagtgtagttgcagacccgctgccggttggcgagacttctaaaaaataaaaataaaaaaatgaattctaatgataattatgttcgccttttagaatcccaatgacaataaaaagtagccgccgattgggtcgtgaagaagtatagtggcatcgtttgacgggacttataaaaattataaaaaataaaacccaacaagacaataaactctaaaaactataaggaccaatttttaaaggttcggaactttcaaaaaataaaaaaacccaatgataatcatgttcgattttaaaatcttggtgacaataaagaaggaaggcagcaggtgagccacaaaggagtacaatggcaaagccgctgacggtttggcgggacttctataaagtaaaaaatgaacccgaacgataattatgttttatttttaaaatcccaatgacaataaagagaaaagacagtggacgggccatagaggagtataatggcagcgtttgacgggacttctagaaattataaaaatgaaacccaacaaaacattaaactctaaaaactacaaaattcaatttttaaaggtttcagggagaataaatagaaatagtggtagattgagcaagcaaataaagaagcatatgacagaagtaaagggtagcaactggtgtgacttttaaaaactatataattagaaatatagggatgataagatttggattttcaaaatcttaagacaacgacatagatatttaataaattttaagtaaaatcatactaaaaaaatatatgattttgtttgggtgctagccgcagaattgcgcggaccacccagctagttttttaaaagtcaccttgcatggcttaacttacacaccggcagttctctctaaaaaaacacaccggcttaactatgtttttgcttttatccctcttccacaatttcaggacaaacatcaggcgcagttggttcttcagactgtgcagaagcagcattactggtttcagcatccttcgtccatactttattgttgtctagcggccaattagctactcctgagcagtgctgagcttcgacaaactccagcattggatacagttcacgcaattcctcccaacaaaactgcagatccttgaggcatctcaagcgcagcacctctactttgcactccccattctgaatttccagactatgcaacttcccaccagtaaaatacagtttctttaaactgtcagaactaatcgtcccaaattgtctcgacgggaagcagtagagatccagctttgaaagattagagggaagaacaaggttaaattttgcagcatctgattcgtcggcagcatctcgtggagataccattccccatgtaatcttcagtgatgcgagactggcaaaattggcaagcactttcagctcatcttctgcacgcttcagtttcttgctaacactgatgctaagtttgcgaaggttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23669 - DNA, 473 bp, Oryza sativa
aaaagattgaaagaaattctgaatggtgaatgattgtggagagaataataatactagtagtctacaaaatgtaattattctcagataagtttgagtgctaaataatacttatagtgagatgaaggtagtattaacgtggactcatgtttagagctctttaaatctaggattttatttatttattgagtggttgcacgtaggatacgaattattaaatttcaatcatatttttcatcaatccagtggttctcagtactcctatttttatttcttattatgggaattgctaactgtctgttgttgacagaaaattgatggttaaatcttgcacttgttaaaccgttggatgtgttcgggatcgtgctagccgttcgatacaccgtgatttctgagaaaaagagaaaagcaacgcacaaggagggatcgatcctgtgatctcatcctatttatacaagttacagtatatgctaggg

SEQ ID NO: 23670 - DNA, 658 bp, Oryza sativa
tctcaagttctttatactactactacttattgctttctggtcgctgccccctgaaagcaagatcgacgcgagcgtacgtcacaaacgacttgcgagaagataaactgcaggagcttagctgctcgatcgatcaatgggagcatcgttctcctacggacaaacgcaacgggtcaccgagaataataatgccgctgcctccaccgtcgtcgccgtcgtcgatgcgccgggtaggggcggatccgatgtgagttccccctcccaatcaattctagatccgccccagacaccaggtctggagcggggcaggggcggatccaacgtgagttctccctcccaatcaattctagatccgccccaggcaccagatctggagcggaacaagaggaagaaggtgaagaagatggtggagcgtgttatcgatggtggggatctagacttggtcttatcgtacgagaacgacgaagaatgtttgtttaatgagagcatgctcgaggatcaggaaacattccgtcaccaaatcgagaatttgggctatgcgttcattcatgtcatgagggaagtcatcctaaccgatgatgaggatcaagaggaaggcgaaattgtcacctatgctgaggaggaagatgatattggtaccgatgatgatgatgaggatgat

SEQ ID NO: 23671 - DNA, 832 bp, Oryza sativa
  unsure (1)..(832): unsure at all n locations
nnnnnnnnnnnnnnnnnnnnnnnnnnnnnnnnnnnnnnnnnnnnnnnnnnnnnnnnnnnnnaattatatatttaatgaaactctgctagtgttgtaaatattactatttttttctacaaaattaatcaaacttagagtagtttgaatttgaccaaagtcagaacgtcgtataacctgaaacggagggagtatctctttacaaggaataattaacgttttaaaaactttggctggtaatgattaacaaattagcattagtgtgagctagtgtgtatgtgaagttgttacaggtggttaaataatttgggcagatttagggccaaatattttcctcttatagattataaattattgtgggcacgctttcgaaacttgtaaacgggatgttttttttatgaaaaagatttaaaagtgattagagtatttttaaaacagctttttaagtttgaagtagttcattcatcgttttgtagccctcagatgtcatcagaaaattagaaaatcaaactagaccttattgcagagttttctttttaaagtgttttgtttgttagaatttttctccaaaggcggctgcaatttgtactccttttttgagaaacaaattgagaggtgttgacgtatgcgaatttttatgtatttttctacagtatttttctcagtattgacagctatatgcatgattggatgatgagtctcacatgtggttttaaactcttaatcttcatgctcccattgtctgtatctgcagtcactgtcatcctgacccaagcaaaaacaaactaacctagaaaaattatagcacaacccattttatttgtgaataaataat

SEQ ID NO: 23672 - DNA, 19167 bp, Oryza sativa
  unsure (1)..(19167): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggagtaccttgaaagctgggaggagaatgaccatatggtggatagttgcttggggaacaaaatggatagaaattgtgtaaaaaatgtgggttgaagctttgggtaaactgagattggggaaaattattggggaattgttggggaggggagttgtggctagtcttttctgcatggtttggagagtcttgactaagaagatctatgaatttttggttggatgaatccatctcctgatgaaatgaagagatacaaactgaaatctcttgttggtctgttttataggagcatagagaaggagagccaacacccagcaccaaaggctacttcaacggacacttgctcggctgctcacgccccagcaccaactgctttagattttatattcatttatacacagtgaactcaaaaattactgtattttatttccttgtggcctgcctattctaagaactactttagcaattaatgtcatatggactacctccactgtgtatattgcctgcccttagagctgcatttattgtataatgcctactttagtgatacattgtggatgccctaatgacttaagaacacccttaaagcaacttcgcactgttggagaggatgtatggactgcgtgaggttcctcgttttgggtagcttgcactgtaggtgacataagagcaaatcaagatcctgcaaacgaggagggattcgccgattcggtgcaccggcaggcaggatctctgacgcgacgacagcaaccaatgtttgcgtgtcaatactactggagacgcgagagagatggacgacaggacatcggacgatcgacagcaatgggcaatggcctcctccagagccagcagattctctcgttttctcctgtgaaccatctctctctctctctctctctctctctctctctctcagacgatcaccatctctctctctctcctcccatcagctcatgtcatctctctctctcagacgatcaccatctctctctcctcccatcagctcatgtccggatgtccctttttggtcgttgtttctttggcacgatatttcatcatgtatcctctcttttagatataaaaaaactaaggatgtaattcatttgtctcataaaaatcaccttaatatcatatgtgacacatcttaatactataaatctagatattatcttttcagatttataatcctaagatattatatgtcatattcagaattaaatttgtttttttatgagacgaaggagtatctccctatactacggatacgcacaaattttatttcatagattaaatatatagttttgtgatatatccatgataaatttagatctaaatctttttgagaaagtttgataaataaaatcctaacttagatctgaacttttgaactaatggacgttgggttgcagaaatgaagattggattgctaggaaccatgaagcaatactagttgactaaaaccaccctaaccagtactcactctgtttcacactttaagtcattttgattttgatcaaagttaaattgctctaagtttgatcaagtttatagaaaaaagttaatctagtattagatgtgatacatcctaatactatcactattgaggaacctatctttagttccggttcgcaaccccttaagtctcgggtatgcaaccgggatgcccaatccaggactaaaccggttgtttattttttttcttttttaattgttatttgctacttgcatattaatttcgagccgaactcggcgcacatcgagttgctcctgacatccccagacccccacatcaaaatcatctaatcagacatcacatatcgagttgctacaaatcaaaatcatcacagatcagacaaaatctaatcaaaatcatctaatcgagttgctacaaattagacatcacagatcggccacctcagcaacaaaatcatccacaaaaaatcatactcaacaacaaaattcattcacaaattcacgaatcatctaaaaaatttcgcaaattcacaacaaattcacaaataatgccaacgccgctccacatcgccgcctgccgccaccgtctattgcctcccctcttgctggatccggtagaggggagggcgctgtcgttgcccctcaggcaccttccgccaccaacgctgccgcccgtcaccgtcgtacgtcacaactgaggagggggaggagagaggaaggggagaagataaggacaagaagataatgggagaaaaaagaaaaaggacacacacgctcggctcttttcctcccgtgctctttttttcaatatcagccccagttggtatcataaagtgtcgttaggtttttgaaccggggctacagaaattctttagtcccggttcctatttgaacgggacaaatgtcatttttaccattcaggcaaagatcagttcgccaatagtctatgaatctgaacagaactaggatgtgtcattttcactaatagattaatttattctgggttaaagagagtaacttaagtaatagtgtattaggcactctctaagactcttagatttctcctatatctaggggcccgtttggcacaccttcaactttagctccacttcttttagagctgaagctcaaccaaatggttacagtttcactcaaaaaggcagtgaagctggctaaagtattcttacaaaatgaattagagaagcgaagctgcgttttaggtagctcaacttcactccaaacccaatttctaaaattaaacctagaagttggaaccctaccgaacagagatatttaactaattgctactcttactagtgacaataaggaatttaccactggacacatatgagggcccacatgtcatatattgtgactggcaaatccttaatcgccacatattaaaagttgtatatagttaaatgcccctaccctaaatcctagtcccaaaatataaatattttttgatattgtcacaagtattaagaaaatatgagaatgattagaggaaacgtgtgattagttgaaaagataaagtatgtaaaagaaacttattgtgattggttgaaatgagaagaaataactctattttagaacaaagtattctctccgtccaaaaaaatttaacctaggagaagatgtgaccccttctaatacaatgatctacacaattctctggctagattcgttggactagaagggagcacattgctttgtacgttactacctccgtcaataatagatgttgctttaactttttacttgcaacgtttaaccattcgttttacttgaaaaattaatgcaaatataaaaaataataagtcatacttaaaatacttttgataataaagtaagtcacaaacaaaataaataataattaaaaaatctttaaataagacaaataatccaacattacaaacaaaaactctaagcaccaagtaatagtaatatggtacggaggtaaggcagtactctctctgtctaaaaaaactcaacttagaaggggatgcgtataactcaacttagaaggggatgcgtatgagtgtaacccacaactgtaaaatcatagatgtttttgattattattctatgatgaacaattgggcattggagattattggttttgttatttggaatttattcacgaagtggttttggagatgattggattcacatgtgatcgcagggttcattattttatgtgaccggtcagaccgggttgtgtatgctggtcagaccagcggtgatcgagcagtcggaccggccagcctgcggtctgaccggccgacgctgtgttggtttcggtttcgggttgtttgtttggatatccgagtttatttcttgattatgacttctagatggatactatacgtatgtaatacaattgtttgctgctaatgagtcaagttggagatagcttggtcgcggaatatggtttctttgtttgttccagtgtaggtgacttgatgtctcgggagagtatttgcgatgatggaccgggagtcggcttggggataaggtgacgtccgtggtggtcagagatcatgcgggatacttaggctagagttgatgcacgtggttgatggagattccatatggcatacgatggagttattgtgtgcgtatgagatgtggagttgaatttggaaggagtccaaatttggtacgattggttatgtaaagtttctttcttgtactagagggtttcctaaggtgtttaggactcttagtatgagtttggttcgtggctttaggctgcctaccttatgtataaatagagggggagcatgaggcttccctgtatcgctttagagagcaattgagttgagttttgagttagggtttcgagtttagtcgaaatttttgtaaggagtgctgttgatgcactttgtaaacacagagagaatcaataaagttgtcatctattttaagagttcttatatttgtgtttcaccgggttttggcggtataaccggcaactcaccggcggtcagaccagcggcattgcggcggtcagaccggcgggagaacggcggtcagaccggcggcggcgacagcgagcagcaggcgatctcggcggttagaccggtagatcaacaccggtcagaccggcggctatgcttcggtcagacctgctaatctacttcggtcagaccgatctcatcgaaattgagggtaacttttatttccgctaaaagttttcggtttttggttataccaaccattcacccccccctctggttggtttagttattgtgatacgatcctacaacaacctcttttttagttctagattgagtttttttttaagaacggagggagttttttttttacggaggtagtaaggggctgtttggatgcttgtttcaatttaccaaactactatatagctaaggtgtggcataccacaatttatgtggctaagaaattcttggccacaagttaggcaaatgttggtaaagatatgtgcctatgacaagtggggtcataaaataaaaaattgtggcatgataaagatgtggcaaccaagcaaacactaggttaaattggtcaaagtagcttgccaaagttgtgacaaagtatggtcactatccaaacaacccatgagcgcttagggcatccacaatgttaggaaaaagcaggtattaagcaatataatatttctatgatctagtaataagcattgtggaagtgggtagtaactaatgctaggtagtaagcttatgacccactcataagaataaaaaaacattaaaatctctctcactctctccttccaacacaagatgtgctactactgcatgctgagttggacaaaaagcaactaaaaagcaatattttttccctcatgggacccaccttacaaagacctattacttagccctgctacttattacctagttaaacaagatacattggtgttcccttagaaataacatttggagctagtcccccacctacgcggctacggccaccacgccgcccgacgcgcgcgcgcgcacatggggatggggggtgggggggggggagcaccaggccaccagcacgcccgcggcgatggctcccatagtcccatcccattcctcaacaaccctgtggagattatgggtaccccatacccacacggcatggttatccgactagttataggggataacttatatatatgaaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagcatatatgagacaactagatcgtcagatctataatacacccggcggattcaaatccccaaacaggagtagggtattacctctcatcgagagggcctgaacctgtctaaatcctttgtctccacatccatccacttttaggtctcgtgcgctaccccgttttattattgccgaatccatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactgcgcggcactattgaggcgattgatgctggtcatggactcgaggcgtctcagctttccggtcgatcggccgcgagtccactccgccggcttgtcctcgccaccgccattgctgatagcaacaacgacttcaccgccggcccgcctccgtcgccgccgactggtgtcatcgcctatacggttggtcggtcacaccaccgttcatgggcgtctacgacttcaccgccggcctgcctccgtcgccgccgattggtgcctccgcctacacggctggcctattatgccgccgctgttgggcgtctacgacttcaccgccggcctgcttccgtcgccgccgagtggtgcctccgcctacacggctggcctattatgccgctgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccgacctgcttccgtcgccgccgagtggtgcctccgcctacacggctggcctattatgccgccgatgttgggcgtctacgacttcaccgccggcctgcctccgtcgccgccgagtggtgcctccgcctacacggctggcctattatgccaccgctgttgggcgtctacgacttcaccgccggcctgcctccgtcgccgccgactggtgtcctcgcctatacggttggttggtcacaccaccgttcatgggcgtctacgacttcaccgtcggcctgcctccgtcgccgccgactggtgtcctcgcctatacggttggttggtcacaccaccgttcatgggcgtctacgacttcaccgccggcctgcctccgtcgccgccgactggtgcctccgcctacacggctggcctattatgccgccgctgttgggcgtctacgacttcaccgccggcctgcctccgtcgccgccgagtggtgcctccgcctacacggctggcctattatgccgccgttgttggatgtctacgtcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggtcatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgccttctccgccgccgactggtgtttccgcctgcacggctggcctattatgccgccgttgttgggcgtctacgtcttcaccgaccggccgcctcgtccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggctgccttgtccgccgccgactggtgtttccgcctgcacggctggcctattatgctgccgttgttgggcgtctacgtcttcaccgaccggccgccgcatccgccgctgactggtgtcaccgcctgcacggctggcctgttataacgccaactgatactaccttcttcacggctggctacatcgctgtcactactaataggcatcagtatcttcaacacaagctgcctacgtttgccatggctgccgactggtttcttcacttccatggctacatgattctaccagtgttgattagccttatcttcttcaccgccggtcatctcgtctgctgttgactagtgccctcgcctctacgtctggtttatacagctaccactactgatggacatcatcgttttctgccgccgactcgtgttatgccgccgtcgactggtgtttttatcttcacaactgcgcgtcttcactaccggttcacttcatcacggcaacacaactttgtcatcatggtggagcgacttcatctttattatcttcggaaccagcaaactctattgctgctacttaacaagttttgctacatcaccaaccatgacgttgttgtgaatctcgacatctcggcatgcgatgccgtgttattttactacaacaagtggctctccaatattcaggatttctacttggacatcttcaacacatatcttcaatcaagcaataactattcgacgacaagatgctacagttctcgactctatgttcagttgtttcccaactaatcaaagagtcggggggctacacaaatacaaggctcaaaatttgacaaattttatgtcaagctgaagaaatcaattcatcagccaatgagtcaactccaggagtcattatcttcatctttgcttcggagcatacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcatcatcatagtcggatatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatctttactgttagctgacctgactgttgccaactggtttcttcgcctccatggttatgcaacttcattacatttgatcggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatgttacccggaagatttattactctacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaaactttatatagctgtcccgctgacttttttatatataagtcaaggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcagattttacaccacatatgccatatatttccaggtgtggtgaaaccatgtgtcttatagggacttaagcacatctgttaaagcagtgtgcgcatggcgtatgcccaatactttggaaatttctttattcacaacatacaagcttttttatagctgttttgctatgtgaattttcaataatgtagccaactttagggtacactcatcatattttacaaagcagtcggtatatcacttggatcatattattcagggattcacaccgcatatgctacatattaatatcaggtcgcttggttgactataattattaaaaccactcggttggttggattatttattccttgactatatgcttggtttgttcaattaaccacatagtcgggggctacacctattaggtgcatctagtcgatgcacctgactttatttttcagccctccacagtctttatatttggtaaaagtactcgggagatcatggcgaggatgattgaagcactcggctttggagtaatctagttcgagagaagattatctttccgactgtgaaggtcccaggggctactgtggagattatgggtaccccatacccacacggcatggttatccgactagttataggggataacttatatatatgaaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagcatatatgagacaactagatcgtcagatctataatacacccggcggattcaaatccccaaacaggagtagggtattacctctcatcgagagggcctgaacctgtctaaatcctttgtctccacatccatccacttttaggtctcgtgcgctaccccgttttattattgccgaatccatgtttcgacaaaccccccgctatcttaccatctccatgtgggtgtgggtgtggcgctcctcctcctcctcctccaccccggtccactccccctcccctctcctctttaaagcgccgccgcttcttcttggcagcggggtagatagattagctcccgattcggacaaagatcgctcgctgctcgctctcgccccgcattccatcaatgcgcccgctgatgacgatgatgatggattggccggctgcttaggcagcttgggatggtttcggggctccgttttctgctgctgctgcttcttgctctgacgacgacgaccacaaaccgtggccttgccgattcgatgtcacgggcgccgcccggatgtcgctgccggtcgccgaggtagctggcatcgccgccgcctgcgtcgccctgctcgccgccgtggccgcgctgtggtgcgccgcgcggcgcatggcccgccgccggggccgcaactccgacgagaccggctcctccgatccttccaccctgggtgcctctcagttcgccattgtttcttagttcttggccccttttgtatcctccatccatttcgatgctgatgtgtggtgccaatgtgcgtggtggcagtggagtggggcaagggaggcaggagctcgtcggcgccggagcaccagggagcgaggcaattctcgttggacgagctggctcaggcgaccaagagcttcagtgaggccaacctggttggcctgggcagcttcgggctggtgtacaagggcctcctccttgacggctccgtcgtcgcgatcaagaagcgcattggggcgccgaggcaggaattcgctgaagaggtaaaatgtggatgcagaatcagggtgatattgttgttgggggggaaagattggaactcctttttttttatagaagaatggaatttagctgtgtcctgagcttgaactgtgttggtcttaattgttcctcatgtgtttgtatgttgtctggattctttcggtgtctccttcaatgtttggtggtactttctgttactcctattggattctgaaattaactgcatctgcatctcactaaagtgtgccatatttatgggcatagagtgaacattttagtcaaatggcttgtttgggagctagtaagatctgtctggtgtcaattgttgtcgtttgctagtccagaaagtttcataaattagatagggacgggtaagtaaatgcatttgtttcagcctcatatgtcagcactcccattaacttctttggtgccccttgcaaaatgcaggttaggaagctttcagagattaatcaccggaacattgttactctcattggttattgccaagaagggggtctacaaatgctagtgtatgagtacttgcccaatggcagtgtctctcgccatctctatggtaatgtttagttaggtacttgcttttgtgcccttgctatactttctaaagccttgtacgttttaccagataccgggaaaagctccatgacaaggcttgagttcaaacaaaggctctcaatagccattggagcagctaaaggtaataacataagtgagttatctaattgctttggagacattaagtaataagtagtataatttttttttatttgctggtttgagtcatctgcatatcctgagcctcctctgagtcacaaggattgctttgttgacgtgaattataaattcttttttatttgcaggtctcaatcatctgcatactcttgtgcctcctttgattcacaaggatttcaagacaagcaatgtgttggttgatgaaaatttcattgcaaaggtggctgatgctggacttgttaggttacttagaggatacgaagacgtcagcccatctcatgggttcagtagtagtgtgtaccaagatcctgagtaagtataattaccacatctttttatcttctatttttcatgtcagataatagatgtgtttttggaccgaaagacaataaatatgctgatcactgctttaccctataatatttatatttgaaaaacttgtacaataattttgtcacaagtcaatcacagttttaggaaaagatcttcaattcatgtattctaactaagtcttgcagttctggaatgatttagtcactaattctgtcatatagtcattgatgtttcattacgcatctttgttcttagggtacaatcggtgctacagttttctgaaagcagcgatgtgtacagctttggagttttccttttggagttgatcactggaagggaagctgcttgcctgatatctccagattccagagaatctctggcccagtgggtaatttccattgacatttagctattgttacgaagaaagaaagctaaaaacttctactttgtgtttcaaatatcttaaacccagtgttcaggctcatcccttagtatttatagagatggtgtgaaggttcttacttttgttgcttggaaaagaacataactttttatttattggtccaatataatctgtcatagcttgtttatgtccacatcaacaaaaaagtggtaactatggatgtttggtaaatgctactgtttgtctgttaggcagtgggccaggtttttttttttcgtgtatgtgtgtggatcaaacctacagcagaggaggcccccgtggttataactttattaataaaccatggccagggatttcctcaacaacagttaggaaatattcgtattggagcatttttcacaccttttggcataagaggtccttgacatttgatgctactttcctgcctcaactgagatatatagttcaaaaaaggaaaaataagaacattttcagaagagaattgcagtttcttgcacacgattatattccatatcctacctccagctgacatccattttcctgtcacattgaaagattgaaggacatttcagttcaaacgaactaattgacccaaggttaggtgccaatttcacctcagaaggtatgaaagagtttgttggcctcacctttcagtgcctgactccatcttcaagaagaaggccaaagatgaggttagtcgcgacagaactagacagaattcttgagacagagatgtctctgacaacgattatgggtgatggaaccgccatcatcacccttgggagcacattgtttaagtagcgaagatgaaaattgattgcatgtctgctatttgatgacatgatgattgtctgtagagtctaacagctgttgtttcttagaagttgtacaggctctgcattgttgtgatatgccatgtatgattttttttaggcttatcatggttggtataatttggtagggaaaggtgagaagaaacagagctgtatgtatctttctttttcttcctccttttgttggttgagagaattgtatgtaatttcagattgttcagtgcccttttatgttttaatctttgaaagggctattgattgagttctttgctaattcagtgtcatattaaatgattaacatctgttgttacatctgtcctcagcacatgtttactacaaatttgtttcagaattaatagcatgtatatttgagtttatataacacccttggagattatttgtagcacctataaatttctgagtttgcaaaatccctactttcttaggaaaatttttattcggtttgcgactaattttgttagaaaatacgcatgaagataatagcctacatgtttgtgagttgtgattaattttgctagaaaatagtcgcaactccattttaatccttggttcaatttcacctaaacataatgcccggttatttctccgctccaaatttcagaaccaatacacataatcctcaaatcctactatatcacaataattttgatcaaaatttctactatagcacaataattttgtaatttataatttatatagtataagcttgaacttatttatatgtactacatagttactgccattgtgacgcttctgtcgtgtgtgagttatcctcagcagggatgaaaacggtaacggaaattcccggccgaccgatgttcgttttcgacttctatcagccgagctatatagaaacggtaatcgactgaaacgaatatgaaaatggtaaataaaaaaatatagaaatgatttttctattataccgaccgtttacatattcttgtgaaaattatcgctttttaaaatatggtaattaccgtatttctaaacatgtcgatatttatagggtatgtctctacttgatccacagtttaaagattagttaacttttcaaacaaatccctaacttgagtgcatggctgaatgaagttaatttataaagtaaatttcacaaaacttactttgaccaaattaacgtaaaactacaaatttaaggtcatatatcataaactaaaaatttagcaacaaatttattacaaaactataggtttaagactaagtataacaaaactacatatttaatgataaaattatcataaaactatagatttggggttttaaatcctttgtgtttgagttataaatgtctaacttttttgattaaattgatattaaacttgtagttgtgtgataacttgttactaaatctgtagtcttgctataatttaccttaaccttaaatctgtagtttgtgatacatcatgttaaatctatagttttctgataattttaccgaagtatccgtagttttgtaaaatttactctaatttataattgtatagtataagcttgaatttatttatacgtattacgtagttatgctaagttaaatattttcttttatagtttaatgttttttatttgctactggtttccgatttgcaccgacatgttttcgttagtattattcagttttcggttattatttccgagaaaaatatgcttatatgaaaaatatgccctaagttaagaaatgagtgaccgtaacccctcgtcctcgtcactttccccttgcgcaccgcctccgccgctgatccccatccatccagcgagcgagcatcattcgtcctaccgcatccatcctggtgagcacatcctccgccaccgccgcctatgccgatccccatccatcgcgcgagcagggtcgccgtcgctcgtcctgctgcttccgccgcatcctctttcccagggatggattcaacgtgggtgcaggagtccccccctacacccaccgaaccagagcaccccctgagccccccttcaaaaaattcaccatgatagagtagagggtgctgagggggctcctaatgggcgcgtgcgcgccggctggcttgctcgcgcgcgcgccccatcctgcttagtgtataggattaacggttaatgacactaattagttataagtgtaattttagtagtagtatttcttttaaaaaataattcaattaacatttgaaaactttcatgttgaaatttgaaactttaaatgtggatttgaaaactttcaaatcaagatttttttgataactttcaactttaatttgaaaatttccaattcaaatttgaaaactttcaatctagatttgaaaaaactttcaactcgaaatttgaatatttaaaatcaaaatttgaaaactttcaactagggtttgaaaactttcaactcgagattttaaaaacttttaactcgagattttgacaactttcaactcgagaatcgaaattcgaaaactttcatctcagatttgaaaactttcaacttgagatttgaaaactttcaactcagattcaaaaactttcaactcgagaatcgatattcgaaaactttcaaatccagatttgaaaaatttgaaaactttcaactcgagatttgaaaactttcaactcgagattcgaaaactttcaaatcgagattcgaaaactttcaactcgagattcgaaaactttcaagttctgatttgaaaattttcaactcaaaatttaaaaactttcaaactcaaaacatgctaaaagattaaaaatataatcagaaaaaagtggaaaaaaacggagaaatcactaaaaaaaatgaaaaaaaagttctgggcccgaaacgcacgtcgccggcgcgcgcactcgttagcttttccggggtgctgaaggtcgggactatctatacatttgtcgacaaattttcttctaaaaatctgtcaaatataattgtagtgtaattacattgtaacttacatataattacattgtaactacaatataataaaactgttacttatatataattacactgtaactgcaatataactgcatgtaagtaagatataactttagaaaacttccgcttggacagtgctcacgccaaagagggatcatgaactcgcaaagtctgtttggacgatgcgtgcggagcatgcaggctgaacttgtgcatgcggcatgccatcgaactaatgcttgccgtcatctaccagcatacagtgcttggccatcattcatgcatgccatgaaatattaaacgaggacatgttcggctatgccctgtgccactttatgaaagcccttcgtccgtcacctatgctacgcatgaatgaactgcccctgtggcctgcggacgtcgaaagaaacgaaagtag

SEQ ID NO: 23673 - DNA, 821 bp, Oryza sativa
acccccccccccacccccccaaaaaaaaaaaaataaataaaattcctggatcctctacccactcactttttttctcctatttgcgttaaccttagcttctgttctttgaaatttgcattaaccttaatacttatatttggggattcaactgaaccccctgtcctatgttagatccaccacttcttacttctttttatatatatcgcaggaatcaatctgaattaagaagattagcgtgatgtctttcctcaggctgttacctcaaaggttgccgcaactttttaggtaggtattagctgcaaattttcggcaatcttgtactgagtgtaatttgtaggctgcatttgtatattcagatatccaactttgccatggaattaggttgtgttttaattgcttccttgatggcaacttctcaggcagatggagcaagatgttgagacagtgataaacgttctacagccaggaccgatagggattgtggagcacaaattcactgatgcagagatccgcaatgcccaagctgtagtaaggcgagcagtcgagaattggcagaagagctcgacccttgagagaaatcttggtagtggttctttcgccaaatagaactaatgccaccaacacatgacttggtggatcagccgtaccgagtataaacgggttgttaacttgttacgacatcgctttcaaaacgttgatatattttcttcctgaacgaatccatgcaatcagatgcattatatgcagtctgttcactctgttgccaataaaagtactttgaacttttgttaattgttcattgaacttctgaggttttggat

SEQ ID NO: 23674 - DNA, 790 bp, Oryza sativa
  unsure (1)..(790): unsure at all n locations
ccggtcggtaaaaagtaaacgtccaacaacgncggcataaaggccagcggtgcaggcgaaacaccagtcgctgcgccgaaggcaacccggtcggtgaagatgtagacgcccaacagcgggggcataataggccagccgtgcaggcggaagcaccagtcgccggcggacaaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgtccaacaacggcggcataaaggccagccgtgcaggcggaaacaccagtcggcggcggcggaggcaagccggtcggtgaagacgtagacgcccaacagcggcggcataaaggccagccgtgcaggcggaaacaccagtcggcggcggcgaaggcaagccggtcggtgaagacgtagacgcccaacaacggcggcataaaggccagccgtgcagacggaaacaccattcggcggcgga

SEQ ID NO: 23675 - DNA, 948 bp, Oryza sativa
  unsure (1)..(948): unsure at all n locations
tttttaattttttggtttagtgatttattttttttagtggggaatggtgatagttttttgtgattttgagatagtaaatgggggagatttatttggtttgtanatgattggtganggtgtggtgttnnnagganngatganggnnagaggngggggtgggggggtcaacatacggggaacacacattatgtctcatactattacaataccataatattatgttgtactctaaagaagtttcatatagaaacaaagaaaaaaaagagaaatacatcacaacttcacaagacaactgattatttttcacgcgtgacgcaaattatccttcatgaggagcattctgtacaagagagtatgagaaagcaaatgttcttttcgacatgctgcgattctagtctagacaaacaacatgaaactgtgctaaattgctaatggattgaagtattgaatcattccaaatttccacttaagtaatctctgattcacagtagcataaattgcattgcatatatttgcataaactgataaaagtgataagcatacctttgtttagatgttttgtagccgccggcctgctgctggcctattgctctgcctggtcaggagcagatcctggtcacgcgcgctcccgtggcgtcgccggcggccggccgcctgtctgcaacctgctcggctgctcttgctcgcggacgcgccgtcacccgtgctccgctgcttgcctgctcaccgctggcgccgccggccccccgcgctgctcgcctcttgcgccgccggcgtcggggaactagggatttggggtggggattgagttaagtagttgggctgggggctacatgtgggcctacggcctattttttctaagtgagttgtgaaagcccaatagcgtccgcctggcccaattttcgttcgccggccaatttgggctttccataccgattttgctataaa

SEQ ID NO: 23676 - DNA, 2222 bp, Oryza sativa
ctatgataccactagaaaacctaatggtgaaaacgagggttatgtgttggaccatagaaatggttcgacttacttacatactgaagataagagcttgaagactgagaaagagtctgctacatctggattgactgataaggatttttcaggtggtgggaatgatggggaccacaaaatctctcccattgttgttgataagtctgcatctatgccatcaaggtgcaagaatgaaactacagaagcatccatggcagttcctgcttctgaacctgttgatcaatgggtgtgctgtgataagtgtgagacatggcgccttttaccttatgggatgaattcagatacacttccaaaaaaatggcggtgtagcatgcagagttggctgtaagtttctgcaagaaacgttaatcagattcattctttttttttaatcttctcatttcatgctttatatttgtctatgcactggtttctgtgaactgaaataactgacaggagtaaaatttcccttcactatatatatatgcaccataatttagtttcatcagtggaaattcaaatgcagtcttttcattttctaactgccctgctgcctgagagagaaaacaactgttgagatcacataattgattttgttctggtttatttgtaatcttgggattcatgttttccttcaaggatcttctggaaaattttatctcccgtcatgttgtgatgttgcagactataggctattggactattatatcattgcttggaaatatttagttttgtttatttatttatttttgcatttgtggtgcttaatgttatcttcaattgattggtacttttaacttcttgtaggcctgggatgaataactgcaaactaagtgagggtgagactacaaatgccatacgtgcactttatgtggttcccatacctgaaaataacatcagtttagatagtcgttgtgatactgctacattggttagatccaatgatgcagccattatgtcagataatttaggaatgccagaaatatcaaagtcttcgaagaaactacatgctcctaggaatcgtgatggtcttgactgctttcctaaactcaaggaaaaacagaagcgcatagaatcatcagataaaggtgaaaaatctacgggtgttcttcatttagaatctattatcattcattttattattaaaggtcaccatttcctcaggacaaactatggcaaaagatcggatgcatcgaaaacggaagaccagtggtgctgattatgataacctgatagcatcaaagaaattgaagaaagtatacaatgagcctccaaagcaccaaccccctcagtttgaactaagcaaaagtagaccttcaaccaagggatctctaaaagaattgccgaagcatactaatatttcacctggcatgggaaagcatgctttaccttcatcaggtaagcagttttgtgatggagataactcgataggggtgctagagcttcggatgcaggaaaatctgatcctcgggacttgttcattaagaagaacaaatcaaaacaaatgcagttaagacagcatggtcctgatcctcgacctagtgatgcctttgcaaaacatgttgtaaaagaagtgttaagtgaaagtaatgctgccaaggaaaagcttgggtcagacctgaaatttctgaaggtagatgatcatgagaaatctgctcatgccagaggccctgtcactgggactaatagcaatgcaatattcagtgagaaagaggatttaattgagcaacacctggagaatatccatttccagcacccattgctctctgaaagctcagtcaggaggaatatctgtaatgtacaagcatctacagctgccacttccagttcatccaaggtgtctagctcccacaagaataaacctgaatttcaagaaacaaggacctcacctgtagagtcagtttcttcatcacccttgagaacttctgacaagaaacacttggatcggcatagaacgaattcatatgcagtggcagaaattgtgcattctcaggagtcagtgaaaactggtgcttcatgctcgaaggaaaaatatggttttgaatgtggttctgatcacacgaaacctcatgtttctggttgctctaatagagtcatgcatcaagatgctttggaggatggggacttggataaacaaaatatattgacaaatggagtctttaacaacagaagttctgggcttggta

SEQ ID NO: 23677 - DNA, 8823 bp, Oryza sativa
atctactgtagcaggaagcaagctgttgcccggattaaacaataaagtaaatggaaatgcctccaataagtcaaaacagtctgtagttgaaaatatgaagcatgcagctattcatgtcgatgcttcaactccaattaatgcatctgctctgctgaaggaagctagagatctgaagcacttgtctgaccgcttaaaggtttggatgtttgatacattagtcagccatttttttagggttctcttgattcagattccatcactactcatttgcaggggaagggggatgaccttgagagtgcaaacatttgtttcgaggcttgcctaaaatttctccatgttgcatctctcaaggaggctgctggtgttgatagctccaaacaaggggatccaataaatactatgacattatattctgatactggaaacctttgtgggtaagcaatttgcagttcacgtcttcaaaaggcaggcagcatgtagaatatcacttctatatttgttagacccttttaacattcttgaatgcacgatagtagtaactttttttaatttggtatatttattcttgttaggaaccatttcaaaacaacaagtgctttaatacttcttgtccttgtaattataaactataatggccgaactttaatgctttcaatgtctttcgtgttttttggacatgcctttcatttagctgccaaatattacttgttccatttatccttgtataaaaatttattatatgcatatgtaaattcactatgctaatatggccccattggcttgttcaacagattttgtgcccgtgaatttgagcgacttaagaaaatggcaaatgctgctttggcatataaatgtgtggaagtggcatacatgaaggcagctttctacaagcatcctggtgcaattaaagatagccatgccttgcaggcagcatctgtgattgctcctccaggttttacatattctctaattcatgaagctgcttagttgttttagtagtttctgaaatctctttcattcattaagggcatgtttggtttgaggaatggcctctctggaacgggctggcccatcatggggtcatgtttctattttcaactcattcagcatttctcaaaccaaaggttccattggagtcaggatcagatgatcctgggttgaacatattcctcaaaccaaaatgcttcataaaagtagggatgcttaaatgtttgaaaaactgtatctgtactaagttctaccacaagtgaaatataacaacatagaaatgaatatgaagtaggtaatgctttcgatggttctaggatttcatccttacaccatgatttttttgaatctcttacatcattattgttctgtttattagacaaagatatccttcattttatttcgtgatatcaattccaaacaggtttattatcaatttgttgaaatgattggtcttctgataattcacattcctcttgctttctccttggccagctgaatcaccgtcgtcttctgcctcagatgttgataatttaaataacccaagtacaatagctaacattggttcaacaagaggtctatgcacttctcagattgctaagaatcccatatctcggagcaatcatcacttgatgggattgcttgcttatgtaagctgcttatttttgctgcttatttttgccatttggattattggatattgatatgccaagttgagtttttacttgagggttgcacacaacacctacaattggcattgcacgattatgatccatttaatgcttgccttgtttagtttagagcaatacttattattgtgggtcaaatatgattacgtatggaactcaatgattgcatttattccagttttagagtttctcctatgatcctttctgtttgctagataaggtcagtatttaggaccaatagtgtgtaacggtactaaaaagatgtccatggaaatcaagctttaaaaaataacagcactcttcaaaccttttggtttagtatggattctgctatttgttagttcaaattgactggttatctaattccatgtaactactccacaactggtatccaatcatgattaaggagatatcagtgagaattaagggaactgtctcctgattgtaatattttttacaggtagaggacacaaattatgcatttgagggacccagaaagtcgcaaagtgcatttttttcctatctttctggtattgaaaaagatcaggctgatggcattgctcttttaacggaagtccttaatttcagtttccataatgtcaaggggctgctgcaactgatccgtcattcattggagtgtatcaaccatgaaaggttcaaataatagaatgggcattcttaatgtgaatagagatatatgttggcaatgtttctatatgttgttttacaatagatgcctccagtatgggtgcaagaatggagcaagattagcaatttgctaacagaggaaatttatgatgtgtggttatcacctggaagtattttctctgtggatgaacattttgacctgtgccaactggggttttacataaaatttagcaacaagtataaattgctacattcaacattctcagtttcaatgtctgattagtccccgattccattgttgatgtgaacccagttgtcacctatttcattgttgtaccggtaagaaatatctgtttacccctctttttgtacatgcatgtctgagtacctaccaaatggctggcttgctcaatcttctcttgtactcttgatatgaattgctgcatatttttctctatcagtcaaacttttgtactcaaatagcatccaataaacaagaaacttagaatcctcacacactatctttttttaaaaaaaaatctaacatatatacctgcacttttaaacagggacaaaatttcattgggacaatgttgaattgaacaatctattcctgagttcctacagaagcataggtcagggcagaggagaatattctacttttcctcaccttctattggtctgtcgatgaaggttccaataggcaagaaactttaacccttccgttcttaaatctttatgttgtactactagtgttttagttcagtcctgtacttagaatagataactaagtcaagaaggtttgtgtgattgcacttggttttatttcactagatgtgtccatcttcctcctgataggtagggtatatttgtgacctgtaataggaaaaccctggataattcttattttcagaaccatgtaatgaattaggacaaacataaagcatatctaatggacaacgtcattttgttacagctgcagtgaagtaatcctttatatgattatgattgccaagtttgatacatgcattcagttgtggaggcgcataagaacccagctacccagtgagcaaacttgcagaggacggaggacgtcagttaccacctctgactccaattttgtgtacatatatataaattaatgatgagctgattgcttccccttttttctccatacctgtgtacatctatagagaggtataccagaaaggctatagcggaacaaaatggagaattttgatccaatttcagttgattttctgtggtttctgagtgactgaattcattcttttggtatactgcaaagatagctgccccttagctaagtggtcattaagttgttgtgactatgattctttgagctgacctaacaacaaatgatgatggttctgttttctaacatgagtgttgtattggttcctgccccagcatcgtcattgtacatttgtaactgctcatgctgctattaaaaaaaaaatctttgcatctcgaaatgttgtcgttttcaggctgctttgatcgcgtattatatacatcagggaatttcataaaaccaaatgcttgtagttttataatatttgtaataaatatgtagatttgtgacacaacaccttaaatatatagttttgcaataatttggtcaaaatgtatatagttttgtgaaatttattctacatacattcattctcactgtaagggtaattcacgcgacagtgacttatatgtctccctcgcaaaattcttccagcttgacctttctcctctcattttgattttatttcagtaagtctaaggctctgttatttaattggacgtagtatcaaaaaaatttttaagtaggaattataaatataatattataaaactaataggtggtttagaataggctgatatacaaagttttttaagaaaccgtaatttaagaactgtggtacatacaaggaaagatttgataatttaacaccttttaaaataggcttcgattatttaacatctaaatggtcctacatgttatcatcacaagtgtcaatcaaagaaattgggtagaaaaaaaaatgttaaattatcaaatttcccccacataagttggtgacaaaaaagtaactcctacgaattacttttttgaattatttattgaatgaattgttcttttcaaattatttattgaatgaattgtttaaacattttatgtgtttcacacttcaaagtaataacagccccatcggatggcctaataagccaaagaaaaatccaaattttaaattttcaagcttaattttaagattgattttgacatattttcaacatagtaacatatttataaaagttttacccacaaattcttttattttctaataagccgttttggtttattagaaaataagccaaacgatggggacctaaaaaatacattttatagaaaaaaacttacttctactaccatttattttattaaactaatgaggaaggcaaatagacttattcctaggaagaaacgcaggctcaccagcccaactcaggcccaaaccgtgcaatcctcccaaaaccctagcccactaatctccactctatatattcccccaagctgcgggtttgtctccctccgccgcctctcttgctccaacgaaatatgctgttgttatactcctcctcgcctctctgtttgatgatttgtgtttatgatggttgttttggtggtctctttcgtttgccttctgctgttaaatctatccttggtttctctttcgttttgtttctcttggtaatgaatcttgggttcggtggcctggctgtgatgcgtattgataagggattttctgagggatggagacctagttttcctcctcctgattgagagaaaccaatggatccttctgagcctaccaaaaccaaccctgcgagttctttttttatttttgtttgctcttgtacactttgtgaactgttcatttttgttctttgattttttctctcttccttttgctgtcttctggtgaactgtaatacaagctagtgcaagatctgctctcagttgatgtgaggataaaactttcacagaaactcttttgatgtgttgaccctaaaattcagactacaattatctgatcagctgcagaaacttgccctacgaaaaaaaaaagatctcagtttttcccaccagatccagttgttttccttgttcgtcatgacttagatttggtatttaattgctaatccttgcacaataagccgatgctctggacgaaataagaggaaggaagcatggtagtgtgcacggagattcaccacaaggtctgcatgtctgcctgcagtgacgccttcgggctttgatctcgcgggcctggatttgacccacattttcctatctgaattttgcttccggtttatcttccggtaacattgggtttttaggggatggatgggtatggtggatggatcgacatgccagaacgatcaagatcgtattgtaactctgtacttctgcacaaacttacactaagttgtccttattgatatgccaatgcgatctacataatcctaaatttgtcattaatttttcagtgtcccttcggaaataattctttgttttaaatggctacaggaattaaaatacataaacatgtgaaaaattgaggaatcgatatgacatctagttctttaggaattgtggcatagatagttgatccttaggaattctaaaatgcaggaatttcaagttccttgttgcaaaggagtacctgggaaaatttgccatataattttaatgtaaaaattcctctacttttcctttgtaatttgttccaaaagagcccttaaagagggagtcctatacgccagggtcttctggggttcgaaggctcatcatttttaattatttgatattaggttatttcctaatatttgtgtccttaaaaggagtcgttacaagtgaaatataatgtttattcattttatgcatgtgcttgctcttgttgctcttttgcatagtgctgcctccggttgtgctttagagattttgatgctcaggccatgaagaacataagcagaaactagtgaagatttataccagttaatcttgttgcattttattattagaaccaaacaggctatgaagttagtcaaacttgttaatctttaagatgacaaaatgtgttaaaagtataaccagcaactaaacacctcagtaacatggtctatgttatgctggagttgtaattctaacagcaacaccaccattcatgggcagagaggcagagctagataggacgggaggtgtttaggaatctagtctaaatctctttttaactaattaattcatctattctcattatatatgttacttctcaatacaactcagatatatgcatcagcataaactctggctaaacattgtgtaggtgttcttttctcctgaagatggagattaagtttttttacgtaaaatgaggtggttttaacgtataattgattgagttttaattattacaaacttgaataatatattaatatgatattttagagtaactttaatataaagtttttgtacgaaacgtaccgtttagcagtttaaaaagcgtgtcacgaaaattttagggcttattcctttcaaaggaattgcaaaggaaaagcataggaataggaatagggcttattcgtttcataggaatgtaccataggaaagttttccattcctccaaggaaaagcataggaaaaaataatccactccaacctaatatttgcattcttttggttggcttgctcaacagcataggaaaaatatctgtgttggtttacatatgtattcacgaagtatttctatgttttgaaaatcctgtgaaccgaatgagcccttaggcttcatccaactcttatcagggatgcacatgaccatagttcgttccagcttttcgcccgtgccgtttgggacttgggacatgcatgtcatgtcagtggcgctgttcatctctcggaaggggagcacaagtagcaccccacagtcacacagccggtgatggacagggacgggttacaagaccggcgagttggcctagcctactggcatgaacgaccatcccgtggaagtccaccgtgatgggcatgacagaggctcgttgagatggtgccatcgctgttggcgaacgtgattagcacgtacggtggcgatggccagctttcccgctgttgctggccggccgcatcgtccacggagatgttcctcgatcggcgacccgcgatcagggttcactaaatcgattcggatggaattaaggtcaacccatgataagatggttttcatggtgatcgtgtgggtatcaaaagctttaccgcacggttttataaatcctgcccgcgatcgttgtgaatggaacaggaaagctgaaaaagaaaatatttacccctctaatgtatgataattaggagaggtgatctcagccatagacggctcagattgtccaaatccagagtgatggagtttctatcatatccagggcccgtgccgaagtagcctacttgctttgccggtgacatatacagctgatggttaataatctctccgcatctaaatataagaggttttgtttaaatgtggtatatcctattataataaatctggacagtttcttatccagatttattgtactatgatatgtcacaactaaccataaccaaaatcccttgtatttagaaatggaagggtattgtagtaactctgcaatggaaaatgttagccatgacacgtgaattcaactcagtgtaataattggtatagtgccaaatgattggagattggaacacggatgccatcctaaaaaaatactgctatggttctgcttggtcaactttgaattatataattaacgcgtgattttaaattttaaaaatgatttataaattttaaattttaaaaactactgtgattcattttataaatcgctttgatatttcctaagttaaacttttaaatttgattaaattcatagaaaagataacaatatttacaaccttaaattagtttcactaaatctaatattgaatatattttgatattgtgtttgttttgtgttaaaaatattattatatttttttataaacttagtgaaacttaaacttaaaatgtttgacttatagaaaagtaaaatgacttgtaatataaaataaatggagggagtagatcttttacttgtgatgcgagcaaacatgaaagctttatgacaaacaaaacaaccaaaaaaataatcctaaaattaaacctgtaaatttaaaatcagctctagggtgattatgtttagagtagaggcaagccaaattaagctggttgagagttactctagatcataatcaccctagatctagagttagggcctgtttgacacagctccaggagggatggagcttagccaaacagttttagctccaccaaacctgggagtagagttgggtggagctctctcacaaaatgtactggagttgtggagctggatttaggcagggctgcag

SEQ ID NO: 23678 - DNA, 5318 bp, Oryza sativa
  unsure (1)..(5318): unsure at all n locations
ttcctgcagccccaagttttcactatatatgtggtttgcactagatattttccctctattttaccatgcttggaatcaacggcaacttgttaaacaatggtgtacctctaatactctctttacttcttaatttcgcgcgacaatgtacgggaaatcatctagttttaaatttggctgatactcttgatgatacttaattaagtaataatccacttaggtggctaatcaaatttggctgatagttgtgcacttaggtgtgtctagtgctaccagtacattggaagtgattaactcaatgaaattttgtagcacgagattgaggattgtgtatcaaacaaatatatgatggtgaaaagcacgagattgaggaattttgttaagagaaaaaaaacattatctttttagtggattgtgtatatcaagatacataatctactaaagagataatgttttagcttatcaaaatttttcttggtcggtctcacatttcaattagtacttcctccgtttcacaatgtaagtaattgtagcattttctacattcatattaatgttaatgaatctagataaatatatatatgtctaaatttattaacatcaaagtaaatgtgagaaatgttagaataacttccattatgaaacggagagagtagtagattgcaaaccctggtcaaaagataagcatgacaaagctaacggtagcacatgcaaactaactgtactgcagtgcaactatgcaacagaaacgttagccaatagccatgacaagtgaattcaaacagatgtgtcatgctacggaaacctgcttgagcggtcaactttgaactatactccctgcaaaaaaaaatgaattatataattaaagcgatttgaattcaaagattgaattttctaaaataacttatgtgagattttttacttgtcttaggatcaaacatgaaaatagggccttgtcacaaagaaaatcgcttaattaaatttacaaatttaaaatcagctttatgatgattatctaaagtagggccaaaccaaagctatcaacatcttgagttactcccaactaggcaactagcttttagagtcgtatgctaaacagtggaacatggttctccatccgtcccacgaaggcgcacccacatatcttaaatatccaaatcttatattactagaaaaaatgcccgtgcgttgcaacgggtaaaaaagtttttgattgctatatattatactccttcacttttcatccactctcccataatatcatctttccgtttttatcaaaatcaaagagaatctttctacttttatcaaaatcaaagcgaatccataagagtcagataaaaacgacgacagtaaatccggtgaattaaaaccaaatgatgaggtaatagaaggaatcaattttttaattaattgaaggaggaaacgcatgtgagaggcaaatcgacagtggcgcgctaggggtcggcctggcgactttaaaaaaacgaatccttaccgcgtgccaaaaaaacgacttaaaacggatgcaaagacagcgacaaaaaaacagtggaaaaaataaaaaagcggattaaaaaggatggaaaaaatacctgtattttttaataattaggtatatggatatatatttacatttgcaaaatttgtcaaaccacacgaaaatcacaaaattatataacgtatattttttacgttaatgacttctatggtcatcccaatatgcaaatatataaaaggttactatttctatatcatatcagtgttgaaaaattaaaacttccaaggtcctgaacattaatgtgtgagtactaacctgggggtatttttacaaatattttgtatgtactgaagtataggataaacaatacttttagggatgaaaatgaaaaactgctggattcagatgccacgtgcatgttcgcatgtggcctttggcagcggtgcggtgactcgccgtccatctctcttcatgtaattcacgctccatgtactgcacatgatttcgcacagagagagacaaagggcgcccagcctaaccgctcggagcgagcgccgggcgcctcgatttttccgccctcattatctcctcgtttttccctgatcttttctcttcctctactcgtcctctccattgcgcatcttccctttccttctttttcttcttctcttctcagccgacgacgccctccatctcgtccctcccacccttccccaacccatggtggggtcgctcggcacggggccctccccccaagcggcagcgccctacccttggcggcagtgccttcgnctcggctcctccacctggccggcggggtctttcacccggtgagcaacggtgcgcgacgggccggggagcggcggccagcgatctactcctcggcgtcggcggctctctccttccgcgagcggcaacaggcggcggcgcctttccgcccctcgtctcgtctccctcgccatgaggccgcgggagggctcgacggtagtgggcggcggcgccctccctcccggcgggtggggaatcggtgggcaggggcggtgccctcccctctgctggatccagcgggaggggaggcggcggcggtcgggcgtcccggatccagcgtgaggggaggggatgggaggggaggcggtggcgacctggtggccctgcgacggtggcagcgacggcggcaccctgcccttcctgtgtcggcattttcttgtgttcttgtgttgatggaatctgttcttgtgttgatgagtgctgatgaaatctgttcttgtgttattgtagtagtgatttctctaggatttgggtccaaatttgatgcgtactcggattaaggcgcacgggggcaggctgtgaaggccagtactggtgaggttgccagcatgattttttttctttctttcttttttttttttgccatcggagaagggttgataagggatcgatcacacgcgcgcattagaaggattttttaggcgacggacgaaacggacgatcggaaaccttgcgtattttttaattaggtatagattataaaatttggtcaactattagtctaataaataaaatctgtttgatgacaataatatcatcattgaattgatatttgaatgtacttatgtaaggttatgattttgttgatacaaacacgctactccctttgttccacagaataaaacatagtcaaacttaccacaatatctaaaactaatatttgaatattggtttcaagtatactataatataatatttgtagcggcaacaatcataaccacaagaaaataaattcaatgattttattttcatcaaataaatttctatttgtattagactaattgttggtctaatatttcaagagttgaattttaaaatacgtgcatgttttatctagtgggatggagggagtagtatatgataaactcctgatgatctaaataatataaataatatggtaaacctttctcgatcggttttgttgagacttcttcttagtgcaaagacatgcatggggacagtctttccctttccctcaccagttgagttttttcttttaaaataaaatattaaggaccaaattgagcaattgggtgaacttgaaggattacattggctatttaggccttgtgtagttgggaaaattttttgggtttggttgtcacatcagatatacatacacatatttaaagtattaaatgtagtctaataacaaaacaaattacatattttgccaagaaattgcgagataaatttattaagcctaattaatccatcattagcaaatctttcctgtagcaccacattgttaaattatggcgcaattaggcttaaatgtcttgcaatttacacgcaatctgtgcaattgctttttcctacatttaatactccatacatgtgtccaaacattcgatgtgacagcgtaaaaatttttgttttgggaactaaacagggccttagccgataaccagtgttgccacaagtgtcaagcagtggcctataaagctactcccctagtcaaaaaaggccattcctagcattccaaggtgaaattagtggagagtaaaaataaccaaaatacccatcattatcagaaaaaacaataatgcagataagtaggtaaaggatactaaagcgatgataaaacttctcattttatgtgctaagggtaggtatgatgacagatttttttttctttttgacaaagttcaaactccagaagttaagttttttttgaacggaaaaggtacatcacatttattagtacgtaggatctcatcctcctatctatctattatattattaaaacagccttgaaaggaggcacaacgtttactgtggaggctagaaattcccacattaatcggagaaaaagaaaagaagagtccaagtagaaatacaatctaaaaatagctaaaattcggaattaaaaatatgcaatatggaaagaggagtccatatatgaacccaatacgtgattaattaaaattcataataataataaaataaatttataaattagaaaaataagaaaagaagagttcgagtaggaatacaatttataaataactaaaattcggaattaaaaataaggaatattgaaagaagattccatacaagtatcaatacgagattaattaaaatttagaataaaaaatataataaaatccgaaattaggcaaattaaaaagagagttaaagtaggaatacaattttgaaacaactgaaattgaaaataaaaaataaaaatatcaatagaacataataataaataaaataaaatctgaaattagaaaaagaaaaaaaagatttcaactaggaatacaatttataaataactaaaattggtaataaaaaataatactaatgaaagaaaataccatctaaaaaaatacatgacgagattaattaagtaacaggactataaaggagtagagtggtggcggttgatgaaacatctaaaagctattaataaaacaccaaatagaatcctaatgacgattaaaaggaaggacgttgggcaggttgtgaagcaatcagtcaacacggttggcggggacttctagaaagtaaaaaaaaaaccaatgataatcatatttgatttttaaaatctcaattataataaaatgagacgcggcgggcgggtcgtataggagtacaatggtagagccgtcgatggttggtgggttttctagaaagtaaaaaatgaattccaacgatagttgtgttcaatttttacaatcccaatgacaacaaagattatttgccggatgggtcgtagaggagtataatgacaacgtttgacgggatttctaaaaattatcaaaaacat

SEQ ID NO: 23679 - DNA, 9262 bp, Oryza sativa
ttttagaaattattagaaagaagcctgataggacaataaactataaaaactataagtttttaagatccaatttttaaaggttctaaggagaatgaatagaaacagtggtagattgagcaagctaataaaaaatactatgacagaagtaaggggtaacaactgatgtgtcttttaaaaactactacctccgtcccaaaataagtgcagccgtagatatccgtgcccaacgtttggccgtccgttttatttgaaaaatttgcgaaaaatttgaaaatatttagtcacacaaaaaatactattcatattttatcatctaatagcaataaaaatactaatcataaaaaattttcaaataagacgaacggtcaaacgttgagcgtgaatagtgcaaaactgcacttattttgggacggagggagtataaaattagaaacacgaagatgataaggtttggtatttcaaaatcttaagtcaacaagataactatttaataaattttaagtacactcatattaaaaaatatataatttatattgacatgcaatcattttgcgcgtaaaaaaaataattttatatgggtactagccgcgtaattgcgcgggccatccagttagttcctatatataattatggtgctaggctgctaataagctgccagttcgccacaagcccacaccaccacgtcatgacgtccgtgtcgtattctctaccgaaagtgtgcatgatgatggccatggccatcagctgcatgatgatgatgtcccaagcagcgtcgtcgaccgccgccatggcgcccagggacggcgagggcggcggacgacggcaccacttcgtgctggtgcacgggctgtgccacggcgcgtggtgctggtacagggtcgccacggcgctgcgccgcgcgggccaccgcgtcacggcgctcgacatggacgccgccggcgcgagcccggcgcgcgtcgacgaggtgcgcacgttcgaggactactcccgcccgctgctcgccgcgctcgccgcgctgccgccatccggggacggggagcgcgtcgtgctcgtcggccacagccacggcgggttcagcgtcgcgctcgccgccgagtggttccctgagaggctcgccgccgtcgtgttcctcaccgcgtccatgccgcccgtcggccgcgccatggccaacaccaccgacgaggtaaattaacatcgactagctagttgtttattaatgcttggcttaagcgcttaactcgatttgttaaactagttttatcttaagatttataatgttaaatttatcatcaagaacttacttaagtacaaattatgttcgaagtaattgaagaattaagtgtgaatttaacgatcactaagtaaaacaaatatatgataatctttttaagcgaggtaaatgagtagcccgtgagatggctcgttaattacggtcttgagcaaaagctcatcttactatgattacgagttagagccgattgaatccacgagcttttgagctctttgggctagtagagagaggaagccttactatatcaatctgaatgtcatttttcttttctcattctgcagctagcactgttattgaaatataccgtataatgttttaagattatgtaatcgaactttaaaatctattttccgttaaaaaaaattaaaaatcttactccctccgtttcataatataagagattttgattttttgcttacaacgtttgaccactcgtcttatttaaatttttttaaaattattaattattttatttgtgacttactttattatctacagtactttaagcacatcttttcgttttttatattttctaaaaaaatttaaataagataatcgcttatatcgtgggacagagggagtagatcactagtataagaaatcaaatatggtagcaatccatggctgcgaaagggaatctttcttagcgacatggacattattctttttttgctctatctgcacctggcagtgtttgctttttttgaaagaagagctagcagctttaaaatatctttcactaacaaacgtggtagtcttacgagaaggaaaaaaaataatgtactatatccgtcccaaaatatagtaacttttagctataactttaaacacagttatctagattcatagctaaaaataattatattttgagatagagggagtacttaataaaacttaaattgcaaatttataatcacctaaatttgcatattactaagacttaaattgatggactacgggtctgtttggaggagctttagattctgagaagcagctgtttggtagccagcttctgagaatctggaaaaactctgaaacccagcttctccagcttctggcttcttagttcatttttcagaatctataactacagattcttagaagctgtggattatttgggggccgcttctagcagaagcagttttttggaaaagctgcagctgggacaagctccgccaaacagggcctacgtaaaatatgtaattgtaagttcattttatctgcaattgttgttatgtatgattttgatacatttttatccaagattgaatattttaatatgtaattttatttgtaccaagttttaatgaatggtaagttatatttcatgtttaggttacaataatttcttcaaccttttatttaaaagaaaagggactttgcgtataaataattaatagaagagtggtgtaaagaatcatgggattgccattcaagaaattaaaaagtgattgaaattgcctaaaacaacagtcgaatataaacattcctaaaaaaaatacttcctcaactgtaaaatataaagcataacaaccactaatacaaataccaagaaaaaagttattatgacattattatttggatcacgccgataaatacaatacatccaataaaattagatatcttaatttagtcaagaagaaatgctcaggtgctagttaatcatactactcctacatgcacgccacgccttgttttagaaaacattgaaaacaatagcacgtacttcttttgcatatctattaaaaaaagcttctcattttcattttgcgtgtgcgagagaaagagagagctagacgtaattaagaaagttgacttatcttgataagaagtaattacaccggaagttaacacagccgagatcgccgacatgggcgtgtctgctctctgctggaggtacgcgtagtactattaggccctgtaatttcgagtttcatatcgaatcgaatgtttgacgggatatcgaaaaatgttttaggacacaaatgaaaaaactaattttataaatcaactggaaaccgcgagacaaattttttagtctaattaagccgtcattaacaattatggattattgtagcatttatggctaatcatgaactaattaggtcaaaagaatcgtctcgcgatttccatataaactgtacaattacttttatatttaatgttttatgtatgtgtcaaagatttgatgtgatgcttttagaaaaaaaatttagaaactaaacgagaccttactctactcctgtgactatacatgtctcatggctggctggctgcctagctggcgccgcgccttatgataaaacgtacaagacaccactatactctaaaaatagtcgaatccaaacaccaccttttgtacatgaagtcagaactctagagtctattgcatgaataagagctaattcgtgagacaactattttaagtctaattaatccataattagcatatgtttactgtagtatcacatagtataatcatagattaattaggctcaatagattcgtcccacgaattagtctagagttatggaatgtgttttgtcattagtttacgtttaatatttttaattagtgttaaatatccgatgtgaaatttagtccttctatccaaacatgccccaaataagtactttcatctctaaagtctcatccacctccgaggaccgcgcttagcgcgggtggcaggagccagtggctcgctccgtgccgatcagcattcgagtcttagactcaacgctcgtccctcgcccggggggatttttcccctctttacccgggactgacttcggttggtcccggctaggtaacagggtacacacacgcgtgcgcgtttagtgggactgcacgttttccgtgcactgaggcctagtgcctccaatctcattcctaacgtgtgtgtgcgtgtgttgtagtgtgagtgtagtaatttagtcgttttatctttctcttcttatcttccatgatcaaaaactctataattaagtagccatatttgggtcggctggagcactattatttactccctccattctaaattgatctacatatttcataggtacaccaagatcaagaaaaactaataactctctcatactatatttactctaacaacaaactctatgcatgcaccatccctactatttcttagccaatagcaaatcaagatattgcatgtgggttataaatacttatatgtatggatgcatgcatcaatgtctatttactccaatgcacaaataacgaatagacttaataaatgaacataaatatgcagatcatttaggaataacctcaaaaaactgtatgtatatcaatatgtgatggagagagtactagctagtccgtgcaatgattatcatgtatggatgacacaatatatttattacgttctaactttagagtttagactagcccacctaaacagtcgaatccaaacaccaactttcgacattttatcactacatactctaaaaatagctatacttggtatataatttaaatagtataagtaactatgttttactacctccgtcccaaaataagtgcagccatagatatccgtgtttagcgctttgaccatccgtcttatttgaaaaatattaaaaaaattagtcacacataaagtactattcatgttttatcatctaataacaataaaaatactaatcataatattttttgaaataagacgaacggtcaaacgttgaacatgaatagtgctaaaactgcacttattttgagacggagggagtaagacttaaagtggactagcttgtgatgtgtgcacacacatttatatcagaaaaattaatataaggaatctcgtggggcacgagggcacatgataaaacaagggcgaaggttacatatctcccatatccatttcccctaccaacttgctttctcccccaccgagcagcagcgcttcatcttcctcctccctccttccactactctgccccagtggccatcctcctcctccctctcctcaactccttgatgatcgtctccaacatcgacgacatcctctatcctcttttcacccttcctacaccaaatccagagcatgtgagagagtggaggttgacaagggcatgggggttatagccaaggagggagccaactatggctgtgaggttgggggttgtcatgtatgagtagaaggaaagggaggcggcgaggccgagggggacaaggttctgagcatcgacatggaggtggaggcagccggtctcaacgtaaatggcaaccttggagttgatgaagtggattagaggccgtcgggtttattcatgctccttgctaacccatcacttctactcgtcagtgttgtatacaggtacatcgcagccgataccttaggtatcagggggttgatacccagggtttgatacctcgggtatcatgcatggtacctaggtacaagggtttgataccttggggtatcatgccaggtaccttaggtatcagccagtacacatatgtactgtcggcccccggtttttagatacggaaagccacatgtgttcgcaataccaactccctggatcggtaggttggcatacacacaatataatactgtacaacatcgtttgcattgcatagttttatagttctcattgatacaaggaaagcccgaatgggttcccgaatagaccataactggtcgagtacaataccaacatcaaagcataaggtaggatagcagaagcgaggctatagcggaccggctatattcccgcaggcaacaactgggagttagtccctagggcgtctcttccttctctccctccttgggagcgtttttgaatggcacctccacatcaactgggtataagagagggtggtaaagcaagggtgagtactagcgtactcagcatgtcaccacttaaaataaatgcaaataatgaatacatggataccaggaaggggttcgagctatttgcgtaaagctatatttcacaaatcatttcacaaacctaggacctagcagttttaaccgaaaatgtcgttaagttgaagttgtgtttaatagtgggggttcatccacccaccccaagcctcgcttggtcaggtttaccctcaccaccagttcataccattactatactaacctcctcgcatgttgggcgagaggttacacaagtcttaacatctctagtctaagccgtactaaactttatgaggttcgatcaatcgttcgaaggtccgttcattcgagcgttcaaagatcgttcgttcaaaacgttcatgtgtttgattagccgaaacgtatgacggggttacgacgaccgagaggtggcgcaatctcttgcccaaccgaggcccaatcgatgccggccggggcggagcaagcgaagaggcggcagcctgtgcgcgggagggagtggcgaggatggatgggagtggaatgtcggggagaagggagaagagaggggcgggttgcgtgcttggctttggcggcgcttatataggtaccgggtgagctgatgcatgcattcatttcatccacgagcttccgcgcacgtaggtgaggtggttgactgtttggcggcgcggcggcacggcgtcaccgattggggctaccgtggcgatgcgggattggcttcgacaggtgttgggtgatggctgacacacggcgccgttaggcggaagctaacctcccgcactaactcgagtaatatcggcaaggtggcggtcgaagacaggattttcgggcgttcggccgccaatcgtgtttaccgcgtcgcggtgcgctggtgcgctggtggatccggcgcggcttttgctgccatttgctcggcggcgtgcggttggggagcgacaaaacggccagtgagggagggaaggaaggggcggcggccagcggcggcgcgcgaacggcctcacccgcgatttaagggaggacaaagccgattaagggtggagggggggaggggggagggcaaacatagacttccctcggctagccgattgagggaaaaaaggagaaatgggccaagggaggtaaatagaattttctttaaaaagtctcaaacagtagaggctaggttgagggagtggatttggacttcgtaggatagagttgctctgagaggtaaaatataaggataaaactcttttcgaggatagaaaggattgtagaaatttaaacaaaatttggcacttggcgagaaagggtaaaatccaaatccataagttcggcatgatgcaagtttttgcaaattttcctgaggcgaatttttggtcttcgaattttattttaacgaacttttcagggtgtgttacatgtaccaagtgaatagtatcatatattaggtatcgggtttggtacttacggtatcaggtaccatatcaaggaatgaggaaggagggtgcgctctcatcgtctggcttaccgacaagtcacatgtcattgtctcatcttcttttctcccttcctctcgacgcctccctccttcctctgttgttgctgtgaccggtgagggcaaggagttagtggtgccactgcttcatttctttgaaacgtgggagctcaaacataggggaagatggattagatttatataatatcccgttggaatggaatcccgtgctctagcaatcctcatactaatacacggaatcatgtggtgcatgaggtactagcaaaggcccagacccatctttgctacgggtagctatgggtaaaagaaaatacgataatatatttagataaaatatctttggtgtcaaatatacaagcaccgcttgtttgtgattttaatacatgtatccacttttttaaacaaatattcatactattgcataatatatgttaaaaaatattaaggactatcaccgccactactattttccatagcagtatagatattattacatgtatgtaactattctacgatcacattatgcactgtatattgatgatatactcctacataattaattaattatgaaattgttggtttctactttgcgatgcagtatgtgagctttgttggggcagatttcttcctcgactcgagggtgctggagcaaacgaaccccgatatcccgggaaaccctgaaatattcgggcccaattttatggcccagaaactttaccagctaagcccgccagaggtaatgccttaaatcgcaacatgaggcatcaatttctatttatttttttctagagcaagagggaattttaatttaatttttttatgatactctagatcagctcaaatagttcgtatgtttgctctcaaacagatgacgttatgtacggtcaaatctcacttgttaaatcaataataaaaaatatttatatttaataggtgaaaatggcattagtagatttgtcattaaaaaagcttcatatgattatatatgattatatttttaataatttgtatagatgtataatttgagaaaaaacataaatattagggaaggacctaatatcaaataaatagaaggggtaaggcttcaaatttagaatggctaactcatcaccctgtggagttaggtagaataccccgaacgtttctctttttgaaaaaaaagaacgtttttttcgaaaaaaagaaaatgatgacacttacattaaggaatatgtgaatgatcaaaatgatgttaattttcgattttcgtagaaaattcttttgaaaaagcacattttatggtaaagcttctgcattccaaataggactttagctagggatgacaaaaatcaatctctaatgcacctacgaattgacctgatatattcatatatataaatgttcatttatttttggatttatgattcatatataagtctttctttttttttccataggagttaaaccctggcgttgtcgctgatccggcccgcgaaccggttcaccggcgacgcgctcatgagggacgccggccttctgaccaaggagaggtacgggtcgacgaggcgcgtcttcgtcgtcgtggaggacgaccacgccatcc

SEQ ID NO: 23680 - DNA, 15087 bp, Oryza sativa
ccggaggccgcatcctccattgtccacgacacatcacagctcgccgccaacggccgtgtccttcgtcatccacgccccacactagagctcgtcgccgacggtcacatcctccaccgtccatgccacgtcggagcacgtcggcggcggacgcgtcctccatcatccacgccccacgccagagctcatcgtcagtagctgcgtcctccttcgtccactctctggcgatgagctccctggcgacacaacaataccaatctccatggcatacaagcagcaatacaaacaatgaattggaatcaccttctggttcttcaccttggctggaacttgctcctccactgccgcctcttccttaccctcttctccgactagctccccttcttcgggtcagcgcagcagcatccggcgatgtttcccgggcagtgcagcaaggcaggcacgagtcctttctccggagagccccttccccttctcctataatgtgctccttaacggagcggcgaggtgaggcgaggcagcgggggccttctccgacaagctcctctctctctctctcctccgctagcaagctccctccttccttcgctgccgcatgccgccattgcgctgctctgctgccgcgcttagtgctctaggatgaggagcaagacgataccgtcgcgtgggcgctggaaacaggattccgtcatttagcatttccgtaaagaaaaaggtgtctgtgagtatcatcaggagattttcttttttgaaaatgtacatcttttttttccaaatttgcatgacttgtcgggttcaaatcaaacatttaatttttttcttcatttaagtcttgaatgcatagagactacaaataaaacaacttatttgaaataactaaaatattaaataggtctagctcttatggatggagggaatacgtagagggtagagtacaattttctatttctaatacgaaggaagatacaattttctgcagtatatgcactcactgttagcaattaattagcaccgtaaggaaatcactgtggaatgttcagaacgctgccttgtccatttattaatcttccgtttagatcatcatttagtttactctcgaaagtctagttcgatcagtcacttgcatggacgttaccaaattttggctattttagttggtaatattttttcagagatatattatccataataaatctacaaatacttgagcctgttatgctatttataattgtatcggagcgaaataggcctacaatacaactattaacctataaaatttgataggatggaaattaatatgattactgaatgttactaattattcgaaaatgaagggaatatattattccacacttagccacaaagtgcctagaaacaattgggacagtaaatattttaaggcatgttcggtccaatacacgaattaattaataactaatataattcaataaatagcttgaagaaatgttatgtgagcagtgtttatatacaaaattatataagaaattgtatttataaaagcctgatatggataattcataccttatcttaaaaagaacacggtctcattagcgttagaatctcataaatacacgctatggtgctaactaccagtttgccagctgccaccaaggaaccaacccaccacctcatctatattaccgtagtactctctccatcccaaaataaaataatctaatactggatgtcatatatcttagtctagattcatactattaagacgtatcttatccaatactaagttggttttatgagacggagggagtatcttctaatgaaattgtgcaacacctccacccaataaatatgaggaaaaagtctacttttttacatttctagtttgattctcgttctttgaccacaaaaatcagggacagaattaaaactagatcagattacctctctaggcagacagttttgatgtttattttgttctatcttacatgttgacctgatctttattatacgtaacgtttaactgatattatagtgagaggataaaatgacacattatctctactattataaaaattaaatttgtttccgctaaaattttggtacttcatccgtatttgagttgttttttatttggttataaatcatctgtatctaattcgatgtgggtctaaataactaatatgcccctcctagcccgacccaagcggtccaaaccatcctgccacgccatccaatgcgtctccactcggcgtggcgcgtgcctctcccccgatcggtgttttttttcttttcccatttttcattttcattttctccttttcttttcttccgatcatcatgatcttctcacgatccttcccatctcttccgttttctcctccttttctcttttcttctctttaaaatttctctcctcataaatgttttccttttgaaattatcattatttaaggtgtgtatacggtaaatttgttactttacaaatgctttctatctacagtaaaaaaaattcaataattgaatattcaaaatttcaattttggtcgatgaagtatagcaaatacacatgtgttaacttatatagtagccacccaatcgatttgtgaggctatggaaaggtgtacataaaggattcttcgtatgataatgcaagcgaatgtaacatggttcaatgctatatatgattttgatttagttttaccattattttgtcttgtttcagtcatttaaattggcagagtttaatcaatcgcgaaaattattttcagctgttgcaacgcaaaggcatttttgctagtaggagtaaatataaaataaattcagtgggacccacatctacatgccatcctatgtcatccctactttctcttcctctcctctacactctcttcactcgttgcctccatgaccacctgcccatcacttcctcgagttctccttcacccttctcgtcttgcatcagaagagctgccactttcctcatggtagggcgtgacgatgccatcaacgtaggtgaagaagattatgcatggtcgtcgatctagaatccgcctctcgatgatggtcatagtggcaatggacccgcctctcctcaaccgcaggccacgctcaccagatgcaacgtcctcatcccgcatgcactgctggagggcaatatctagaggcgggcgtcaccaatctggagtacgagctcgacttggaggacgggttgggtgagttgcgtcacctcctctatctctctctctctagatttagatggacccgtctctcctcaaccgcaggccacgctcaccagatgcaacgtcctcatcccgcatgcaatgctggagggcaatatctagaggcaggcgtcaccaatctggagtacgagctcgacttggaggatgggttgggtgagttgcgtcacctcctctatctctctctctagatttaggaagccacgaccgctgatgcaaccaatgtggcatctgcctggagtagccacgggcttgtagtcgtcaccgcctcctcctcctcaagttcctttctttcctgggctcagtcctgccttctccacgcactgcccgaagcgagctttgcctcctccgccaatgccactgcctttgccctcgtcgatgcccagccagcttttgttaatgactagcaaggctctctacctagacaaattcacacttggcgcgacaatcaaggtggcatatgctcttgtcgatgacagcggtgcagcactcaggaggtgcctccgtagggtctcatcgtctagtgcgatatagtggatggcgtggtgggagagagactgaaaggagagaaaaggggaggagagagctgtcatgacatgttagtttcaccgtttttctttaaaaaaagtcgtgtgagacttacacgtggtttttgtctatttttaattgtttcttttgaattggaacgcatgttaagtgttacgtaggtactacgtcatgtaaaaaaccaggttaaagtgttacgtaggatgaaatcaccatcaaaatcgtataggaacgtaaattaaattgattttaacagttgagtgagtctctatacttgcttttcatatggataaaactcgttatgcactcaaggaaggtaaaaatggactttttcctaactatgaggattgcccaagcactcaagaccacggttggtggcacagtggagcttggcggcggcggcggcgaggtcgacggccgcagccatgtaaatagtgacgtacagtaaatgcttacggatatatggaggaactgaagttacaattttctgcagtgtgtcccacctgtttgtccgtttagcactatgacgaaaatcacgcggtacacatggaacgttcaacccgctgtcgacagcgataaaccttaactgagtttaccgcgtcttatcagcggtacacatggtaataatgctaagacgtcttatctgtttatcgctgtctcgatatagtttggtctgctccgtaatccttatcctccctccgtcataaaataagtgcagttttacactattcacgtttaacgtttgaccgttcgttttattaaaaaaatttatgattagtacttttgttgctattagatgataaaacatgaatagtattttctgtgtgactaattttttaatttttttataaattttttaaataagacggatggtcaaacgttggactcggatatctatcgttgcacttattttaagacggatgcagtatattttataaagttcgtactcaataagtgtagtcacttatgaagtcacgacatcttaattgtttttttttacttatgaagtcacatcatattaattgatttagcatttgaatgatttatcaaggacgtggattgcatttcttttcctccgaaaccacaccatacaacttaatcatttataacatttagataagtgatcaagatacaaaatatataagcacatgaaaaacatctatagtaaataagaaagaaaattttataatttatatatactattttgaaataattgtcaagattatggataccacatatctaacagtagttgacgaaatctcagtaggacccaccacataccatgtcttatacggaaactgacctcggatatggagggagttccggataaggaaagacaaccagagttctatatggaagcgacaaggctctactcggattgtatccatactggtttccctagttctacttggacaaggggacacctatgggtataaatacaagaccccctaggaggagaggggagacagaacaatagattaagacacaatatcaacatacaagccaatatacgccaagatatgccgccggatatcgacatcaaagatatgcctggactgaccctatcccggtacctacagaggccggctgtagggatctagcgttgtctctgatctcgccgagcacagattcgaggaggaagactaccctgttgtcgactacatgatgatacttcaatctgctatgtcgataacagatagataggctaccccaaatattgtaccagtgtgattatgatgaataagagcaacgaccggcttcggccaacaggagtagggttattacctgacaattcaggggcccgaacctatataaaaatcattgtccccatctctttacctcaatctcgcatatatcctagcaccaacgatccccatactatgcaaataccggaatcgcgacatcgaacatcaacaataatagcggctaccaaatttaattttacctattttaaatgtggcgatatatctttttggtttttgtaaaaacgtagaataacgcaattgccagaccggtcttgaccactgtttgataatttttcgtgcaggcctgcagggattatccataacaaaactacaaatattctacattattgaacgaaataaatctcactgtatagatataaacttacagaacagataatgtggagatagccattgctgccgattatttaaaaacgaagaaaacatatactactccctccgtttaattaaatgagtgttgacttttcgtataacgtttgaccatttattttattaaaaaaatataaatataatttcttttatatattgtggacttgttctatcatcaaataaaatataattttaacttacacttttacatttctatattaaatttttaaacaagataaacggttaaatgttgtgtgaaaagttattgaaaataaggtagtgtaatttaacacttaattagccacatttgttacacaaatgttatggtgctagccgccagtttgtcagcagcccaccaccataataccctattttattaactttctactgaaaatatgcaacacgcaaagaaatataaacgtgcattaaataattttctactgatgatgtgcaacacgcaaattaaagaaggaaatatatatataggagctacgcagatgcatatgcacaatcgatgatggcccaagcacccatgtccacgggcggcggcgccatggagctcggcggcggcggccatgagagcgtggaacgtcgtcgacggcaccagcaccacttcgtgctggtgcacgggctgtgccacggcgcgtggtgctggtacaaggccgccgcggcgctgcgccgcgcggggcaccgcgccacggcgctcgacatggccgccagcggcgcgcacccggcgcgcgtcgacgaggtgcgcacgttcgaggactactcccgcccgctgctcgacgcgctcgccgcgctgccgccggccggcggggacggcgacgacgaggagcgcgtcgtgctcgtcggccacagccagggcgggttcagcgtcgcgctcgcggcggagcggttcccagagagggtcgccgccgtcgtgttcctcaccgcggccatgccgcccgtcggccgccccatgtccgccaccaccgtggaggtaattaacctgtgtttagttcacactaaattaaaaatttggttgaaattggaatgatgtgatggaaaaattaaaagtttgtgtatataaaagtttttgatgtgatagaaaagttgaaagttttaagaataactttggaactaaacacggcgttagttgcgaaatcaacagaagttttttctgatcgatctactagtctttttttatttactccatgaatgcgcactaaacgatgttttaggattacgttaattaaatcaactttaaaatcttatgacctaaaaattccaccctatttttctaaaaggtagatgtataatatgtgagtttaattaggattgtgtcaatatctaagtgtcaatataaccctgaaatgctcaaattaaaatggcattttgtctgggagtccttaatgaattgtactgtggaccaacaagcattgtttgtccgtgatttattttctaaaaagaagaattatgaacacacccacacatggacaaaaatattttaagattgatagtcaatacaaatgcactgttgacatagactcatcaattagcactgaaaaaataattatacaaaaatatgagtactcatacttaatgagttgaagactagaatttgactgagtatattctaccattcgaaacttaacctatttaaggctgagttcgtttgttggagttgtgaactaataatcactcatacatatgaaaacgagaaagaagtgttggcaacctcaagcaacggactcagtgttagtagttacgcttcgtttttagaggtaaccacaactacctaccgagtatcgagataatgtttttgagaacgacatttaaatttggtcaatctttaatcatgttgtgaacttttttattacatttctgaacttagtggaaattaaatgatctttctcgccagataatatagccgacatgattttattttcatggaaatcataggaaataatcatattccctacaaacattttgtcgagataaaacctgccagacatctcgactccattattattatctccgagtcataatatttgataattttgagtagcggaccatatatattttttaaattatttacttatgataaataggctttatattaccacatatatgatttgcactacataaatataaataaatatgtaccgatttacactacatattttcttcacatttatgataactaggctttatattaggtttgtccatgtttccaagagaaaaaaatatttttatatttaatcatgagtaaatattttactgtgagtaaaaattttatttttgctaatgtggaaaaatctcagacgtttgttttcaaatttaacggtagttccaatgtttctaatatatatggtttgtattacatactttttctgtttattaggagaactcattttctttgcgtgcgaccgagagagagggggggagatatagacgtaactaaatgcgttgacttagtttaatattgacaactactgctaatgcgagaccgacacatgagtctactactcccatcgtcccaaattataatatttttttacatggtcttgaatgatatatttttgactattaatttatttaatattatgttatcaaacaactacaaaattaatatcacataaagtattttaaaatacaaatctagtgatataacatgtataatacttaaagtgtgttcggaagctagtgttcccaaccgaaagagtgcgcacgaaaaacggagcggtccattagcacgtaattaattaagtactcttagctaattaatattttttaccaaatttagactctagaacaagctatattttgtttattaataggacacatcatacattttccttccctactaagggctactttgggaaaaaagttccgaaggatgtattcggaaagaattactatatggacattttgaacaaaggaatggcttttctgaattcctttaaagtttgttaggattgcctacaattatgagaattttggaggatttttaacataaggtttaacgtcttgaaaatattcatttatgcctcctctcttctgatcaattcctattctttttctgtgatccatacaaacgatatggttttcttatatttttctatcataagacttgtagtgacaaggcactcgaattctaagtttttcaaaaattatgtattccaaagaagttgtcccaaaatatgagggatttttttttatttttagataaagagagtgtttaggacattttagtcatttttcctactacctctaaccccataatatagctatctcttctattgaagtttgaatggtagaggtagttatattatgagatgaaggtaatcggtaattctaaaactggtgggtaacccgccatgcaattggtccaggtggtcgtataggtccgcgacgcgtggagaaacgagaggaacgggcggacggcacaccacgatagattttcttttctttttttgttactcgtgccttcccgatttctcgcgtacgcgcgtccgatttgggcctgctcccagcaaggttgggctgattggcggcccatgcgcgaggaaggacgcgtgacgagcggacgaatgtcgtcgggtgcgtgtgctgggtctttgcctcttgggtgggggggtactggccgggcaactcctgcgctagcttcatgtaggaggaggaaaataatagaaaaaaaaagaccaatgttagccatcaaggaaattctacaggcaaaattaatgcaaattaaatattagatagaaaaaattaaggtaagaataatttgaaagaaaagaaaatgttacatgcaattctaaaaacaaaatctggtctaatttaacctagcaatttttacatcatggagtctaggacatttttgtagttatcagacagatcccatggttggagtcaaataagtaggtatgccctggttgggttctgaaggtaattttgcactgacaaaagtggttgaattacttcacttgctccattttgttttcttcagatataaatttttaagccactatacaataatatctattttaggtgttcagcatatcttcaaaaactttattaagactgtaagtgatgagggaaggattgaaatcactaattaagggatcatttcgaatgtgtgatttttttggatagaaatttcattggcataaaactaattctgaataaacatgaaagatttattaggatatagagaaactcacgttggtgatgggccataaatcagtcaccagctcagcgcgcgccaattggcatgctgattttctagtatatactaaagttttctcgagatacaatggatgcttttatttttggaaagagggggtattcgtgtgcacacttttctacagtcacattttattaggtaaagtatgccgatctcacacacacacacacagatatatatatatatatatatatatattgtattaattaattaactaatcaatcaattcattagcaaatagtttctactaattgtacgcagcacgtgaactatgttggggtggagttcttccttgactcgatggagctggagcagcagaacgctgacatcccggggaaccctgtaatcttcgggcccaattttatggcccaaatactttaccatctaagcccacaagaggtaataccttaaccaatcgcatcaagagggaatcttataggatttaaaatgttcaaattgctaatctagatcgttaagaccgcctagagaacggcaagtatttcttttagttgaatgtatttgacgttggaagaaataggtttagttgtctgaacgtcaaatataaattaaatgtctagatggagtaatttcgtgataaaatagcttgttcggaatgtgggaatttttcatggccggccactttggaattaacgaagaattaattccaagtttccaacaagaagttagggcgttttttttctcaagatggaaaacttaatgttgggatgttacattattacttgttgggatcgtatgggagtcacacaaataggatttgtactagcaaatgtggtggaaaatgtagaaactcaagacacacctaggagagagaaccacgagatatacgatcatgttaacttatcgtcaaaatccatatggaatagcacatttcatacagatccaagagtaatctgccttcgacgctcaattctccaaaattattgtagtaattttgttttgttataaggatagggacctcgtttagaaaacttagttattttcacatgaaatttatgcattccaatagaatgggaccttcagaatccttttagatcctttctagggggtggagattctaagaagcagaaggtgggaatctgaaaaagctttgatttttcagcttctcgttgctagttcattttctatagggagaatagctaatatggtccctaaagtttcgctcctgggtcactttagtccttaatctttcatattatccaaacaagtcctttaaatttgtcacgtgggttgatataatccttggccccatcaaaatcgccacatcgacatgccatgtcaccctcctatacaaaatctatatgatttatctaatttaccctacatatataataagaaaataaaatacaaaaggaaaaagtaaaaaatatatatatagtatatgtaagagcaaaaatatatgtcaaaagggtgaaaaaaagggaaagtttttttttctatggttatatctaattcaccgttatatttatttttctatgatacgtaagggtaaattggacaattcatcataacttttgcataaatgattacatggcatatccatatgacaatgttggtagacccaaagattattctagttcttatgacaaagtttaaggatttcttttggaccatttaaaatgttatgaactaaattgatattatagagaaactttagagactacagtagctattctcccttttctatactatatatagtagctactgattctgaattgtatgaaaccgctaaagattcttaagaaaaactacagctacatgtccaaaagctaacctaaacaggaccttatttaactaataatttcaatacatgatggtgacatgattatatcgtgtttttgccatataggatttgaccttaggactatcgctgatccggccgacgaacaagttcaccggcgacgcgctcatgagggaccctgggctcctgacgaaggagaggtacgggtcgacgaggcgcgtcttcgtcgtcgtggaggacgaccgcgggatccccgtggagttccagcgccgcatgatcgcggagaaccccggcgtcgaggtggtggacttcgccggcgccgaccacatggccatgatctccagcccggccaagctcgccgagttgcttgttaggatcgccgacaaagcacacgaaccatgagtccatgactcggactaggagtggggacagccaaatcactgatcaatagggcagaaatattatgtcacccaatgaggcaaagagaatgagggaaggaaaaaagaattaatgattgttacactgtttgtttgaactttgaagtagtatgtaatagtatattatttatttgggcaccatttgatgatgatgatgataataataataataataataataataataataataataataataataataataatagtaataataataataataataataataatggtgtttgtttagaggttattgtccgaactgggctgaaaaaagatgtgccaagcatcgcagatatacaggagaaaaggggaccatatagtaaaaaaacacgtaccaacacataaagtgggtgaaactgcccaaaagagaacatgtgttctagaaaataaggagatttaaatatttctcatttatacctttggtaattatttaagagtaaagtgcataggcggcagaggcgaatccctcataattcgggcccctttgaatcgcaggaatggaaaaacgcaggaataagaaaaacacaggattctgataggaatgcagatgtaaaatagaggattggaaaatacaggaaaaacataagaatgaccgtttgattggaccacaggaaaaacgcatgaatcggatgagagagatagattcaaaggaatttttccaagaggtaggacctcttgctaactttcctagcaaatctctataggattacatgttctataggaattttaaaggatagtataggattcaatcatttgtttcaaaggctttcatagaaatttttttcataagattgaaatccttcaaatttcctacatgtttcctacaaatcgaaggggcccgaattcatgggtattcacctaaataccaataaatattttggtgaaacatattatggattacaatgatttgtatgtcctagtggttgttcaagttatataggtctgggttcaactcctaacatccccatcatttttatcctcttttatcttcaatagtttagtttttaaaagatagttcttgaccaaacacatctccaattttcagtatttatttttccttcttttagtttttccatcttttatattcaatagcttagtaataatgtcttctaatagactttacttaggttttgtatgtgttgacagaaaacacgtagcctgggagatctgcttaactccagtgcaggtccaaagctcgccttcggatgtattagcgtgccagttgatttgatcctgtaatcaacaagaaatagaagcaaagaaaccgtagttaaatctaaaaatgatagccgatcggctagatgccgatgacatatcatttatctttgggccgatgtcatccatgtatcgatcggcagtcatgaataagtaaagaagaactaaatctacttgattggctgtagatattaacaatatataatccttatatcgatatatacttaaatcaagtgattgggatagatcggtcgccatgccgagacagtataaatcacctagatcgaaatatatattaataataagactatatacgttcatagcatagccgatcagatagatctagcatgtatcggctaatactccgataccactctatgttaagatgttaaaacaagtagaatatactaaacaaaagcctaatatacttaaatgcagcaagatcttaacacaaagggcagatttaacatatcagcgaaacaaatagagtaagtatagttaaatcagatacgatcggctgaaactccgatactattctaatcaacaactagatggcaggctagagatcaatattctaagcatgacttaatagatcaaacttaattgatgcagcattaagtatgaaaagaagaacaatatctagacaatcaagccgctagaagattcatagaatggtagatatcttatataatctagatcaatgtcgagatctaacctaatcggctgtcttttgcatacaaatattagccgatagtagattagataacgatattgctgaagattatataaggtatatggtaacttgacgaattatataaataagattagagcgtcatgaagatgtaagcactaatcctaagaacacgatccgtcataacgaattttacctcttgttgaagatcgaaaccgatgcagctcaacccgaaagtaagaactcgtcgaaataaaacaaaagcaaaaggtggcgatgcgccggaattgtattgaatgtgtgtgttttttttacatagggctcggggtttatttatacccgaggattacaagatacgcccataccggacacgaccattatctctaacaaactctaaaatatgacaagtctttgcggcaaacttttgcccacacttatctataaggaatttacataaatcatcattattaatagatacaattgccttcccaggactctatccatgcgtggcaatcatcttgaagcacatcaatctgagcctgacgtcgcgcacaagttgtattgtatatatcagcttatttagcttaactcaaccttagccgatcctagccgtagccgatcctaatcgtagccgatccagactccagccgattcttgctctgttccagaactcgatctccgcctccaactcttctttgaccaaatcccctttcctgatacgaatacttaccaaattcggttgttaatagtatggcatttaattttctttctcttttaactctttcacgtttaattttcaatagcttgtagtgtgatagtaatagattttagtatggcacgcaatatattccatttaaa

SEQ ID NO: 23681 - DNA, 9438 bp, Oryza sativa
aagtaattgcacaatcttagacactgttcaaaattttcaggggccacttaaccagtgaaaagtgaaatccaaaatggaatgagaatgatccacatcatctgaaaaatattatctgttggatttaatacaagacaaaagagagtgaatggtaaaaagacaaaagagagtgaatggtaaaaaaacacattcaagaggcttccggtgacgaagctttcctataagtggaaagaaagaacggaagaaaaaaccaaccctcatcctttaactaaatattcattaatcatgattgagctatttagtgcatattcaaaatgtatatttatgtaattaattttgtttctaagaattagttgttaatgtgtttaagaaaaatttgctagagacacacacattccttccaataaagaggtcatagtcgtctgaatatagatctaatgattttcacacaaatttaaaaaaaattaaactaattccttaaaaaccaacaaaatataatccacaaagggaacgcaccaatagaaaataagtggaggataaaggtaatacaatagcaaagacatataaagacgataactcatactattaaagtttgcaaaaaatattaagacatttaatgtattaaggtaatactatgattcatcctgacccaacttttactagcaacaagaaacccaagagaaatatattagcactctcacatatcacataacagggtgtgtagagtcgcgcaaatgcgcgacatcataggctagttgaagtgaagaattaattctgtgaacttaatattaagacgtgatcaatcatatgggagatagatcaagggggatttgttacaaatgttgtttggtaactgtcaaaatcctcaaaattttggaaccctttgatttgtaggaaaacatatgaaatttataggatttaaatcttacatgaaaattttctatttagtcctttgaagaaaggattgggaccctaacaatcctataaaattcctctgaaatagctcaagacaagaagatttttgaagaaaaattaacgtgaggtccaaccttatgaaaacttttattttagttatttttcttttctctaatttatatttttcttgttgtctattcgaacggtaatttcaattatttgtttaacacttgtattcatgttaaattcctatataattttctattcgtgtgtttctcgatcctactgctaaattgacctgatatattccaaccacctttcatttttgaatttatgatttatttttttgctctctgcacgtagtacggtagtaggacttgaccctggcgctgtcgctgatccggccggcgaaccggttcaccggcgacgagcttcatgaggggcgccgccctcctgaccatggaactctgtagtacatctatttggacattatcaggaaaataaatgaggggcctgtttagtggttatcatcagaaagggttgaaaagctgtgcatatatctgtagttcatgctacttaaatgtaatgtgcatatcatcagaaaggatgtaaatgtaaatgtaatgtgcagtaagacatgaatgctaaggaattagtactatcatagagccagaacttcaatgcacatatgaacataaactgaagcaaataaatgagatgattaacatactcaagctaaagactcgtcctctcagctgctatgaggtgaaatttgccaacttgaagaaataacagaaagagaaccagcaacagatctaattctagcaagcacaaaatcgtttactacttggccgattagtgtgtactattaacaattatagactggatgcctaccaaaataatctcagttgcacagcatattcattgcaaatggatacataaaactttactcagctcagaacctcagaatgtgaagttcaagaagtcctgtcctgctcatcatatagtatagtgaagctgccaaaaaatttgttcaggctccaaggcaatcagcacaaatcacaaaacaacagatcactcaacaggatgggccacagattggtcagggttaatgcctgcacttagaattgccgagcacagattaacacaaatttcttcctgcagcccaaatgtcagtcatcatccttaacacaactagcctaaattcaggggcacatatctgatggaattatacagaatgcaatatgtatgagatgacatgcccagtaagcctcccgatgacaggtgatgaccacgaacaaatttcccgcacgcaccatacatgcaaatccagtcacataatgcgttcagcagttacatgaaaggttcaaaaccacctgaagacatacataaccatgcaactgatagactacaaaaaagagaatagataagagttcaggtttctccaatttcttatgcattgcagccatcgcctgggcagctcgatagcatagcatgaggcagtcgagcttacaacatgctatcagttcttgcagggagcctcctgaagaagttcagaggaacagagggcatcttgtggcggaaccttgggtgtctcaaggtgtacaggcctgcaaggaagaccacaacacggaatggagtcacgtagaggacaatggcagcaacaaagcagaaggtcacaaagagcgccgtggctcttgggtctctccagcttagcagggactgcagcctttctccttgtgtcgcgagatcgccgactacggtctgtatcctcccagcaacactccgtagccggtcataacgcatcctcacaatgtcaggcggacgagaagtagggaatgtgtcaaactcttcatcaagctcatcaggatgagcactctccgcatgtgagaggcgagtgtccatgtgaggtggctgccttggccgccagcggtagtaccacactccaatcaggaacaggtagaggaagattgttggcagtatcagctcaggatacaagactaaaatcacaaagagaatgtggatcagtatggtggtcagcggatttctccaatggcagatctgatcaaaccacttggccaccgcaatcagagggcttaggacacccatgatacggaaaaagtttgccttgctcttccgcatgctccacatatgagagtcaacatccagcatgtactccacaatttccttccgcagtggtggttctgcacggctcagccttgttgatacaatgttggtggcttggcgccttagattgtctacctgcatcacggacaatgggtgtacatagtgcatcttgggcagcaatggttgtgaatacagatgcatcatgttcagcagtgatgagcatgtgaacctgacagcaagctgcacctcccccattttcttaacaccagcaggtgtcagaacaatcagagggtaagcatgagtatatactcgatcagtttctagcgtagagaggcggatgcggaccttcccaattctggtatcccgggcaccgttggctttttccccaccattcaagtggcaattgtcaaatacaccaatagtgatcacagtgcagggatcatacacctcccaagtgtattgttcattccacttgggtgtgaaactatcaataatagtccttgtccgcacccacttctgcccatacttagcaacacaataagcatcagttgttccacgcccatccttggtcttcatcggcaacaggccctgtgctgtcaagatacccaactcaagaatgccaatgctgtgcttccataactgtttagcagttggcctcaaatcactgctgtaatgtgttgactcatccaagacatgatatccaccttcgaggcatattctcaagtgaatccggcttgaaaatttggtctctttcttctgctcgccatccacaattacatgcttctcaagattgtaccactggctgttcagcaacttgtgatccagcctccgaggtacgtgctgcagagaaatgattgtccttccaagtacatcatccttccctggggcaatcctatcttctacactcagaatcaggtgttcctcgaatggttcagcagcaacaaacattaaatcctcattccacattggattcagcgtccggcttggtgatacccgggttctaagagcttggttacctagcatggctttgacataaacatcagggaacctggtcctgtcatttggtataagatcttgtgcctcaatgacattgactctcagataccaaagctttggagtaaggtaaacttttgatctaatacttgcaagtccatctcctgggatcgacgctgcatcagagtgccaagcttcagggaatgcttcatctgcttgagtacccatccaaacggccaacatcaactctcccttcaccttgtgtccattccgctcttccaaccgataccactgtggagccaatgggctgtcaggtggcactcgttttgggacctcattcaggtcaaacaacacccgcccgatgaagtcatccttgacaaagtccttatccttgacaatgatctcaaccactgatgactgaatgcgctccttagaaaaggcaaagacctggttccactcaggattagtcttcttctcgaaatgccgagttgtacccttataattcccaagcttcacctcaacatatgggtcacagcttccagtgatgtccttgcttggaaggtccttagcttttactacccggacataaagatactgcatctgctcaaccaagtcataggtggtggtgagcttgtcaccagcagctccaccaccaaggtgaggagaagtctccttcaaggagtactcctccggacggaacggcctctgcatcatcttgaacgaaattcttgaaccaaccaactcctacgctcctactcagcaatgaaagaaaaagatccaaccagcagcaactggtgtgctagaataactgcaacatcataaataagaacaagttttaaaatggctggttgtcggaaacaaaaatgatgaacgatatcaaaatgaacaggaagaacctggcaccttcgaattaacaagtcatcaggtaataaggtttctctcaacagagcacctcacaagcattttcttcatctcgaaccatcccagtatctccacatcatcaatcatgggaacaccacacctggagcaatcatggacaaaccaggtaaatctcgcgcatttactagctcaaagtaacaaaggacggttgccgttccccactgagggaagtaaatcactaaaccaagaggtgaaaaatgagttcttgcactgcaaagtaggcgactttaaagaataataataatctcgaaaggacagagaagcattaacatttccagcgcaggcggcaagaacaagcatgttctccctattgaccatgctccaatatagtaatagaaaactcaagacaacatatataccccccatctacatctggagagggagaccaaaccaaatgcaaaaacattcgtccagggattcacctgccatcaacgcccgaacgtcgtccccgtcgacatccagcccattccgaccggtgtcacgccggagatctagcaaccgccgccgccgccgccgccgccgagcaagaaacgctgctcaagcctgccattgccggtgcacaagaggtgagcaaccacaaacaactcgaaaaaacacacaagagagagcagaaaaaagatcagatctgaacccggcaagaaaaccaggaatcgagcaaaaaaatccccccaccccaaccattcgcaagaaaccagcagctacatatgcgcgcacacagcaagctcgtcgctttacccccttttcgcaagcacactttcactttcgcaaaagcaaaagaaaaacatccacgcacgcacggactcacaccccaccaaagataaaagcacgaaccgaaccaagacctctcaagaaccctcaagaaaccgtcacgcaaccgccgccgcgcttcccgttcccgaatctctaccgggcaagaccgaaaccacagatcggggaaaaccaaagaggcggaaatggcaccggcattacacggaaagcggccaagaaaaaagcagggatggatggaaagaacgggaacaaagatataccaaaagattcgagcgggctcaccacgcgatctctcccgagggttcgaggaggaggaacaaaaaccggaagcttcggcggcgagtggggaggggaggggaggggacgaagaggggaggcgagatttttcgattttccgcagggtttttctcgcgagcaaaaacaaacgctgtggagagagagagagagtggagcggggagaggcgaagcggcgctcgaagcgtgcgtcgtggtggaggtggtggtggggtggccggtggccttcttttttcgaaatgcgaagggggtggcggttttgcgtgttgcaccctgggttttggggatttggcagtttagggcaggtggtaaggggtggatggggtttttttgcgttttggaccctactatggggttttggggatttgagggtggtggagagtggagacaggagtgttgatggaacattgtgggggttggagttcgtgccaactctatctgcattgtcttcttccttcctctcccagctgccggtcaagtcttctttataaatggaaaatactactgctcccgagtcgcaaactactcttccccatccattttgatcgtctcataagatttgtaggtcttctcaaaataattattatctataagaatttcgtttgtttgtgtaaacagtaatatgatgattgaatgtgttgcatgtaattaatttttattggtgtataatttctattggtgtaatgataaacaatatttaaaacatgagcaattcaccggacacaaagcgatagaacacgttaactgatgagaattaatttgagaatgatgaatggttcggtgtccttggatttatgctttttcttaggagatgatcaaaatgggatggagatagtaccaaattaatagtaatcccttcgtctaggattatagagttatagtaccactacattcaaaaattatgagacacaacatggtactactacaaatcttggcatgtttattttttcagatttgtagtaatatgatttctcgtataagattaaattattatgagacagaatgagtagtactttcatatatttaaaaatgtatttttctcaaaataaattattctaccatactgtttaaattgatgtaaaatttatttctcaaatattttatttatctttataattaagtagttaacccatagcaataatctattaacaatctaatatgctcaaattcctaatgggtccttggtatttataaataaaagttctagtacatttagagaaaaaaatagtactacaagttgaggttagattttattttccttcttccttcattaatgatagttagtacgatagcagtactatatgttgaccagggtttcttggtactctgttgtgatcatgggcctgagtaaaaatagtataaaatatatttacgtgcggcttatttagtctggtgtttgaatctcctaaaaattaagtattaagtgtttcacgtaaaacgatgtaacaataacgtgtgattaattgagttttaattattataaatttgaaaaatagattaatcttatttttttagaacaactttcatatagaaagtttttagacgaaacgcaccgtttagcaacttgaaaaacgtgcaacttttatcccaaagtttatctaatttttgttggagaaaagaacaaggccatagtttggtgtattttggttttgattttatacacgacgttgtaaggtaatttttttccattgaaatggtaaggcatggattattaaagacatcgtgcacaattactaaaattgatttataataaacagtgatcaataaagttggaatgtatttctaacaaatgtttgccaagtttgtaaatataattctgaaaacgtaatcgtttgcatgtttggaaaatcaatatttttatgtgtgaaataatttataattagccaaaaaatgataatcgtagagtaatgtaaggtaaatcagtgacagagcggtacatctacatgactgcattgttcttacagttcccgtgcttgcaaccaccattgacaagtgaacttgggttgtatttagttccttccaaagttggaagagttggaagtttgagttaaaattagtacgatgtgactgaaaagttgtgcgtgtatgacaggttgatgtgatggaaaaagttggaagtttggatccaaacacagccttagagttggggttggtgtacaatagtacattcaaacaggttggtggtgcgccccttgtatgaaaaccggaggtggtacaaattattccctccgttttaggttataagatgttttgactttggttaaagtcaaactgttctaagtttaattgagtttatcgacaaatatattaatatttataatactaaattagtttgatcaaattaataattgaatatattttcataataaatttgtcttgggttaaaaatgttactacttttctctacaaacttgatcaaaattaaatcagtttgactttgaccaaagtctaaacgtcttataacctgaaacggagggagtatattaggccatcaccaatgcgtagccccaggtcgtccccttggccccctctgcccgtcgccgtttgcttttatcgtcggtgctgttcccccacaatggaacgtgtccctcgctcacttttggcaggggaacgcaaccgaggggacgcgttgggcgcgagcgtcacctatggacaccgtttccaccgaaaaatttccccttccacccctcatggccaccggcgacgggagagagaggccagcggcagcgacgaggtacagaggtgcgagtcggcggtgagagggggcgagagggagacctgcgcgacctcctccgtcggcgtcatgacctcctcctcgatgcggtgctgctggcaccgctccaccccgatctggccgcgagggggccagatccgcgcacgatggcatcggatatgccgcctctggtcgtcggcggcgccggaaccgaggtcgactacggcggtggggtgaggtcggggcgaggccggcatgagacggcgacgagtgagggtttgctcgcatatgtctggcgacggtgtcggcctgggttgtgagcccgacccggtgaccaccgcgcgatggacatgaccccgccggcgccgcttgccatcggccaccacgagggagagagaggctgcaacgagagagggagaaagaggcggcgaagagagagaggatccggcgccggcgaggtggaaggggaggacggaggaaaaggatcggcaggggagagcggagtaaacggagcggctggggagagggcggaggaaaaatcggcgaaggggagaagggcagagaaagagacgcaaagcggagaaggggcagaggaagagacgcgtgagataggagtggctgtagggaggggtattttcgaattttttcagtgccgagacacccattgtaggcttgagtatcttcatatagtc

SEQ ID NO: 23682 - DNA, 25431 bp, Oryza sativa
gggtgtgcactttgggcggcccaccgagcgtgagtagggacgacacgctgtccgcggtcgcagacagggtgggaccacggcgccacgctttgcatattcctccgcctcggtggtggtggtgggtagtagtatgggattattcgcgtgcgctttccttttttttttttacttgggcgggcgggcggggctgctacagggaatcgcttccacttctccttttctcgatcggcgtgcgggcagagacagacagcggacgggtgaagaggaccccacgtggagggcgatccagctgctgtgggttggactccggtcggtcgggggtagtctcctcgacctcgatcggtgcgtggaccggggtcgacgagacgacgacccagcgacacacatcccatccacgcacgcatcccgccggtggacgtcgccgccgcagcttccgccgagccgggccgtctcggggcgggcgccaccggcgtcggcgtacggggctgtttggttcttaacattgccataactcactttaggcaatgttaggcaagtgtggcttgccatacttttttggcctacaaattataagccacacttgtgacaaagttagacaaagaattgagtctataatatgtggggtaagatggtaagaaagtgtggcttgccataactatagcaatgaaccaaacacaaaactaagaaggtgtggcagcctaaaatgtgatgtggcaagttgaaacattgaaccaaacagcccctacgtgctgcgtgctgtgcgggaacgacctagcacgctcgttcaagggacaagggacacgccacagagacatccgaggtggttattcttcgagctcatcggttggcccaataagcctaataggttaaaagcaaaagctataatttgaattcttaaaattgaatttggaaatggttttaacatattttcaatgtaattttattttaacattggtttttaagtcgctatgaacgagtttataaaaaaatttcctatatattaacttttatttcttaaaaagccgttttgtcttattagggaatataggtaaccaatgaggctcttattaaggattcgttgctatgtttttttgacggttttacatcgtgttaatgtaatttttttgagaaaaatctacaccacggcatcccgtattgttaagagaacaaaagatagataataaagtggatcaccaaactcttcgtcgctttgtctttctcatgccataagatcgtttcgtcttcttcaagccacgcaaaggatgtagttcatccggttttcccccactacttcaaacaccacccttctcctcctcctcccaccttacccatcatcacgcgacgacccaatctctatcttcctcccccttcctcaactcctcaagcgtcgtcttcctccttcctccctctttatccatccctacaccacatctagaggccggcgagtttattgggagctgttggaatcacagtagtcggtgaggagggaggcgacgatgaggtcggtaaagaggaaggaaaagaagggtgcaagtccgagtacaacgaggttcgcggcacctgcgaggatgtgtcggtcttggcattgagagcaatttaggagttggcaaagcagacgaggggtgattgcaaagtgcttcatggggctttgaggttgttacgcaggcatcgcttgaagccatcgtgcttctcgctaagtcgctagctcgttgatgtagcttgcagatatgcaatgggcgcttcatcctcaactgatacacataggcttggtacaagatgctaggtaccaaggcatagggaagaggcaagcgcaaccattgtctggttctcgacgagccaccaaccgttagcaactcctctccacttctccctttgtctcctctacacgctccctaactccacccctactattgaggtaccaagcactagtactccaaacttaggtactaggtatcaaagcagagggaaggggagagcgtcgtcgccacctggtcaggcaatgagtcacctgccgttgtctcctcctatcctcttcttccttcctcttctctacgcgctccctcttcccctaccattattgtggccgatggggcaaaacacgatgagtgttgctgcttcgcttgcacacaagcaggaaagtagggggctgcactgctttgcttgttttgcgtgtagaaactctaagtacgtttggtgcgacatgtgggattagatttattaagttgtcccgtttcaactgcatcatgtgctctagcatctctcaaaatttttctatatacaaattactttaaaatattaaataaatattaaataaatatttttaaatttataataattaaaacttaattaattatgtgctaataatttacttgttttttatgacttaacctaatcttcatctttattagatgaagagcaccacctagcttctctggattctggaaagtatgcacccgtggccagggcgccgagctggtagcccagaaccagaaatgtgattccaatgcctttttttttcttaaaaaaaacgatggttttcttttggaaatcaatttgtgccataccaattgtttggctgcttcgacagtaattttcagtgattttttttatttgtattgaagtcaaacctttggcaattttatccatctaccgatccaaatctttgttggcggtcaaaatttggctatgtaacaaatgagagaggcaaaattttgttgtataacattacggttttagctatgaacactgccgaaatcaatcatttaaaataaaaataacattgtcaaaatctgtatatttgctattagaaatacccatactgttatactcactctgtcttaaaataagttaatttttacaacatcccatacataccaataaaataagaacaagtaccctcactttatcaaacctaatgcaattatttagcacttcatctactcctaatacatttatcatacttttataaactctgatgtagtgattaaaaaataaacttattttaggacaaacaaaaggggctaaaaataatctcattttaaggcggaaggaatactatggctcgatgaagaaatatacaacgagtgaaaggtcagaaatgttccctcgcccatttctttatttcatacctaacaaatgaaaccaagtttgcttttaaaattttatatggttgtctaaccgatcttccctttgtgcaagattttttaaagacgaattgtgcttaagaaaacattcatcaaacacaattcattgaaaagtaccttaatctttgattcccaactctcccgttaccggcgcggagctacagtgatcagggagggttcacaagcacccatgtccaaaaatcattttaccttataggtaccattcaccccccccccctcaactcaaccaagtgtacccccaacaggccaccatacagagcaagaaggtaaaagatgcgttcatgcttgcagcttataagtattctcgggtagtcagctgacgagttgcttcctttccaaattgttttttaggatcatcctgatttactgtaagcaaaccgaacaatgttgcttgatagggagtcgattggatgattattggttgttttttttctctaaatttagggttgagttccaatttgttatcatttgcctcttttgtgttttagacaatgagtgtggattgaggtagttctctaatttgggtatgttttttgttgtgattttagtcttacttttttttactacagttcactaatttttatattaacattggggttctctattttggtaaacacattatcgctacattttcttttacctatttttgtgtattgaatgtttactatgatgttacttaatgtaaacacgtataaggttacacttgtggtatagtagtgcacctcctatattttgctctagctccaccactgcccgttacgacaggcgttaagctgttggttaggtacaaggcaccacagcgatgcaatactgatcaagaattcaagatgagcctagtgtgctgtgtgcagagtatttgtttgcagctatattgaggtgtcaatcaatcttctaaaaagcttagccgcaaaagttatttgagtggttgtttatccaccttctagcacttttacgatctaattagcagtcaatgggtaactgaatttggaccttggtgaatcattctcgaccatcccaaactaaaaatggaatgaaatgttacaatgttggatcttatctagtactatttcactaggattaacggataagccgagaacatatcttcccacaaagttacgcaaggttagaaactgtgaactgatctggaaaagtttccagcccactgaagtttatcaaatcttagtaaatataaaaaaaaatggcaaatcaagcttggaatctgcttccttctcgaagcaaaagcattggctctgctccaacgagcccggattacgtggccggccgattgatgcagttgccactaacgcgaggaatttttcgcttcatcactaaacaattactagataataatacactactcaacatattctaattaccgctatatatatacgcgatcatggcgcgttcaaggtcgagcagcttcgatatcgacggaagccaaagccggccaccggccatggcgatggcgtgcaggacgctggagctgacgctgctgtccgcgagcgacctgaggggcgtcaacctcgtctccaagatggaggtctacgcggtggtctacctcgccggcgacccgcgcgcgcgccagcgcgtcgccacggaccgcgccggcggccgcaacccgtcgtggaaggggaaggacgccaccgtccgcctcgccgtcccggcgtcgggcgccgggagcggcgcggtccgcgtgctcctccgccggagcgcgccgggctcggcggcgaccgcgacgtcggggaggtgttcgtcccgctcccggacgtcctcgccggctccggggacgggcccaccgccgccgcggtggcgtcctacccggtccgcaaggtcggctcgagcaggaccacccacggcgtgctcaacctctcctacaagctcggcggcgtcgtccaccttgaccccgccgcggccgccgccgccgcttgcagttgcaagcccgccgcgccggcagcaggtggctcgacgatggcgtacctggcggcggcagcggcggcgtacagggtgcgccgccgccgcagccgccgctgtacggctaccgccagctgccgccgataccgcagccggtgccgcctatgggcgcggtggagggcggcggcgtgcgcgccggccggtgaagcagccacgggcaaaaatggagtcttgcagaatatgaatgctaaactatattctgtcttaaataaatatataaatatgtgaacatatatgcgaatgaatctgatcatctgaaggcgagcaaaaaaagtaaaattatgaaattgaagcttgcaaatcgcaatggtgtttagctgtttatgaaccgtggaaatgcaagctatatactcaagtcttattgaaacctacattttattttcatgttcaaattgatttttgcttggctttttttttttgaaaacttggtgaaatgaaagcctcaaacatgtggacaccttcaacattaaagcgtagcgtagacttgatattttgatggctgaaggacggtctaatacagtgagacggaaagctgcctgttaaatggaagtttgttatgacattaatatagaacatcaaatcatcgaaaatttgaaccagaaattcttttgaaagttgaaacacaacctgaaaatcttgcaaacatgaattctgaatcctacaaatttagtttgttttgcagtattcagacttctgaattctgaatcatggaagtttctcatgtcaataaaagctttaacggccgctttgaatcataggaatgaaaaaacggaggaataggaaaaacattggattatgataggaatgtagctaaaacagaggattgcaaaacacatgaaaaacatatgaatgaccgtttgattggaccacaggaaaaacacacaggaatttgaggagagataaaactcaaaagatttcttccatgaggttctacctctggttaaaattccttcaaaacttgtatgggaagagatattccataggaatttcataggattacatagggttcattcctttgattcaaagagatttgtaggaaaaattcctataggaatgaaatcctctaaaattcctatgaatttcctttgaatcaaaggggccttatttaactaaattgttttcctttttttacccaccgacttactatcaaataaagtatcttccgatcatatgagatgttccgtttgattctcttcatcttacttcacacaaatttgtatgatttggacaaaattattgcgagtgagctacaaatgatcaaatcagtgcaatatagcttgactcttcccattttattttatatggagttgtataattggaaaaaaatatctctagaagtgagctacacatatcggatcatttcagtatacattgtttccattgttcaagtgagatgtaatatggtcttctccaatatctcaactatcttattcagagaaggaactgtctgatctgtccaaatgggttcacaccctttgaagagcaaatatgtactaaaatattggaaagatatcacaacatctaacaacatctatggtattatcttcctggttgattgcgtctcctttacaaatatatatagaagtataaagcattggttgcactcatgaaatagagcaggaaaagagtcttaagtataaaacagagttgcatgctagcttcacactagcatgcggcaaagacatgtagcatgcatgtttactactacctactagccgctggctcattcatcgtgaagggtaatgacttggttctaaagtaaagaattatgcataataaattatgccatcatattggaaagatataaaacaaaactatcggtactttttcatgagaatggtgaaatattctggtcggtggtttagattttagaagatctgtctatatgcgtaggcgcctttgttatgtacagaaaatgtctccgttctgaatgctgcaaaactttgctttgctttcaatcctacattgactcaaagtttttgtctatggaatttcttaacaacaaacctgttaaaattaatctggtatttttctgctaatcccattttttaatgaagaaatcttctatgaaaactttaacatgagtaataacaatctggtataattttctattcttaaatacttattcaacataaaggcaagggctcatgaagaattcataatacatgctggattttttacatttagctctttttacaaaacatattttacaaatagattaaaaaacattaaaaaaatggacatctaactcgatcggcgccaatgtctctaacgcatatatgtatatcagcaaaattgtgtgtgtctatatgaatgtatgtacatcacttctaacccagtagccaactatctcaaatcccctaactctatcccactaaacattagggacacaacacttgttattgttaagtggctagtcttaaaatcatgcatctgcgttaatgtgacatcccggcccagggcttaatagaattaatagaatactcatatcaacaaattctaactttttttccggaagccgatctcgaaagaactctgaggttaagtatgcttgacttggagcaatttcgagataggtgaccgacctagaaattcttcccaggtgcacacgagtgaagacaaagtgttctttccttggacaaagtgtgcagaaaagacttgtgttggagcaatgggtgaccgacgggaagcaacgactgggaagcaatttctttcccgggacaaagtgtgcagaaaaaaaattctttcccaagtgcgcaattttgggatgggtgaccttccgggtgcgcaatttcgggatgggtgaccgacctggaaattcttcccgggtgcacacgtcccgagacaaagtgtgcagaaaaatttctttcccggatgcgcaattttgggatgggtgacctcctgggtgcgcaatttcaggattagggatgacaatggatcgggtcgggcacggttagagcgaaaccatgctcggcccgagacccatgtgcccacgcccgacccatgcccacaaagccaatcgggcccgacccatgcccacaaagccaatcgggcaaatccccgtacctgtgcccatgctcgtcgggcacgggcatgcccgacgggtgcccactgggcatgcctgccatccgccaccgcgccgccgcccgcgcgcagccgcgtcaccggtcgccgcccccaccgccgtgtcgccgcctgctacccgcgtgcagccccgtcgccggccaccacccacaccgccgtgtcgcgggccgccgccccacgctcgtgtgccacctaccgcgaaactgcagtcgcccacgctcgtgcgccaccagccacacgctagccgccgccgctgcgctcaagcaccgccgcgtctccactcgccagccactgtcccgccgcctaccgcgtcgccactcgccagccactgtcccgccgcctaccgcgtgccactcgccagccactgtcccgccgcctgccgcgtcgccactcaccagccaccgtcctaccgccagccgcgtcgccagccaccgcgtcgcccacccccgccacgccgccagccaccgcgtcgctagccaccgccgagtcgcgccgccagccacctttcccgtgggccgccgctggtagaagattgaaaggtggtagtggggagataaggctagggtttcattgagtaagtatatactccctccattccaaaatataagacataaccacccttgacccaaagaccaagaaacaattattatcacctctttgtttgaatcaatccaattaatacaatacatgcacccaatagaattaaatatcttgtgagtgtatgatttaaaaaataataatttaggagagaagagatgctaaataattgccatgcatgcatgcacgccttatattatgaaacacctttaaaaagttgttgtgccctatattttggaacggagagagtatattgctgtatacaaatgagccaaatgggctattgggccatgaggggaggttaaactattgaagacatgaaggatatacatgggctataaaagtctcgggtcgggcatgggttatccacgggtgaaatataaaacccgcatgtgcccactaagtctacggatattgggtcggatgtgcccacgggaaaaaaaggtgcacacgcccgcgtccatcgggccgggtatccgcggatacccgaacccacgggcaatactgccatccctattcgagatgggtgaccgaccgggaaattctttccgggtgcacacgtcccgggacaaagtgtgcagaaaaatttctttcctgggtacgcaatttcgggatgggtgaccgaccaggaaattctttccaggtgtacacgagtgaggacaaagtgtgcagaaaagacttgtgttggtttgtgagagcagtctatgacctatgaaagctgccagatgtaagtgggcccggcctaggagaggcgtgacgttacagctaatatgacactactatagatttaatttttctgaatgagacccctctaggtttcaggcgggtcagaagacttgtgttggtttgtgagggcagcctatgacctatgaaagctggcagatgtaagtgggcccggtctgggagaggcgggacgttatagctaatatggcactactatagattttatttttctgaatgagacccccctaggtttcaagcgggacataactgaccctcatgcaaaaattgctattccaggagtggttcaagggttgcatgcgaaaatatatttttgcaggaggcccactgttggtatttgatacggttacagataaaatccacaagcgcacggatataccgatgtagcacttcccctacggagtatttcttccatgaggttctacctctggttaaaattccttcaaaacttgtatggaagagacattccatagggctgtcaccacctctacacccacctcaacatactgtgggatacacagcaattactggataataattacctaaacaccacgtctaagcaattaatatctactttagtgtttataactcaccaaagcaatcactatattttagttgattatagtgaacaataatcccgtatgctgattaggaactaaccaagagataattctcacaagataaatctaaattactcaagaagaatattatattgaattcagagtaataaacaaaataaaagaaataggagaagattaccaacaactccggaattcttccgactccttctactctactctcttcctattctagtatacaatatagtacaatagagcctcttataattcagctcaagcttggaagtgtgtgtgtgaagtgagggagtgaagcctttatatagaggtaggtatgacggttggcgaagaggaaatgtccgaagtgccctccaaccgccatcagggatgcatctgggacgtccatgccaaaccccagcctggatggctgagattgtggttcggccgaaccagggccgaacctgggctgggcccatctggcctggcctttggcccaagtcctcccctggtcctcctctatccatttcttggtattttgggctgatttactgatgtttcgatgaagttcacaacccgtccttgcatggatacataattctcttcactttagtctgattttcctcccaccttcagggtttattatctgcatccaaatatacaccaacacctgtggaatatgtgagattaagtgcctatctctatgttggatgttttattatctgatctttatgcagatgttggcggtatagaatcgacatttaacagccgccaacacccacctacgataataggctattttcgtaggtgggcctcttaatagaaccgcatgacaaaatcaattttcccatatggacatttctctccttcgcctacaattcacgcaacagctagtcagctacccctccacttaactctttttcatccgtgcatttggcctctccaccttccccttttttctttccccccttctcttctcctctctctatttccttctctactttctcctcctcctctcactttccttctcctcctttctccacttcccctcctcttccttcccgcacttcccagcagagatgacagctcgggaacaggcggcaccatcacgtggagatggtggcctcaagggcgggcggtgccggtgcacggatctagcgtccttggagagacaggagtaagcctcgggtggcggcggcctcaaactggctggatctgctgccggtgcccacagaagtggtagatttgcccaatctgaggatgacgggagcagcagtggtgacctcggactgggtaaatccgtcgccgatgcccgcgggagcagactcacgcaatccgaccggggacggtgggagcactggtagcgggagcgaatggccgcgatggcaacggctacgacgacgacgatggtggtggcggcttcgatgacgatgcgtttagaagctagggttttgggagaatcggggagctagggtttcagccgaatttgttcttttgaaatttttatatttttgttgctgaaattattttcacatgcgggcgtcataggtgaaagcattcaaaaatgttgtttttgcatgtggttgcgctaaatatatagaaaaatattgattgtcacaaacatctgtgtgcaggcggaccatccagccgtttgggaaaaaaaaatttgccgactgcaaaaatcgttttttacaagtgtgaaaattttttataacgacgagagctcagtttgaaaactttggtaagtattttaatggacaaggactcaattttaaacttactgaaattaattagagtttcatctatatgatcggtaagactaacaagaaaacaaaataagcatatgatagttgtaattctaatcttcctttctacaaatgatacagattagattaatcaggttacacatgatagttataattcttatctccctccctacaaaatgatacagattaatcaggttacacatgatagttgtaattcttatcttcctttctacaaatgatattgattaatcaggttgactcaaacatataatctcatatcaatttgtacagttgttgtgataataagttttgaagttgcacatgatgatccatatacaacacaattattttgtttgagatcagatattatattttgtccaggatggtaacaagatgtaagatgtaaaatggtttcctacaatatctcagctaaatgcatagagcaggggttgttttctagatgatggataaactaactagctgtggtctgcttctgcactgaagcattgattgattctagttatcaaatgcagagcaggaacagatgttgttggctggcagtgtctccattgcgcagaagcatggattgattatatagttatgaaatgtagagcatgaatagggtctttggtatgtaaaagagacatatgaatgctatcttcataaaagtagcatgctacttaccggctggttcattcatcgtgacgggaaaattgctcaggggtgaaagagaggatgtatatgcatgaagcattgaagccgcaagagaaatggcatcgtattggaaacacagaaacaaaaatatactaccacgatttcatattaagctttgatttttttcaagccaaatttttaggtttgatgaaatttatagaaaaatataataatagttttaacataaaactaagaagctatcaaaatatattcaatgctgaatttaataaaactaatttaacgttataaattttggtatattttgcataaacttgatcaaacttttaagaagtttgacttaaacaagtcaaaagcgtgtgaaacggagtgagtagataatttctaatcatattggtgaaagatatgtccgattttttttctcgaggtaattaagtctattcttactgtattgctaactttgtttacttcctttcaatccaatacactgatacttataaaagcttgtgcctatctcatcgtattttttttaattgttgaatatatatacaccggtacttttagctgggggatctagtctgttcatcatggatgtttgaacgagaaaatatgtagtgaaaacctacacctacgttgtggaccactggatctaaaatgtgcgttccagattaggcgttacctacccagctcccactcaacacgttttatgaataaccccccgcgtcaggctttatacatttacaaatacaccatctcatttccctcctttctcacataggtacacatctttctgaatcaccagatccaaatcaaagacaaccagccgcacaggataggagcgatgatgagtgaagcctcgatgctatcctccccggcggcaacctactctggcctctggctgtcctcgccctcgtcggtagctgagaaggcgcggaaggagaggaactcttttggtaaggaggatgttgccgatgtcgccgttgcgccgaacacggatgcagatctgagggagccggatgtggtgaagcttagagggagcacgctgccgaaggtccgagggagctagcccccgacgcagtggagttggcggtcatgcgttgaggatattgactcgtagctctaggctctgaaggtgagggtttcttgatcgcctctcctagtctcagcctgcatgtagctgtttgaactgattggatctctcgtgtggatgtctcatggatattggattttgtcccaatttagtagctgatgtttaggaaaatggcaaaatgtttggacaccaaacacaccgtgactaaattttttgcaagtgctgaactcatcagtaaccaattacatattggattttgtcccaatttagttgttgatgtttaggaaaatggcaaaatgtttggacaccaagcacactgtgactaaaatttctacaagtgctcaattttggggagctgaagtgctgaactcttccttgaccaattacaggggatgctttcagaatatgataggcataaaatggatctttgttggtttcttggattagttaagtaaatgtttcactagttttttaacttaaccttgctagtatcacacaatttttcaggcttccctgtatgtttttctaaccttgctaccaaatcagtatttttacttccttggatgtcacattttcagactaccaagctgagaggagagcaacatgcaacagacagtaatcctgtgggtctagggttcagcacttcaaaactgacgaccattgtgagaatacataggaggtgctaactaagatgatgattgaaggtgacaatctagagaaggtgctgcaggaattggaggagatgaagaacttcatcaagacaatgcatagcacttatcatgctattaggatttaaaaagaaaattcatataagagttagtttgtaatcaatttgtctatatactgaaatgacaatattacaagcaaacacaatgtgtaaaatgcctctgcttcttccaccttgacttgcactgcttttgcatctcaatgacagcccgcgcacgagcagaactcgacggcaatccacgacaacgcacggcagtgagagttatcgttcttcccttccttaattcaaaaatgagcacaagaacaaggttttggtgaattttaagtggacaatggacactgcagagcagactgaagtgaatataatctaccttatgcacatgacaacaggaaatcgtgcctagggtggaaaatggcatctccctcaccacatacacagaccacatatatggatgagggtgaacagatatataccttcatgaaaaaaaattgacatctgaacattcagggaacttaattctaaagaaactcaacatgaatatattgttatagagacgaaaaactttcatgaccatagtgtgcaaatgcagcacaccggtttgtgggaacacaggtgcagaaaattactagttcaagtagaaaaatacagcacacagaaaatttatccagttcaagtatatttaggattttcctagaaaatcataggtccagaaagtggctacaaacaactggcacactacaagataattgagctatcaccaccaatttattacaacgaaaaataattcgtggcaatatattgtactatcgcaatgatattttttttgtggcaaataactataatttgttgcaacgatttacaatcattgttttattcagtatttttgttgcaataggaaatgagctattgccacaacaaacagtactattgcaaaaacatgttctatcgccacacatttaatttttgtggcaatttgcatagtacatggtacttttcactattttctattgccatgattaacaaattcgttgcaataaaaatttatcatctcataatttaacttattcttttcatatggacacggattaggacaaattttatatgaaatttatagctctcgatgagatctacaacttaaatttttcatttgaaatattttaaatactcaaattcatgatttaaatcttagttaggcagtctcaaatggaattgtatgcatttttaaacaaaattgatgcgtagatgagttggtcatggagagcgcgcgtgatggagagatcttagattcgaatcctggccatgacaagatatcagaagaaaatagttaggatgataaattaatattgaaacatttaatttggtacgtagaactaatgccacacatggagtgatagcaatagttatttattgcaacgatgtgaagtgtcgcaatatatattttttgccacatccattttatggcaatatcaaattttattacaactaaataaaaatcgttgcaataacctattaccatgctatttattaccacggctagcaacgattttaagattgtggcaacatgtatctatttccataattttagcattgatactacgattttttttcgtggcgataaattatttttcgtggcgataaattatttttctagtagtggcagagtcaacctagtccatcaatgtataacgacatggtctgatattcagatgtcttttgctgacacaatttagatcccacagagttttggcaggtaataacattcataagttacaacacttgtgcacaaatatcagttatccccttcaaggtgttgtctaataaaaaatgcaaccttgctattaaatggctaaaatctattaatagatcacacacgtgtgcactggatgatggcagtggctctactttgaacaaaaaactactctaggcaaaagaattctcgccagctgctctcagcaaaaaaaactgcacccagcaaactgcatagtgaaaaaaattgttaagaaggacacatatacttgtgagcatagataaaaaattgttaaggacacatatacttgtgagcatagatacatacaaagttttattcacactacggaccaaactaagataacaaaatgttcctggaacacaatggttgttctaatattttttccctgtcttcccatatgtactcttaaccatttcaagctgaatattagctgtccaaaatgtccttgtcgcaatatacatttgtatatgagccaaacatgtttgtagaatacaacaattgtgttacttaaatattttccatatgtaattcttaaccattccaaactgaaaatgcaatccaaaatgattgtgcttcctacacatcccactgtatattacatgcccacttgcccacctagaatccttcccatatttttttatactttgttccaagttgataacactaggtcccaaatcatacaggcaaaaacttaaagaactataaataagaacccatgcaaaaatgcaagggaccacatcagttaacaggacaattgtacatttgcgatttatactaataattagactcatgacgacaatactaaaaatgttattacctcacaatggtcccaactaattatatttcaacatgtgttcactacctgctgttagttaaatattatatggccacctattatcttttacatgaattgctactttgttccaaggaaatctacagcatgtcaattagaaccagaatgttcttgccacactatagactttacgatacaccgttagttgaattttggatgacaacacacaatcttttacagagaaatgctaacttcttccaggaaattgtatgacaactattataagatgactgatagttaaggaagcatgatgtatagaaccttgcatcactgttgtggttctttgttaggacagttgtgcgaatcgtgcagcatgacttgtttgcacttcttgcaccttcgtggtactctctcttttttctttctcttcttgttttgctttttctccttgtcattgtgccctttaattctctttatccgacccctggaacgagtgtcatttggcgggtggatttcaatttgacttggaatgctacatccaagatatgattcaaattcctcaatttggctaagctctttttcaggaaccatctcatttaatttatcaccaagcacaactagttcatccctcaaaagttgcatagctgctgctgattgcttagcttgtaggatgagcttctccatttggttgcatgcttctgaaagcattttttgcatcacaggatcattactgttgcttgtgtttccttccaacaagataccatatgcatcgaacacatgtgtcttctggcagtccttcctaaacctttccaataaatagtatctcggcagttcacttagctgggcacttcttaggactggaattagatgacgacatggtataccatgagtttcaaacagcataaatgtgcacgttgcaaccattgtctgtctatcataacgcacaactcttggcttcctggattcttcaatgatatcgatgattttgacctcgccatcttgttgcacattgtcaataaggcaacggtccctggcagctagcacctctttctaaattatgctaaatacctcatgtgtgaagtaggggtgggcgtttggtcagaccgaaaaattcggtcccggtcttcggtttttcggtcagttcggtcttcgcaaactcaggaccgaatttcatccaaaaaaactcaggaccggcaaattcggtctcggttttttcggtctcggtctgaccgaaatttttgaggagagtttggaacgaaaaaatttggaacgcgcggtggagggcggcggccgcggcgcggtggaggacggcggcggcggtcgcacggtggagggcggaggcgggccgcggcgcaggggagggcggaggcggcggcagcgcggtggagggcaaaaccggcggcggcggcgcggtggaggctggaggaggcggcggtgcggtgggggctggaggaggaggcggcggcgtggtggggctgaagaagaaggctgcactggtagtagggttagtatcacttctagggtttgttttagtgggcttattgggcttcctaggtctattgggccaaaatttcggtcatttcggttaattcggttaaccgaacccaataaccgaaataaattcggtcttttgagggctgggaccgaatagataaccgaatttctcggtctcggtcttttcggtctcggtctcggtcttttcggttcggttcttcggttcggtctaaatatgcccacccctagtgtgaagaactcacttgcatgcttctctatcacccattctgtcttcaaattgcggattgtgtggagcgtaatgttatcttcttctagttccttatgtctttgttcttctagtgcagcatcaagcctgagccaaaactccaccaaagcaagcttccacccaattagacgagaaaagaatgaatcggcactctctgaccttgaggtggtccttaacaatcctaacaaaggtatgtcactaaaataagctggcacccatgaacgccgttgatcgaactttgtactgaaccattcgttgtcttccaacccatattcataaataatacaactccattcatcctcgaattcgagtggtgtttcagaagaccacacacaagagcttagtcgggctttgaatttttcatcctctttcagaattggtccaaccttctcacaaaccttcatcaaaatgtgccacatgcatagtctatgaatagtagtggtcagaacttctcttattgcagctttcatgcttgcagcttcatcagtgataattagcttaggtgcaacacctcccattgctttcaaaaaagtgtggaacaaccacatataggactccattgtctcgtcagataacattgtagcaccaaaaagtacactgctcttgtggtggttcactcctgtgaaaggggtaaaaaccatgccatactcattggtgctgtatgtagagtcgaaagagacgagatctccaaagtgagcataatttttcctgcaaatagcatctgcccaaaatacatgaattaacctccccttggcgtgccacaacataattaaaataaaaacctgggtttgcaagactctttctactcaactgatcaacaaacattatagcatttgaggactttattaaaactcttaaagcactatggtaattctgcaagttcctttttgtaaatccaacattctcaaacccttctacccaacacgaagggatcggtatgcttgtgatgtaccgatgctaactttatggcacgtgagcaatgtgtttctaccactcaagtaagctttctgttggaacgtatgagatgcctcttgtcaggagaaacgaatgcatgtgtatgaccttgctcaaatcccgtgataacatacttatcgccatcgactagtttaataaccagcttcgcctcacaaccacacctagtgattcttttctcataactccttttctcactaccagattctagtcctctctcacctttgtcctcccagaatccttcgttcgcacaaaggaacagtttgtacagaaccactccatcaactttcttgtgttgtccaatgcgaactgagaagccaactctaagcgcatagctttcataaaactccttggctgattctaaaccattaaaagtcataccgatgtttggcaccatagaatcatcacagtctggaataaaatacgaaccctacacagtgcacattaacaatgatgaaagagcagcatatcatgaatgcttaaactaacttgaaaaaatgggtgtgcaataatacttacacagaatggagtgcttgaggacttttgaggcgtggtgtattgatctcgtcgattcggaatacctgcagtaaccgattctgcatcggaatgcacatcattaaagtccaatctccctgccatgtcacttcgttctctaagaataacctggatgatcaaaataccatatgtaaaacttaatttttataaacagagcacacccagtagaaataaacagacagtaaaatagaagagaaattcaagaagtgagatctatatgtgagacataggtaaaatgaaagaaaactaagaaagtgaacatgtcagattatttcaggcttgcttaatggtaaaacatgtctttccctaggcaagaatgtcagagcaaatgggagactcgaagcaaacaacacatcaacccaaaccagtgggccgataatattttcttggaagaaagtaacggtttccggtaaaaagattataggtaaccatagaaaattcaactaacagtgggtagggaacacatgctgaaatacaattccctgtgactataattttggaggcatagttgctaccattgtgtgccaagagcattttggttctaacaaaatgcttgacaggctcaaactttcacatatgtgcttgcaacatgacatttgcatatttgtctttgcagcttgcaggggtaacacttttgatgaaagtagccgaggggaatacatttcccatagaagttttttttttaacagtggagacacagtgttaaagggtgcattttgtttaggaacaccatagggaaatgatggttctcctatttcagaggtattcattggatgcattgtcgtactcgttcccagattttatggattaaattagtcaaattatagtcaattacactatcagctgctgtggtgcatgaatgaatgaatggttggatggatggacagactactgttgagtcttgagcagtgttcagctctgcaaaaggatatgtaacagtcttgatgtttatggaaagtagaattataatctgttgatcagattgtctattcacagcaaagttctgaatggatgtgatgctaattcctggtttcgatcaagcatcttgattttattcagaagcaactactccaatctgtagttgtgtggcatgttaatgaaatgaaacatgacaacagttgtagaaaaatcttttatagtcacgagttgtaggaaaaataatcagtcatctagattgacggtttcccacaatagaactgcatatacatttcataaaaaatcagggaggtcggcatttgagttacatgtacaattttaggcaataagctcatgatgtagatttcccaggtcacacattcatctgagtatctacagaacatgagaaaatctgagttccggctaactacagaaagaaagaaacaagcatatggtcagagatacaaaatccacactaacatgagtattaatgttctaaagcaatatgcaagataatggagaacataaagcacgacggcaggccgtcgtcagcaacatcaattctacgcacggtcctcccatcgatgaataatacaacagtaacagctgcagacgccgccggttgctccacatcagtgggtagctcatcacaaccttacagaacagcagtaatggaggaacaccattactaccttttgttggccaatcgatgaggggctaggcccaagtggagggaaggacaagaagaacaagaagaagaggaagctgtagctgtctctacaagaacaccgacggcatagtaactctatttcatctgcagttgtcagtgttggtggcatcaaaaccctagttcatctcagcccctaaattgttcaaaccaagaacattccgctcattccgcggaagaacatacacgaactatagcagggatcaagaagagagaatgaccttaattcagtggatgctggatgagcaatcggcgaatcgaggccgccgttcgcagatgcctcgacgtcaccggagcagcatgggggttgattcatgttgccgcgaatcacgtggaaaggtggcgctgttgccgaccaccgccggcgccccaccccaccccaccgccgtgccgccgccacaccacccttcccccaaccccaccgtcgtgccgcagcagagagttgagtttggggatggatcccttctgaatccgagatgtgttgtggtacaatttgggggctgagattctaaagtttggaattaggcggggtgttttctgaacatttcattctgtggtgacgtggacatatctggaacctacgttttgcatccaagtgtggtttctatgtttgcactatagatagtgtttccactacatatcttctatgtttgaacggttttgcatgtttgaaactgcaggtcaatcccaaatccatttgattttcgctctcgtcggtcttcccacccatccatccatacctccgccgcctgctccggcgaatcctccgccgcctgacgcctccaccgctcatctcatccgccgccacccgcctctcatctcgctgctgctccacggcatcccccgctgctgctctccggctcggtggcgcagccgtcctctcccgatcgagccggcgccattctcctctcgttccgtggcttctcgagctcaccaccacaagcggttggatcgtcgcagaagatcgagcgggggagatgcgagacggcccggcgccgccgagccgatgtccacccgctccaccaccagctccgtcctcaacttcctacgccacgtctccttcccgccggacccgcgcctcctcccctccgcgctcaagtcatgctcggcgctgcgcctcgcccgcgccctgcacgcggccgccgccgtcgcgggcgtctcgcgggacgccttcgtcgcgtcctcgctcctccacgcctacctccgcttcggcgccacggccgacgcccgcagcgtgctcgacggaatgccgcacaggaccgtcgtgggctggagcgcgctcattgccgctcacgcctctcacggggacgccgagggagcgtgggggctcctcgagcggatgcggagcgatggcgtcgagccgaatgtgatcacctggaacgggcttgtctccgggctgaaccggagcgggcgcgcacgggacgcggtcctggcgcttgtgaggatgcacggggaagggttcttgcctgacgcgaccggagtctcgtgtgcgctatctgcggttggggatgttggagatgtcgctgtcggtgagcagctccatgggtatgtggtgaaggccgggtgcaggttggatgcttgtgtggccactgcgctcatcgacatgtatggcaagtgcggacgagctgatgagatagtccgggtgtttgatgagtcaagccatatggatgttgcctcttgcaatgccctcgtcgctgggctgtcacggaatgctcaagtctctgaggctttaaggttgttcagggagtttgtcggcagagggattgagttgaatgttgtttcctggacctcgattgtagcttgttgtgtgcagaatggaagggatctggaagccgttgatcttttcagggagatgcagtcagaaggaatcgagccaaattcagttacaataccgtgcgtgctgccagcttttgcaaatattgcagctctgatgcatggtcgttctgcacactgtttttctcttaggaagggctttcatcatgacatttatgtggggagtgctttggtggacatgtacgccaagtgtggcagggtcagggatgcaaggatgatctttgaagcaatgccatataggaatgtggtttcatggaatgcaatgattggtggctatgctatgcatggagaggctgagaatgctgtgcggttgttccgatccatgcaaagttccaaagagaagcctgacctagtcaccttcacttgtgtccttggtgcctgcagccaagctggctggacagaggaggggcgtagttactttaatgaaatgcagcacaagcatggaatttctccgaggatggagcattacgcatgtatggttactctgcttggtcgggctggtaagcttgatgatgcgtatgatatcataaatcagatgccgtttgagccagacggttgtatttgggggtcattgctgggctcttgcagggttcatggaaatgtggtccttgctgaggttgcagcagaaaatctatttcaactagagccagaaaatgctggtaattatgtcctgctttccaacatttatgcatccaagaaaatgtgggatggggtcaataggctgagggatatgatgaagactgtagggttgaagaaagaaaaaggctgtagttggatagagatcaagaacaaggtacacatgttgttggctggtgatagttcacaccccatgatggctgcaataactgagaagctaaaacaccttactatggagatgaggaggctaggctttgcaccaagtacagattatgtcctacatgatgtggaagagcaagaaaaggatgatatcctttctgtgcacagtgagaagttggctgtagcattgggccttataagcacaagtcatggaacaccccttcaggtgataaagaatcttcggatttgtggtgactgccatgaagcaatgaagttcatatcatctttcgagaggagggagatatatgttagagacaccaaccgatttcatcacttcaaggatggaaaatgttcatgcgcagactattggtgatttttcttgtcttgttcgactctacattttacagaacttggcaaggatggtgtagaaaagcatctacgtctctgtaccctaggttaatatttcctcatgaggtaattacttaccagcaatatctgcattacttagtgatttattttataataataataataataataataataataataataataataataataataataataataataataataatattaatattaatattattattattattattattattattgagcaagggctgaaagcccattttcattaccagaaatgggatagtctttacattacacacgacctttacaccattacatgataacagacagcacagctatcacagttttctggcactatgagggttccatcccacccctttcctgccataacctgaaactaagacacaggactactgtgtcaccttaaagcataaccgggacttagtatcaggaatggcatgacttgcccatcaccaaaacacaaacatccaggaccgaaggtaatgacataacacaccc

SEQ ID NO: 23683 - DNA, 6004 bp, Oryza sativa
  unsure (1)..(6004): unsure at all n locations
gttatttggtttgtgcaattttcataagaaacatgatatatttatatagtagactttcccatcttacctgcatatgtttgatggacagaataatttcttaagcaattcagtgaaagtaatattattttatatgaaaagtattcatggttgtgatctgcagacttgttgatttaagtgaccgtatactgtaaactgggatatggtaaataaagaaggatttacaggtgaagaaaagctaaagccttaaaggtactttcctgtcaatctgcataataattatgctactttcantttgtgattcatgtctaataactatcctgagacatcactctaatcagaatctctgtttaatactagaaagctagactattgaagagcctgatatacgttgacacaataataatattttactacagatgctcgatggtttcagatattttcataaccccttttcattgacgaagttacttgcatcttcttgttctctcgtctctgggagaggcagagagctagctctgtgtttttgtttggttctatgccctaccaaaagttggcagagcaaaaaccttgggattggtaaattttggtaggatagagatgaagatgtctagtgctaaaattgtacttatttgagatagatacatgaacttgccataatttttgctgagtagagctttcatggagttttttgttttgttatgtaacaacttttttgcattttactaaaattttgctaggtaaacaaaccaaactagataaacatcacgctgaacatgaactattgaactgggtctgtatatatctctgcctccccagctgtcagagcccctaaggcctggccgagtcagccatatgggaaagaatcaaagaaaggactaatacaagaggaatcatgtatctttgtctgccgatagatgtggcacaaagaagccgtccaatacattttatttgcagtaaggtaaaattgaggatatcttaaaaaagggatagaacgaggagaatatcaaagtacagtaaaaacgagcatcgtctgaacttgtttagtcttggcctcttctcgtcgtagctgctttaaaatttatactctatatataaatgggcatgccaatatgaagctggaataatccttcatccttcgaaaagctcgttcaccatgtcttccatgtcctgttgattactgccacatttctcctgctctggatgggcctccaggtatgttctgtatccagtaggaccagtaataaccttgtcaatgatagcttttcgcaggctcctcctgagctcagggttcggaaccttccatagcttctgatgtctgcatgttctctgaaattccgatttgaatcttgctagctgcgagggtttagaaaaccagagcgttgtcatcttaatgtgcaggcaagatagcactgtatcccaggagacattgagatagcaatttcggtagtcgcaatattttatccctattttcgagtcagatggaaggctgtaaccggtgattgcaatatactgatcttgtatgaagtaggaattgttaagcaagaacaagtacctcaggatagggtctgagaacgactctgatttcttctccagatgatctattaagttgctgatcatttgctcaatgatgtcgcattttaggatgcgatgaggccaacattggcctagtatggagttgagctcgtcaatgtgtccccaaaatagtcttgcatagtccataattaagtgagtagccttgtggatttctgcactctgcgggaaagtttcccaggaatgcatgccactcaagacaggagtaacagcttcagcatcgtttgccatcctttgtatggcctgacccaaattatcttttgcagtcgagaaaatattgctggtcttgttgagcaggccttgcagcatttcgtccgaatctggtagccagagggtctccttcttcaaggagagcatgatgatttcagacgcgtgggagatgcagctgcgcacgttcatgaggcccgagagcttgttcattggattccaggttttatcggccacggcgactagggaattggcaaaggcaagcatcttgcagacggtcgcctcaacgaaccgcaccagtcgaaggtcgtcgtcccggtcgacttgggcggtcgaacggccctcttcctggagatggcgctgcgtggcgctgagcgcttcggccatcacggtgaatcctcgtgtccacctctgcacggcaagatcgtacagcttatccaaggccagctcgctcttctccttctccagcgccgaccggagtacccagccgacgtcgagctcggagaaccacctctccagagcaggtctgggcgcccggccgaactccccgatcagcttgcccatgaagccgtcgcggaccatccgccgcgcaatgtcgcgagggcttttgtcttcaagtcttgccaacctccgggaagatgagatggagtaaggggcgtagcgatgacgagagctgcttgacttactgctgctgtagtaactactggatctcgccgaccgagacgacgacgacggcgaccacccgccggccgagtcgacggccaagctccggatctcctgcaggtagctgtgtctccgtgactgcagggaaatgttaggatcgctgctacgacccaactccatcgtgatcgccagctgtggctctagcttcatgctcgctcactcgagctcggccatgtttggataatgggtttgggatatgatttcccaccccttaaggcctcgttcggcacgtggggagggctttccctagggggaaacaccaccagtccaggattgggtggatcccctcccaccacccaatccacttccacgttgggtgttaaacccccatcctattcggatggggaaaaaaggggaaaagcagggaaagcagggaaaatgcatatctttgaataaaaactgagaaaaaacgagcatagatagcacatctcaacttaggaatagaatcaaattacaaaaccacacaaaataatctgaaatttcaaaaaaaaaagaaaagctgataactaatttctacaatggcatgtacagaagaaaaccaaaattaagaaaatagttcattaaataaagaaaatgaaaatactgccaagcttttaaaacgatagtaacactgctattcaatgtagcagttgacattcgcatgtggtaagtcaatctgtgccctccaaacaatattacaagcatatataatagttgccaatgtactccacgcatttaaattctagtgattagcaagtgacattaacacctagaacactgagtacaaccacaaactaggttcccaggttccaaaatctgatttatccacaaatttaagaaatgaagatggtaactgcatgcactgtaccatttgatcttcacctaataatattagctccatgacctgagaggagaaaatgatgagcattgtgaccccaagaaaagattaaaatcaatgccaaaaaacacacacaaaaaaaaaaagacagacagacacggcagccaaagaacagctgttgcagcatccagaaacaagcctctgataagtttttacaggtgatcacaacaacagaaagcttccaatatagaatagcatacagaaaatgacagcacattaggaggagaacaatgttggcccatagataagtttattttacaaagatatgacatagcaggactatggtagcttaatgccgacagtaaagcataaaaaaaaagtacagagaagttggactgatgacagcaatgtcgagctcaacaggactacaggagaaatgaaaaaaaggctgatcactatcatcatgctattcatctaccctataattcaccaacccactcttacacctacattactcattcatcaaatccaacggccagaatcatccaatccaacggatcacattataccacgcaccccctcaacctccgtatggaccccatcccccacttctctgtcaatcacgccaccccctcgccctcaaggattctctgcgcaccgtgcctccatctgcggatctgcctctgcgcacccatccgcccctgaccgcgcatcggccccgcgccccctccactgctccgccgaccaccgtcaggtcgcgacgccgccgatgactctctcgtgccgccaaggatcacgccgccaccgtgactcctcgccatcgatgcgcgacgtgacgcgtttccatctcttcgttcgtcgtcgacgtcttcgccggcctcctcaagaatcccgcaccgccgctgtcgaccgagatgaggaaggccaagccattatcgaaatagttgcgcgcgtaggcacaccagcagaaaaaggcaccggccactccaagctcgtccggcactacgactcggaggcctcctggaacaatgtatcactattcactagcacccctccttcctcactgctttgctgttcttgttgctaatggtctgcctctagattcctgcctgatgcttgcttgtttgggctttgcaaaggattaatggctggacgtcgtgcattggatccggcaggagtgcaattacatcccaaataagatgctacttgttagcacaataattaaattcttcatgatgttactttaagatcgatgtagccacctgtagcaaatgttgagtgcatgatcaaaaaattgaagtttactgttatttacttgtgaattgggatttgcttgcatcagtctacaaaatcttccctattgcttagttcgaaactaggcggtgtggattttggttaattttgacatatgcaggatcttagctcgatgatacgtgcgcatctgctgtttaagatgcacttggctctgttcagggatgattaactgtgcattctttagttactgattagtaagctttacagtataataacttagcggctgaaatcgtaaatgttagtactgcatttcctttacttggatgtaaggattcatgcaatcatgtggtctcacttgtgttgaggttttagcaaatataattcagattgccctgattggcagagctgagcatatgcgtgagttttgaatctgtcagtagttgaatactgctttgatatgtctgtagcaccccaaatatgttatgcagaattattggtacttatttgtgtttattgcaccgtcattcatttctgtagctattgcctcatgatgaagcaatatttggatatgtcatcgaagccagggagaccaagagcagtagtcatctgctccacaaggtagctgactgatcaggtcaggttatccttactaccaaaaaaacatgagtttatgatcggatttttttaaatgatactgctgaatgtgatttcgtgcaatgggatgaggcgtatatatgcctgtctaattgtattgctttgaatagaattggtttttagataaacctaatatgtttatttttagacaacaacatggattcatgctggattttagtatgaaaacctttggtctatgctggagtttagactaaaaaactctcctctctcaatattcaaataatgtgttacaaaagatcccatggtggtggtagagactaaccaccacttaatactgttttttatttttgtttatttagatacaacatggacaaagttcataaaattacattagtaatcatcatcaaattcatgcttttcattcaggctgaagagatgggtaggtttttcggaaacacaattatatccaggtattattcagtttcttgttgcttcttatatcatgtaaagagcttatttatctacctcggatgttcattccaagagacagcataaattactccggagatcccaaaacttgagctgtggtgtcttaagttagcaactaacatatctgtaatatttatgtttctcaaagatgtgcccttatcagtaaattgtgaaagaggggtggagatgccttcaagtgattttttttttgttgttttctgacatagaaatgcaataaagaagattggattattttaggcaatgattggcaaggataagtaattttactgatattagatttcagctgca

SEQ ID NO: 23684 - DNA, 8091 bp, Oryza sativa
  unsure (1)..(8091): unsure at all n locations
ttggtatattcaagcctagcatgctcattttggatgtggtactttcatagaagtgcacttagtgctggagacttcgatagaatgtcacactttcacctcagaaataccgaaaatttgttggtattgtttcatactccctccgttttttaatagatgacgctgtttatttttttctcacatgtttgaccatttgtcttattcaaaaattttatgcaaatgtataagatataaatcacacttaaagtactatgagtgataaaacaactcataacaaaataaattataattacgtaaattttttgaataagacgaatggtcaaacatgtgagaaaaagtcaacggcatcatctattaaaaaaccgtcatctattaaaaaacagaggtagcatttagaataaaattaagataaggtttgtgcttttttttattatttttcctgttctttttctctttttttggattatctgattgaattttgtatctatttttgaatttgtgttttatccatcttacgtgatgagttactcgtgtgtatggaaacggaggccatcgttcgattggactcacggacgaaaaattgatgtgaagaactgaaagttacaaatttttgaggtagttataagatatgttggttcaattacagtgttgataggttaattagtcacggttcattagtagagtcattagtgttttcttgattggccttttcttttttgagtccgaacggggtgtgtttgcaaaccctttttcccaacccatcttgctcgtttttcacgcacacgcctttcaaactactaaatggtatattttctgtaaaaagtttctatacgaaagttgcttaaaaaaatcaaattattctattttttttaaaaaatagcaaatacttaattaattacgtactaatggaccgctccgtttttcatgtttactgtgcacgtggggaaactggagtagtgaacacaagtcatcatagtccggtttattttagttgtgttgtcagtagagaggcacggacgaaaatttagttgagtatgtaatcatctgcaacatttttaataggtaaagataatagtagagattaaaaccgaaatataaaattaaagccgattcaaacacggatgacataccaaaatttagaaacatattcaatttttataatagtagagaagagatatatatataatttttataatagtagataagagagatatatataagtagagatttgttacatatatgttgcttgcaaaaatagaacgtgcacgtatattattaaatgtcaccgtagtgttagtacgagcatgctactagcggtgcaggagaatttcttaagtgtattgcaaatgctaaatattaggatagttatttacctactttattttttagttgtttatgcccgcaacaaattaatggaataaatctatactttttaacatattttttaaatgtatatttccctttatattgtatactgaagtgattatatataattaattattatcaagatttattgtgtccatgcaatatcatatttttgtactttgtgttaaatatatttaatgtacgatatgaattgaattgaaactcaattgcacatatcatataaaaatattttttgctaacatgaaattttaagtttttgaagatcaaataaaattgctccgtagcgtttagcacgggcatattactagtgttgtaagaatcatacaagcaagcttaacttcatggacaatggagccactttacaaacaagtacatggaaagaaagatctttatgtgagttctttggtggacatgtacgctaagtgtggcagggtcagggatgcaaggatgatctttgaagcaatgccatctaggaatgtggtttcatggaatgcaatgattggtggctatgctatgcatggagaggctgagaatgctgtgcggaagttccgaagagaagcctgacctagtcaccttcacttgtgtccttggtgcctgcagccaagctggctggacagaggaggggcgtagttactttaatgaaatgcagcacaagcatggaatttctccgaggatggagcactactcatgtatggttactctgcttggtcgggctggtaagcttgatgatgcgtatgatatcataaatcagatgccgtttgagccagacggttgtatttgggggtcattgctgggcccttgcagggttcatggaaatgtggtccttgctgaggttgcagcagaaaatctatttcaactatagccagaaaatgctagtaattatgtcctgctttccaacatttatgcatacaagaaaatgtgggatggggtcaataggctgagggatatgatgaagactgtagggttgaagaaagaaaaaggctgtagttggatagagatcaagaacaaggtacacatgttgttggctggcgatagttcaaaccccatgatggctgcaataactgagaagcaatgaagtgaggatggtgaaggatggtgaagtgaggatgctgagatgcaagggatatttgattcaggtgataaagaatctccggatttgtggtgactgccatgaagcaatgaagttcatatcatctttcgaggggagggagatatatattagagatacgaaccgatttcatcacttcaaggatggaaaatgttcatgcaaagactactggtgatttttcttgtcttgtacgactttacattttgcagaatgacattgcaagggtggttaaaaaaaaatcatccatgtgtccctaccctaggctagtatttgctcatgaggtaattattcacctgcaatatcaggctttgtttggaaaactagccaagagttattttgagagctatttttttagcataaggaaatagcccttcaataaaataactctaatcatttggatccaagggttattttgagagctatttggcctttaatgtaccttcacatggagagagatagagagaagacactttttcagtgggtcccacccgaaatagccccaattaacaccccttggatgggatagtttttctgggtgggttatttccaaatagccctcaaaaagctcacccttttggatttttttggggctatttgggctatttgagggtggactaaaaaatatcccttggatccaaacaggacattagtgaggatggtgaagaccaaaatccttctttccccaccctataggttgggttttctcatgaggtaattgtttacctgcgatgtcagcactttagatgggaatagaaacaacggaaagccactactagtactcccacagtttatgttgaccaacaaagaaaacacttcaaggataaacaaagctcattctcagggaatcttatctatgccaatcccacaagtggaagggaaaattcccaattatccaatatgcagatgatattctcatcattctgaaagcttgtcaaaaagagctttttgtctcaaaggtattacccaaccatttgcttactctactactccctccgtttcataatgtaagtcattctagtatttcccacatttatattgatggtaatgaatctagacaagcatttcccacattatgtctagattcattaacatcaatatgaatgtgggaaatgctagaatgacttacattgtaaacggagggagtatttgagaatttccataaatcttgtacgatgccaattcatgtcaatgaagaaaaactagaaatccttactggtacttttcgatgtaatattgtttcgatgcccttcacttatttgggtcttccggttggaacaacaaagccaagaattgttgaattccccccctcccccctaattgatagagttgaaagaagacttatggcaatcaccatgtttcttaatcatggccaaagacttacccttgttacccttgtcaattttgtcctctcttcgccgccaaccttttatatgtgcacactcaaactcccaaagaaagtgatagaacatattgatgctccattgctccgctggccgccacctgcctatcaacaattgatgctccattgctccaccaccatccatccttcatcggtgtgtgggcactgttgcaccggcgccccccaccggttagcctgcgtgtgccaccatgcggccatccgctctccgcactggtctcccatagtcgatgggcctcttcgatggctgcgcctcctcacaccgagccggcctccatcactgccggccgtgcctcctcgcgccacgttgacctccgcgcctcctttcgctgcatcggcctccgccgtccacaggtccaggaacaaaacccgcgtctaacgatcacgtcgcctcaactccaccaccgctgattttaggagctccactaccgccgccggccgtgccggcctccgacaccgccgaccgcgcctcctcgcgtcgtgttgccactgctccacagcgtcgctgccagcccgctgccctagctgcgcccagccggatctagcctagggcagcccgtgggtgatggcggtgctggatctgctgcctcctcgctgggagggctcgccaccgccactccccatcgccaagtgtccgccgcctcccccgcgcctgatatggagcgccgccacgaagtaggccctaccgccgccatcctagcttgccaatcggctttccggcaatgagctccagtggcggtgaggtgggggaggggggaggggagggggcggcgacgctatggtttcacccccgtgtctcctgcgtgttggcgacgctacgggagctgatttacttagacaattttagttatgagtgacattatctgttctgaaaaatactcatggtcgtaatctgcacacttgttgatttcagaagtgatcaaatccatgtaaacggaggaagtaattttataggatatggtaaatacatatgagaagttacaggtgaagaaacgttagagacttaaaaggtaataaattttaaattgttttgaacgaacatgcattgttaaattttggtaggatagagataaagatgtttagtttagtgttaaatatatgaggttgcgtaaaaattttcaggacaactaggaagatagcccgcgcattcacgcgggcatgtgtcgtacactatgtttgaacatctacaatatattatttctccataaattgttttcattagcattgcttttataattttctaacctagctattagttatctttataacatatcatatttaattaatccctacaagaaattatttataatattcttcatcatctaaaaagtaggtagacatattttgtgttagaaaacatgtatagcaaattaagtgtaaaatcaaaagtaagatgctttttaattgaatataggttgtcattgtttattgacagatgaattgggtgggatatgaggctccactaaatgcatgggtttatatagcctaatattattgtttaatttgagagataatccatatgtgaacgttccatgtagagtgtgtgggagactccatgcaacctagcgcgaataatattggatgaagaaatatagttgtgcaatatattattttggaagatgatgcattatgatacacgcttgtcttttaagatgagatagatctaatggttggaaataatgggtttatcggtttaaaaggcccaggaggatttatggggtaacaggtggtgactttatataaaaaagaaaccatcatctatgatatataaaataaaattataagtgtagcttaaaattatggtctttttaatatttgtttcaatctttagtttagaagctgaaaatagggaggagacaggagagaaacgaatagcgtagaactcgaatcagatatgagaaagggtttgtagtgcaatagtgttatgtgcatatgattggagagggagctggagggtacattttttttaaaaacaaaatctttgtaaacaatctaagtgagaacctatgaattgttgttttttcattctaaagatctttaagacatgacatgtggtggcttaagtttttttataaagagaggcaatctaatagttaaaaataatgggtcatcaaattaagtggaaagagatgattattttctctttgaatttcaattttttttcaaagttttacaatatcataagtggtgacttaagagtgctatagagcacgtttaatcgatctttactgtgtaaaacgattcaagaatatatatatcatgtttttcaatgtcttgttgttatttggtaaggagattttgtttttattgaggtagatttaatacgttcatctgtttgaattatttatgtctttaaatccaattgttaaaattataactccactgttttaaatgaaaattgatgaaattataagtccgccaatttaattgaaaattgatggttagatttgttttcttcataatattttttataattaaaattgttatttataaaataggaagatgagaaagaattattggagataaagaaaatgtatgtatgtatacttacgtgcgtggggggtggtgggaagggtgggccagtggggagaggagagttgtgccggtgggagaggggtgagggatgtggattgtggtttttttaagaaaaaaaagataaatctaatagttgaaaatagatggttcactaatttattataataccacgtggcggtttagtagtgtttataggcgtaccacgtggtagtatatatgtgtttgtataaagtttaatggattattagtatataatttttttgatttttaaatggtaattaggatgacatgccctaaaaattattcttttcagtagaagtttacacggttgaatcattaaattttttaaagacaccatggatctaaatttagatgtgttcgcaaatttgttgattatttagggtgcttgttgtttagccaataaaagataaatctagtagagtttagcaggatgaaaacacgtgcatgcacaccctcatttgtagtagacctaatgctaattgcattgataatcctagcaagaataggttagcctatttggataaccaaattaaagcaagcagcacgcacgttgaaaacctattcaatattttgatttctctgcatcattgtggtttattatataacttagtaacaattatgatcacttatgtttttatatggggttgctagctataaaataggaaattcacctacataccacagaaggaggagtacgtatatagagagaggagatttcttttactgaaaatgaaaccgatacttgagatatatctaacggttagaaataataggtccaccgatttataagttataacggatggtcagatttttttcttttttctcataatttttaagattttttctaatttcttagagtgtcacgtgacggcttaggagagtatgtaggatgtcacatggcgacttgtgcattcataggaagtttaatggacttgtgctagaatacaactcggaataacatatatttttacaactgttggctgaatttattaatttggtttttatcccatgagagtgaaaaaaaagaaaaaagaaaagaagggaagggagcatacgtacgaactatgtacgggatggatcgacaaagaacgtgccgctttctaaatataaatctatttggtatcttttatgttagatctaacggttaaaaaatttgggtccaccggattaaatgaaaattaatggttagatattttatttttcttggaatttctttaatttggtagagcgccacttggcggtctaggagtatttatagatgtgccatgtggtggtttattagtgtttatagggattttaaatggctttttagtatataataatcgatagatngatagatagatagatagatagtttgatggagtgtttgctttgctaccttatcaaaagtttggtgttaccaagttttattaggttattagcaaaccaaacagataaaaatgtcacgctgccgctgcacttgaactagttctgtgtctatctctgttctcccagttgtcggagcccctgaggccggcgagtcagctatacggtaaataatcaaaaagaggaggaactaatacaggaggaagaatatacattgttatctgtcaacaggggaaagtatctcgtgcaatcacttaattcg

SEQ ID NO: 23685 - DNA, 10123 bp, Oryza sativa
ctgtgtccaaattgcactatactaatgcacctttttggggtccaaattacactatactgaatttaacttgtttttcaaaaaataaattatatatgttgtgtggggaacaaaaatcatttttaaatttttgcgatttgaaatgtaagatgcagtacataggcgctacaaatcatatttgcatttttattctgaaattacgtatggtacagcttccatttgactaattgcaatccagccactttaatctggtgcatacgaatttgctgttactttgcccataccatgatgagctacaaaaatttggttatttgccaggtggtttgacctggggtggtagatgcagggtctgtccattaagttgctgaagtcgttagcgcggggcgctccggggcgccggttgttgaagctattgagttcagcgatgttgacatcctcctcacctttgcgcttcatgcctttgttcttggaggattcggggttgtcgcatttgggtggaggcagtagccacccaagttggcgtccaagtgggtgtgtcacgaccaactccgagttggcgtccttgttggcctagtcaagatgaacgcttgtgggtcctccacctgctaaagttttgcgggcccactacttgataaaatccccgttcttgtagccttgatacaaggatgccatgacgtgagagtccttgacatgtgttatggtgttgcgcttctccgtgaaacgtctgatgtagtcggagaaacgttcattatcaccctgaataatttgatatatagaggtcccaggggtgccacgagtgggaacgtgccttggaagttggcgatgaactggacctttaactcggctcatgagtcgatagcattcttgaggaggctagttagccaggcccaagttgccgaagtaaacatcgatggcaaataattcgccatagcgcactggtcacctccggcagcttggatggcggtggagtagactgacaaccaagaagtggggtcagattttctgtcatatttgtcaatcccatctgctttaagttggcaggccactgcacccaacggagggtgttggtgaaggcggggaccccctctgcttggtcagggtgatggaagtggtactctatagattgaatctgtattggtgtgtgcacaacacgacgtgtgaatagcacgtgctccctccggtttcattttaattgacgttttggacaatgacacggtctacaaaatacgtttttgaccttatttttctattataatatatatatatataataaataagtgcatgtttacttttattacagtgctttgaaagacaaaattatatatgttgttctagttcctttaaactaaatatttttaaaattattggtggtcaaagttataaaagtttgacctcaatcttattttaaaacgtcaattaatatgaaaccggagggagtagtgcgtataaaggaatcaatcaattacccgtcttagagtttccggctccctttatatagacctagaggcaaccggctaaggtcggtaaattatcccttataatctaggtatttatcacctatttatatgtgataagatttatagccctattttcctataaacatttttaatccctctcaccatgttacatcatgtcgcattggctttaggcctatacggcccatcctgtgtaatacggtccaaaggcctagtctcgggtacccgggtacccacactagcatttgtgctttccaaaatgcaggttgtaattacaggttacggccttgaatagacacactattaaccttcattcatatatgcaccgtacaggagatagcgctccaacaaaatgaattatgaagttgtcaagtggtaagctttcataacccaaatgtaactggcgttaagttcactgaattatggtaggcttcgataaacataaaaaaataaaaaataaacgagctctgggtacagtgttgggataacagcagtagtgatctaaaatacaactgtatcgagcatggttcctagcgtctgaactatgtttgatgacatcaaattggagacatgctcttccaagtgcttcttagcatcttgccgtcccacatttgctatcgctaatttctcaggcggcagctcatcctcctcttgcaccgccttgttgtacttgatagcaaggttcagcatttcctgcaaaagataacacataaatattataaatgataaaaactacagagatgaagtttcaacattgactaaaatgatcgttcaaaatagaaatacacacctgaacagtctgctcattggtctttgaatgagtgtcaaacctcttcagaatcaatccatcggtccatttctttttgtgcaagttcagtaacatcttttcctcaagctcatttttccggtaattgattgcaattgaatagtagtgcctgttcagcccatgaataagagcctgacaaaaaagagataccctgatcattcataagtaataggaaaaagaaaacatatgtagaagctccaacattattacccacttacctgaatagatggcttatttaggtgcccaacatttgatgttgtctgtcgtggctcctgaccaagcatcatggtctgagggttaataaggcgaaatgcatcaatgacaactttccccttgacactttggatgggatctatcacgacggcaactgccctggggtttaaagcttcaaaactctgcatgttcaattttgaagatgttagacgtaaatataacttgcactaagcccctttttataaaaacgttaacttgggaaagtagcacttgacactttgtgaaaaaacaacaaacatatgcgaaatttttgcaatagaagttaaggtcagctagatgatcatggtagctgactgcagggaattaccagctaccaatgctgatatcaaattgacccttctctagtttattagatatacatatagagttagcttctaggtttcaggtgacagccttatataaagggtggtgaataatcattaagtagaaggaataagaacaatgaaatggccttctcccaaaggtattatcatcttcatctatgatctcatcttttctcctacatccccccccccccccaaacattttatcacagctctattcaggatggtagtaagtaatagcctcaatgattaagatttatcacatatattgtcacgcattattctgggatctgttttccaaacctattccctgcatcaggtgtacaaataagctataacccaaaatatgcatcagggtgatatagttgaattcaacccagaagctccagtcaggaaaagccattgccaaaagcagccagtaacagcctgacatggttaactgaacaaaggctggagcgttcgtttgaatgacagaaaggagaggaagtcctcgttttccgcgcgcacgcttcctgatctactaaatgttgtgttttttgcaacattttctataagaaagttgctttcaaaaaatcatattaatccattttctagtttgaaataatgaacactcaattaatcatgcactaatggctcacctcgttttgagtatcttctccttctcttttcctctcctctaaaacacagccttaatggttagctaatctgcctaacactaggtgtcacgtgcaaggacgtttggagacaaaggggatatatttgattataatggtcgggaagtaacaggaaatggccctgaaaccaaatggcgcgacggagtcgaatcgacgccgtgccaacgagacaggactatgggccctaaaataatcttgatctaatgcctaacctgacctgggctatagggtccctacttatatagatgaactctctaacctaatcccatcctaacagactttatccaactggactactctatcctaacagactttatccaactacaataagaaggccagtcagccagtgaacctattaggcccatgacaccgtgacactagcatggaatatggtaaaagccagggaacacacaaacatatggcaatactaatagaaatcaagaatatggtaccccattcatttgaaaaattagttactatgtccatatttcattaaaaagaataaaaaatgtaatgacaaatacaggaatcatctcttgttaaaccaagttacaggattcctttcatactgaagaaaaaatgtctgaaatatgcaccaaacctgttgagtattgatgtcaactcctgaaagccagcaaccaaatccaggatgggaatggtaccaacctaccaccatttctggcctgtaaaagcaacgaaattatcaagcttaatttgcttgcccacagaaaagctgagtaaaaataattctagataaccaagcaaaaggtgtcgaccaacagagcaacaaaatatctaaagttatggccaacaccaatatccaaataacttaacagaagttgaaatagaagaaccaaagagataacaagatacaggatatgctgtatgagaagacaggtgttctttctttccaatatgattactttcagttatgatctaaatgcacttgaacacagagcttttcatgtgtgaagaagtgctcttaacagcaagtaaaatttatcattttttctctccccgagaaagcgcaatcttttttaacagcacaagtaagacaattctcacggacatcgtgttatcggcgctacgttatatgcggctaggaatctatgactattattacaaaaagaatcaaatctagaccttgattcttcttcttttttatacatgatatatgatacagaaaagagtaaaggcgcaattaactgaccaccactaaaacataagggcaagtcttagatcttccaaattcaggcatatagcaacaaacgatgaaagaacactgccaatcaatcaggcaaaggcaaaagcattattacctcccggtctgcttgagcatgtcgagcatgttggtctggaagacatggtcgacggcctcgacgctgaccccggtcccgctctgcggcatggcgaagacgtcgaccaccctgaccgtgtagtcgtcgacgaactcccccagcatcagccccatcacctccatcggcacgccggccctccctgcggcgcgcaggcgggtgagcaaaagagccgcagaaaccctagccaagcaggagagggggggacgcaccgtgcttgagcatcttgaggagggcgagggaggagatgtagacctgctcggaggagtcgagcagcggcgagtccgacggcggctgccccatgccggaggcgccgaagatccgctgcagccgctccatggcttctccccaccgccgccgccgccgccgccgccgattcttcgcttcgcttcgcttcggtagtttcgtagggttcacaggatcttttttcttcttttccttcttttcttttggatggaggaggagggggagttacgctgaaataaccaaagcatgtaaattttaaatggagtaaatttcacgaaactactgacactttagctaaattatcataaaactacatatttaaatatgatgtatcacaagactatagagttgacgccaaatttatcacagaaccacaaatttaaggttaaatatcacaaaactacaaatttagtaataaaattatcacaaaactatacaatcggaatgagattctctgacgcagtgaattctacgtaagagggacgtccggtcttggatcgccattctttgtgcatccgacgggcaacaactcttccacgtcctcagtcgtaggcccataattaagctcgattccagcacatttgcatcagtgattcacggcgctcaacagtcgggatctccggccgccctcaccgccatccgccgctatcgatctctcgctggtaaagcgcgtacgcagtcgatgatcctcagacaaccacatcatgctcatcgacgaggtcagccagcattgaggacaaatcgaagggaaaaaccactccttttctcttcaattcgcatacagagaatcctttcattggtcaacatcgtctgcactcacttggtctcttgttttaacagaagggggaaaaagtatctgttggcaagctctttttttttctttaggctactcggggagattttctaccagcaagattttcaatcacatattcacatactgaaggcctcagcaagattttcatccacatcccaaagatcccggcagtggtatcgcgtcccccatgtgagagtcgaggaccatcgagtgtgaacgcgcttcaccagtgagagatagcggcgacgatgaaggctagagatcccggcgccgcgattgcttgccgtgaatgggctataccaagcaagcttatgggcctacagtgaaggatggacaaagaacggcgatccagggcaagacgtccctctcaccctctagcgtagaattcactatgccaggggatctcgttcctatacaatcatacgtactttgtaggcgcacatattttacaaccctagttttactagtattatttatgcgagttgtacatataaccttcgttaatccagcaggaacgaaatatcataatgaacattgacagtgtttaagaggaggggataataaaagaagatatgtaaaatgaggtgagccaagtatgttccatgacagttcataaaaagtttaccgtgtattacacgttaatacatgttttcctttaatttctaaacatgcaagagtatatagacctgcaatatgtggtggagacgggagcgttcaacgacatcacctatcctataattacccactaaataatcacatgattagctaaatagttgtgttcctagatgaaatgtggttcactcgcactaactatcttacccatatattaatcttgtcagaaaaactactgtacgggatcccatcccatcgacgcacgacgggatagaccgctccatatggatcaatcaatccagacttcagccaggccactcattgctctagtcttatcctctttattcactttcccctttttctctttccactacttagtagtttccaccatccatggattcgtacaacacgatacaagagactgtaggctatagctcaggcaagacaacagtgaggctggctgaactccactggcgttgcaagcagtgagaccttcctcgcgtgcgcaagtagcccggatgccatgccgttggttggggcaatatcaagttgagcctttgccggtgaactttgctcatgtggttcggcaacaataaccgtgtcgacgccattggtggctagtgcctggtggcctctagtgtggttggccaagtgctccacaggccaacgctgcctctaggtggttgcttgcacaattgcacgtggaatgaagggtggcaggagagtattcattctaggagacacatagagaaagatcaacatgctaacaggagatcaacaatagcatgtatgagcaattggttgttgattttttttcactcggaatttattctcaaaattggattttggattttcttaggttggctttcctttggatgcagcgctattcggttacgatactctttgtggtatcatcgtgatattccagtggcatcgatatgatatttttggtggtatcaacatggtaccctaacggtatcggtacccatgtggtatcatgatacctcggtggtaccatagcatggtacctccggtattggcatggtacccggatggtatcggcatggtacccgggtggtatcatgataccttggtatcatagcatggtaccttggtggtatcatgatacctcagtggtaccatagcatggtacctccgatggtatcatgtcatatggttcaagggtatggcatggtatcgggggtggtgttatcgtgtagtctagctaggcggccttttttttctctaaacaagctagctggtgcatgtgtgcctcgtggaagatggtgcttgtgggcctcaaatcggtgagaacgcatcgagagttcgagaaaaggaggcgctaccacgctacgcgctagagtatttgtctgttagattcattaactaccccgtaacccttacgggattccgtgctccagctgccctctaactttatttattattttagaaacttcattaattactaaattaccaaagacattttgatagatcaatttcaaacatacattgtcttttctggaatttctgctaggttgccaaactacaaaagcataattaccgctttacatatatgagagatatgtagtatatatgttgttgtgctttctatcaattatcttctttattatagtcacatccaaatcttgattccatggtagtgaattgtagtatcaatccatatgtgtagccatggacccatatcctctgatgtatagtagcaaggttagaagatctacaatgactccaactcctacacacttcttccctcaaatatctaatccctttgcactgtagaagtaggacgacacaaaagtaaggctgtgttcaggagtgagggttggtaacccttactcaccggcacgcaaaacgaagtagcgtttagcgcgtgattaattaagttttagctatttttttaaaaaaatggattaatatgatttttaagcaactttcgtataggaactttttgtaaaaaagtactgtttagcagtttgaaaaacatgcgcgtggaaagcgaggaggaggagttgggagcatgtcctaccgaacacagcctaaggagcaccaacacccatggccatgtttcttctacctatttcctagtgtgattgtagccactgcagcaacatgagcattctcgctcatctaaccgagctggatagaactcgagccccactctccaatgagcttgacatgctctcataagtggtgtgtaatagcagtttgaggtggcgtcgtggtgcggctcacgttagcaagagaatcaaggctcatccagcaccatgaagcaggattgcatgctccaccggtgcccatagaaatcaatagcaggtggttgttgtttttctaccaccgctgcttagtgatgtcaagattaaagtgggccaaattcatcgaaggacataaagaaacttgctttcaaacatgcagacaaaaataggaaggaaatgtgggataaaaaaaaaagagacgtttaatgtgtttgaatggtagatatggacatacaatatttctctaacttttgctattgcatgccagaggatccgagtccgtatagccaccatgtgacagcaaatttgcatgtggtttatgtgtacataagacttagttatatgtgcactacacatattacgttttatgtgtcgggagaagggggggttgaggggttttgaatttctagctcagtatagaaaatgtagcaatttaaaattgttcggatatatgtgaagttgcttccatctaataccatatcgtcatggagtggtcaatcaaagttcagccttttgccactgacaataattttcttgtatgatttttcatcttcccatttatttttctatacttctttaaaacggagcagtgttggtgatgagtggtgaattaagatgtggtatatatacataaaataaggataatactgtaattatctttaattaaaatccccgttacaagcattatatgctgctagtagtgtaacagctcaagatgcatatcccggtccctgtcgccacgagcacggcacgatacgaacgtccgtctctgccgcacgtgacggtggagcgcctgagcccctgatgcgccccatactgccgtcgccgtcgccccacgtttccttctccagtttcccacacacactcacccctggccctgggcactggcaccaagcatgtttgtttcgtgcaacacctgcacacccacgacacgtcgcgccgctcatgcccttttcccacccgcacccccgaacaaacacagcaatcccatctcactcccccccgcccgatctcatccgtccacaaccgaatccaacggcaggaagcacatccacgtggaagatcactgcaatatcctgtttctgcaggggggtaaacggaagatgaaccgaatagtctacttgggtgtattgcgactcatttttttttatatttattttttccataattacttcctctcgtctctgtctcgtcctgtctttctccgaggaggagaaacaccggagggagggtgggcgacgaggaggaggaaaaataa

SEQ ID NO: 23686 - DNA, 3089 bp, Oryza sativa
ggggagctggagctcgcttccgccggcggattgggtggcggcgggggcgacgagcttgttgatcctgaccagctcacctacatcgtaagggatgctctcccattggtgtttttgttttttaattattgttgttattacttttttttttgagcgtgtgcggattggatggttgatgagatggtggtggtaccgtggtgttggtcgcctgcttgtttttgcgcatcagcggcaatgctgtcatctagattgttgtggcttcttgaaattttgagtttgatttttttctctgtttgtgcacgtactttcgattgcaatgttgtcatctagactgctgcttcgtgcaatttcggggtcggtttttatctgtttctgcacgtagttttggttttggttgataaaggggattactgatgagtggtgtggtccgttcggtaatatgagctgatcatcaagtcatcgattttcgcgaatgggttttgctattttccagtaaattgccgccctccatagtgagaatgtgttagcatcggctgatatattggaaattgtctctggagtattagcttggagctgacatgtgagtgtccatctagttggtgaatttcctctctatcatgtgtatcttttctggtacggtggtacgaccttctggtgagaaccaaagttttcatagcacagtacttccgtgctactctgatggattttggtaagagcagctgtaacagcggaatcagcacataattttgactgcttgttatcttgtgactggcagcataatgttttcaagattgatttatatagccatgtattggttaatttgcttgtgacaatttgcaaggttatttatctattgcatacatagaatgaagcgattaacttgtgagttgatgcgaacgttatctaggccattgacttcttttatttttccttcaaattcatgcttctaaacaatctattaaaatcctgcctgtcatgccaaagcatttgtcacctataagctcgataagttacttcaataagcttgtgggcatctcacctataagctcaccaaaccttcccataaccaatttgttcgtcaggtaaaactatattataagctctagaaaatataatagataaacaaaaggaattccacatatatgccaagaaaaacgtttagcattatcttttgttgcattagttggcagcccatgcatccacattcattcatgcttcacaaaagttttagtaactttgtttctcacttgatctttatagtatttgaattgaaaaaccttaagcaacatgaatttctgcacatttggatgacttatatgcgatagttgcatttgactaaaaaatttcttatattctatagtcctaactttattattattaatttattgattgttattttgttcaacatgctgcacagttcaagaattgatagtctgtacagacacaagaacactggtttcggttagaaaagtatgctgactggatttttaggatgctgtgaaatctatttgttcactcctagataaaatcatatataatccagtttatattcccttttatctcttttggggagtttcaagttttctgttattttcttgatcaccatagggtttttaactgtttatctttaaacgatataggaatttccagctttccttgtttaccatgattatttggaggggggtctagtattatgatgtatgaaggtgattatattgactgatagtggattctctgtcatgatgaatgcagtattatgttgtattttggatttttaattggatgcttaaaacttgattcagcattggaagctcttataatgtaattgtcaatttgttttgcggcttgatttgcctttgtctgtgttgtaacttgattcaccagtggttcagaaggacaaatactctactccatatagctgatgatggtttgcattctgtgtgcaagtttaattatcagtgatgctacttttggcatagggaatacgtaactcgtatagtttttgttggatccagctgtgggattttatctctgttatgtgatgcttctggacttcacgggtcggacctactgtacctttttttgtttggatggtgaggaattatagggaatgagttattctttctgcagtatggctgctgctaaatgctaatgaactccagatgttagatcttcaaccttctgtttccatatttattcccaaagaggctttctctttcacagatggtccttatgttctgtacagtcttaaagaagtagttttctctttgtgaatgatcagcatgaaataaagtatgatgtatgttgtacaggatgaaaaacttcaaaatatcctgggtcatttccagaaggagtttgaaggtggagtatctgctgagaacttgggtaaggggactaaagctgtgtcacatttgctccgtggagctacagttgtattgaactactgatgtatgtgcaaaatcattaacactgcatagggtcacaatatgggggttatggttcattcttgcctacataccagcgctctcctcctgccttatctcaatctggaagccctgcagttctacccaaccatggcagtgcctcgagatcaccatatataccactggaggtatactgccgcaaacttcaccatgcgttgttgtcttcttagtattactgcctaatgtttgcaccctgttgtgatatacttccagagtgtacagaaaaaccattttgtcaagcaagctatagatggaaggaggaaaaacaattactgccaaagaacatccagtgagaatgatagtaatcactctcaacagttgttgaacagtggtcctgagcagaagacagcaaaaatacgtatcaaggtgaacaataaatgcctagaaagaaataatgctgctatctacagtggcctgggcctcgacatttctccttcctcatctatagatgacagtccacaatggagcatcgaggctcctgaatcaaaactttttcctgatgaatctgcagataccatttttcaggttaagtttacaccatcaattcaatttatcttggcaaaacctctggtggttgatttttgataaataatccatgggctgcaggaa

SEQ ID NO: 23687 - DNA, 716 bp, Oryza sativa
tgcagccctatttaaaacattttacttttataaatattgctggtcaaagtagcatcttgaatactgtatcaggatttaaaaatacttatatttttggacgagtagattgccgggtgacttgtcatgacatccaaagaatgaaaattagaaccacaaatccacggtaggcagcaatgaacgacggcgtccgcggccattggctcggcggtgccgtccccagcacagtcgccggccgccggcagctacgtcgtcggccggcccaacgctttcttacaatcgcccagcttgaccctttcctggctaagaactaggtgctgatggttcgccccctgtacgtccagcaaccaacaagcaacaatgaggtcagatgaacaaccaacaaccatgacttggtgctgttacacttgtagcatctgagatgcccctcctaaaatctatagaatcttatatgtctatagatatccactacaacatgatcagcagtatctgaactttaagaggatggggctgactattggtcaggtgaaagaatcagaatttgctgagtatcactttcatatttgtcattgacctcattttgctgaatagaatcatcaccacgaatccacgatctgttccaactctagccgaactggaaattaaacaaaattagtggtgctccatcagaaactattttcctaattgcacatacccaacaaaattgacaagcaaacaat

SEQ ID NO: 23688 - DNA, 556 bp, Oryza sativa
gtccccaagctggagcatctggaaagcgagtcttcacaacatgatagtcctcccaagtagcatgatctgctggtaataaagaccatttcagcaacacctggacatgagctgcattgccgcgcttcactagtcgacgctccaaaatcgcctcaggaacaacgtcagcagcatcaagaaccactggggatggcaaagaagtataaacaggagtatgatctggcacctgagctttgagttgagaaacatgaaacaccggatgcacagtgctgctggcaggtagatccaaacgataagccgccactccaatgcgctccaaaacagtaaaagggccaaagaacttataagccaacttaggatatggtctattaactactgaggactgagcataaggctgtaacttcaagaaaacagcatcacccacagcaaaaacacggtcagaacgacctttatcagccttgttcttcatacgcagctgggctcgagttaactgctgctgtaaaaattcagacaagccctgccccttcagtctaaacatccaccacatcaggcagagtag

SEQ ID NO: 23689 - DNA, 9480 bp, Oryza sativa
  unsure (1)..(9480): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatcctatgaaattcctatggaatggcacattgcatgtggattttaaaggaaatttagcaagaggtctaacttcttgaaaaatttcctttgagtctacctctttcatccgattcctgcgtttttcatgcgctccaatcaaatgaccatttctatgtttttcctgtgttttgcaatcctctgttttacacttcaattcctgtcagaatccttttgttttactattcctccgttttttctaacctgcgattcaaaggggtcctaaatggttctatgaagtgggtccccatgttcgaaaagttaccgattctttgggaaagctggcgagaccaagccgttacggccccatggggccgttcctggcgaatgttaagctccctggctaaatttaacacgtcccatcccatcaccacacattgcatgaggctgttttcttgagagctcacctgaacagtcgaatctactgtatgcagcttttgtaacacctttctcctcacgaccgactccgtgctattgggtgttggccaccacggatccatcggcgatcgagtctccattcgtacgccagaccgagcccatgatctacacgtactactattactaccaccagaccctgtgtagtttccgcacaaaaaaaatttacaccttatcacacctttctcctcacgatagactctgtgctgttgggtgttgccaccacggatccatcggcgatcgagtctccgttcgtacgccagaccgagcccatgatctacacgtactactattactaccaccaggccctgtgtacttcccgtgcaaaaattttacatcttgtcacatcgaacgtttagacacttacatgaaatattaaatataggctaaaaaaataactaattacagagattacaactaatttgcgagatgaatcttttaagcctaattgcttcatgatttaataatgtagtgctacagtaaacatttgctaatgatggattaattaggcttaataaattcatctcgtagtttacggacggattttgtaattgttttttttgttagtgtccgaacatcctatacgatatcctatataatatctgatgtgacacgttaaaactttgagcattgctccagtccagcatattgtacctcgaggtaccagtaccttcaggtaccaatttaaatccaaccgttcattcacggagggtaagattgaaaatctcacacgctaaacagctcatgatcgtgatgctccttctctctgactgagtgactgtgtcaacgaagactccaagagcaactgagcaagtccaaaccaagagcaaggacgtggtgggagcgcgacaaggggtggtcggcgccggtggtgccgggggcgtcggcggcggggtgttggacggcagcgtgttgggcgccggcggtgtctgcacggcggcgaggtaacgaggagcaggaggggtggtcggcaccggtggtgttggacggcggcgcctgcgtcgaaggctgctacgcggcggcgaaggcgacgaggacctgcgtcgcttgccgatgtgcttgaatccagcagcgagattaggggaagggccgcggtagacgtatgtcaccggcgagcttgggggaagtggtgcacggaggctcgtcggccccctccacctccactccggctagcctgtccatccctggtgagagccatcgatcgatgcaggcatgcagcatcttttggagagagaaaagacaggaggaagatgaagaagatacacgcgaaattacttaactacccttgcttctttagtactccatccattccaaaatataaggcataaccaccctaacccaaagaccaagaaataattattattattatcttgtagtttggatcatcctaataaatacaatgcatgcatccaatagaattagaaagcatgagagtgaaggatctaaaaaagtaatattttattggagaagtggtcatagttaattctctacatgtatgcatgccttataatatggaacatctaaaaaaagtggttgtgacttatattatggaatggagggagtacctttctatgctctataaaatcacgtggacagtactactaggtacaactctttctcacccgttagatcaaacgaaatcgatggttcaaattacatgtacgggcaggtaccaagtacctgctggaccgtaaaaattctctaaaactttagtgtcttaacaccccatgtatcggtggccggggcccgggagccccagagcgcgcgaccaatgatgcgcacgagtacacaacagcgaaagcgaagcatgcatgccacgcgcgcgccggcgagcacccaccaccgcagtgatccctcgtcgaattcactctgatccagccgctgccgcacccgccgacccgcgggcgctgctgcctgcacaccagcacgtaaaagcgcgcacggctcgatcgtcgcgatggcctttccctccagtctcgtgcgtgcgtctggccgaaagaggagagatatatcgaccacggcagcgacgcacgcagcgtgctgcttgcatcggcgcacgatgcaccgtctcgtggttgccgctcagcgggagccacactcggatgcgtgtattacgtatgtgtcgctgtgcgcgtctcgtgtgttgctgtgcggtccgcggtggcgtggaccacacgctccacgcgcgcgcaggccatgggcgctagtataccatctttctgttctgttccgctcttccaggtggctagtggcaaagcctgtttgtcttggacccattttcgaaacgctccagatcatcagtgtgagtttgtgaccgtgacgtcccagagtggccacgtcaatatatagtactccctccggcccattttaaacaccactacgagttttcatatctaactttaattgttcgtcttatttaaaacttttctattaatatttctattgtattatatgataataaaacatgaatagtacttgatgtttttttttaaaaataagacaaacgattaaaattggacattgaaactcatatgcgcttaaaatgagacggaggccgcacacaaaaatcttgttggaagtccatatgcatgtacgtaatattcacgaggatttgaaccctagtgggttgagtctaggagtgggtattcggtctgaccaaaaatttcggtttcggtcttcgatcttttggtcatttcactctttggaaagtgaagaccgaatttcaaggcaaaatgtcagaaccgacaaattcggtctctgtcttttcggtctcggtctcggtcctaaccgaaattcaacaatattttcatatatgcaaacaaataatgaaaaatttcaacacaaaaatcacaaaaaatttcgtaagcacgtattagtaaagactcttattaggttgcatgcctaaaagaagtagggatgtgaaaaatagagtttaatcctattgaacttagtgggttttaggttgcatttagatatttttgctaattcggtctattcggttaaccgaggagactaaccgaattgagagaacaaatttcggtttttcactgcctaggatcgaattgatgaccgaatttttggtctcggtctttttctacctacccctaattgagtcatgcacccacgagtccatgacttcatcaccacaccgctggtgcttcctaatagtactactattagtatatctctcctccatgtgtctgccttctttgtgaccccatcgatcgatcgatcgatagctttagagtgtgtttaagaaggaggggattgaggagattggaaagatacgtaaaatgaggtgatccattagcacatgattaattgagtattaattattttaaactttaaaaatggattaatatgattatttaaagcaactttcctatagaaatattttgcaaaaaacacaccgtttagtagttcgggaagcgtgcgcgcgaaaaacaaaactatttttctctctttctcatgcgctcgaacgcagcctaatagttgtgcttcagaaaagtttgtttgaaaaaactagcactactgctactttagcaggactgtgcgtttattggtacggggtgactggatgattgccgatttgccttaaacttcctagtttcctacttctgttgtcgatgagcgattaaccttggccactgaggcactgtaaattgccctagctagatcaggctttcggtttcaaccaataagtttgtcactgcatgcgttcttggcgactcattggtccgttgctaccttttgtcatttcgatagcctttttcatgtcaccgaagagtcaaaggcagtgatcaaacgctgatgatctgatccacatccaagtaaatactacaggtagtagaactcttgcagtagatcagccaaacctacaggtaattttcactgattagtgattacaactctacgcactgatctagctcgactttagttggcaactgtttcctcaagcttctgtacaattaatgaaactaaaatgtgatcctatagcacgatatgactaaacaaagtcaaacgacaaaacggtatgggctggtttggtttgtgctttgtggcctaaatttagccttaattaccaatattggtaattttaatagtgtttagtatcattttgtttgatgctaaattttgacatgcttagaaaaatataccatttcaatagcaaacttaagctattttggctttaatccaaacacaatattgccttgtcaaaattagtgatgctaaaacttgccaaaattcagacattgtttgttattttttataagactctttttgtctgttgggctttctttcaaagccgggtcaatataattaatctgtttcaaaaaacaaaaacttgccaaaattttacattgataaaaattggtagatcaattttggccataaaccaaaccttccctgtatacgctcaaggaatattgctcgatcttcgcgtagtaaacacatcattcgttcctaccaagagtgttcggttaaccgccctatcatcctcttctcattgtcactcgacacaaggcgcacatatacgcacactcgcacatgcaacgcatgaatgttactagcttagtacctttcaacctgtacgcctgcagtaacaataatcttagccaaaaactaaatcccaaaacgagataagagcctggtcatggccacaccgacgacgtccatcccctgaaacggccaactgatagcgtccaaattaagcacacacatgtaaggattactgcactggctagacatgccacaccaccagagacagagacgcaaggatggcgactgtaccagcagcagcagctagctagctagctgcaggcctgagcttagcattcatggcatgaacaataaaatggaacaagtgaggcacacggactgtgcacagcgtgcaaggcaaatgtacttaacagagatggacaccggcccgggtcacagtgtaactgcccagatttcttcttggtgatgtacgagagatgtgtttgttgtgctgcatgactgcatctctccctgtgcatgggtaatgggtgccattttccatgtgcatatgcctcaataatgaatgcaggtgcaattccatggggtccatgagatggtactatatatccgatgttatgtttaatttctctctcccggtcttcctcttttccctgtttacctgcaacacctttccctttcctgcgatttgtttacttgcaattagttgggcaatttgtttattttattactcctacctgtgcacttgcttgtgtaccaggcaaggagtggcctggctggctagccgggtcacttttttaggtgctgatgtgaaattggctggtgtcttggcatgaaggagacaaggacatcagacattccatgacttcataccttcccaaacttccaaacaaataccccaatcagtgtccgtctgtgttctaagcaggcaggcacctttttttgctggtcatgtggcttatctgtttgattagtataaacaaatgcagtcttgatcgagtactggggagtagctttctcacgaactttggctggaggatgaaccgtgggtcctcatgttagtggggctcatctgtcattggaatgtaatggcaatgggctctctcatctctcttcacattagcccagaaaccttagctagaagctcgtgcatcagtggctgcagctccaggtttatgataagtttccagagagaatatacttcaaatcacactgtccgaagtctgataattcacacaacattttgaaaggaaaagttaacggagtctgggggaatagaactagctactgtgtactgctttacatgccctgtttatctcttctcctactgctactctgtattcggtcgatcgatccattcatcatactgttaccttcagaaaaaaatgaaaagtgagtagtcgttgtactgctactgttttgagattccgaatcaaataattccaaaatggacagcataagtccattgagtcctcgatctcacagcagcttaaagaattatagcagtgtactatattggctctactatttttatatgttctccgagggacctgttttgcgcgtctgtgcagtcatatgaatgcattcgaatgccacattttctgccatcaagcaaagctgtaaggcccaacccggccaattatttcacgtccacggtacacacatcgcaatctttcttcttggaagatatctgcaagaaaacttttagtctgaatcaatcaatcagtagccattcttacccagccaaaggccatggcttcagctcaatgctgtccctctgaagcttgcataaagaaaaattacagtaaacaagaggacatcgcttgcaagattagtactaaaaacgaatcaaacgggccccgtatcaaactgaatcgcctctcatggaatacagttccgttgcgtggatgcacgaaagtaagaacaaattaatggcttgctcattccgtcatgtagtacgattgtacgaacgtacaaaccggcagctaattgacaagggaaaaacatcacctacattatatacacatacataatcacgcggggacagctgtcgctaacatgaacagctggtgaacagacatagcatgatgttcaggaaagagtggttcttcagtcttcaccgatgtgtaaagaactatagctagagactaaagacaaagagagacatacatacctatacatatatactctcttcttgtccattgcaatgctagacacacgtacggacacaacatagtttacgtcgaaatcatccatctcggagacgaagctccgggcatttctgcttggtccaagaggtgatcatcgacagtgctctcgttcatccattggctgcttcctgacttgtgatcaggacccgtccaagacgatgcagcagatgcaatgatccaggcaacggtgaaatgccaatgccatgagcgttgccgcaggctatcttgcaatacacactcgatgcccctgtcgtcgcttgcacacatacgcaacaaggtactataatttgaggtttgacaagcagctttcagctccatttccctggagaaacaggaaaaattggtagcaatgtcagctcatgcatgatggtggaatataaatccagcaactttgaattcaacatgcatgcatgcagtacaaaaaagtacagtatgttcttctattcgtggtgataacctgcttacaaaattgttgcgtagacggcataacaactgaataggtgaatgaattgcatgcacatgatgtcagtccacaaaagaaagctactagttcatagttttactaatataattacttgtcctatgcacacataatagtataaagtatagtagtataaccatagggaatacctttagtcagtgatgtaaaagaaaagaaagggtgatcgatttgatctgattcttcaggtcatgggcgagggagcaaaattagctgttggtgcagagaagaggaagacagcaagcaagtaaaaagaagagctcgaaaaggttaggacaagggcaagtggaggtcagtcactttgatagaatggcatgttacatacatacataaaaaaatagaatgctgtaacagatgtgtccttggggaataaacatgcagtagcaaacaaaccctggtttccgtgcccaacgtctgaccgtccgtcttatttgaaaaaattataaaaaaaattaaaaagacaagtcacgcataaaatattaatcatgttttatcatttaacaacaatgaaaatagaaattataaaaaaaattcatatgagacggacagtcaaaattggaaacgaaaattcagggtttgccttttttttgggacagagggagtaggaaggaataatgtctcaaggcgtttctgagcggccaaagttacacacacacaaaaaaaaaaaagagaggaagaactagcagtagtactagcctacaatatgttatagtagcagcatatgaccatgtacctactccatccagtgttccggtgttccctgattccaagctgattgcatcaagactggagagctcatgctcttccaatggccagcttccaatccatgcatagatctagctagctagctaggccatcacaagggtctaaacgagagccacgtcacgcacaggaagccctgtctcctgcttgattattcgtaggcatcctccctgaccagtcgagggtgtactgtttgtcgttgtagcaagtagcagaagatgaggatcaatgatgcatttgatcgtgctgtattcgagtgagctctgaaattttcatctctgatgagacatgggttttggttcgctgctgtttcatggatgaacatgtagaattgagttgagttcaaacaatcaaacgcctgcaaaattgtactgcgacggacttgtttcaaattttgaatggaccatttctgctatatagctgtagtcctgttgattcgcactcgatgtattgttcaaaccatccagggaaaaaagaacttgccattgtctttttataattttgttccaagccgccgtatgatgcccaggacatactgatatgtgatgtggttcatactttaattatgatccatgtcgacagggtcaccttttttccttgttaagtgcagcaatgctttgaccaattgacgtcaccaaaaccatcacttaggccagctttagcagacagggcaatcttaattgtatactagtatattatgcctgtattgtactggaggaaccatgccatatgattctgtcatatgt

SEQ ID NO: 23690 - DNA, 6492 bp, Oryza sativa
gcccaggagttgatgggcctcaaatgcatcctggaagctcagcctcagcatagcccatgggctatataaactctctttgcaggctttcaacaataggcgaacctgatacagagtgtcagagtcacaggaagcacaaactgaagatcacgctcagaaagaatccagtgaggtactgatcgcttaaatgcccatttgttccctcataaataagaggctgaagctaggagcaacatgaactcatcccaatcatatcggtttcatgattcaatattcaaatgaacccctcgagcagcaaatgtaaactaaatcatttttcttagtgttgacaagaaacatcacagatcacaccacaatagaagattgcaggatgttaaccaaacccaggaggcacatcaggatcctcctcatcatcatccccagggcagctaacggcgttgggctcaccttcatttggtttcacttggttatgattctcagtatttgacgactgctgctgctgagttgccatgatgttgctgcgctgatgatcactgaaaccaaatcctggtggttcctctggatcatcatcttccagctggactgcaacagaagttgatgcttttgctggggacacttgctcctctttggcattcctcttcagtttctttgaaggagggtcctgctgctgctcagggttcatcattctattgtagacagtttcagaagttcctcggatatcaatttcatttgataggatgacaccccatatctcgtctgagatttgacccattattttgctcctggttcgaaagcacatcacaataacatatcacattattgatatctagtccggtgtagtaaaaaacaacaataaagaaaaactaaaatgtagttgttcagcttacccgatatcttggtaaatcgcatcagaaagatctttcagctttaacttttcagagccatcttcatttattaccactgactgcttcacctctgcaattatgttgctgcgtagcacctcctgcatgaaaataaattgcagccaacttatacaactacacagcattaaggtcttatctggtcttcagatgtgtgcttctgctaggccagcagtaaatcagagtgaaacatgctaagcttgattaaccatgtatgctggatgtacatataatacacataaacttatagaaacacagcatttaaaacttatctggctcacagtatgtgtgctgctaggccacagtatgcaaatcagagtgaggcacactaaggccctctttgtttaggcttaggcttattggcctagacttttaagtcagcttattggcttatatgatttataagccggtggatttaatgtcctaggtttagtggttgagtcatacatctacctcacataaactaaaaaagcttctccaacctagtttttggcttaatagtgttagagtggcttatggcttcaaaaaagctaaacggaaaagctgcttgtttgtttaggcttagacttttcgacttataagttggcttataagcctaaacaaagagggcctaagcttggttaaccatgtatgctggctgtacatataatacacacaaacttatggaactacacaacattaggacttatctggctcatacctgtatgctattgggccatagtatgtaaatcagagtgatacgtactaaactttcagccttgtttgcaggcaaatcagtatgaagccaagactattataaaaaacaaattctatactctaggatacaactcttttttgcagtcatgggatgcatttacaagtttacagttgtgggatattagtatatatcatgggaacacgtttacagtcacagcggtggggtgctacaaacgtcttgggtactagttacctcttccacataaataacaatgaaggcatgccaaatttatggcataaaatgagactatcttcaaccttcaatggggttatggggcgcttgattcttcaatccattcactgtatccctttcgacacagctctacagcacatttatcttttatttatctataataatccttactatctatataagtacaatccactaattgcagttaacttaggccattcccaacccaatgactaggatgttgtccatagcattaaataagctaccacctaggatgaaagatgatgtgccaagtgaataaatgaggaaagagaagaaaaccaggtcttgcatgagacatggtttctacacaacatccaagatatcatgtgagataagtagcattaaatttaagtatgaaaaagtggtgtttgcattgaaatctagtactagtttcttgatgatgtagagtttatgaaaactatgactagtgtcttgggttggaaatggccttatggctatgaagaagccctcacgttgagccaggtcatcataattgtttcagccattagatgtctgacagcccaacggccacaccatctttaaccaatacttgcaaatttccttgtttttttacacaattagtcggttcaaattcctgcagcaacgccttggttaacccaccagtataatagaaagatatgtcaacaatgtgtaattgtgtatgcttcccaattcccaacaccaaaactagaaaacacaatgctactacaagaaaatttccaactttactactcacatggacaaagtaaaatgactattgaggacgcaatggtttcattggacaatgtaagaatatatggacctgaaacacaatttccgatgatatgaataagctggtaatcaatatgactcatttatgacgaacaaaggcgcaaccctactcacattcatatgtcaatagatgactgtataagatatgcaaggttaccaaacaatgtagtaatgaagtaaagcacacaaacagaagctgcaaaattttcttacgttccaaatttcctccgaatatattatcaagttctaaatgcgttgctacagcaacatacgattggttacattcctgataaaacttgaatcacgtagttctggtaattcatgagaacagacctgctcagagcatatacattcacacccaatgtctaaaacttaacacaagaaggcacattgcagttcgcctgaagttgagataatgcatgatgatctatgctaaatccactgtccccatggatgacttcaggaaaatcgaacccacccaatcgcggctatactgtcagtgaccccataccaaacgcaggatcaacgcaattctcagcgagggtttcaatctagagcgaccccttacagcaaatcctgcggtatacgaaggggaaagtggggagcgtatgatgggagcttacgttgtccttgaccttgcggatgatggcgcggcggagcgcgtcaaatccccgtcgtccttggcacgccccaccacctcagccctcgacggctcccgccgcatgccgagttcgcggagatcgctcatgggagcgcgggggtggagcacggctccgccgcgggaacctgattcaccggcgtacgccgccgccgccgcccttcgagttcgttgcagattggggagggaggggactccgtgcgccgccgcttgcttccctcagaaaattttggggtttcgtcggagagagcgagaggcgagaggacgagaaaaaaaagaaaagaaaagaggaaaatactcacgcggtacgtactcaagcctagtccctcggtcacatcaaaacccaacctaatcaaaatttacagtagaataatatgttatattcaatactaaattggttatttaaggtacagaggcagtacgactcaattcgtcccggtgataaaattgtctacctcgtcctggtgataaaactgtctagcgaaacaacccgtagaatttttcagtttcattggttgacaacattccctaataaatcaaaacagtttattaggaaataaaaaaaattatagataaaacttttatatgtttattcgtagtgacttaaaagccaacgctaaagagaaatggcgttgaaaacatcttaaaatcaactttaaaaattcaaattttgacttttattttggtttattaagtcaaccaatggagctctgagaacaaaagacaatggtggtgtttgaatctcttgaaaatgaagataaagataaagataaagtgtttcacgtaaaacgaggtagtaataacatgtgattaattaagttttaattattacgaacttgaaaaatggattaatctaatattttagaataaatttcatatataaagtttttgcatgaaacagaccgtttagcagtttgaaatgcgtgtcaccaaaatcttcatcttcatcttcatccaacacttgttggagaaacgataaatgcatcagacatcgaattcagaagaaaacacaacgccttcgcaattttccaagaacaacattctatcaaaaacagcacagatatcatcagccgaaggagaaacaggctagtatgatttttcttgtctaggagacacgatgcctcaactggcaatcggcaagcaaaccagatagtactgaagaattcacgtttcaggtcacatattcaatttcatgcgggatacacagagatattcacgatggctacaagctctcatattcatgtcaaatggtagatgctcgcgacttgagagaatcgcaacgcgactggagaaaaatgcaatctgatttcttctgctcacgcattcaaagtttctgtccataacatgagtgaagctctcacggctcaacggctgaaacgctctgaaatcgacttcggtatgaggctggttgtgtttgactgtttctccagcctgcgtcaagaaacgaatactgttaggattacatgtaaacatgcacgcaacatgtgcaaggggaaggcagcaggaagtaagaaccttgcaatctcttcgacagatctcattatttgctctgaacttgtttcaatcacttgtcccccaagtatcatttcatctaaaattgtatgcagctgcatttgatatttcaattagcctaataaaaatagtgattacctttaagcagtaacaatcatcactatgacacttccgttaaaaaaaacaatcatcactatgacacgagcaaagacagttgagatgaattgttgtaatgtttggtattgacgactgagggcagcattaccaaaggtgtgggcttagcccctagctctctctctctctctccgcaacaaaatttccagtgttactttttttttaccatttgtgtactaacaaaacaaactaacttactagcaaaacaatattggtcctctcttgtaaaggaccataagcatgctttatgaacttgacccttttatattcttcaagcccagcctcaatggagcatattcaaagtaaaaggatcaaaacatgagaatcactttaccttgttgaagttaaatacgatgtcaagctcacacacattcttgaagcatctgtccaatgtttcaacaaaaactgtgcacaagataaagttttctacagattaattgatctgctgcaatcatggctgataaaacggggagttaaagtgaacttaacagaagtgaaaagagctgagtagttcagcagctacccagcattggacgaacaaacagtgcatgtttggggttgggatttgaggagtagcaaaccatcaattattgagagaatgctaaatactagtaaatagtaatgtatgaacactgaaactgaaataagtgccacagtcatcagctatgagtttgaatctaaaagaggaattgatataaagaagcgcaagtgacattacaataaacatgtaaaataaggcaggtcaaacaactgaacaagcatgtagtaagatcgaacatgaacataacaattatttttggcatgggagcgtaaaccatgactgtatggttgttgccttgttggcatgtcacatgagtcaaacaattgcagtaactaataaacagtttcatcaataaggcactagattaccttgtacaagatcaagcaccgcaagttcattttcagagctatcaaagacaaaaacaaagtacaatgtggccaaatgtttgtagaccaatttcgctccttgaaagtgcaaaagaaaaggttgaccatcatgctatcatatacaaatcgctaaaaaagttgtttgtttccttgctacagtttgactgacatatagaagagaaacagacaaacagtaaatttcatgaggaagcatgaacttgtacagacgtcagttttttttcctttacttttttttttttgaagaaagtgtttgcaattgcatacagattgactaaaagtctaagatagtggcaggttacataacaaacgagagaaatcaactgacattagagcaaggagctttcaaaaattcctatgtcagttccagcatatgcttgtattttagcaagatttattacaagatcagtcttggagagggttcattaccggtccaaagattgcacaaccttgacgaaattgctgacactgtccggccttgcagacaaccctgcaaaacgtgcttcacaaatcaagcatactacgta

SEQ ID NO: 23691 - DNA, 10774 bp, Oryza sativa
  unsure (1)..(10774): unsure at all n locations
ttggttagagtctgtaaacgcaaatggtaactgaatcaaataaaactgttaatggaatcagattcaagcaatccttaactttgtttggcttgatggtgtaatgaaagccatttcctttattgtgttttgaatgaatacatttaacggtagtaagattgcatagcatacaaaatcttcctacaaagttttttttttttttgatctcaggcaaatttcattacccggctttagagaaaagcccaaaacagacagagtcttcctacaaagtttgggtatcaagattatgtgcatgtacatttttagatttgagcgaatacaaatgtgagatttatctacaatgatgtacagaatacaaatatgtagatacgcaagaacagaaaacatgaaaaacatcaacagataaagagaagaaattacaccagcaaaccaaacaaagtcagtaaaacagacggtttttagtcgtaaacctgcgtgatccagtcgtcaggcaggaactccgcggaggcggggcggacggcccacctcacccccccccccctccccccggctcgccgaaaccctagcggaagctccggcgatggacgagtgcggcggaggcggcgctgctgcaaatgtggtgcccggcggctgtgcagcacaacagccgcagcacgcgctccgccacgaggacaatcttccgcgcgcgggggtggggggagcggcgccggcgaagcggagagcttctctttagatcgtaacagctcgccgctcgcgtcgcgtgtgtacaaggaaggggaaattgtgggggcaatgataggttaacgcgttcatttaaaatttgtttcaacgctcaaacactgagcgcctgtagctcagtggatagagcgtctgtttcctaagcagaaggtcgttnnnnnnnnnnnaggttcgacccctacctggcgcgtattgtttcgttaaccaattttattttttttattgttttgtaatatatgcgcgtattgtttcgttaaccaattttttttattgttttgtaatatatgccaaagactaccttcgatgttaaataattttagtttgtattttcctagtacaagatttcatctattttgatttggtccaacacattgaacaatgtacagaacatggccatctaggtgttagcaatttcatcatttgttgattacgagtcatggcgcttattaggaaaaaaaatgtgtaaaacttttatattttttttacttaaaaactacttggaaaataaactgagataaaaagaattatcattttttttgcgagggagaattatcaaaattaattgtagtgtaagttttaaagtttaactagctgggtgacccgcgcaattgcgcggctagcacacatacaaaatttatatatttttaatctgattttacttcaaatttattaaatagctatctcattgtcttaagattttaaaaaaccaaaccttatcatccccgtgttttctaattttatagttctaaaagtcacaccagttgttatcccttacttatgtcatctcattttttatttgcttgctcgatctaccacggtttctattcattttccttggaatctataaaagttggattgtatagtttttagagtttattatctcgttgggttttatttttataatttctagaagtctcgttaaacgccgctattatacttctctacggtccgtccacttcctcttctctttattgtcattgagattttaaaaatcgaacataattatcgtttgtgttcagtttttttactttctagaagtcttgccaaaccatcagcggctttgccactgcactcctctacggctcgcccgctgcatgcactcctcaacggatcgcctgctgcatcccttctttattgtcattgagattttaaaattgaacatgattatcattggggtttactcaccttgtagttttaagagtttattgtctcgctgggtttcatttttctctaatttttagaagtctgatcaaacgttgacactatactcctctaaggttcgtccaacaccaactctttattatcattgggattctaaaaattcaaacataactatcgttaaaattcattttttactttctaaaagtcccgccaaccgtcgacggctctgccactgtactcatgtacgactcgtccgctacctgtcctttttattgtcattgagattttaaaaatagaatatgattatcattggagtttattttttttactttctagaagtcccgccaaccgccttgatcggttgcttcacggcctgcccgtcgttaatccttttaatcgtcattaggattctatttggtgttttattaatagttttagatgtcccatcaaatgccaccactctactcctttatagatctgttacttaattaatctcgttatatgttttagatgatcttttttttcaatagtctttattttttatcaccaattttagttatttataagttgtcttatttttctttttctaatttcagaatttattttatttgtatatcgaattttaattaatattgtattgtgttcttttaatatttttatttttattttcaaatcaagttgtttcaaaattgtattcgtacttgaactttctttttaatttgtctaattttggattttttttattttatacttaattcaattaatctcgtattagattcttatatggactcttctttcaatatactttatttttaatttcgaatttaagttaattttaaattatatttctacttaaactcttattttcttttcttttttctaatttccaattttaatttactttttattcctaattttaattaatctcttattgggtttttatatcgactcttctttcaatattgtttaattttaattctgaatttcaattatttttaatttttttttctacttgaactcttcttttcttttttgctaattttggattttattttattttttattttgaatattaattaatctcgtatcgagttattatatggactcttctttcaatagtgcttatttttaatcccgaatttcagttatttttaaattgtatttctacttagactctcattttgtttttcttcgattaatgtgggaatttctagtccccacaacgaacatggtgtctcctttgaaagagataataaaatatgaatagtattttatgtttgacttatttttttaatattttttgaaaactcatgtttgcgcttaaaataggatgatcaaagttggacaccaaaactcatgtttacgcttaaaataggatggagggagtaaggactaaatatggccctgtttacattccaacttttttcttcaaacttccaacttttctgtcacattaaacttttttacacacacaaacttccaacttttccatcacatcaaactttcctacatacacaaacttccaacttttccgtcacatcgttccaattttttcaaactttacacaacatatattgaagaataattgtattggtagtctagatgtggtgtttttttttccatctgcggccagttttatggtatgctagcttctggattttatttggctgcaagtctgaatgcatcaattaaattgggtttgcagtggacagatctagtgatagttcaattcctttttcacttcaaaatccaaatctacgtatgtattgaagccatccgtttgatttatttttttctatttggaatccatatggtattcaatttttttctttcccccaatcggacaacatcctagccaaatacaataaggaatcagacatgcatgcatgcatatttgtgatgtacctcaaagatcagagttactttcctatttgtatcgaatagagtttgattcatactgagagaacttttttctgataaatctacaccctttaatttaatccattacaatctaatggtatagattttttctctttttctccgattaatatgggaatttttagcccccacggcgaatgtggtgccttcttttcgagctgtcttaataatataatagatagatttttagttatggatgataaactaaggagcagaccgatgcatgtttacagtctcattttgcttattggagaatcagaagcagtaatagattttttgtttcccgagatatggcggagatcttacatatcactatcaacaaaattgttatatgtggcaggaaacagttgatggagactagtaagactaccattaccaagttcaagatcttaaacactaggctatacttcgtttgttaccagccacctaaattcatgtctttgtagtttgtaacatgaatgctactggatacattttcagccactttgcaaaaatgatatcgacatgtcagaaacacaaaccacaaaaaaacagagaaacaacaaaatacacaagtggtttcatgtcctttgtgtgtgcataggtggctgtaaacgaaatacgtatgtgaagctaaataatagctgagatgttggattcgatgttttgccactatttagattgggcaattgaacgcacgttaaaaggccccaatcagttacatatgggcatctgttcacagttacacattgagaaattaaataaaaaattgccatcaaaagcaatttccattttccttcatggacaactatatattttattatttccttttactttttcgaatggcaactttatatttttttttcttctgggctgccaaaagtaccaaacggaattatgcagtcatgcatgaagaggtgttttttggactttcgtgtgcaatgtgtgaggtgtcagttgagggatttacggggctcaattccttggagaaataaattcgtataattgagaggaaagcctcttttcaggactactagtccactgttcgtctcttccttagcatactgtgtgcataagtgaagaggggaagggggagccaggcatcttcgagcctaggagctcaatctggtaaggaattatgtccttgcttagctctgtgctcttcgatactgttcatggaaacactacgcaggattccttgtttgggagatgcttcaggtgttcagtgttaagtcagaaactggaaatcaaatttcttgttctctgattccccaaaatcttatactctgtgcaagtggggatcatgattatgattacattatgattttatcatcctcttcttccccgttccatcttatgcaggagtatgaaagaactatcaaattattcagcagtacttcatccttagtttagaaaatcaaaggggatttctaaaaggaaccttaacactgcatcctaataagttcttgagttgtttgcgagtttgatttgcttttgttaaataatttctagttatgattcttatcattggggaaaaaaattcttccatttatgtcctgtatgcagaattcatcgtagttcttgagaagtatccggtatctgtatgtatttcatattcagaatttagcaaggtgttcgtccaagaatctatcttctgctcctatgttttgtatgaataggtcataggttttcattttcatccgtcatgtcctatgtagaattcataatacatgagcagtatcagtgtcaatgacttgcacagttgtgctcggctgaaaaatttgtcatatggtgcagttcatcacagatgcctaaaatccttccattttaacaccttttctttagtttttgattgttgcagatggaatacccaaggacactcacttcctgaccgctcaaatatcccatccattccatgctctgatgtgagcaactcggttccaagaatcttggaaacatggggaaaattcccggatcagcagtcgccatggccacgccgccggagccgtcgtcttggctgagcctcaaggtgttcttcctgagggtgagcaggtgcgaggtgaacgagtccatgctggattctgtgaccgtcacccacgccccgctcaccccggacaccgtgctcgaggtgagcggcggcagcgtcgccagcaacggccacgtgtcgctccgcctggaccgcgccggcggcgtcggcgccgccgccacggagggcggcgactcctgcaccttcgtcagcacggcggacgtcagggtgtccgggagcgcgcggttcgacgtccagtgcagaggcgagcggctcgtcgtcgggatcctggacacgcgcgacgccggcgctggcggcggcggctgggtgatgaagtgccaggtcgcggcgcagcgcgggtcgggcctcgtgaggcgcggtagcaaggaggcgaagccgccggtggtggaggtgtacgtcgccggcctggcccgcggcgcgccggtcgtcttcacgagggcgatgcagctgcggttcaggaggcggcgccacgtcaaggccttcatggagcccatcccggagcacggcgagccggcggaggactccaaagaaacgctgcctccgaagcatgaaaccgaggtaaaaaaatcccagcattttctttctctccgatgaatctccgtttattttatcatcgtcgatttcttgaactgaaatgcttgagctgcaccgtcaatgtaggtgtcggagtacaggtgctacaagccggagcaggacgccggcgacgccgactacgacggcttctacgtgaagcctgcaggcgaggaagacgacgacggcgatttctcgtggttcaccgccggcgtcagagtcggcgtcggcatcagcgtaggcatctgcctcggcatcggcatcggcgccggcctcctggcccgttcgtaccactctacgtcgaggagcctgagaagccggctgatctcgagtctgttctgaacatcaacattgcatcaagatcactgtccatctcaaaattcagatatccctctgttggagatggactagtccagtgtgtgtgtatatatccttgttagtatagttgttactaccgtcgtagatagatgagatgtgctatctttggcactgttggttcactggtttatacttatatgatcaggcattgtcaaattgagaccctttcatatctacccagatcgatcaatcgatgtcattgatcactagtgcatctagtctagagccctatgttgttagactaatttcatttgaagattgcacaagtctattccgcacggttattacttgatgcggctattcttgaagattgtggcgggcatcgccggccggcggccatggcggtctgatagtcacatcgctggggagggacccaacaggaatagcgggaaactcaaggggctccaccggaaaactcatccgaattggtaatttggtatggatcgggcgatgccgtcgctagcaatggtagcgacccaacacggatgggacaagacacggcccatcgttgtttgcggacggcaaggggggaggcgcgccatgttattgggctcgtattcggacactaatacgaaggaaaagtacaccgaaggtccctcaacttgttgtcgagttacaaaatcatcccccaaccgcaaaaccagatatccgacgtcccttaactaatcaaaaccggtgacaataagtctttcagtagttttaaccccggttttatcccacatgtcggaatgccacgtcatctctctcccctgttctcttcctctctctccgcctgttgagcgcgagcgtgaggctctccagtactgagctgcaggcgagcaaaagtgggggaagacgtcggcgccgcgggggaagcaaccgctcctggagcaccttgagggaggatggtagctcgacggcctcaagctcaccggcagagtcggaggagagcggcacctccgtactccgatggcggcgcggccgccttcgaggaaactgccacataagcgccacgtagtatgccacataattgaggagactgcacactgaaactagcccatacgactctttgtgggccgaaactgcccagttacgcagcccatgccgtcgagctgtcggcaaattgaaaacagttttgctagcattgaaaactataataaatttgtagtggcaaatttagacttttcctcagcggtcaagcgggcccacatgcagtgacggagagctcgtattagtggcctccctcaatctctgtgttcacgcatgacagccgcatcagttgccgcgctccaacgtatataaaaccatcacggatcgttcaagttgtacagcaccgtcatcgtggatggcaacgcgcgtcgaggacgaggaggaggcggcggcggaggagagagcgcccgccgcggcgttgctccgccggatcatggcgcccatcgcatggagggcggcgcccacggcggcgtcggcgtcgtcgtcgtcgtacctggtcgccgccgaggccggcggggtggagaagatatccatgctgtccggatacgagcgacttccgagcgtgtatggcacggcgttccacgacgacgacggcggcggcgcgtggtcgtcgtcgtcgtcgccgccggcgtgccctccccgcgcggccaggctgctctggggggcgctcacccgcgccgtccagaggcctgggaggtgcaggtgccccggagacgaggaggcgggggtgacgacgaccaaggagcggaggcggtcgtcgtcgtcgtcgtggcggccggaccccgacaggcggtggccggtgcagggctggagctagccgtatttgaatgtatttcttggggaaatttgaatgtattttctgttggtttgatgactgttcaacgaaattcagttgcaaatatgaacataaattacgtcgcaaccgagactgtggttagaccggaacagaggccgaatctacattctgttcgagcccatctcttccatttggaagcccatttcagaggattgatctgctcaagcaaattgcgcgggtagatttctgcagctcgatcagcgaaatgcttcccatctactcgtcccgtgaatcttaccacgcaagttggcatgtgtacatgtaaatgttcagatgctatgctttaccttgtgacaaagaccactgctactcctgcgcaatagcgcaagcttcgctttgaggcgtgagttacagacttacagtaatacagtgcacatcgagagcaagtgttgccatctcaaagagaaataaaaggaggtgtttacacttcacagtgtcaggtaaggtatatctcaatcagaacattgctatgcttttcattttcttagctacaatctccctgttcttttccgagtgttactacatgataagaatatgcagctaatagcaaagttacaaaaagaaagaaaagttacaagcttcaattttgtactacctacagtaagcagagacctgtacatcatgaattgattatatgagtgttagtactaatcaaatgacactgccaaaatgtactgacacccacagtcacaagcttcaatctgtgagttctgaaccctggtaaggaatatctgaaactgacctttcaacagcaatgggcttttgacctgtggatcccaggatttcctcccagcaactgccagtacaattgtgcagagagacgagctagcacacacgcaattaaatcgtggcagtacgattcaacgagcggttaagtgttcaatttacgcagctgttcctgtcctacgggtgagcatatataggtgtccgaggccaaggggattggagatgcccaataactttaggaatttttttcattgctcactgtccagatccaatcaaagcactgaaggctggggaacttgagacgtcaagctcaacattgattcggttcaagcccctcataatttgcagatatattgggggggtgggtatcgtgtcatctctcaaggaggttactcgttttgggagttcgttgggggtgtgtgcattcttgttggatatgcacagcatcccaaagacacggacaccaaccgatcgatgctgtgatggtttgaagctatggattattgaaaatttatagatttgccggcgtgtgcgtatttttaatcgcttcttcattcttctgtttttattcttgttcgggcaagattggtttgccgatgctgacggctgaccgccaaattaaacatgcatgataatgccaaaatctgatcgttttggatgcatcctgatccatgtctgcctgctcccagaacaaggccactgcaaaactgaagatgcccacaacgaatcaaagggtaaagaactaaagatgccaagaatctcttgcaggttgcagctgctgcctttaccctgaagctactacacagccaaggcagcaacaaagccaaaaccaaagcaagagaccctttcggtgcttatctactgactactgtgttgctgtgcaaaccttagctgaccaaacaggaagaaagaaatccggacgatcaaacaatctgacttgacaacagaacatccctgtgcgatgacaatgcacgtacaactacaacggtataattgtccttacttttctgcacatgatccgagctagtacgtacagtatgtactagctgggtacattgttcgatcgatcgatcgagcgatgagcaggcaggcacctcaccttggtgtaatttaattcgggggctgtacgtgttagctcccatttcgcatcacagcgagtagctgggctaaagtagtggtgacatgatctctccgccaacgaccagggatcagggatcagagatcagagaggcagaggccatgcatggccgcctctgcttaattgcgagtccacgcacggtcatttcagcccttatttggatagctgaaaattcaatgagattttacgagacaatgtgaatatgaaaaagcttatctattcagcttttggttagtttatttttacagttttataacttttgattcttccaatcttg

SEQ ID NO: 23692 - DNA, 11854 bp, Oryza sativa
atttgagttcttaaatgatggttgtaggttcctggtgtcaaacctgatgatgttattggcacactagctgtcagcagtgtatctgcaggctacaaggtaataaaactttctactgtgattatttgtgaacattttattcatgaattgttcttcaatattctcaatggatatttcataagtatctctcttcatgaatcgttctccagtgccgtctttaatctttcacatcatttacaaaagttagtacttataaactgctgaggtgttatagattcactgaaactgtttttatttgttttgaaatgattgatattttgtaaaagttgattcataactaacttttccaattgcacatgacaaaactgaatgtctggaattaagtcataggtatgttgaattttgtaacaaaaatgcaagaaatacagtgtaactaaaatgtgatgccgttgcagtgtgttggatatgatatcttattgtgtactctggtccttatttgaaggtacggattgtctcccctgataaagacttcttccaaattctttcaccttctttacgtttgctgaggattgctcctcgtggttctgggtaagtgtacttggttttttttgcctttcttgcatgcttactggaatactctaatagctaatcgtttttatttggacatggaggatggtttcatttggagttgaagactttgtcaagagatatggagcactgaaaccatcacagtttgttgacgttgttgcgctttctggagataaagccgacaatataccaggtaccctttatttctattgtgccttatgctacacatctgttctgacatccattcttctttcagactaatttttgttggtagctatgaaaactatgagagaaaggatactaaactttggtctgcattgggttgtatttatttatttatttctcgcaataaattcttgtgcttggctacctttgtttttcttgtccaatatctttcatttcagctctaaaacagaaaaatggaccacagttgcacacgattttgatgtgtcaaagtatttttaagttgataatgtgatagaaaataaagttcatacactgtatataatgtgcttgccgaagaaaatggtggttgcatgatctatagacatagtgatttcattttggttcttctacctatttatttattatttattatgtgctgtaatcttactgtttgataaaaaccttaaatcaactcatcaaatatgttatggaccctatgaagtctactgtcccccatctttttaaggggaaaaacatgattctcatgtctgaaaattatttcatgttatgatatatgtttgtacgttaccaacacttcaccagtgcaatgcagattcgtaagctaattttctatatatggtagtctatcgaccaagttgtttatgatgtgaccggaaccatgttctttttcaggagttgaagggattggagatattaatgcggtaaaactgataactaagtttggtatgttcttctctttaaagtttttttttagattgtcgccttggtgcgaaccactcgagctaaacacattctgttctaataaaggactgcttgtatacactcaaactactcaagattgaaaagttcatgatttccctgtgatcaatctacctgtttagtcttggttattaagttctactcccctaaaaaatataagtagtttttagctttctcaagtctttcctaaatgtaagtcatcctaaacttctagccaccttttactcctccctttcttccgtgaataattcacattattcaatgtggtataagtaaagggtaacaaggtcgtttgatgtactttattatccctgtacataaatctagaataacttatatttggaatccaagtattctatgttttgagtttggaaatagtgggcatattagctgtcctgataatcctgcaattctccaaaagttataactttgtcattttattggtactcacataggttccttggagaatctgttgaaatctgtggatgaagttgaggaagaacgaattaaacaggtatcattcttaatattatacattagatgagatatcccctcttcgcatttatcagcatgcacttatgcacagaaatgccaagatacagaaactgggttgcatgacgcttttgtttcactagaacagcgcaatacaatgaccccattaaatggcattgatattttaccctttagtataatatgattatcttcttgaatgttgattgcacatactctcttgtcaaatatatcattttttatcttatgacttctcaaatggttgagcaaatcatatttggtgtggtcctttacaggctttgatatctcaatctgaacaagcaatgctttgcaaaagcctggtaatcttttttttatgttgctcaaaagtcctttctattgtcttgatgaatcatgaaatgcaatcatcttccatattatattgtgagattctatctcaaccagactcttctcattgaatttacacttcttgtaggccacattacgttctgaccttccatcctatatggttccttttaagacatcggatcttgtgtttcagaagccaaaggtagcaattgtagcatcatatatttatgaaaacaactaaaccattactaaagtttgtccctctgattcctgcttacactgttattcttgcccgcaatgcttcttcaggatgatggagccaaattcataaaactcttgcgagctttggaagcatatgcagaaggctcgtcagcagacctaatcataagaagagccgcctatctttggaacaaacttaactcatgactatgctgatgtttccagcagtgacaacatacgaacttttcaagcacaaaagttccacctgagaagataggtgccttggtgctatgtttctgtcaaatttggtgcgagcggctcgctgtgctttctggcacaaaaggtggacggtgcatgtttagacaggctgtgcataccatgaaactgataattagttagttttgtagataaaagcacgtcatggctcatgcaatctacagaacatgatattttttacactctaatgaatggtggctgctggctggaaggtggaagaatggcatgtaggtacctgaaagcttaatcattcgattatgtgcaacttcgtagaaatattatctagtgacatgtcactattcatatgcacaatgataccaagttggtcacaaaagtatgtggagtacgtgtcttttcctcttagcaggtgacgggtacctagtacgtatactcccttcgtctcagaaaaaaaggcaaaccctgaattttcgtgtccaactttgactgtccgtctcatatgaaatttttttataattcgtattttcattgttgttagatgataaaacatgattaatattttatgcgtgacttgtctttttaatttttttcataattttttcaaataagacggacggtcaaacgttagacacggcaacccgggtttgtctttttttttggacggagggagtgtacctacgcagccatctacttgcggactaaagtcaccaggcaaagcaacactccaagccaaacaagccgacgcacggcggcgtcagctcgccgcgaaaccgcgcctgcggggatgtagcacgagctggtctgcggcacctgctgcccctgcgtcgtccccggcacgccggccgccgtcacacagtaccccgtcggcgtcatccctctgctcggctgcggcgtgttctgcaaaaaccaaaaaaagacatggagatcagatcagggacgtccattccattcgatccaaagactgcaggcagaatcggtaggcaacgagcatcgatgaaacctgcaccgtaactggagtaacggtggccggagccgccgtgccgggagcggcggcgagcccgatgtcgtagttcgccgtgaggtcagtccggtagaggccgaacgaccgctcggactccggcccacccttgaggtcctcgtcgtagagcgcgaagaggtacgtgtccaccgatttgcctggcgtccgcggcgtgccgacctgcgacttgaggtgcgcgacgaggttgccgttgtacgccctggcgttgtccaccgtggcgccgccctcgtcggcgtcgcccttgtacggccacccggtctcggcgatgacgatgtccacgccgctgtaccccttggcgtccagcgccgcgcggatggcgtccagctgcgcgtcgaacatgttggtgtaggtgagccctgacccggcgtcgacgcgccccgggttcggctggaacaggcagaacgccagcgtctccggccgcgtgtcggaggcgtaggcgaagtacgggtacgggttgatcatgaacggcgcgccgttctgcttcaggaagtccagcaccgggtccaggctcccggcgaggtcggcgtggaacgcgcccgacgacggcgggtccgacgacgagagcaccgccatggaatgcacggtcgagatctgctagtcaaccgcaaactcgttcaagaaaccaccgcgatgcgtacgtagagatgctgtgatgagatacgtgccttggtggttgagccggcggggagcgcggcgaggaggttctgcatggcggggaggagctgcggcgcgagggtgggatcgccggagttgagcagctcgttgccgacggagatggcggagacgggcaccgtggtcgggatgttcgcggcagcccaggccgacgctgccgccggggaggacgcgaggttggggacgtcgccgttcgggacgccgaggaggatggagatgttggagcccgcgagcgcggcgacgaggtccggctggggctcgtagaggcggaccttgccgatggacgtcgacttcagcaggttggccgtcgacgccggcggcgggaggttgtcggctatcgtcccatagttcactccgatgaacgactgcgacgctgcaaatatcaatcaaactcgcatgagaaatccaagtttacaaaatttcagcaaaattcatttcacatacaaattcacatggccaacgctgtcgcaaacttcgtacgcgcagcatctgctaataattacttaattgtcacgttaagcatatggcagtggtgagagcacacgcaaacgtactacctccagagcagtagttggatagcaacaggacgagctgcgttgtacagctttggcctctttggggcagccattatctgtcaaatgctgccgggcgtgaagcgtgatcattgttcctctttgtttggccaatggcgagagctgttgcctgttggtcaagttcgaattattctcccccaaaataaagcctccaactattctagcggccgttaggtgatggatcttgcgcccacgagtgttggctcctatgctttggatatttgatttggtatttgctagattccttgaccaacccttttggtgtactcaatgcgaatcgttggtaaaagtcacctcaccaggccaatgtaaattgagcatggttcatatgcagctagcgcagattacagttcatgccaagttgctctgttctttttttctttttcaaaaaaaaggaagagtcaacttcgggtctctgcaatgtttagctacaaagtcaacagccatagcacaacggcttcttaccatttctaccgtttgagaataaagcgttgaaaaagtctgattaatcctataaagtatggaacaaccgggtaaattatctcccaaaagtatgaaattggttcaaataacctgtagagtggttttggccaccgggaccacgacgaacacacagtgacatgaggatgtaattgattaaatgcatttttactcctaactatagcggcttaggaaagaagtaacgtgatcggagaaagttagtgattgaactattcggctgaaattggttaacgtgtctgtcatgcaaacaataccactcggtcgcatcaccgcctaaaagaacacttacaaaccatcctcacatgtttctttagaaaataaaaaaaacttccaaacaactttgatatgttgtttttttggaacacggtataaacgtaaatattcatacacatgcgtgcacttatctctataaacatatatatatatatatatatatatatatatatatatatatatatatatatatatatatatatatatatatatatatatatatatatacacacacacacacacacacatacacacacacctaatatcatatctctttaactagcttaaaagtacctcccagaaactatagaatactttatgtggaacgcttttcgtactttaggggcacaataaccgatttcatacgttatgtagactgataagtgctttaggtattaaataaagagttttctctaacaaacaatatatggtgttctgtataattaaccgtcgcttttgaatgcaatcccaaaataattcctctctttatctaggcgttgggaatatgatcaggagtcgtggcagagaaactccatttctctccccactttgcccctcgtgttggcgaaatctcaatttctcggagcaaaaaagtaagatctcatcaaatcctccccacctatttattagaaaaaaaaatgtgccatcaatcgccatcttctttgctcaccattccggaagctagaaaaggttcggtaactcggcacgaatgagtaacctgcatccgtaaaaacgacgcagaatttcgtcctaccacttcgctgaactgactaaagtattctagtgcagtacgctaattcgaggaacaaagaatcacaacgaaagtgaagccattgttccactattccaaaaccgaactaagctaaccagttaataagcatccagcgagcgaaacatgatctgaagatgattcggtgataccatttcatctatctatctaccaacaaaatgcaaaaacgaaatcaaaactttcaccgcgataagaaacaacaaggtagcatgtcaatgatgtacaagaagcaacgaatcactggcacaattcgcaggagacagcttgagtgagaaagaagcgctctagcgcggaaagaacttacttgccaagtggaagaggagcgcttgcagcagcccagaggtgacagcagcatccagccacctcctcgcccccatgccaccactgccagccaagctactagcaacaagaatcctactgcttgatgcaatctcgccgcagcttctcagatgttcgagtccaattatggctactacttgggatcagtgaaatggtcgaagactcaaaggagctcgagtggcaaactggcaatgggagaggcaaagaagaagacaaggaggaaagaggccaggaaggaggaggaggaggcgagtcgtcgatgcagtctttggcccccttgcttgctgcgtaaaataagaggagagaaagcggcggggcgcgaggtgacaccgtggggtcggcagcacaggacagggacgacgacgacgacaagggttgtgtgcgggagaagccgcggtcaccgtcgcctcgcctcctttctcgcggtgcctgcctctgaccgcacgtctacacgcgcggcgcggcccgccaatgcgttttttcccctctcctttggtgcgtcaactcgccgagaaatacagccccggcatataagaggaaaaagcgaaacggtagtatttacaaatgaaaaataatttgtaaataaacttttatatacgtgttcttaacgatctaaaagcaaaggctaaaaaataagcaacaataaaaaaaatcccaaaataaactctaaatttaaagttgaaaatttaaattttagctgataagcacaagcataaagataatggtgataagcaggtgagccgtaagacttgtttagaggagattctgatagctacaatttttttttaaatcatcgcataacataattttctctagaccgtctaaattttcacttagacttttagaatttatagttgtagaaaaaaataaaatagaagatagaagctagagaacccatttttttctcaccagttagtttaatcataagctttaagaataaaaccgcagtgtggatcggcacagcgaatagtggctttgatcagggaagggaacggaggcgatacatcgttctcggttctcgggtgtacttgcttctatctttttcgtgaacgcgtaaaaaatgtgcatgtcaatatatcgtcgcgaggatggcccgtgacgagtatgtggctgtgcggttgtgccgtgagcctgactcgcgagagcagatcagcgtcgtacctggaattttggtttcgggaggtgatgggattttgctgtctgtcaacaatctgtcatggacgttaagcaggattgcatgagcgagcgagtggcgaatatgggcgagtcgtgttgtggcgcggaaacagccacacgggtggttatcgtcgtaattaatgggtatactaatcaccggtgctcatctccaattattaagccgctggcgctcgctgagtgaggtaaagcgattccatatgccataatgccacccggatcgtgatggggatgatggcaaatatgggaagaaaacagcgtttcacctcttgttcatcattgccccggttaattgcagtagtatgcacaagaagctttgacctgtgctgctgacaacctcgtatgagtgcgaatgctctcctcctcgtcggtggttactggcccgttgctctatcacaagttcacaactcacaaattaaacacaccatcgtccacaaggcagagcaaggctaccaggccaccgtgtccacgcgcggctgggtcccctttgtcacggacgcccgcggtacccacggcccacggccacgggggatcggctgcctggccatggtggacttgggcgtcctcgaattcggctgagttaagtggcagtgtctgtgaagagcatctttttcatccttgaaaaagtaacatgaggtaccaatctaatctaaccattgatttagcagggatatgatcagtctaataaaaacagatgtcctctcttcgtcgtccctgcccatccgtcgccgccgtgcatccagcccgccgccgtccccctcgagctagccgccacgccgctgctctcccgacgtttttttctctcgtgaaacagaaaatgacataaattccctcccacccatagtaccacttcaatgagaaggtacggtaccatgaggtacggacgatttctgaccgttggatgatgccagatcaatgatcaagatttggtactccataacctcaataacagtaaaaaacctcttctgtgaaattttcggggacatgggcaattggccaaatggctggctggatgactgaagccggaccgagtaggtctctgtccgttctccgagcctgcgttgacgtgttgcgtggctgtagctgtagtttaggcgatctgtttgctcggattatcgagatggcaaaatgggaaccatggtcaggccagagtcggcgtgtctcgcggcagcatccgaaaatatagagcacttcaagcactactggagaaatgatctttaccaggtcgaggaaaaaccacaattgtcccggttcataaaaaacagggactaaaaataatttttagtccggtttataagttcaatgggaagatttgatctatcaaccgggactaaagatggcaaagatggtgttggacgacacgtggctgcgccatctttagtcccggttggtgttttgtcccagttattttaaccgggagtaaagatggacatctttagttccggattcgccgtcagtttccaaccgacgttaaagatgggttccagcagtgaagcgttaaagatgggttccagcagtgaaggcaaactaggcaaagtgtgtactatggagtgatcacacgcgcaaatagcaagtgtgtggatatgtgattcacgtttatacgtaagtaatttaagcattacgcgctgacatcccatgtgtaggtatgtatatatatactcagggtaggcgacttcagacagaaactgtcaggggcaatgtacaagttgtaaatagacacatgtggttcatgatggctgagggttttgtttcctaaataaaatagggagctgagaactgtttgtatcgggctaataagagcatctccaacagtctctacatctcactcttcaagttaaattttaataattctaataaaaaaacatgctccaacaacctctccaaccggatggctaagccatccgactgaccaaaacccttcctccactagccaaatttagccactctatttggctgaccaatggtgggccccacacatccagtcttctctatccccacacggcaaccaatgaggaggcacaagaggagcatgaggaggaggcatggggaggagctcgagcacggcagccgccggcccccgctcgtcgcgaccgccgacctccgcactcgccgtcgtcatcatgtcgcgcgtgcctatatctcgtcgtcgccgccttccacctctcgcgcacctggatctcgtcggcgccaccttccacctcgccgcgcctggatctcgtcgtcgttaccatacacctcgcgcgtgcccggatatctcgtcgtcatcgcctctcgcccgcccggatcctcgtcgttgttgcctcctgcctcatgcgggcggatccccgtcgccgtcgccccccgcctcacgtgcgctggcgtcctcgcttcagagagggccagtaaggagctcgaggatgggccgatggggttgccctagcgggaaaagaggaagcaaggaagaaaagaggaagaagggcggtggaggctgacatgtgggttccattgtcatagactcaggatgaaaagtacaaatggagagtctattggagcgaggaactagtttgacttgctaaatcagataaagagttggctatatgggtgtttggagagccggattttagtagtctgttggagatgctataaggtcgacaggtcgttcatcaagtcttgcacccaatgttcatgtgaattcagtcaaaaatgtgtactcacaagtcacaacgtgctatcggaaggcattagtgtatcctctgaaactgcgtagtacgtgctctcgtgcaagcaatcatgcatagcatagtgttttcaggtgtaggtgaagtaaaggagtaaaggactcattctcatgctaatacaaagatcgtcagacctctcgaaattagatcacatttatagaaaaaactacaacgacatctacaatctcaaattagtttcatcaaaattcaccataatataaagtatatcttgatggtatattttatttggtattatagatattaattatttttctattaacttgttcaaagttaaagaactttgactaaaaataaaatcaaaacaccttataatacgaaatcaaaggagtatttttcagctacttcaacgtacggattattaacatggatcatttgctccataactctaaagatatgtttccttagaaaccttcttctattgcattgtttagatcatttattttaacctatttttaggtcttttttctcaagacatttgatttcttcctataatcaaatacgcaaaatctatttcgagaggcatctcgatttatacttaacgagcgacgcggacaattgcgtgagaagtactagtagcgttacagacatgcatgcaagtagtttttgctattaggttgtccatattttttttcttatgaaattttctcttaaattacttattcgatctataatccgattacaccgttgtgttcataacaattaaatctttacaacaagatctcacatgattatattttgatgaaaaatcacaaattacttttatgatatgtctaaattacttttagatttcactaagttacttcttagacatacaaaagtaaattcagtaaagcctagaagtaatttacatatattatagaagtaacttagaaca

SEQ ID NO: 23693 - DNA, 19259 bp, Oryza sativa
  unsure (1)..(19259): unsure at all n locations
catttattgcggttgggctgagcgtgtcacgccgtatgtaacgcagtgcagtgcactcgtttatccggtctgtgaccagtcacagaccggtcagatcgcgggttaggtggcaacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggtgagcatgtaggttgctaagctgacacgtggtggacaagaatgaccgacgtgactggtctgataccggtcatgtcgtcagcagacagccacgattccacgtcgcgcctgcttccggcggaagtggaggtagttgtggcccgtctcatcagaaggtcattcggacagcaaccatacaagtctccgtctgtttatgaaaaggtggggtaagtccccacaaaaaagagagaaatggtgcatgtggtatccccttaagatataaaaggaggaccttgcccactgagatgggggaggggactggacttttccagattagaaacccagaacaagggagaggctggctgatactttgtagctccttcatacacagatctcccaaaatacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcaggtgcgttctagtacaataacttaacaatttagtattttgttgtattaacttggctaagtatatcttaggtgagtttttttacgatgtcaacatgccattacatagtaatcatacggatattaccttatattgaatttaatatttatgaattatactgcacatagtagtacaatttacatccaattacctttaagatttttttttcttcaccttctcaattatcaatcgaaatataataatttctacatccagtttaattgattttcagctattagttattaggataaaaatataaatatacttatacaaatccgcgctagtatattgtcaaaataagttcttaaaaatgaatttatatatatataatgttgcaaataattaagttgtcacataaccttttaatttgttatatcaaaatcatacctaacttgtaagttgttgcatttatacgatcacttataaattttttatattaaattacacctacttaccaagttgttacattggaatgttcatttctcatgttattgcaccaaattacacccacctgtcaagttgatgcaccgtggatgcaatttactctttggattttatctatgagccatcgtctatttttttttgtcgttttatttagcgatttagtaatcactgcccagctaaattatgcatagacaacagatggccgtatgattacatttttttttcttaagaggtaggagtactaccacaaggacgcatacgatccatacgcataacaattgagtgaacatcgactaaatgaggggcagggcgtgcaacagatactatttcgcaacctccaggcctctgtccataaattaaaggtgcatcacaccataattacatgggaccgcagcaacagccacgaattatgcagcatacatataaaaaagttatctgtaaacatcaccctaatcatctttccatggcaccaaattaacaatgatgctggcctatctggaaatctggatccagacccttccttttgatcatttctgttccatgcttcctcatggcgcaggggccatctctctgccagtgccattgatcaggctaccaagaattgattgtcagtgctacggaatctcatgccgttcgtggatgaacgggaccaatcagttttgatgagagccattagattccgttaacaagctggaagcactaagaatactgttcatgctctgttttctaaaacaaatcagatcgatgctggctagctttcaactcaaatgataaatcagtatactaataaaaagttcaagaccttgacagagcatcatgatatgaatatgcatgtttcaccaatacattaactagtggtgtttttcttctatttagaaatacataattcaggtgcaactcttttgtaaattaagaagctggtcatcttagagaaagtcctctaatcattaaggatgtcccccacttctcaaatactaccacataatgaatagttcttcccaacatactagtaattgaaaacactagaacaatttacatccatcatcccaaaaatttcaagtcctaattgaacttgatccacgcatcaagggaaaaaaaatgtaatggacagtacctgcactactcatagttgaatttgtagtttttaaattcaagttaggcagtgaacattttctttgtgaagtggtctatatcactacattttatgttatttgtttgtagactctttcatatataacaattcacattatattcaagagccaaaagtcttgcaaaaaattaatgtttaggacaaggtttgattaaacatttgaacttcgacaatcagttttatatttgaaaatgattgtaaaatctttttcacgaacgcgcaaaagaattgcacgtcaatatattagagcgaaattttttttatacacaacataatcagccagaccggtttatgctaggggaaggaagaaaaagcaaaacaaaaaagtagctaggaaggaaaaaaaatactacggcggctaatgagttataatattatgatggtaattttcagtgttccatttatgtttttaaatctagcatttgagaaactactggtggtcaaagttgaaatttttgattaaatcttgttctaaatatcaaatacttgtaggggtaagtttggatcttcaggtgtcatataacagcagcaaaggtcaagctctgcctcgtagaggcgatggacatggagcagagctggcatgacggcgctgctgtagccgcagcaaccatctttggatttccagcaatacacacagagccacggagtagcggcaaactagcaatcaattagactctgatccagtagagctgtcattatctgttggatgattccgattttgcagccgtctgcacagcaggggaagtgctatgtcttcattaattagatgttatatgcaacataggtttgtactgtcttggcttgactaattatgtatgttcacatcctcaactgtataagaataaaacacaattagcatctgacctgttgttgcattatattagtacactatactactagatattctatttttaagggtgcagactgcagagtatgtacaacacactacaacagtatggagtaatttgcaacatgcatgtccgctaaccagcccatgaaattagcgccaattgaaatttgatacaaaggtggaattttaagaagcgtgcaagtatgaaaacctagcactatagtatccgcaggagacctaacttgcccattgattcctatgagacagattacaagttgtttaaccagtggagcattgctttatttcttctatatccaggtgatctctatactaaactgtaataaaagactttgctagtctaacttatatatatatatatatatatataatttttgaaagaaagtttaccttttatattatcctgatctcaaaaaaagatgcatgtgacaaataaaaacataaccagcttctcacatccacatcctgccaattttaactgaacaagaggcgcctcctgtgcagaccctgtcattagtcaggatcagaacggtagaatagtttgttaattattcactaatctctagtactatagttgtatgtattatatatcttggcatgaatatatgcattatagtattccattgtatggcaagtagagcgggaaaaaaaataccactactccagtagctattactactagcaggagccccactcctcctcccctgcatgcttgcgccacaccaaaaattgaattatagcaaaagaatcctcgcaacaaccacatccttcttcttcctgtctcacgcctcaaaaacttatataagagtaccccatgtccacagcagagagcgaggtgaagtgggcacaccttcctctcctagctaccaaattctcttctttgcgcaaagcagccagcagaaaggtttttgcagactcagaggcgtggaggatactcttgtaatttggcgagcaagagggaaaaataaataaattttgtagtagaagaagagagagcaactggccggcagtcggcgggcatctcgatcggtgtatagctagcttgcttgcaggctgatggccgccatgatggcgtccataaccagcgagctgctcttctttctccccttcatcctccttgccctgctcacgttctacaccaccaccgtggccaaatgccacggcgggcactggtggcgaggtgggacgacgccggcgaagaggaagcggatgaacctgccgcccggcgccgccgggtggccgctcgtcggcgagacgttcggctacctccgcgcccaccccgccacctccgtcggccgcttcatggagcagcacatcgcacggtcggtggtttcattactcggtacacgcacacagctatataagcacgcgcactgctcgcctcgccgtgaagcaagcttagctagtagctaggatatcgatcgatcggtaataataggctgacggcgagctggggggtggcgtgcggttgcgtgcgtgcgtgcatgcaggtacgggaagatataccggtcgagcctgttcggggagcggacggtggtgtcggcggacgcggggctcaaccggtacatcctgcagaacgaggggaggctgttcgagtgcagctacccgcgcagcatcggcggcatcctgggcaagtggtccatgctggtcctcgtcggggacccgcaccgcgagatgcgcgccatctccctcaacttcctctcctccgtccgcctccgcgccgtcctcctccccgaggtcgagcgccacaccctcctcgtcctccgcgcctggcccccttcctccaccttctccgctcagcaccaagccaagaaggtacaacacacatcgtcctccattaagttgagcatgcatatatcaatcagctcgctctagcgatcaatatcaatgaaacgcgcgtttgcgtgcgtgcgtgcagttcacgttcaacctgatggcgaagaacataatgagcatggacccgggggaggaagagacggagcggctgcggcgggagtacatcaccttcatgaagggcgtggtctccgcgccgctcaacctgcccgggacgccctactggaaggctctcaaggtacgtactcgtagctactagctactccctccgtttcgaaatgtttgacgccgttgactttttatcacatatttgaccgttcgttttatttaaaaaaattaagtaattattaattattttcctatcatttgattcattgttaaatatatttttatgtaggcatataattttacatatctcacaaaagtttttaaataagacgaacggtcaaacatttgctaaaaagtcaacggtgtcaaatatttcgaaacggaggaagtagctagctaccaccccacccgtgcggattgatcgatcgatcgatgtccctctctgcctacacacaccctgcgccccggccgtacgcgcgcaaagtcgtgcgcgcatgagttttactccttccgtttcaaaaaaaaaacgacctagacaagtaatatgatgtaacctagaacaacgaatctatacaggagtatatccaaattcattgtcctagattacatcatatctttgtctatgttgccttttttaggaggagagagtactttacatatgagttatgaccggccggccaggttcctttcttcccctattccgtatgcatactataagcagctgcatataggcatatactactatacccagcttagctaaagcaaacaacttgcaacgacgatcatgtgcaggtccctgttgacagaggttagagatgtaaaccatttttgttgttttcattatctaaagagaaaacaagttactacgacgatcgagatgtacgcaaggggatcatatttatattggagaggagagagagatgatttgcgacttgtgagtgataagtgaatatatatactatatatttgtgtaggagtgacgatgacttccctgtcaatgttttgtttggtatgcacacggggggaaaagagtttagagaaaggaattggctagagagggccaggtttagtttctttaatttttgtttggtggttttgtgtgtagctagtccgcatgcatgatatatcatatatatgcatggcccatcattagatatatatacatgacggcagtgcacttattatatatatgtaggggcatatacaaggtgtatgtgtttagaattgtggatggtccaggaattgttgcagctagttctatactagcatagtgaattagtgatccatatcgagatcaggtccaatcggtcagctcgcacagcgggtcttttagtacgatttgttcggacaaattatcttgcctttgagataatcaacataggattgaaactgcatactagcaatagaccatagctatttggcaatatagaaagctaaaaaatgttgattgaaaggtgcgtgcatgcatgctagcagtatgtcttttaggccaggtccagtttttttttttttctcaaaggcagttgcttaaggtgaaattctagcagaggtcatatgaatatatttattatcttccaaacatgagccaaaacctatatatagttaactcaaaaaaccatgcattggtacttcttctgagtatgcatcctggggactgatcgatcatgcagattcttttctttctttttccctggggacgtactgatcatcactcatgtgagcataaaatgttgcctactttttactgcatgtgaggtcacactcaaatgatctttattgattgcctcagcatgcatgctgctagctttcacgatctctctccgatacacacaccctgtgctgtgctcaacagcatgcaacctggcaggtggaatttttaatctgttggaaagtaaatgaccaaccttcataatttggcatgattatatgctggggaatctatcatttatcatgattcaaccgctgaccaaactctttgccacacacccgaaccacattaatttcgttaagcggatgattagccagcaaccttcacagtttggttttaattagttaatgaaagggtgcttgtagttttattagctgaagagacactgcagtactcctactgagcgttctccttaattgggaaatagatctctgcagtactatcctttaactttaagtgaataacatgtagctaggtctcacacttatcaggcccacacatcagtgatccaagtcaaatggcaatacaccataggagattcttccactaattggctaacaaaaataaactgtgatcactgatcacagctgctaacactataacacattaatttgcatgtctcatgaaatgccagatgagttggattaattatctatcttatgttcagtgccgaggaatatacaaggaaacatcattggtatagttgtggagttctgagtgcattatctcacccagtacggtcaaattaatcctagtctccgtaaatatggttgtgtgcactcttagttaattagtgtagacccggaaattatactttgtcgagaatgttgttatccgtgtgttaagtttcaagtaccctgcaggcctataactaaacactgccaacatggatgtttaagaatgaattatacatacagcgcacttggaaaagaaaaggggtagctacccagctgaagaacacctctctctcatttgaaggtcgacacaatatgtgtcttttctatatcgaaaggaaacgacattttttctcttcaaaacagaaagctatgacaagagacataatcctagactagtaggcggttaggcaacaccatatctgaatttgataggtgtcccacatattttttttcttttcctgataagaaggaacttttcaccgtgagcttatttttttctgttctatgtcgacattagttccatgatgtttactgtgtatttttactgttcccctgcagtcgcgtgctgccattctcggagtaatagagaggaaaatggaagagcgggttgagaagctgagcaaggaggatgcaagcgtagagcaagacgatcttctcggatgggctctgaaacaatctaacctttcaaaagagcaaatcctggacctcttgctgagcttgctcttcgccgggcacgagacgtcgtccatggcgctcgccctcgccatcttcttccttgaaggctgccccaaggctgtccaagaactgagggtacagagaattacagattcgaaattaacatctactgtcactagctcagtgctacgtttaactgtagagcaacaattgcagaaagcgaaggcatcagaaatgacatgggaatcgattagttacactcacactgacgcgtgacatgcaggaggagcatcttgggattgcaaggagacaaaggctaagaggggagtgcaaattgagctgggaagactacaaagagatggttttcacgcaatgtgtaaggccccccctactttgttccttccgatccctcctccctaaacgctactaatataaatcggtgcaaaggctttgtgctagcgtagctcttgctgttttgtttggtcacttgcgtagagagatagcaacttcccgaaatgtcatgtacgaatggagactgaaagctctgcgaaataattgccgggccacgtactacagtacttacgctccctctcttcagtttggatcgatcgagctaagaaggcgcacgcatgtgtgcattgatcgatagagtcgatctgttctgccttgtaagctagccagctgaggttctttcgccttggaagtttctacagggtgaggcccatcgtcttgcaacgatccaaatgccatgacaagtacctgttgttgtaggcttccagtagcacggcctgcccccaagaaggtatctgaatcttctgcattgctgttcagacggcagagcagaacatgccgaaataccattccagtcagttgcagtatatgtgtgtggtggtatcagataaaggagcagagtaatttgaggccttagaaattcagatgagttgctcgacaattgtcgcctaccgatcgagaataagttgcatgcatgtatgtgatgtaattatgggtcttagtcagcaggatagtttagtcgctgcagtactgtagattgtagtacttgcgttcaaagcagacccaaaacagaacttgcattcaggaaacaaaacatgaaaaaagaaatatacagtacttggcactgatatttcttttgtttgggtccttattgcaggtcataaacgagacgttgcggctaggaaacgtggtcaggttcctgcaccggaaggtcatcaaggacgtgcactacaagggtgagtagctcgatttcactcttcttccctgaatcgacctctcctctatctgacagcagaagctaactgaactgaactgaactgaactgaactgaaggttatgacattccaagcggatggaagatcctgccggtgttagccgcggtgcatctggactcgtccctgtacgaggacccccagcgcttcaatccctggagatggaaggtcagtcgcagtaggattatcagtgaatctaatctattaatctcggtttaattgctgggattcaaggaaaagaaaatactgggacaagcgcggatgtcgctgttgggcagtgtctgtcaatcataagcgaaggggatcatgtcagaatctgcaaaagcagcacaggctaaacgcgtgcttgcctcgagcagcaatcatgcagagaggcaagctccgcgataggaacatgcatggtgaatcactgaacctgatatgaaagtgaatgctcagctcagctcgctcgctcgcgcgcgcatgtgctttctcatttcgccgtgttgcgtgctagctagtcaatggtgttcccacgaattgttttctcttctcatcacacaaagtcagtggtgaaaaccgaggtgcatgtgcggtaatggaacgggggattaggcggcgacgccgtgatggattatgcattcgtgcgagaaaaatccaggagcgttggtccaaatcgcaagcggatcaaaccgaaccaatcagtggacgattggagccctgcagtccatccatcacatctccattcttatccgctgcgactcacggacattagttgttgaggggtgaacgacgcatgtgtgtatgtatgctcgatcgatcgatcgaacaatggatctgtgtgtggtgtagttgccaacgccgacgagattatctgctcgtctgcatgcagccgcgaaaaagacatgtgtccggattatcctgcaggagattgagcaagataatctgctgcgcaaaaactgcagccaatcgatcattccatgacgcgaaaaaaaaaacaataattactactgctgatacgataacttcgcttcgaattgttgacacacaagtgttcttcttttgttcgattgcagagtagcggatcatccggcggcttggctcagagcagcagcttcatgccgtacggcggcgggacgcggctgtgcgccgggtcggagctcgcgaagctggagatggccgtgttcttgcaccacctggtgctcaacttcaggtgggagctcgccgagccggaccaagccttcgtcttccccttcgtcgacttccccaagggccttcccattagggttcatagaattgcacaggatgatgagcaggagtaaaaaaaaggaaagaaaaaaaagaagagccttttgacctaattgttggatatataaaatcaaaaggaaatatctaggaaagtacaggatgcatgtacacgttttcgttttcgttttccttttttttggtggcagtttgtgctatgtgtagatgtgatcaggaaaggatatagtaagatagtagtaatatatctattatctattatctatctatctattatatactaaaagtccattaaacttcctagaaaccctcctaagccgccacataggacccctagaaacgctcctacgccgccatgtggcgatctaataaattatagaaattctaagaaaatattagccatcgattttcatttaatatatggtagattagatgaaaaactatgttaaattaaagttgtaaaaatatatgctatttcaagttttattctaaatagtgcatcgcatcaaaacatccattaaaaatattaataaattaaaattgtagattatatgattgtatatctcttaataacatagttaaattattggacttatattttcaaaaaataaaaagaatttaaattatgagcagcgttctaaaaatttactcactccctactgtataatattgatatgcccaaatgacattattaaattatcatgaatatattttcatatattatatgttcctttattcatatatttttggaaaattaacgattatatattttttacaccatgtggatgtattttttttatctcttaggcttcattcggtctacctcattagatgagcttatctaggacacgcgaaaaaaaagcatgtcgtcagcgtaagattaattaactattaaatattacaaacttgaatatggttttatttgatattttaaaaaaactttgcatagaaagtatctgaaaacatgaatcatttcaggaaacatctcaccataaagggagtagccaatccgataagattttagaactcaaccttaaatttactataaaatatatagtatataatatattttgtcaattaggaatagagctaaatatatcaatcatatatccctactaattcctatgtgtataagtttcatatacaaaccactatccaccaattatcaagtcatattaattacttatgaggcatccgtgcttaatgcacctaataattagatgacatctaatatgcagtgtgttatcaagtactgataatggacaattctaagtgagaaaccatcaacaaatgataggtaagaattgataccaccaagccacaacaaataatacttcctttgttttacaatgtaagtcattttagtatttcccacattcataaaatgtcgcatgtaaccatattatatcttcttaattatatcattcccatctatataataatatgctaattattaacattacatattattccatcgtatattacccatgattttcaaccattagatctattgtaaaacataccaattaaaattatctccaaaacccaatattgccaatctttatgtgcatgtgcacataagtacggacgtttagtaggtattccaaaaaaaaaaggtacgtacatatattccaaggtaaaaaagtacgtacatatgtacataagcaggccgggctaacgacatctttttattttctttttttttcactcggatagaaaaccaaactgcccatattaactatgctctacttacgttgtaaaaatataggcacatatatgtcatcgaaacaccaatgagaagaaaaaattaattaaagtatatattatgtaatagttaaattagacttgcattttttaaaataaaaacaattctaattgtgactagcaattctcaaaagttacctactccttataaaaaataatgatatgtcaaactgatatcactaaatttatcatgaatgtgttttctctattcgtataatatttaaatatcaaagattgtatatattcttttcacaccatactgatctactttatcttctacttatgcttcatttgatctagctggatggctgtagctggatggctgagcttattcaggatacatgaaacgacacatatcattagtgcaagattaattaaatattgaatataataaagccaaaatagatttatttaatttttaaacttttatataaaatatattttaattatacacaagttgcttttaaatatatacgatgtaggttatggttgtcaatttaattatagtgcataaaatggttcagatggatttagatattattatcaaaagatatgtcttttgtaataattcctatatcaatgggtagataactgggaaaacaaggagcaaccaatctgataagtactctagaacttattgcttatttactaaaatgtttaatgtgtagtatataatatactttatgaataaaaaaatatcctaatatataatcatatgccaccacttatccataagtatataaattctatcaactaatcgtcaagtcatattgcttacgaggtattcattcatagtgcacctaataattagctaccatccaacgagcacttatgtcatgaagcaccatatataacggactatgctaagtggagaactatcaacaaatgataggtaaagtaaagcatgccaccaagccacagcaaataataatcgattacaagtatattgtcagtataagcaatagaattctacacttctacaagaacccttaatatatcacgtaatagatctcataaattagaaaaaaagtataaggaaaaatataaaaaagaaaatatctggtcatcaatttacacttcaactggtagatccattattttcaaccattatattggatatattcgagctaaaaaccaactaatctctccctatgtacgtacctatacaagagatgtcaaaaaggaaaaaaaaaagaagaatgtatatatgatctgctccgtctggttgtttttttgtttctttctttgcagcactaaagttttcctcaaattatgcatatatatagtgaaactctntacgatgttatcgaaaaagtcatgccaccgtggcatcgcttcatgccatcccacaaaacttttttaaatatttttttaactaatgatctaaaacgaaatcatagacactcatataaatatgtgcacaaccatcctacgaatatgcgcagtactattcacaaaaaaaatacaaaaaaaatacatacgtacaataaaaaatgtcgcatggaaacctattatatccttatataagtatgtcattctcatctaaatagtgttgacaaaattagcacaaataattttgacaatatgaattattccttcgaatattacccatgaatatacgtaggtgacttagatgtatagtaaaagaaaaaaatctaaacccatattaacctgtatgtttacgaaagatggtgatatgcgactttatgtatagccatgacaaagtgaaatttgtttgaatataatagatattatcaattagtatatcaaagtttataatttatttcacataataaatatttcttattttatattataaggtaatctatggttcttaaaataaatacggtaacatatggtttattttagtattctttctataaacaaaaaaataaatgatgagtccagcagtgagttggaataaggccggcccacggcccatttcaagtaatacaaagtttggcatgacaaacatcttttatttgttgaactgaaagagtttgcagatcttgaagcaacgattaatgttcgacaaaattaaatcaagatgggctaaaggcccaaatgacacggccatgaaaagaataagtctctgcgtcccttatctcttgcctttggtcgaatatcatccctcaaccacaaaaccgggtagcgtccttatctccggaaaccggtgcaaattgacttctcaagtagttttctaaagcggttttcgtcatacgtggcacttaggtgttattctagatagaaaaaaaatgacagtgggcctcacatgtcagtctcacttctttccctttaccattttctctctctttggtatcgcttcttctccatggtccggggacagactgacgggcatcaacgcctgcgaagaggaggagagggacaggttggcggagatggatccgccttgccgcgcccccacaccttggtctccacctcctatccatgacagatccacctacccatgcccccaaagagaggatggactttagtagtcatgcgtcagccatgcctcctctctagctctttggtgtcgtgatcatcttcgtcgagtgacgtacgtgtgaggaggagggagaggggcaaaggccgtccatccatatgtgacgcatggatgtggcgggactagcagggacaagctgctgcagatggacgtgacaggaccacgaaaacgttgctgccgaaggaggctattgcgctgcgggaggtcgataaagcaaggacatcataggccacgatggcacgggagctcgaggaggcacttgctatccccaagccggccctctctcatctatatccttcgacgcatcgccgccgttgcccccctccacgaaaacatccacttgtgcaagtgggggggggggggcggcaatggtggtgagttggagctgaggaaggtggtccctcaggcgacggtgggagctcctcaaggttgtgacaacaacgcgtgtggcaaggggagcgttgtggtcgaaagcagccgtgtcacgccccaaactagtcccgaccggaactagcccgtgacactctaaattaacctgttaatcgataccagtcccaggaaacagtgctggtatcacaggaagacagaatatcacagcaacaaagttctttattatagagtagaggtacagtcatgctgggctgcggacagatcccgagctcacaactgcattacaaagggaagcggaagccaagacttggaccaagcaacacaggcgcgacttgggaactaggccgaaaccctaaaactcatcgtagccggcttgctcctggaagaactcctcgtcagcgggatccgcttcatcttcttcagcaactgggggggattatttatatagagcaagggtgagtacgggagtactcagcaagccatgggaaataagtgtttaatgcaggcttcaacgaaaggctgttgtttttgcaattgattttatttgaactcttttctgaaaacaactaagtgagtgcttctcaaacgacacggatgagacagtgcgtctcgtccggtcggagtatgtgcaatgtatcagtctttaaaattgttcaagattggcacccggccaacaactttcaaacggccacccgggccaacaactttcaaacggccacccgggcctagctgatcccatcagctgcagattttccaaacattgaacccctttccacaacagcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcaagagcgagaaaccgtacacccggtacgatccccggtccgcggttttggaaattcatttagttcgcaagcaccgacccaggtgtcgggttttccaagtcttttgtaaaacccaagttttacccaagttgtttttcagattttaagtttgaaggcgaccgtcgatactcgtgcagagtgcacgatttccgaggcgcaactgggtggttacaagtgaatatggtataacaattgacaaaggaaggatcaaatgcaacaaactaggtaggtccgccaatctgccttgcagacgggacaaacagattaagtgcgatcctatcaatgcataatatttttcaagcaacataattaagttcaaatataggctcaagatgttcaaaggtggcttgccttgctcgagatcttgagcttgatcatcgaaatcctcgcactgcgggtcttcgggctccgaaactacacgcaaaacgggacgactcaacaaacggcgaaaataaagtcctattaatgacctctaagcgtgccattagatagatctcgagatttgaggaattttggaagttgaacggagtcaaacggacttacggttgggaagatattgaatttataagattattggatttttggtctaaaggaaaaatgatttaattaaacccttttggaaaaagaaaaggtagagggaggggaagtagacttccctcgggcggctagggcgcggcccgagagaaaaggggcggctcggccgagctaaatgggccggccggcccaagaggacacggcccaatagggcgcggggaggggagagagagggcgccggtggaccgagtccatctcgcgtggtccggggtgggaccagcttgtcagcggcttggctcaccgtgcggagggagcacgcggcgcggcgctagggtgtggagcggggcgcggtgcatgcgcgtggttcgcggtggaccgcgcccgcgagcggggccggagggagcggctgaccggggtcggctcgacccggtcttggccgagctggcgccgacgtggcgcctacgtggcagccacgcgggccggcgggaggttgaagaagacgccggccggaacggacggcggacggcggtggcgagcggcggagcgaaacacggtgatctaggcgaaagcgagcacaccgggaagttgcacgggacgaggggagtcgagccaacggctcggatttgccgggggatgctcgacggcggcggattgcggcggtggcaaccggcggcggaagaagggggaaacggtgacgaggtcacgaggggccgattcccggcggcgagagcatctacgcggctacgggaatccgatgctagcgttggattgggcggagcggcgccgagcgaggccggcgacgagcggcgcttccgagctcgggcgacgacggtggcgagcacacggcgagcgacggcaaccgtcggggcggcgccggctagctacggggaggctactcatgctactacccgagtctaaggggaggagatggagcgaagagggagaacggggagatgcgctaccgtgcgggcgggcgcagtgacgagagccgacggcgcgaaacgtgatcgtttcggcctcgggccgaggaagaggaagaagagggcgcgcccggagtccccttccgcgtcctcgctcgtgccggctcctccgacacgcgcgacgacaaacggcgacggcgtacagagcacgggaggcggcgacaatggagtggaggcgatgggacaacgagaggagaagagagggagggcgcctgggctttataggatggcaatgtcggtttgggagaggggaaccgactttggacggtcaagccagcgagctggcgctccggctagcggccaaatcggcgacagggcggagggaggatgacgccggcgggagaaaaaggggaaaaggagggagagaaagggggcttgccccttgcctctttgggaaaaggaggaggggagcgggggcgacgcggcagagggaggaggagctctgcctccgtcccttggaggctagcgcgtggagtggcgggggccgggcgatgacgacggcgatgacggcggggacggtgtggagcaaagcggcgacacgggcgacaggcgcgggcaggcgcggcagaggctgacggcggcggcgaccaggcggtcggccaccacggcacgtgcgcgcgggaagcaacgggcggcgcggcgatttgagcggcgcggcttgggcacgcgtgctggctcacggggccgagcggctgcgccgcaggcagtggggccgggcggcgcagacggcgcaggcgcggcacgggcggcgaccacgcgggcgcgcgcacgcgaacaacggcgcgcgggaagcggcagcgagggagcggagagggagggctcggctcggcgcggctcacgcgcacacgcgcgcggcgcgctgacagagcggagaagagggagagagagagaacgagaaagagagagagagagagagagccggggagggagggggagatgggcc

SEQ ID NO: 23694 - DNA, 8950 bp, Oryza sativa
tcgaacccgagggaggccaaatagacttttgcggagggattgatttgggaaggattgggattcgggattgaactcggcgatagatcggggatttgagatctgagatggcacggacactagacagcaagcaaagaaacatatttcgcaaatagagtttttaagagatagttttcccgctaggcaccacgacggaacgggcgctacaagccgccattagcaatggtggcgctgaagaaattgggtggcggcgagggtgatgcttgattcgtggtggctgcggcatgatcatggtggtgtgagctcgccagaattgctggcttgggatgtggaaaaagagggaggaggatgaatgcttcactaacatatgggacccactgccattatttttttctatctacaatgccacctaagcgcatataggacaaaaacgtttacaaaaccacttaaggagttgatttgtatcggttttcggaaatgggaggcattataccccgttttgctagtgagggatgcgattcgaccaatggctagacaggagggagaaaacataaacttattccaccaacaaatacaatgaccaactgtagtgaaaattgggctaaaaggcctatagaacacctcgtgattatcatttgggctaaaaggcctaaaattgggctacatggcctaaatagctcagatctagaatacgcgtcgcagccaatcaggatccccaataccgtcggccacaaaccgcatcctcgtgttcgctcccgcaaacgatccggttaagcagatgacgcacgcagtgacgtcaaataccccgcaagttgcggtgtccttgtgcgatccagctgtctcagccaatggcgccgcgccacgtgcctcgcatcctggccgtccgagcacaaccgcctcatccggaccgtccgctgcgtctgaccagaccataaataccttgcttcctctgtttcgcctctccaccacccaccgtagccaagcaaccctagccgctttccccatctcctcctcccagaactagaatttcgccaccccgaatcccttccatggtaggacttccgtttgattccgggtcgaatccgtcgcctccgatgccggaacggtgaggttttccctccctttatatggacaacacgcgtttgttttttctgttgcgcaggtttcagatcttggatggacttgctcatccttcggcggccatggatctatcggcggaagctgctgctgctgctcgtcctcgcgttcggcgagtcagatctggagccggtgagttcagcatccgtgtcgcttagatgtttcgtttcgatttacttgcatggcttgtttcctgaatatgtcgcaaccgcgtgctgatctgtggatttctttgtgttgtcgcgtgtagatctgacctcttagaggtccggttggggcatgctccgtacgagctggcgtggatgaagcggcggggcgagggaggaggctggtcgtcgcctggatcctctccatcggggcctcgcgcgatgatgtctctttgtattgataattattcgatgaactttcgataattattagatctaagagatgttgttcgagggagccgtgtgctgagatgaaggcggcaaggtaagagaacatgtaacaagcgaggtgcttgtgtctgagggtcaaaagaaaaagagacgaaaaaaaaacgagagatgtgacatcgcaagattggcctttgccatgttgggtgcgctcgcatggcaggccaccgtaataaagatgatctttttgtgtcctggggggagttcgcacgggggttattttgtttagccccgggttctccccccaatcttgtgtcccgttgtcccctggttgtcctcagatcccactgcgactacatcgttcaacgatcgcgcgtgaatctaaacgtggagctacagcgcaacaaccaaggtacaaaagataatctacatgtgcaatattagtcgtaatcaaatttccatatcattcagcgtttcataattatcactgccttaaaatatccctagtcacataatattcctggatttactttaaattgcttgaattacttaattattattatcattgccaattaatatccctgataaacagcagtattatcatccctagaagtgcatctcacatattgactcaagttgattaaagttacgcttggtaattggtttaagagcagctggaatactacgcaattgttctaacgaatatctagtacttgctttgtatacttaaatatatccataagtcggtgtagtggtaatatttgcttccgagattatgtgctcagctatactccgaactgtcaactatcagtttggaagtatgttatgttggtcaaatactattatgatgtttccagcatacgattggagaactcttgtccaatttaagtgaaataagctcttgttcttgcccagaatttacagcgctcctgcgccttaatatcaactaattgtgtatgatttaaccgctcagctctttcactttgccctttctgtatttatgcatgtacgagaaggctagtaatgttttatatatttgcactgtgagaatttcttttcttggatagtcagcaatgtaacctcttttgcaagctgtagaatatgatcatatgttgtcctccttagcattatgttagtttctgtacgttgaagtacgagaatttatgttcttgaagcaaaaagttatttagcatttgtctattcatcatagtttgtactatgtagaaattgtagcattctctcgtcgttttaaggtgacctgaagacaagttcaacctgaagtcacccgaagaaaggagtattcttgcgaatcaaacttggttgaggtggccgtctgggatcttgacatctgaagcttgacatctgaagcaagatgatgatgttttgctgtgatcacctgtgctcattacatggtgcttcaggaatgacttgtctaatgttggtaattgttggtgctcatcaattttcatggttattgttggaccgactttccggtatgctggattaagctgttgcagctttgaagtctggggtgccaaccttgtttggactaattgccagatgtatcattataaatttcttcggtgagagttgagcaccatggaggttctggataacagttccgtctctgctgcggaaggtttgttttcttgaggtcaatccggaggtaaatggctgtaatttgggtcgtgtaaacagcatggcggctacatgttataccaaaaggataagacactcgtttttattttacacgatgagttacactactatattagctgacgtttttcacaaggttatgtttgatttgagtttattatgtagttaataatgagctaaaagtaagctgatgaagtcttttgtagggcagaaaacaccaagtcaaattttgaagggctctattgttttggtaaaaatcactcgagtattgttttgttttttcagagttgtgtagtgtgtttaggatgttttggttctgtttaaagaagtgcacgcacaaactgaggtaaacggttcaattcaaaatactcttaaatcttatcatatttggttaactaatatatatattatttgaaatggtttataaaatttgttactttgagggaaaaaaaatccaacttgtaatacaacatcggaccattagacaaaatagttatggacgttacatacgaaaatctcagttcgcttaattggcggtaatgtggatcttttctcagttcgggagatcctccgttgattgttgggcttacgctctccggttacggatggaaggtggttcaattccaccaaggtcctgttaaaggttagaggcccaaatccaattgtactgggatttgtgcggttagaggcccaaatccaaatatcatttgtgcttggcaagtctgttttccttattattttaaatggtctacattaggtgaagattatactcgttaataggtacttgtattgatatactcgttaataggtacttgtattgatttaatttttaacagttggtaagttgcagggcttgtttactttatgctaaaaaaaaacttaccaaccaatgccaaaattttttttggaacttgttaaatttttgggatttcttatatagttatcaaaatttggcagcaaactaaatgtagctattttatatatatagtaagttttaaaaaaaaccttaccaaccaatgccaaaattttgggaacttagtcaaatttttgggattttttatatagttaccaaaatttggcagcaaactaaatgtagccactttttttatagtaaatttatcaaaatttagtaaggttgaaaattacatcaaagtgatcatgcccgtgcagttctgttctcaatataaggtcctgttcatttgatgaaacaaaaatcttgccaaaatttggtaatgctaaaattttaaaatttttgtaacatgctaaaattttaaaattttggtaggatttgttatatagttactaaaatttggcattaaattaaatataaatattttttttttgataattttattaaaatttggtaagattgaaaatgacatcaaaagtgaacatacccttaaacgtaatactcatgttatttgggccgcaagcttaaatgcaaatgtaggtgggccaagacaaatggagtacttactagtatgagttattcgatcgaaaatgctagtaataaattacgaatatgagttcgactgcatgcctaggttgattaagggcctgttttaaatcgaggttagggcccgttttagagagattggaaacaagaacaatcgaggttagggcccgttctaccatatagaggttggaaatagaggtcggaaacaactgattagggtagtcccaatccatagtatttataaactgtgtatataatgtctctacaatccatggttttttaaatttggccattaataaatacatcatctctcttctctaccaatcatatttattcttcatctattataaagacacttctctcaaaacttgatagcatctagtgcgtaggttcttgtgttgaagctgtgtcttgcatgggacccaatttcttcctctcttcactctctcttaattaatatagtaccacataaactaaaagttctatatagcaatatagtaaatgtcatagatacaatcctaggtagagattgggactgcccttagctgcatgcaaacaaaagtgattagcataattaattaagtattaattattttaaaaagattctgtttcattttttaaagtaactctaatattataacttttttgcacgaaacacactgatgtttgaaaagtgtgccaacaaaccctaagtattcattcatttgttttaggatgaagattgatatttatgtgttttattagagttaatattgatgaaatgcagggccagaggacaactgttaatgttatttcttaaaattaatacttttatgaaattttagccaaaagcactcgtgtgtgtgtgttgaaccaatggctgcaattttaggtcgaaaatgagtgcaggataagtatacgtatcttgttttctaaactatttactacatgacactcgaagaaatatgatatttattgaaggatatcataaaaaagttgactttgtttgactacacacgaaaattatggtaatttttttggttgtaggacactgaccttatttcagccgcgccacgtgcctccccgcgcggcgaggcacgtggcgcgcgcggagggggccacacgacagcgcatgcgtagaggtggggcctacagttttttctgttggtttttttttctgtttttgctttttttttcttttcagttttttgcggttttctttccgtttttttcttttcggttttttagcatttacgtatacctataaaaaagtttgtatacattcatacaaactttgtgtacgtgtatgcaaactttgtgtacgcgcatgcaaactttgtatacgtgtatacaaactttatatacgacacgtatataaactttgtatgtgtatattttttatacatcaaaaatatataaatataatatatatatatatatatatatatatatatatatatatatatatatatatatatatatatatatatatatatatatatatatatagtaataatattagtattattataacattagtgtagtagtactacttgtaatagactagtactagtacgttgatgacgaaaaacacgaggcctgggagatctgcttaattccagtgtaggtccaaaactcgtcttcgggtatgctagcgtgccagttgatttgatcctgcaatcaacaagaaataaatataaagaaaccgcagtttaaacctataaatgatagccgatcggctaagtgccgatgacgtatcatttatctctgagccgatgtcatatgtaaatcgatcggcggttgcaaataggtaataaagaactaaatctattcgatcggctgtagatattaacaatatataatttttatatcgatacatacttaaatcaagtgattgggatagattcggtcgccatgccgagaccgtataaatcacttagatcgaaatatacattaataacaggattatatatgttcatagcatagccgatcagatagatctagcatataatggctaatactcctatacgactctatgttaagatgttaaaacaggcagaatatactaaacagaagcttaatataattagatgcaataatattttgacataaagggcagatttaacgtgtcaatgaaacatatagagcaaatatagttaaatcagataagatcggctgaaactccgattctaagcacgacttaatagatcaaactcaactgatgcagcattaagtacgaaaagaagaacaatatctagacaatcaagccgctgggagtttcatagagtggtagatatcttatataatctaaatcaacgtcaaaatttaacctaatcggctgccttctactaacagatgttagtcgatagtaggttagataacgatattgtcaaagattatgtaagatatatgataactcgacgaatctcgagaacgtaagccgtcataacaagttttacctcttgtcgaagatcgaaaccgatgcagctcaacacgaaagcaagaacttgtcaaaataaaattaaagcgaaagggtggcgatgcgccgaaattgtattgaacgtgtgtttaaaattacatagggctcggggtctatttatacccgagaattacaagatatgcccataccggacacgactattatctctaacaaactctaagataccataagtctttgcggcagacttttacccatatttatctctaaggaatttacataaaatatcttaattaatagatacaattaatcgccttcccaggactctatccatgtatggcaatcatcttgaagtacgtcaactcaaacccgatatcggatacaagttgtattgtcggaatcggttgtatcacttaacccagtctgactcggacttagccgatccaaacctcagccgattcttactctgtttccgcgataattctcatgtttgattccgcttcaatccaatcttctttccgatgcagatattaccaaatttgattgttaacatacgtacagagtagtcgcgcgccgggggagccgtgcgactagtcgcgcattaccccccctcacccccccccccccccgccatagagggggctaactacatatgtgtaggcatggtggatagccacgtcggctgtcgaacacaatcagacgtgcactggacctactataatacattaaaaagtatctaaatattgtatttacaatattctggacctaaatgtgacctcgctttaaacatttaggaccatgcatgtacttgttagcaactttttctctaattctaataacaatgaaaatcacatatatttggtgtacctgaagaggaaaatagtttaggatacaaggctagaagatacggcgagtttgtagaacaagtagggaagatgagatgtagggaagaagatcgacgaggagctgaaccggcctcaaagttatcgtcgtagtcattctggcgttctattttttcgatgccctaccaagcgcaactccctccgtccttaaaaaacaaacttaggatgagatgcgatatattctaaactaaaatccggattataaaaaatccgaacagtacaaattcatagtactacattcgttttttagtatatgaccccgttcttttttttgacaaatgtttaaacattcatctttattttttaatatatgaccccgttatatttttgacaaacgtttaaacattcatcttatttggattcttttgtacaaatataaaaagagtaagtcatacttagagaacatttgacaaaaaatttaatcacaataaaataatgataattacataagtttttgaataagacgaattggtcaaacatatgtaaaaaatcaacggcgtcatatattaaaaaacggatgaactattatgatgtgtcttaacttgtcttaggtttgtttttatgggaaattaagagtttgtatttgttgttcagtgtgcttgcatgggcttcacttgacatgtggccatcccatgccatctgcggcccaattcagtttctaacactgatttgacttttttttgtattttttaatttgatagcctatgtttagatttaagaaaaagtagaaaaaatatgaattaccccctgaactatcgcgatcgaccgaattaccccataaacccaaaaaccaggcattgctcacactgaactttcaataccggacgaattacccccttcaacctaatccaaagtggttttgtcctatgtggcgtacacgtggcaatccagtcagcattttatttattaaaaaaaatataggacccacctgtcatacttattttcccctcttcctttatctcttcacacacacacacacactctctctctctctctctcacggtgcggcacg

SEQ ID NO: 23695 - DNA, 9186 bp, Oryza sativa
  unsure (1)..(9186): unsure at all n locations
gagcgccctgtctgcgccgactgcctgcgcctgccgtaccgcccgtccccgcgccgccgaccagctcctgcccctacgtgccgccccatgagagagagtgtgtgtgtgtgtgaagagataaaggaagaggggaagaggagaatgacaggtgggtctcatatttttttaataaataaaatattgaccggattaccacgcatacgccacgtaggataaaactgctcctagattaggtcgagggggtaattcgtccggtattgaaagttctgagtaagcaatgtctggtttttaggtttatgggggtaattcggtcgccgcgatagtttaggaggtaatttttttttgagacaatggagtaaagcacttgcactgtaaatgcgtagcagagcaccgccacatgccacgacgaaaaccactcaaccgtccccggccagatcaacacgaagccatcagtcgcgtagggagcgtatcaacgtttggtcagggacgacattgcctttttaaaacatcgtgtcacttatacattacgccaaacacaatttaaacccccccccccaccntnnnaaaagcaacaacattatcaaacgctggatcccggccgggcgcgttaaacgaaccaaaaaatgtacaccgtgtgtgtcgagggagaaaaatgtcagctgctcatcatcatcatcgccacatcgacctgtccaaatcatcggctccgaccttctccgacatgagcaacggccgcgtgttgtttggcgacgtccggtgcgtcgccctcggcgtccggtgctcctgcaagatgcagctgcctttagctcgcaatcaagtggagtatatgacttgcgccattagcgcatctgaagcagctcttcgaacataaagttagagagatgtagggcctgcttagcgatcttaaaattttaagaagcagctggttgaaagccagtttctaagaatctggaaaagctgggtttctcagcttctggcttctagttcattttctgtattctataactacagcttctcataatctggatcaaaagctggactgtctgagaaaacttttgattctgcgagaagccaccgcagctaaaagctatccaaacatactcataagtcgttaacaggtgggttcaccccatgaacccatagacacgtctcttttacgtatgttagaggagccccgtcactcacacgtggacacacttaccgtgcggaaggggaactcgtcgccttcgagcatgtgcacgatctgccccatcttgggccgcttgtgcgcgtcggagtcgatgcaacggaggcacaccagcagcaccctgttcagcgccctcgcccccggcggatcctcgatccgcgggtcgaccagctgctccacccgcctgctccccaccatccccttgaaccactccaccaagttcacctgcacggcgcgctccaacacaatatatgtcagccacctacaaatgccagattgactgacgcacccccatctgctgtgacatagatcgatcacctcgccgacagacttgctgtagtccacgggtctcttcccggagatgagctccatcagcagcacgccgaagctgtagatgtcgctgctctcgttcagcatgcccgtcgaagcgtactcaggcgcgacatagctagcgaagtatacaaaaaattgcagatcaacaacggagcggcggtgagacagtgagcgtgtgtcacgacgtgtgcgtgtacatacccgaacgtgcccatgacacgggtggtcacgtagctggatccggagccgagcaccttggccatcccgaagtcggataccttggggttccacttcttgtccaggaggatgttgctcgacttgatgtctcggtgcacaactttgggctccaggccttcgtgcaggtacgctattctgcaatggacaatatcagcatccacaatgtcagatcagtcacctgccgatacggaagagcgagagatggaaattcagggcaaatcgacaccggtcatcaccctttggccgttccgacggcgatcttcatccgaatgtcccatgtcagcgggctgaccgggccaacgtcgccgtgcagccactgctccaggttgccgttctcgacgaactcgtacacgagcatcctgtgagcacggagtgatgatggcattgattatttgcatcgctgcattgtcccccgttttcacttctgctgaattattaatgctcagaactcatcgaggattcagagctggtggcatcacttaccgtttgggcccttccgcgcagtaaccaacgagaccaaccagatgcttgtgcctcaccttgccgatcgcctctacctccaccttgaattccttctctgcttgacccctgaaaaaggacagtttaattccagatcagcaggcatccctaatttcttcagacatgattatccgtacgtgatataataaacctataattcatcaacttctcttgctgctcattataaaccatttgcatagaaatctcactgatccatttcacatttggcgttggcagagaaaaaacaaacatactgttgctgtccctgagccaatcctcgtgcgtgcacttgatttacttgaaagctaaactaaaactgcgtcaaagctaataaccctataaattttcttgcctatgtctaggatcagaaaaggaaaagcatggtcatcggctcatcgctttggctttctcttgctttatcttttcttgaaagaaaggatagatcggtgcatatgactgccaacgagctctaccaactaagtagatggatatatactatccatcacacaaaagcacaaaaagagccaccaactgatatcacaggcacatgaatcggaaaaaaatgaagcagagaactagaaaggaagaaaagaaaaaataactattctttgcaacattgacttaaaagtagcagtatttctctatggacattaatctgaacagaattgactggttcacatgagcttcttgatttagtacaatgtaagaaattcatcaataattcgcagaaacctaggacatcggtactaccatagtcatacttatatataatgcaagttcagggtgcaagaacctctgcattgcttactatatatttctgcaagaaaaaataggttctctaatgacttttgtctggccagtcaaaatgacaactgaagattatgaaccacacttatttaagaaagctttcaaaggcctggcaaaaaaaaaagaaagaaagaaagaaaaaaaagaaagggataatatggaaagaatgcaacaatcgggttttcaatcagcaacaaagggcttggatcgacattgcgagaggaatggtggaagaagcagcgctctggcgtcaaacaaacccagtaagtctagccctgctattcagaaggatgcttggtcgcgagaatttagtgtgagagatattactatgaatttttgttcctgtttcggtcccctgctgctcttttctttcatgtaaataactatttatttcacttaatacaaaagaaatgctccttgcgtattccccccccccaccccaccccccctaaaaaaaagaaagaaagctcgcaaagacctaccctttgtttttggcaaagacaaaaaagagtttctctacaatatttactgggtgtacttttgaaataaaaataaaataaattctgcatcagttagttgtttcatacttcccaggaataaaaccgcactagatctattagttgacaatttgccaccgaacaacgttaggttgctaatcagtccatcagctgctttcataagttgcgcgattacactttttactagaaaacaatcatccactcaagcaccgtccatccggtagtttgagccttgaaatttccccaggtttttccagagtatttgaactaggacatttgctgaatagtaatcaataaataattctttcaggggaataggtccgtaaaattctgttgcattttgacaaactacatatgtcatggatgcgttccattggctgctaaaattcggaagcaggctttacaaacttcatgaaaaccctcccatagagaaattaatagtacacatgacaatgatgcattgctattaactctaggacagattttgcgtttaagctaataagtcgacatgtatgcatatcttcccaatgatatgaccataataactggcatacttaaagccatatcaacaacacaactacaaccaccaccccacttattgtgacaaattaacaacaaatgcaattaatcaagaaaagcatcacgtacaccaaactagaccaaaatccaaatatgatgccgaatacaacaaacttgtacgcattcatatatttaaactagtgaaaaaatctctaataaaataaggtaacaagggtgcaaaaaaaaaaattactgctactgcttaggttgattttcttttacagttgccatctttttatctggaatgactggaaattataatgcccgttttgaccgtgccaactacagtacaaaaggtgaacagtaacaaggacgaacaaaaaaaaacaaaaactgtgagtactcacttgtgatcgagcaagttcttgacagcgaccacctcgccgccggcgagcacgccgcggtagactgtgccgtagcctccctcgccgaccacgttctcctcgctgaagccgccggtcgccgcctccagctcctccaggtcgtaccaccgcccccagcccatgtccatcgccgcggcgcagctgatcctctccggcttccgcctcaccggcgactccaggtagctggccgcggccgacgagctggccacgtcggaggagctcgtgccggtgccggtgcccgccccggcctccgcgtggtccttctccttgggagcggacgacgacgacgcctggcggagcgagccggaggagggcgcgtgctcgacgcgcgacatcgacaggtgcttcgcgccccgccgccgccgcgcgcagagcctggcggtgccggccgccacgaggacgacgacgaggaccagcgctgccgcccccgccgccaccaaggcggacgtggacagtccgaagaaggtcgtcgtcctcgcgccgccggagccggtgccgccgtcgacgtcggagcctactgcggtcggcggcggcggtggtccggtggcgtccatcgtcggcggtgggtccggcctgtcacgacgagggagtggagggtggtggtggcgaggtggaggagaggcggaatgggagcgtggctgcgtgcttgcagcttgcgttatatgggagccctttgtttttgcgcctcgctaacgttgctggactcggtgtaccgtggtcccgacccacgcacgggcgcctccggtggtcggcgtccacacgacgaggccgcggcgtgtattttctcctccccgtatgccgttcgacgggacgcgtgtggtttttgttttggtgcgccatgcgtgaaacggtcgttgggtgggtggcccacccggccaaagagcgggacccacctgggaagcggggccccgtgactctttgctcagcccatcgccacaatccgtgtgccgcgcggcgtgagtcccatcggccatcgctcctctcctccatgcctgaagccatttatacgtgtacagactacagatactctgttcatccatctatttacagattccaacctgagatctaaaatcacgcggttacattttgaattgatttatgcatcacctccctcagtttccgatcacgatcagtttgtttgctgcagactgctaaccgctacacggtcacttcagatcttcattcttcagtgttcattcacatggacgacaccatcttacggcgacggagaacacggcaaaaagctactaccgacagtatccgacgggagagaggccatctcaacaaaccgacggcccgccattcctgtgtccattgcacacctcactatcgatcgatcccttcatcaggttgtcaattcgctacaatctcgaattctcgatcgacagtgtaataatcttttcagccgtcagagtctgagagaaactttggggcccaaaataattaagaagcgcttaatcccacttcgaccgaagttcaactaccgaattaactatagtggatcttacgaaattcagagattcagatagtgacctgcaggctacagtgaatgatcaaagcttggatcatctctttggcgtgagcgcggtggagtaataatgttttttttttctcatcagcaacgttctggaggttcttagttaggttaagcatggctgccttggaaagcgacgaggccaaagagatgaaccgaacggaattggcttggcttggaaagcaagtgtggaaaagaacaataaaagatggaggtgtgtgcccatgcatatgcccgtgacttaatttagctcaaattggaattagggaccgaatttaaaatctaggcaatcatgtagtagaagtctgatcatataaaattttagaacgttggtgcatgaacttcttcaatgctgagcgccacgcctgtcttgtggccttgtggctgtctccaccgaacttgtacattgaaatgtttttgtttaagcacagtgtccttttttggatgaagcatagtgtcctttaagaaacattggaaaacaatatctttacctgcaacatccatccccgcaaaaaaaagttatacccttcatctcaaaatataatattaattagacacaatttagtactccctccgttttaaaatgtaagtcattctagcatttcccatattcatatttagagagggagtactacgaacctaaatatctaatagattttttaagcagatttattgaagcgattttcagcaggtacctcttctcttagaaatagggtacttgaattgttatagtttagaacggggaagtttcatcccgcaaaagaaaatgttgcaattttcattaccattttatgaatgtaatgcagagttccactgttgtgttctgttcaggaaagaatgagaaaaacagtccaggttatggattattgtttttcttttaccactggtcacgaattagttactacagtaacttactactccaccgatgaaactgttctcaagctcttatttcgccataagttccgtgctgtgcaatatcagtaatcaaagcattgattgacagctcacgtatttcagtatttgtataaagtgacttctgaacagacatccgaactagaagtactatacactgaacaatttggcaagcgtttttctttttctttttgaaggtaccactttatgcttgctatttttaccttttataaatatatatagagggggaagcaaatgtacagtacaatattcagctaagtctgtgtttagatctagaggtgtaaagttttggcgtgtcatattcgatatacggacacacgtttgaagtattaaacgtagtctaataacaaacaaattatagaatccgcatgtaaaccgcaagacgaatttattaagttaagcataattaatccatcattagcaaatgtttactgtagcactatattgtcaaatcatgacgcaattaggcttaaaagattcgtctcgcaatttacacgcaatatgtgtaattagttatttctttcgtctatatttaatacttcgtgcatgtgtcaaacattcgatgtgatagggtgtacaattttatcaggggatctaaacaggaccaaaggctgagaagaagatgagaaaaaaaaaatagaggcaagcaacatctgcaaaatgttctagggtgggactgcagcaataaattttgctaatgaatcgcatcatcctgtcctaatttggcagatggttaattatcagcaaaaaataaaaaacgttatccgaaattcgtagtgctccccacgtcaaatatcaaacagtcaaactcatatagtcgattagtcgttctccaataggtttaatatattttgcctgtcttattccttaagaaacagtttttggtttcctttgcccggtaggcgcctgtaggagcctaggagggtaatagggcgatgatgtgcagtctttaattttcagcagttgttctggacagtagcaacgaaacctttacagcaaggaattttaagcaagcaatactcgtcatattcatatccttcatccgtacccttgtcatcaaatactattttttataaacttttacagccttttttttcaataagttaaattatttaaaaatatattatattatcgacatactcgatccatatcaaaatagactaaaataatacaggatgtgatacatactagtactataatatatttctgtctagatcgtagtattaggctgtgttatattctgtggtagtaggtttgtttattttagaatgaaaataacacttaacatggtggtgtttgaatcttctgaagatgagcattaagtgtttcacgcaaaacgaggtgataatggcatgtgattaattatttcaaacttgaaaatggattaatctaatattttagaacaactttcatatggaaagttttcgcacaaaacgcaccgattagcagtttgaaaagcgtgccactttaattcaaaatttcatccaccattttcataggatgaacgggccttaaatataactatatttgagttcatcgaaacagtgtaattcagaagttttaattgtcagaaatgaaacctgaatggtcacggcatacattgcccggggtccatgatccactggtttgtcagtctcctcccctggccgactcaggaacagaaaagaataaccttgcggctagctatcggttaagttactctatgccaactccatggctgtgtttatattcaaagttcagtcctttttcatcacatcaacctgtcatacacacataatttttcagtcacatcatcttcaattttaactaaaatacaaactttatactgaactaaacacagcccatatatgagtatttaccggcttttaatcagaaaaattgagaggctgatgcatggggccatggcagttacattcaggtagtagtggttctcttttacctttttgcgaggacattcaggtaggttgatgcattaacatccacataatgctagtcacgacaaataacagtattaactagtattaagtggctatgtagtctctactacacggcaaaaaaaaattactggccatggtgattttgtatcaagtatatgatcacgaaccatatgctaaaacctcatagtacaaaccaagacgcgccaactgccaaatgcag

SEQ ID NO: 23696 - DNA, 520 bp, Oryza sativa
cacgatcttagaactacacaatattattaatcaaggccgtgaacccacacgaacctgccttaacccaaggcctacgatgattcgaccgaactggcaacccgacctgggtcccagctcgtcccaagccaacccaggccaaccattccatattttagttgttaagcaggttttaagaattaaaacactaacttgggtacattgctcggcttgcccatatccgagggctcggctattcgaatagattatactctgatcagaggtgtacatctttacccacaagacacatcttcctcacgtgttgccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggag

SEQ ID NO: 23697 - DNA, 509 bp, Oryza sativa
tcttcgcgctcccaagtagcttcttcttcggcgtggttgctccactgaaccttgcaaaaacgggttactcggttcctggtcctgcgctccatggtgtccaggattttcactggcctctccacataggtcaagtcttcgcgaacttcaatttgctctgaatcggcctgctcggatggcattcgaagacatttcttgagttgcgacacatggaacacatcatgcacgttacccaaggaggcgggcaactccagttggtaagcaacttctccacgtcgagcgatgatacggaagggacccacataccgaggtgcgagcttcccttttgtctgaacctgtgcacacctcgcaatggcgtgacccgaagatacacaaagtcatccaccgcgaattccagatcacggcgacggttatctgcataacttttctgccgagactgtgccacctttagattatcccgaatgattctgactttagcttcagcttctctcaggatatcagtcccgaacact

SEQ ID NO: 23698 - DNA, 614 bp, Oryza sativa
gaactgtgctatgctgtcatagcatcttataagcagcaaaaagttggcattattggtttccggtagtatgttcctttctaattcctttaggataatcatgtcaaaggcactcaaacaaaatcatgttttgcaaaactaccatagtatttttctgcacaaaactggttcagctgctcacattaaagagcactaaaatccagggttaatttggagttaggtgcccaattgcattaattgttggattcaacagctttattttttttcctcatgtatgcagcacagctgcagcatggtcaattggagcatgctgatggaaatggagactgggttttaactatatttaaagctctgtcactggtaagtatatttttttatagatttttttgtggcatacttgttaataagcttaaatttattcatagttcgttttccgggtccctttaatgatagtccttttttttggttgcttcacctaatgttcgtctgaaacgcatcttctacgcttctagcacaatggtcttcatctgtgtttctagttaaggttgactatggtacatgtgtttgtattttgttctcattacaaatctatcatcgtacaagtaggaagtgcaaca

SEQ ID NO: 23699 - DNA, 673 bp, Oryza sativa
atatatcccattctctgatttgttcctttaattgctgattggaacaactggctttttcctcactttcttttcttactaatccttgttgaagtgtactatgatttccctttttttttctgcacaaaggatagtatttgtagattttgatatgacaacaaataaatgttattggcctcccatgtgattttatctaatatagttcaattcaagatgcatggcttaagtttaaatccatataaatgtttctgtggagggattctacttgtttggatctacatcccctgatttattagatcataagaaaaatcccggcatctttactacgaaatttgaaatgatacatttccttaaaattcttagagtaacaaataagtggccaaacttttcttttcaggagtcccttatggtcattatactgccatgccatccaaagaatgtcacatggcaaaaggtaagagtgatatactgaagtaacttgataggatcatgggattcatgggagaatgtaaccgttggattcatctaagattttaggcataaccacatctttatgtgatggatgtcctggatttatgtcgcactttatgttagtccattacttagccaagtatcaaagcagtaggagtgatttaacatgactttccaaatgcccgcctttcatttcttttatgac

SEQ ID NO: 23700 - DNA, 3866 bp, Oryza sativa
attcctgcagcccagactgtagtttttcaacatctagtctcttatgtagagtgctaaaatccttcttaacattttcaaaagtcactctatgatttacatccgtgtcgtctatcacaatagacaaatgtcgtacagatggtggaatttgcacacttctcacactagaactacttatagcaagatattcatatgatgaaacctttagtgctaactcatgtagtaggtcatgcattgtatagtacggagacccatttttgttcatgtcttttctaaaaaatccataattaaccaaatcattcaaatagctcagtcctatctcttcgacttttttgttttgattccgcgattgtaatatgtctagtcctatccacaagtgaatcatctcgtcactttcaaatctgtaatcttcagggaacagagcacaatatgtaaaacaatgctgtagatgaaaagggagatagtcatagctaagctttagcgctggcataatatcattctcaccggtttgcagttcccattctctactttcgaggacacttgtccaatgctccaagtcaaggtgatttctcaataaccgtcctacagtttttgctgccaaaggggagcccttcaatttttccgctatcttcttcccagtgacaagtaagtccacgtgattgcctattgatttctcatcaccaaatacacatgcttggaatagttcccaaaacacttcagattctagcccttccaactgtattgaatgatcaattgttttaaccatttctgcgactgctagaaaacgagtggtgactagaattatatttcccgttgattgtgcttttcttaggggtgctaagagccttctccactcatcctcattaccacaattccacatatcatccaagacaagtaaaaacctctttgatttcaacctttgctcaattaaatcgtctgggccaccagatttctcatctttgagttcaggcattaacttggcaatctcctctttcaatctatacacattgaaattgagagagacacagacccaaaccttaacatcaaaatggttctgtacctccttgtatatatgctgagtgagagttgtctttcatatcccacctgaaccaacaattggaatgatggtcaggtctttgccacaataatcaccccgagtaatgccaataattttatttatctcactcatcctcccatgaaatttagggtctataaactctgaagtggttacaggccggctcatagcaacgctgcttggaagaaaaggtgcttgccctggcatccgggaaagcgcaacattgagactcatgaggccaatgttgcggtttgattccaacaactccagattaaggatggtggagaccttggcgcagactggttttagctgctcgacgatgtgcttcattcttgtggacagatccaccctgtcaaacttcagctttggtgttttcatggtgtgctctatgtgcgatgctttgcaaggataggcgcagcagaggaactggcttctttctgtaggaatgttgcaatggtgataaggtgtcacaaccgtcatgttcagttacaaaagagaggcgtggaaggtgtttatattatcaatgagatggatagtaagtacctcgagcattggaaaagagcttgtgaatgcagctgctgcctgcaagtgcttccccatcgttggtatggcgactcgcttccccattatctccgcatgagcacgccttcttcttgatgtttctgactgtgcggcgtgtgttgagcacgaggccatagaggcagcccttggcgtgctcttcggcggcctcgtaggtgccatcaagctcgtcctggatgcggaagtagtcgagctcgtccagcacgtcctcggcgtcgtaggccaggccgcggagcttcaggagcagctgctgcagcgcggggttgctggtctctctgctgcgagcgttgtgcagcatcccctgcgcatagagcagctccatcttgatggcgtcgacattagggccgagctccgtggtggcagcccacgcctcgacgaaccctcccgacagcgggctcagcgccttgccgaccacccatcgcgccgcgttcacggccaccgactccatcgcgcgctctcctcgacaccgggcacgagtaggatctctcagctaagccggtggtcgaccagagagatcagcgtacaatgaaactgcacagattcacagagaggtagtagtagcagtggcaaagcaataaaggcctttgttttgattccctcctgctttatccttgtggcaactttggttgcacctttattctaaaaaaaagaggcagtcaatgaaaaggggcagtactcttgccctcttattctaaaaaaaaaaaaaaaaactttggttgcaccttgactcctacgatcaaagacagcctgggactgcggcagcatctgcttcgcttcgtttgagatggttcatgtctggacatccgatgcggcagcaggccagcaatcaagcatctgttcgatgcttccttcgctaccctgatcgtgaaatctccatgtgccgatgggcatgtcacacagtcacaggcatgaattccttgggaatcacagtgccaggctgctgcttgtgctgcactacctgctgcgcaaccaagaagttttgtgttcctcttcagctgcttctctgaggaaaagatagacaaacctggtttgcacagtaaaaattttgcctgcagacgaaacgctagagcagcatggagactctttttcccagtgccgaaccaacaaaattgttctaaagtagatgatgcactatgcaagttctcaagaggattcagaaatggaaggtggaagaaaacacagagcaaacaggaaatataaccaaacagtgcccattgcttgatttaaagatggtacatttcggaaatggtggcctctccttgagtgaaatgttaaattgattggctacctacgatagtgcattttaaactctcgcggaacatctcctcattgtctgggtaatccaaatagttatgaaaacaaaaattaaagaagacgtattaatatgtgatatatcactctacaaacataaaagttaaactatagctattcacaataaaatttattattttcgttgtaacatgtagaagttaaatttaatattacacgtttgtagagtgatctattacatattattatcttcttttatggtttttcataatcatttaagtgacatgcaaacaacggggatgtcccctcgagagctttgaatagttcccgctaattaccactttctcttttaaaaggagaatctttgcttttattgaaagcaacatagcagtactgatcactagtgagtaatgattctccctgatccacatcagcttaccagtcacttgtttctatcatcagtccaatttgatagcagtgttgcctgcacatcttgcattttccaatttctactcccttgttttttcgctgcgtgcacatttcctgaacagctaaaccatgtgttttttaaatctatacctaactaaaaaatgcatatggctttcacacctattttcgtcaatcccttcctccctccctcccacacagcgccctccttcccggcgccccatctcttttcgtccctccctccctcccgtgcgcctttgtgtagcgcccgttccgtcgtggcgcctagcgggaaaattatctcttaaaaaatctaattgcgaaatttgtttatttgcttgttgtctagtgtccgtgccatctcaagatctcaaaccccgatctatcgtcgagttcaaatccgaatccaaatccttccaaatcaaattcctccgcaaaagtctattttgcctcccccggggggtcgatgggccgatttcctcccggcccatctccccct

SEQ ID NO: 23701 - DNA, 9393 bp, Oryza sativa
cgccgagcgctcctcctcctccgctctgtccgcgcgcgtgcgcgtgagtcaccgcgccgagcgcctcctcccctcgctttccttctcctctccctggcgagctccccgctcgcaaagccggcccccgcgcgctgttgttcgcgcgcgcgcccacgtggtcctcgcccgcaccgcgtggtcgccgcccggccccgctgccctgccgcgcctgcagccgctcggccccgcagccagcgcgcgtgctcgagccgcgcctctccatccgccgcgtcctcccattgcaagccgcgcgcgcgtgccgagtggccgaccatctggtcgccgccgccgtcaccctctgccgcgccagcctgcgcctgtcgcccgtgtcgtcgcgccgctccaaaccgccccgccgtcatcgccgtcgtcatcgcctcggccccgccactccgcgcgcaagccgccaagggacggaggccgagccctcctccctctgcctcgacacccccgctccccttccccttttcccaaagaagaaaggggcgagcccccctttctctccctcctttttccccttttcctcccgccgtcgtcatcctccctccctcctgtcgccgttttggccgctagccggagcgacagctcgcgccttgaccgccaaagtcggtttccaaactgacattgccgccccctataaacccaagcgccctcccttcccttttctcccattcttccctgtttctcgcccgcgccattgccgtccctctcgccgaccgcagccgtcgcgtgtgtgccggaggagccggtgcgcactaggacgcggaaggggactccgggcgctcgtcttcctcctcttaaccggcccgatgccggagagatccctcccgcgccgtcggcctctcgtcacagcgcccctcctcacctcgtgatgcctccctccgttcttcctcctcgctccatctcctccccctagctttcggtagtagctcgagtagactccccgtagttagccggcgccgccccgaccgttgccgtcgctcgccgtgtgctcgccgccgtcgccgctcgagctccgtagcacccacacgtcgccagccttgctcggtgtagctccgtccaatccgacgctagcatcgagttcccgaaaccgcgtagatgctctcaccgccgggaatcggtccctcgtgacctcgtcggcgtttccctcttccctccccgccggttgtcgccgccgcgattcgccgccgtcgaactccctctggcgaatccgagccgttggctcgtctcccctcatcacgaacaaccgcccggtgtgctagcttttgcccgtatcgccgtggttcgctccgccgctcgccgccgccgcccgccgtccattcgcggccgggtcgtcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgctgcatccgcgtccaccgcgaaccgcgcgcgtgcaccgcgtccctcccccgctcgcgcgcatgagccgcgtactccctccgcacggtgagccgagccgctgacaagcgggtcccacccggggccgcgcatggtgagcccggtccaccggctctctctctcctccctcccgcgcgcgcgcgtcttgggccgctctgggccaccttcttgggccggccggcccgttaagctcggccgagccgccctttctctcgggccgcgccctagccgcccgagggaagtctatattccctccctctccccttttcttttcttttcttttcaaaaaaaaaggatttaattaaatccttttcctttagaccaaaaatccaataatcttagaaattcaatatctttccaaccgtaaatccgtttgactccgttcaaattccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagccccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgtgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaatgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgtagcgcccgttccgtcgtggcgcctagcgggaaaattatctcttaaaaaccctaattgcgaaatttgtttccttgcttgttgtctagtgcccgtgccatctcaagatctcaatccccgatctatcgtcgagttcaaatccgaatccaaatccttccaaatcgatttccctccgcaaagtttagtttgcctcccccggggttcgatgggccgaattccgctcggcccatctctctctctctctctcccgggctctctttctctctctctctctccctccccggcgcgctccttcacccccgctcagcctcacccgcgcgctgcccgcgcgtgcgagagccgccccgagcgcctctctccctccgccccgctccgccccgcccgcgcgccgcgcgcgcgtgagcgcgtgtgccgccgcgccgagcgccccctcgctctccgtctccccgtccctcgctgccgctccccgcgtgccgttgctcgcgcgcacccgcgctgccgcccggtcccgccagcccgcgcctgtcgcccgagccgcgccgttcaaaccaccgcgcctcccgctgttttcccgcgcgcgcgtgccgagtggccgaccgctcggtcgccgccgtcgtcagcgcctgccgggcctgttggcaagtttgccggttcggttcaaaccgccgccgttatcccgttgttatggcccggccccgggccattccgaggccaagccgccaagggacgaaggccgagccctcctttccccgtggggggtcacccccgctccctcctccttttcccgatccggcaaaggggcaagccccctttctccccctcctttttcccttttcctcccgccggggtcatcctccctgtcggccaatttggccgatagccggagcgtcagctcgcgccttgaccgcgcaagtcagtcctcgaaccgacattgccgtcccctttaaacccccggcctccccttacccctcctcttccattcgtctccgcgctgttgccgcgccccgtgctctgtctcgcctccgccgtccttcgccgagcgccgggagagccggtgcattcgaggacgcggaaggggacttcggccgcgccctctccttccccttccccggcccgaggccggagagattactcccgcgccgtcggcctctcgtcacagcgcccctcctcttctcggtgatgtctctctccgttctccctcctcgctccgtctcctccccctagctttcggtagtagctcgagtagaccccccgtagctagccggcgccgccccaaccgtcgccttcgctcgccgtgtgctcgccgccgtcgccgcccgagctccgtagcacccgctcgtcgccggcctcgctcggcgtagttccgcccaatccgacgatagcgtcgagttcccgaagccgcgtagatgctctcaccgacgggaatcgacccctcgtagcctcgtcgccgtttccctcttctcccgccgccggttgccgccgccgcaatccgccgccgtcgagcaaacctccggtgaatccgagccattggctcgcctccccctgtcgcgaacaaccgcccggtgtgctcgcttctgcccgtatcaccatggttcgcttcgccgctcgccgccgccgcccgccgtccattcgcggccgggtcgtcgtctaccttccgccggcctgcatggcagccacgtaggcgccacgtcggcgccagctcagcctagaccgggtcgagccgaccccggtcggtccctccccgtgcgcgcgttccaccgcgagccgtgaggctgcgcgtgggcccgtcgcatccgcgtccaccgcaaaccgcgcgcgtgcaccgcgttcctccccgcccgcgcgcgtgcgccgcgtgctccctccgcacggcgagccgagccgttgacaagcgggtcccacccgggaccgcgcgtggtgagcccggtccaccggactctctctcccctcccccgcgcgcgcgcgcgcttgggccgttttgggccggccggcccattaagctcggccgagccgccccagatcccttgggccgcaccctagccgcccgaggaaagtctaaatttcctccctccttccttttctttctcttttccaaaaaaaaagggatttaatttaatccttttttccgttagaccaaaaatccaataatcttagaaattcaatatcttcccaaccgtaaatccgtttgactccgttcaacttccaaaattcatcaaatctcgagatctatctaatggcacgcttagaggtcgttaatagggctttattttcgctgtttgttgagttgccccgtttcgcgtgtagtttcggagcccgaagacccgcagtgcgaggattttgaggatcaagctccagatctcgagcaaggcaagccacctttgaacatcttgagcctatatttgaaattcaattatgttgcttgcaaaatattatgcattgataggatcacacttaatctgttgtcccatctgcgaagcagattggcggacttacttaatttgtcgcatttgatccttccattgttaattgctataccatgtccccttgtaaccacccagttgcgcctcgatactcgcgcactctgtgcgagtatcgacggtcgccttcaaacttaaaatctgagtaacaacttgggtaaaactggagttttacaaaagacttggaaaacccgacacttgggtcggtgcttgcgaactaaatgaatttccaaaaccgcggaccggggaacgtaccgagtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcgggtaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgacccgggttagtaatgtcgtgtgggtaaagcgtaccccctctgcagaggtcattaaactgttcgaacagccgtgcccacggtcacgggcggatgtgaggtgattcctagcgtagttttgtttgactactgcttgtgaaattgccgttgtgaaaatgggttcgatgtttgaaaaatctgtagctgatgggatcagctaggcccgggtggccgttcgaaaagttgttggcccgggtggccgtttaaaaagtggttggcccagggtggccgtttaaaaagctattggccgggtgccaaccttgtttcaaaatctaaagactgatacattgcacatactccgaccggacaagacgcactgtctcatccgtgtcgtttgagaagcactcacttagttgcttttagaaaataattcaaataaaatcaattgcaaaaacaacagcctttccttgaagcctgcattaaacacttatttcccctggcttgctgagtactcccgtactcacccttgctctatataaatattcccccccccccctcagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatactctgtctccctgtgataccagcactgtttcctgggactggtatcgattaacaggttaatttggagcgtcacgggctagttccggtcgggactagttcggggcgtgacactttgcttccgcctccctctctctctctttcaggaccatgtcgttgccagtcgcgttcatgctattcttattttattcgttgccaacctccaccatctatggacaagacacatcatgggacacattcttccatcttcctcagcaccatttggtcgcccgagcaccggcgcccatctttcctcctcttttgtttctcacctttggttatgaaagacaatgaacattgcgtattgtgcactattccttcttggtccagtccaaccatgcttctagaccactcacataatattgagatcataaaaatagaacatgaaaaattctaattatgtcaatgaaacgggcactcatccaaaattaatggattaggttttcatctatgaggtaaaataagttttttttttcaatttctagctaatttcagtttttttctatttgctgtattagttttagcactatttgatccattaaaaatttattataatttataatttttctctgtattgaattatttatagctaaataaaaaaatggggatttagttatataattttcctaatattgaaatatcattccggccaaagttatttgcagtttcatgttgttattttattgattatattttcttcatcatttatgtctaattgtgatatatggtttaggattttaatttgtgtcaatgaatgctaatccattgcaacgcacgtgcattatgctagttataaaaaaattgcttgaaaaaaatcatattaatccatttcttaatttttaaataatgcttaattaattatactctaatgagctgctctgttttccgtcctaagggtctgatgcttggattaatgagcaatcgattgcccaacaagcacctcaccttgtggaggtagtttcagctcgactgcgacgctcccgaatggtggcggaggccatcctccataggcagtggacgagggacataatccaaggtgcactgaccatgtgactgatcgttgattacctctgtctttggccagtgatcgaggctactactctgatccccgacgtcggcgaccagatggtccggcgatggtctagtgatcatcaatacttgtcgagttcggcctaccagctcttcttctccggcatgcagccgttcccctgctggaaagagctttggcgggcttgggcactgcctcgatgtaagttcttcctctggctcgcacttcagaagagatgctggatggtggatcgactcctaaagcatggcatggcctagacacacatcctgcccttgtgcagccaagatgccgaggacgtcaatcacgttcttatctgttttgtcttcttgaggcaagtctggcagaaggtgttggccatcgcgaggctcactcttgctgcgccaatggaccaagacgacctcgtcgactggtggtccagtgctcgatgatcagtggacaaatgcaccttgcctagcctcgactctctcatgctactttgtgtcctggtgcctgtggaaggagaggaatgctcgggtcttcgacaacaacctatcctcaattcaggcggtggttgatgagatcttgcaggaggttgctgctagcatagcgcgatcgtgtaaatgtatttttcacagcttctaacatattgacatgcaaaacttttgcgtgttatgaaaaaaaatattcaggtaatgttcattcagcttctgagcttcagctcgacttctgtcagccatttcattaatcagacttgttaccagactgatgcatcacaaccctttccgacattgcctgtctgaatgacgtgcgtgtagatggttacagattgcacatttcaacttgcttgatgacgccgccctgcagctttgtctgcgaataattttacaggcatgtcgatgcaactatgggagaagttcgatagagaaatggtagtaatctgcaacaataaaacatctgtccccaaaatcagtactctgtctggtttagtggcaaaaggatgccttcttttttccctgaactcctaaagcatatactcctatataagttaaaaaagaagagaaaaaagaaagccagagaacaggccattttacaaagagagatagagaagagtgatatgatatctgcagccatcatctgattttttttctttgaacatttgccgtatccccttctggccagtctgcaaaacagcccgggccaagtcagataaccatgcgcgtcatcctcccggtttacttataataatggaaagatatatcagccgctgcaccaccacaacctatatggctatattactagtgaaataacaaagtacatatgtttaaaattgtaaatttaccagacagggtgtagaaaatgtcccttgtaaccagcagcctccttgactccttcgttagggacttgcaggctacacctactgcagggaaaacagaacttaggtgtgttttacagtctttccttggcaaaagagatgaaacaattatctttagaaagccccttacatgaaaaaaagaaagttaatgcaggagcaaactatccagctaaggatgccatagtacttctgggctgcaggaa

SEQ ID NO: 23702 - DNA, 1848 bp, Oryza sativa
atgtctgtttctactgtgaagttttaactgaatgtctgaatacattgcaccaccttgatgaactaaagaagaagaaaaactagcatggcatgctgataagttttaacccgtttctcgaactaggcttacacagtgttattagttccagttcatcagacagctattttgtgcatcgaatctcatggtgtcaaattcaatgatcaaactaactagtaaaattgcagtgaaaggcaacagttttctcaaagctaataattctattaaaacctggaaccggttaaagatctgatgaacttgtatggtatcatcaaccagctttgtgtatgtttttcaaaacaacaacaacaacaacatcttttgtgtacagacgaaggaagaagcacaatccaacactaccacacctatcaacataaaaaaaaggttgtgcatggatgcaaagaaaagaagagattctgagagggataaaataggagtaccttggattagtactctctatctttgatgatcggaattgttcctcttagcttgcggcactgccttttgagctcctcgttctcacaacgacagacatctagttcttgcaatgaactcgaaaggccaccctttggcagtgaacagatggctggacaccagtcgatctctaatatcttgaggccgacgagtctgtgtaacccagtgggaagggactgcagcttccggcaggagtaaaactcgaggtcctggagggaggaaaggaccagaagggcctcactctgctccttggtgatgcgctccacctcatgattaaaaccaatggttagcttggtgagtgatgaagaaatgaggctgcagattggtggtgcaaggacccttgcaatgtcatccgtttgaagctgctgcagccgcgaggggtcagacctgacgaagaatttgggggtcatttggatgcgaaggtctgtgagttggccatggtcgagcagagaagacaagccctcaccacttaagtccatacatttccatatggttaatctggtgagagagctgaggtttgagaggggagcaagagtctccatgcctctcacatcactcagatacatcttttgaagggaggatggaaacgggaaacaagacaaggaggtcgagtagtaggaggagaggaaagtggggcaaccccaaatagagaatgctcgtagggagtgcaggccttgtaatcctcctcctatgcctcttaagcctccttccatgccatctacaagagaatggatctgcaggatcagctctgggatttcgctgatgttcaactcctgaagttggtgaggcaagagcaatagtcctgcttcagctgacactttctcatcctctcctcttggttgttgctgctccagtccgaaacgagcatcctccaacttattaccacaaggtgatgatgacgatgccaacattgttgtcatctgcttccccagcacaccaagccctcttatcttattacatctccttgaaataaacatggagagtttggggaaatgagatagaaacaacgtcaattccttcccgctacaaccacactcaaagatctccaatttctcgattggaaactggtagctgacagtgttctcagattcaagatgtgacatgacattgcttgagtcagatatagtgagtctcctcaaacatgatagcattaggaggtattccagcggcaaaggagggcatttcttcaaatccaactctttcagatcagttagattaccaaaaaccaatctcctccagaatgcaccatctagatgttcatcctttcccttgactagcatgcataattcatattgcttattttttgagtaatccaactgctgaaaatccaatccaact

SEQ ID NO: 23703 - DNA, 6498 bp, Oryza sativa
gatatgctcttcttgtaaagaatcctttgtcaaacgtttaatatcacaatctaatatcaacttgtgtaagcgacttttgtttgaaagttctgcttcctctggtgcctgcgcattttcaagattatagatgcccaatgacccttttaggtcttccaactgccccagctgtcttagtgcaaatgcctcaacttgtctttgaacttcaaatctccttaactcttgtaaacattttagctttcccacactagcaatttcagagtgaagattatcatttgggacaagaaaatgccgcatccttacaaggtgattcatatctcttggtaaaccaaagtgaccactgcattgtctcacatcaaggatcctcaggtgataaaatcttgaaataatgttggacagacttagttcaggaaaatatcccttattaatccttaagtaacgaagatgaacaagatttgaaaagttgtgcaacatattctccacagcataagatgctacagacaacaagatgacacggagggcttttgctttacttaacaaattaccaaaaggaatgacaaagcttccattgttttttccaaatatcattagagagtgtagcttttcgacatcaagcctcttacttagtgtgccaaaatccttcttaatattttcaaaagttgctctgtcgtttacgtccatgtcatctatcacaatagataagtgccgtatagatggcggaatttgcatagacattactttagtattacttatagaaagatattcatatgatgaaaccttcaatgctaactcatgtagtaggtcatgcatagtgtagtaaggtgacccatcttcattcacatcttttatgaaaaatccataattaaccaaatcattcaaatatctcaacccaatatcttcaattgttttgttttcatcctgggaatgtaaaatgccttgccctatccacaagtgaatcatctcctcactatcaaacttgtaatcttcagggaacaaagcacaatatgtgaaacattgttgtagatggaaagatagatagtcatagctaagcttcaaagctggcataatatcattttcactagtttgtgattcccattccttactttctaggaccctcatccaatcatccaaatcaaggtgatttctcagcaatctacccaccgtttttgctgccaaaggagagcccttaagttttttcactatcttttctcctgtctcaagtaagttagcatgatcatctattgatttgtcatcaccaaaaacacatgcttggaataattcccagaactcttcaggttctagcccttccaattgtattggtcgatcaaatgttttcaccatttctgcaaccactggaaatcgagtggtgactagaattatgtttccctttgtcattgcttttctgaggggagctaagaactttttccactcatcctcattatcacacttccacatatcatccaagacaagaagaagcttcttagatttcaatctttgctcaattgaatcatccatgtcgacatatttctcatcatccttgagtttaggtatccactttgagatctcttctttcaatctatacagattgaaattgagagagacgcatacccaaaccttaacatcaaaatggttatgtacttccttgtatatgtgctgagtgagagttgtcttccctattccccctggaccaacaattggaatgacggtcaaatccttgtcacagtaatcaccccgagtaatgtcctcaataattctacttctatcacccttcctcccataaaattcagggtctataatccctgaagtagttacaggacgattcatagcaacgttgcttggatgaactagcgtttgccctggtttccttgaaaattcagcattgatactgatggcaatgcatgattccaacagctctagattaaggattgtagagactttggcacatacgggcttcaattgttcgacgatgtgcttcattcttgtggacagatccaccctatcgaacttcagctttggtgttttcatggtagatatgtgcaaggcaccggagtcatcacaattgtcaagaccaggtgcaaaagggaagcatggaaggtgtttaccaacgagatggatggtgctctgagcactgcaagcgaggatgcgcatgcagccgctgccagcaacagcctcctcttcgttggcgtggcgactcgcttcctcgtcaccaccgcacgagcaagaggcagagaggtaccttctcttgatgtttctggcagtgtggtgagcgttgagcacaaggccaaggagacagccgctggcatgctcatcggcggcctcgtaggtgccatcgagctcgtcctggatgcggaagtagtcgagctcgtcgagcacgtcgtcggcatcataggcgaggccacggagctccaggagcagctgctgcagcgcggggttgctggtttctctgccacgggtgttgtgcagcatcccctgcgcgtagagcagctccatcttgatggcgccgacgtttggcccgagctccgtgctggccgcccacgcctccacgaaccctcccgacagcgggctcagcgccttgccaaccacccaccgcgccgcgttcacggccgccgactccattgatctgtctggtctctactccgctagctaagctgaggagagtgggagggatggaagagctgtggactgcgagagaacaaagcagtccaggagtagtagagaagggaatggtgaatagcgagcagacagtgaagtgaaggactaccaaaccacggcagaagtattgtttgttttctgaaccctctgttcgaactttaccaaatggtgttctcaaaaatggatttaaaaaaaccaaagtcgtcctgctcttcttgaatctgatgccattccgtgccatttggaagataagaaaaaaactaaacgtctaatcagcccccaaaaccataattagaacgcaatagtaaaggtacaggcggtacagccaatggatttacttaaatctgttgcgattgcaaaggtgcataatgccagattcgccactgttcattcagtaaactaccgggatagagcaatttgcctgcatgtgggatgtggcacagaggaagaacagatctgataagcaacagcctgtgctgtatcagtgatcaaagtaggcatgaacagaaacctgcaagcaaccaaatggaagtaactgtagtgtagatgcagagagcttaaggaacatacgcttcaaagcgatttgcgctctgggggtgcaggcacacaagaagagtagcctcacgtacatcgtggccggcgcagcggcggcgatcgtgtggaggcgcgtgtgctcgttgccggagcaaggccggcggcgggagcggagcccctcgccgaccgcccacccgccgagattctccgtgtctaccactctcgagtctcgagtgagtctccgatggtcgagtccaaccccaacaaccaaacagtcccgcgtgcgcatgtatgcctccactccctaggccaccccaccacatgtacacacacaaataactctattaaaaaaaacccatatattttgaaacacctctattaagagaattcggtttatttttgtttcacaaaaaaatatttcacctagtatactcacaatgttttactgtgtatagatctaatgttgcagtgaactgaaatattccattgcaacaaaaaagcccacatattttggaaaccccctattaagggaattcgttttatttttttttccaccaaaaaatgtttcacctagtgtacttgtaatgtttcaccatgcctacactcccctggctcaccacgtgtccacacacaaacaactctattgcaaaaaaaaacccacatattttggaacccctctattaagggaattcggtttattttttgttccacaaaaaatatttcacctagtgtactcacaatgtttcactatgtatagatctaatgttgcagtgaactgaaatattccattgcaacaaaaaaacccacatattttggaaaccccctattaagggaattcgttttattttttgttccaccgaaaaatgtttcacctagtgtacttataatgtttcaatatgtatggatcaaatgttgcagtaaattgaaacattctttcgctatttgctgaaacattgtttttatataaggtgaaataacacccgatttaaacgagtgaaacattttcagtctacttagtgaaacaattccgatatacctggtagaacatcgtgcaacatttaaaaataattcaataataagctaaaaaaaattcgtcggaatatatccatgtgtggtcttgttttaaagatttaattgcaacgaatttaatggtgcaatcggatcatgatttggataagtaatttaagagaaaaaacagtttaaagtaattttgcacgtaaattggacgctgacgtcatgctgacattagcgcccgatttcaccccctcccgattgggcgcctgaccaggagtcgtcccatttcaggtcccttaacttacaccgaatcctattttcatcccggaaccgaaaaaccagatacaacaagtctctcaacttataaaaccggtacaaacaagatccctcaataatattatccctaattttaactcacatacacctacgtggctaatttgactaggtcttcgtcctacgtggcattgattgacatggcgcttacgtggtagtttaattcgggaaaaaaaatgaaaggagcaaaattgaaaactaaataattaaaacaaaatatggggtccccatgtcagtcaaataagataaaaatagtgggactcacatgtcgatgggtcccacttcctccacctcactctatctcctcaatctcttcaccgaggcagtgccgctatcgacgacaacacaccgaaaaggcagaggagatgcgaggggatagggtgggagccctgcccatggcgagaacgcagtcgaggtcatctccgtcgcccccaccgacgcctagctccttgtctcctctagcgacagggcgggaatggagcggcgtgctattaacaccaaaatttggtaagcccgaagtcatcatcggcatagagtcactatcggcttcagagtcttggaatcggccgatgggagttgtcaagtcgccagcaattgtgttctatatgaagtcggatcaattaaagaaaatttatccaaaagagtccgagttcaaggaggatgcggcatgacaagtatatctattaattaagaatagtatgttagttttcttttatctctagaaaagtgtgtttatgtttttcgatacctaatttataagcaatccccgttcatcatctaaaaatccaatcatattcaaaaccactttgccaataatctttaaatttaaaaactaataatctcactagtgaagtgaagtggagcggagagtaaacatactattgagtgagctgatatcgtcatatcatgcgcctgaaaaggtaaagaaaaactattgcaaagttaagaacctcttcctgatcaacaagtaatagctatttgctctcagaggctgagggcaaaaatgaagcttgcattcatatgatttaagaagaatatgtgttccaattatgaactgttaagaattaataactgaaacaagtgttacgaatagtagaagaatatgaaagatcaacaagagtacatgacttgtcaatgacacattgacttgtcttccttaaaacaatacaatctctcaaaccgtgtcattaacattttgcataagttttagttcatcagataactactttgcacactgagtctcagacatcaaatttgacaaggagctgaactaacagatcattaatttccgtgaaagcaaacaattctctcactgacagaacagctgaaagattaaaaaagagaacagtgacaaaataagtatataaccaaataaaggagcgacagcgaagaacttatatgagatgttagtgtagacgctggaagcggaacaagttgacgtcttcacacttatcaacacaaaactgtgtaggatgcaaaagattatgcagaggcgctagaataaggcccatatcaatccaagatgaaacctgcacagcaggttacaaggttgatcagatcgatgagtcaagcagtgcgtgcattttaccaaacagaaagtaatcgggtatgagttgaaaaggggcatgtttgttacctgtaccttggattattagtactttctgtcttggatgatcggaatggttcctcttagcttacggcactgtcttttgagctcctcgtttttgctctcactgacatctaatacttttagtgatctcggaagaccgcccttgggcagcaaacggatggctggacacaaggcgatctctaatctcttgaggcgggtgagcctgtgtagccctgttgggaggaatcgcagcttcgagtaacaccaaaatcggaggtcctggagagaggagaggagcagaagggccgcgttttgccccttggtgaagtgctccacctcgtcgttccagcccatggtta

SEQ ID NO: 23704 - DNA, 16561 bp, Oryza sativa
tttctcatcctcctctcctggttcttgctgctcctgtccgagacattcatcctccaacttactaccagcagacggcaatgacgatgctgacattgctgtcatcccctgcttcgccacaccaagccctcttatattctcacatccccttattacaaacattgagagcttggggaaatgggatgacaacagtgtcaattccttcccgctacaactacagttaaagatcctaagtttctcaacaggaaattggtatctgacagtgttctcggctttgtcctgcaacaagacattactcaagtcttgcatacagagcatcctcaatgatgacagactctgtaggtgttccaatggcaaaggagggcactttgtcaacgtcaactcttttagctcagttagattactgaacaccaataacctccagaatgcactatctagattgtcgtcctttcccttaactagcaagcataattcagattggttatttgttgagtaatccaactgctgaaaatccgatcccacttcttcaatataagcatggcatggacagcttgtccaaggaatgggaggcaatgatgacaacttttgacaatttacaatctcaagcttctttagtgtagggaattgggtcaggtttgtcccttgttctggccgagagcaagtggtgggatgtgaaaatggcaactccatcagttcagggcaatctcttacgatgagcacctctagcagggagaacacatggcaagcatcatttccagcccattttgacaatcttggtatggcaactagctccaacctttttaaattcggaaagctccgatctgttgtacaatccaaggatttatgaccatgctcattaaccaatgacaactcccctataggcgggaaattgttccagtcgacacaattcagacgaagagatttcaaacctttcatggacaagttaacacccaaccatgatgggcaagtggcgccaccatgcccattaatgtgtagctccaggagattgctatgtggtttaagattttccaggatatgttcttcttgtgaaggatcatttgtcgaacgcttaatatcccaatctaatattagcttgtgtaagcgacttttgtttaaaagttctgcctcctttgctgccttcacattttcaagattatagatgcccaatgatccttttaggtcttccaactgccctagttgtcttaatgcaaatgcctcaacctgtcttttgacttcaaatctccttagttcttgtaaacatttcagctttcccacactagtaatgtcggagtggagattatcgtatgggacaagaaaatgccgtagccttacaagattattcatgtctcttggtaaaccaaagtgacccctgcattgttgtaaatcaaggatccttaagtgataaaatcttgaaatggtattgggtagactcatttctgggaaatatcccttattaatccttaagtagcgcaaatgaataagatttgaaaagttgtgcaacatattttccaccacgtaagatggtgcatacaacaagacgacgcggagtgcttttgctttgcttaacaaattaccaagaggaatgacaaagcttccatggtattgtccaaatagcatcacagagtgaagcttttcaatatccaattgcttatgcagtgtgctgaaatccttcttgatgttttcaaaagtcactctatcatttacatccacatcatctatcacaatagacaagtgccgtatagatggtggaacttgaatagatctcacattagaactacttatagcaagacattcatatgatgaaaccttcaatgctaactcatgcagcaaatcaggcataacgtagtaaggagacccatcattttgttcatcttttttgaaaaatccataactaaccaagtcattcaaatagttcaatcctatgtcttcggttcttgtattttgatcatgtgaatgcaaaatgtctagtcctatccataagtgaatcaattgctcactgtcaaagatgtaatcttcagggaacaaagcacaatatgtaaaacattgttgtagatggaaagggagatagtcatagctaagctttaatgccggcataatatcattcttaccagtttgtaattcccattctttactatctaggattcctgtccaatgatcaatatcaaggtgctttctcaacaatcttcctacagtttttgccgccaaaggggagcccttcaattttttggctatcatttttccagtctcttgtaagttaccatgatcatttactgttttctcatcgccaaaagcatatgctttgaataattcccaaaacattttaggttccagcccttccaattgtattgaacaattagttgttttaaccatttccgcaaccgctggaaaacgagtggtgactacaattatgtttccctttgattgtgcttttttgaggggtgctaatagctgcttccactcatcctcataaaccaaattccatatatcatccaggacaagcaaaaatctctttgatttcaacctttgctcaatcaaatcatccggccaaccagagttctcttcattgacttttggtatcgacttggcaatctcctctttcaatctatacacattgaaattgagagagacacaaacccaaatattaacatcaaaatggttttgtacttctttgtatatttgctgagtgagagttgtctttcctatccctcctggaccaacaattggaatgacggttaggtccacgtcacagtaatcaccctcaataacgtcattgataattgtacttttctcaccctccctcccataaaatttaggttctatgaaatctgaagtggtcacaggacgattcatagcaatgctgcttggaagaacaactgcatgccccattttcccagagaactcagaattcagactcattgcaatgcactggccaatgctgcggtttgattccagcaactccaggttaaggatggtggcgaccttggcacagactggttttagctgctcgacgatgtgcttcattcttgtcgacagatccaccctatcaaacttcagctttggtgttttcgtggtgtgctctatgtgcaatgctttgcagggataagcgcagcagaggaaccggcttctttctgtagaaatgtttcaacggtgatgaaggtgtcacagccgtcatgttcagttacaaaagagaggcgtggaaggtgttttatattatcgatgagatagatagtaagtagtacctcgagcattggaaaagagcttgtgaatacagccgctgcctgcaagtgcctcctcatcattggcatggcgactctcttccccattatctccgcatgagcacgccttcttcttgatgtttctgactgtgtggcgtgtgttgagcacgagtccttggagacagcccttggcgtgctcttcggcggcctcataggtgccatcaagctcgtcctggatacggaagtagtcgagctcgtccagcacatcctcggcgttgtaggcgaggccacggagctccaggagcagctgctgcagcgcggggttgctggtctctctgccgcgggcattgtgcagcatcccctgcgcgtagagcagctccgtcttgatggcgccgatgttggggccgagctccgtgctagcggcccacgcctccacgagccctccggacagcgggctcagcgccttgccgaccacccaccgcgccgcgttcacggccaccgactccattgctctgatccctgcaccgctagcaagctgggttagagatgagaagcaagcagtggcagacgtgtaggggagaagaggctggaatgttactctggctaagagagaagcaagcaagcacactggcacagcgaatagagaagggctaaggaaacgtcgtgcagactgcagagttgagatccgatcggtgtcagtctggctgggcaaattggcttgagtgtaacatgcttaggcactacggcactaccttgccgcatttttatttggaatcagaaatcagtaacatgttctccctgcatggcttgctggctgcaatcttcagaggcttccctatttttgcctgcagcaagaatgttagaaatgcgtggttttcgttccagtcatccagtgccggacaaagcaaaagtagttttgcaggcttacagtacatctgtttgctgtgcaagtactgcagaggcttcaaaaggaagaaaaaaaagaaagagagggtgttatgaaagacaaaatggcaaggtaacagttatacaacaaagaagaaacaagtgttggaatattcagaccgggaagaaagcacaagcattcaaaatttctcaataaaaattaaactatccttactggggtaatctgttttccatttcttataaaaacaagcaggtttattttctacaatgacacgccatatataattctctgcagctacagagagtgtatacaatgatagttaaagataacttaaactcacaagaatacacgtaccttttttttccttataaaacaggcagtttatttttttcatcaaagtcatcagaacaccatggcaacggaacagaggtgcagacgttgcaattgaaaacgagcatcatgccgcattccccggtttgttcagttgaaacgaccatgatctggcataggcctcatcttttcattgaacaatattaaagctgccatataaccaaataattgatgggcaacttgcccactttcaaagcaattaacatggctgtacaacatgtgctctccttgagcgcagttgactatccattaggttctactaataatcagaaatctccgatcagcatcagtattcattttctaacttcagtttttcttgttaccacttgtgacctcctcttggcttagaacaacatgccacattcaccaaacgccagagtaaatatcaagaaagcaacacctttctggatccactaaaccatcaactgcgttggctgctatctcttcatggtatgttcatgcaggttgtgatctccaggttgccattcatgcctgcaacatcagtatgaccatgatctgccacttgccgcttgtgcaggttctctccagaggtgccattgcatgtgtaccattgccatttcaacagcaatatttcaggcttcacttataacacctcatcttttataaaaactttgatcttcagctaccacatgcttgaccacttccctttcggctcttttggtacttacctacttatcccacataaacttcatatcatctccaaaaaaaatacaaatttgaatgtgtatttcttggaagctacaacttcagttgaccggactcctaggccgctcaatttgaaggaggtggtttctggcgcccccaaagcccaccccatagccaccctccttcccacctccttcctttttcctctcattttcctttttccctctctttctactccagatccgttttcttgcgtttttgaagtcgtctggcgacttggtggtcgtcgggctggcgagggccggatccgcctatggcgcccctggagaaatacggattggaaggcagctgtttagggcaatgtggcggcagggaggtgtgctggttgcgctggtcaccggttgctacttgcgtctcctgcatgcgtgcggtgggatggcggatcagttgttggtgacttgatggctgtcatgctgatgaggaccagatccactggtggcgctccaaaaaagcttcagatctgatggtggtcgttcagggtggtacggcggatggtggacggccatgctatggcggtaccacctgatggctgtcgaccgacgtgacagtggtgatggcattggtggtggccgagggaggtggcagtggaggcggttaccagtcggccttgcactccatcgatgtgtggtcgtgccatcgtggttgtggtggcagcgaggactggtggcatcggcactcctgatggcggcgacgggcagtagtgaagttgggtggtgtcgggggctagtcctccgatccatcccttcctctgtcaccggaggagagggctggtgatgacggatagtggtgggggctagcttccccctgcaacgacggatcaacaaataggtatggtgatagttgtggacttgtatttcggccatggtagtttgtgatgacgatggcagatgctctcggtgtcagcatcctagggatggcagcgacttgacgaggtccgatgcccggttctgaccatgaccaggtgaggacgagggatggtgatcgtcgatgacagggctagttgacgatgcaatggtcgtcggctcgcccaacgcggataaggacgatggcaatggaggctcttggtgatggcatcctagggaaggtaggtaccaagtgagcatcggcgccaaggtctggttgcggttaggggtcgacggcagtggagcatctttgacaagttcttgattgtaaaggcagcgcgtgtcatactaggcggctccacgacgctctagaagcgacagtgagatcgatcgtctacagagaagactggtggtgcggcaaggcggcttcgtgacgcactaagggtgttcaaaatgcggctgcggcgtaggtgttttggatggcgacggcggacagagggcataaatgttggtagcagatggtggttgtgttccgtagaggcagagatggtgcgatgataggtagctcggactagtttctattctcctctttccccatattgcgctgcgacggaaagaataagtcatcgatgaaggttggagctaaatcttctaggtttttttttgtgtgtgtgtgtgtgtgtttagagtctaagaactcatgtatatgttttggttgtgtatatcctttgtggatatagaggccggattaatgaaaaatccattatctaaaaaaacctacttcagttgaccttatagcacaatctcatgctgattcctttcaaaaacttcagttgaacttttctcctcttgcagggtacttctccctaaaagctgcggcaactctgaacttgattggcatatgcattgttgcctactcaggctaggcagtgaccttctagaacaatgcagcagataagcaaagaaggctaaaatctcaaaaagaatgtgattaatgtatataaataaaatgcaatataacttgaacaagtaatatgcaagtctctgctgcagcatgtaatgtcatgcatcatgaattttttgccgagacggccgaaggaggtcacccaaattgtattaaggagaaagagagttataagttttacattaatcgactttagacagtcgaggaaaaaaagcggtcaccatagggtgacgcctctaagagctcttacaggcactgattaatctactcgcttaaagatctctgcttcatgaatagaggatatgaaaatatggttgtgccataacttcattgattgattagaccatatgtatatgtcaacatatactgtactagacctgacgaatcctagtttgtgcaccatgcttggtgtatgccctagacaacctatgggggaaaaaatcaggtttctaaaatggaaacgtccaatggaacttctttatcagcttgagaatatacatatcttcgctcgtgaccagtacgataccagcttcgtccatttggcatgttggataatatcatttgagcaactgatggttccaacaaaagtattactgtctctactaattagtaagtgaatggctgacttttgaactaactgttcattgtgttcgatgaggatactaaacccagagatcaagacatgcatgaccacccaaaaacatgctactcatagcatacactgcatgttacagacaccgttttatatgttaatttaacaattcaaaacaaagtaagcttttacctgcattctggaagttaaaatggagaaatgaaggatccaatcataactgattgtatatgaagatattggatgtgctctaacagaagctcatgttcttaaaatagaacttccatgcagacattgtgtccagaactgaagatagtgtcaatttcaactaaactgtttacatggacatgggaacacaatatgagatctgttcagttgatcctagatagaataagggagcacagaaagcagcatcatagtcatgctattgaaaccaaaggaattcactattctacctcggttagttggttggccacttggccttaaacaaaccacaaatcgatgcgtactaaactgcgaactatttttctataagagctaagtgtagatgtagacatgaagaactgattgactgtatgcatagaaaaaaaggtcattgaggcatccagactccagaaaatgctagctttaaaaaaaatccccaaaaagaagagatcctgaaatcccctttctgccattgctgatgctgtaggattacttggacaattgctactgctaataactgctggtactactcccaattaagcgcacacaaatgaacctctcgtaaaatgtgcactacaataagcaataacacatgccgcatcagtaaccaatacagccatgaacagcgaagccaaaccaaaccaaacggaacttacgcttcaaaagcagggtggattctggagttccgcacattgctgccggggacgcggagcgcggattctgcgaagcccgtggaggcgtcccgcctagagccgccggagcgcggcggtggctgaggcgggcgccgcctcaccgcgtcgccgtcgaccgccatccgccgcgagaaggagccacgccgctcgggaggcccgagacggagagattttccgctccgcatctccagcatgcaaatgggccgggctgaaggcccaattaaggcctcactcctttccgacggcccagtatttgggctcaccaacctctcctatattgcactttgtctaccattgctggacagcagtttttgtatgcgaatgactttattagtactggcatatgtcaaagcaattatacgagaagttggatagagaaatgttaatctgcaaccataaaacatctttagtgcactttttttcttataaaaacaatacaaacagttcatatacaagcgcacactcccacatataatgcacacctgtcacgtttgatagcaacaagatgccaacgttttccctggagcttatggatacataaaaaatagaaagtcacccaagtcttaatacaatgatgcgtaatatttatgcgaattctccggaaaaaaaagtcagagagaatgcgttgccaagttcatgatctgcagccatcatcatctgatatttctttgtgcattgcggtatcgccgtccgtccaggctccaaaacagcccaggaacacatacgcccaaccaagtcatatccagcgtcccagaggcactgaaaattttcagaatcaaaatagatcaacaccccccccccccccccctctcactgtctctgcatccactcacctgatttaatttgaacttcaatcaagcttcccgtatacatagagtacattcatatgcacagaactggattcaaactagttttttttagataatggattcaaactagtatacatagagtacatgtacatacagcataactgctgttggtacacacaacaggagtgcccgaatggattggctgtgcacttgtttagcagcacttctgattttctttttgattgcaacacttctaacaggatgactaagatcctgaaaaaaaaaacacatacaaaagggcatgtggataaataattggagtgaactcttttgttttgacaccaccaaggtgtaaccacaagacaattcaataagctcgtagacaactgctagtgaaacaacaaactgcacacaattctttagacgacactgaactgcagattttgtaccaggcaaggatagggatgaagattgaagaaactgtaccttgttacgaggtgattgcttgttattgtaggaatgacatgccacagccactgcaggcagcagaagaatcatgttctgaatgtttgaaacaacgtcccagcgaaaaaatgtttgaaacaacgaaacttgtgcgttgtggggaacggcgtgaaggccttgttctgggaggataactggctgcagggagaatccatccgctgcaaggcgccggctctctatgctgctatcccggctcgcattcgcaaaaaaagaacggtcgcagaagctctgtctgataggcggtggatcaaggacatctctggtgcccttggtattcaagccattcttgagtatttatccctgtggcaagacattcgtgcagtgcacctcacggaccagcccgatgtgctttcgtggagatgggaggggtcgggcaattactcttcccgatcggcttatcaagcattgttcctagggataacccggttccagtctaccccgatctggaaatctctcgctccacctcgatgctagtacttcgtctggttagtggcgcttaacaggtgctggacgggtgatcgattgaggaggcgcggactgccacaccccgaccaatgtgtcctatgcgatcaatgcgatgaaagcatcgatcatctcctggtcgcttgcccaaagtcccgctagttgtggtggatggcactgagggccattggacaaacaagttctctgccgacgaacgaagtctccttccacctctagctttgcgatagccgaaagagattgaccaaggcagctcggcgtggtttcgacaccattgcaaccctcgtcgcctggacaatctggaaagagaggaatagcagcgttttcaatcagcagcaaaagacttgggcggaagtggcaagggcaatggccgccgaagcagaactctggagacttgcgcgagcagccattccggagttcttgccacagccaactgtcgagaggtcgcaacatcggataggagaatagatcttttggggcaattgtattcctgcatctccccttcacttcttgtatttcctgtaattaaactttttttccatccttaatacaaatatgcgctccttgcgtattcccaaaaaaaacgaaactttagcagcacctttcacaaaatatatctgaacttaaggagccgagcaaaactaagtcagctgatttatatcatgtgcctgaaaaggttaaaaaaactatggcagagttaagtaccttaccgcttcctgatcaacaagtgatgagttatttgttctaagaggctgagggcaataatgaggcttgcattcaatgataaagaatttttgcctactgtgaaatgttaagaattactccactgtgttaaattgaagaatatgaaagatcaaatgacatgcaaatgacatattgacctgcgttccttgaaacaatacaatctgtcaaactgataacatattgtataagtttcagttcatcagaaactagttattttgtacagcgagtctcagccagtaggcccagagtcggcccagtatcaaatttaacaatagcaagatcgtcgacggacagtgtcaatggcaggaggtgggctccttgcggatggcacaatagcgatgacatagcagagtactggagtagccagggcctgggggtagtttcagtggtcgggatcagtgttttttctgttgcacaggtcccggccttgcctgttgtgattgaaatcactttgtaaccttttctcctccaatctaataaaatttggtcggcgtccttcagccatgcccagcgataaataaattaccatgaaatcccacaattcttttttcgggaatacgcaaggagcgcattttttccattaagagaaataaaagttatttacatttgaaagaaaaaaaaacagcacgggactgatacaggacaataacagacaatcctaagtctatctctcacgctaattttggcgaccaaactccctcctgaattacagcgcaaggatcgccgggtttgctttacgccaaagagaggcttcgtccaccatccctctggccacatccgcccaagatctacactgctgattgaagatccgaccgttccgttccttccatattgtccatgctaccaatgtcaccaccgtgtcgaagcctcaacgatgtgactcacttagcaccattctgctatcgcacatccattggtgaaaagaagcttcattcaccagcaggcagttggggtggccgattgctctcaaagtccaccaccaaagctgccttgattctgggcagccgactaggatatgatcaatgctctcatcctgctgatcacagagaatgcagcggtcgggatgcggcaatccccgactccgcaatcggtcggctgtccagcatctattcaacgcgaccagccagaggaagaaatgacagcgaggtggtgccaacgagttctagatcggtgtggattcaaaggcaattcgtccaaggaacaaagctcggtaggtagattttgaagtgtatttgcttgagctttcccacttccaggagagtgagtcgggctctgcggaagaacaatcaactgactgaatcagcgaccaaagtttgaggtattcgagtattgcctgagtcccaagcgcgccacttatgtccttgatccatctacggttagacagcgcttcagccaccatccggcgcttccggatacgagtagagacatgatcgtagatggagggtgcaatagctcggatggttcctccttgcaaccaattgtcctcccggaaaaggattgtttgctcgttacctagctgacagacggtggaggcggcgacaaggtgaagttctttctgtgtgcaggggattaaatcccacaattctctcactgccaatacctattcagaacagctgaaagattgcaaaaagagaagagtgcgatcagacagataaccaaaaaatgagcatctaaagcatcagatatgaactcgtatgaaatgacagaccagtttttgtacacgtgatggaagcagcacaagttgattatcaactcaatggagatggatgcagagaagattctccaagactagaataaggcacatactaatccaagaaagaatctgcacaggatttcagaacaatcaggtttttcaggtagatgaatcacacagtattaacgttgcgccaaacagaaagtgaaccgggatggctcaaacaagagaatgttcattaccaatcaaatcccagtcgctgtctttgatgattggaatggtcctcttagcttgcggcactgccttttgagctcctcgctgcctccagagacatctagtatttctagtgaacttggaagaccactcttgggcaacgaactgatgaactcactgcacgagatctctaatctcttgaggctaacaagcctgtgtaacacagaggggaggaactgcagccggcaaaaactaaaactgagctcctgaagggaggagaggtgctcaagggccatgttttgctccttggtgaagcgtttcacctcgttattgcaaaaaatggttagcttggtgagtgagggggagaggagtctgcagatgggcacaacaagcactcctgcgatgtcatccgttacaaggtgctgcagtgatgaggggttgatcccgacgaagaatttggggttcttgttgactcgcagccttgtgagttggccttgggcgagcagagaacacaaatcctcgcctcttaaatcaccacattctatgcctaagttggtgagagagctgaggttagagaggagcgacagagtctccatgccacttacacggtcaatagacagatatttcagggaggaaggaaatgggaaagatgaggaagatgatgagtaggaggagaagaaatcagggcaatcgataatagtcaatgatacgagggagcgcaggccttgtaaccctccttctatgcctcttaggcgtccttccatgttttctccaagtgaatcgtggtggaggatcagctttgagcaacaggagatgaacaactcctgtagctgggtaggcaagagcagcagtcctgaagatgccgctgctttctcgtcctctcctcttggctgttgttgctcttgtccgaaacgtgcattctccaacttattaccagaaagtgatggtgaagatgccgatgttgccgttatctgctgctcagccacaccaagcattgctatcttctccaatctatacattgtcaagtcagagagtttggggaaatgggacagcagcagcgtcaattccttcccgctagcaccacactttctgatcacaagtttctttactggaaactggtatctaacagcgctcccaccttcaaccatcaacaaggaactacttgaaccatttatttcaagcttcttcaaacatgataacatctggaggtgttccaacggcaaaaaagggcattttgtcaagatcaaatatttcatctcagttaaattactagatgcaagtacttttgagaatgcacaattcagatggcccttctttcccgcaacccacaagtgtgatttagattggtataaatttgagtacttcaagtgctgaaaatctgatctcacttcttcaatcagagcacggcatggagagtttgtccaaggaacgggaggcaatgatgatagcgttgggcattttacaatctcaagctcctttagtgtagggaattgagtgctgtccatctttgaatatggcaactctataagttctgggcaatctcttactatgaacacttctagctgagagaacacacgggaagcatcatttccggtccatttttctagtcgcggtatgccaactagctctaacctttttaaattccaaaagctttggccttctatacaactcaaggatttttcactgtgctggttaaccaaccataactcccctataggtgggaatttgttccagtctagaccatgcagactaagagattgcaggcctttgattgacaagttaaaacctaaccatgatgggcaagtggcacctccatgcccttcaatttgtagctcctgaagattgttatgtggcttaagactttcaagaatatgttcatcttgggaacaatcctttgttgaccaatgtaatattaacttgtgcaaatgacttttgtttaaaagttttgcttcgtccgccgcctgtgcattttcaagattataaatgcctagtgttccgttcagctccaactgtcctaactgtcttaatgcaaatggctcactttgtcttttcactttaaatctccttagttcttgtaaacattttaacttacccacattagcaacgtcagagtggagattgtcatcggggacaagaaaatggcgtagccttacaagattatctatatctcttggtaaaccaaagtgaccattgcattttcgtacatcaaggatcctcaagtgataaaaccttgaaatggtgttgggtagccttatttctggaaaatatcccctaataatccttaagtagcgcaagtggacgagatttgaaaagttgtgcaacatattctccactgcatatgatggagtagacaacaagatgacgcggagtgattttgcgttacttaacaaatcaccaagaggactgataaagcttccatggaatcgtccaaatagcataaaagagtgtagcttttcaacatccagtctcttacttagtgtgctgaaatccgtcttgatgctttcaaaagtcactctatcatttacatccatgtcatctatcacaatagacaaatggcgtatagatggtggaatttgcacaaaccttacgttagaactactgacagcaagacattcacaggatgaaaccttcaatgctaactcatgtagtagatcatgcatactgtaataaggagacccatcttcattcacattttttttgaaaaatccaaaatcaaccaaatgattcaaacaactcaatgctatatcttcagttcgtttgttttggtcctgatgtgattgtaaaatgtctagtcctatccataggtgaatcaactcatcactgtcaaacttgtaatcttcagggaacaaagcacaatatataaaacattgttgcagatggaaagggagatagtcatagctaagctttaatgctggcataatatcattgtcaccagtttgtaattcccattctttactttctaggacacttgtccaatgattgaaatcaaggtgatttctcaacaatcgacctacagtttttgctgccaaaggggagccctttagttttttggctatcatttctccagtctgttgtaagatagcatgatggtttattaatttctcatcaccaaacacatatgcttggaacaattcccataactcttcaaattccagcccttccaattgtattggacgataagtcttttgtactatttctgcaactgctggaaaacgagtggtgactagaatcacatttccctttgtttgtgcgtttctgaggggtgctaatagccttttccaatcatcctcattactgcaattccacatatcatccaagacaagcaaaatcttctttgacttcaatcttcgctcaatcaagtcatctaggtcacccagttgctcattctcatctaggtcacccagttgctcattctcaactttaggtattgaatcagcaatctcttgtttcaatctgtacgcattgaaattgagagagatacatacccaaacattaacatcaaaaaggttctttactgctttgtaaatttgctgagtgagagctgtcttcc

SEQ ID NO: 23705 - DNA, 8304 bp, Oryza sativa
tggtgttttcatagtgtcctccctctgtgatccccactgtttttcttttctaggcatgtgcgttgcagtagagctgtggtcgatatcagtagagccggtgtcgttgtcgtcttcatcggtacagtcgtcatcggcatcatgttcaccagctaaagagaggtcactgccggcaacagctttctcgtcacctccgcccgagcaacaagcagaaaggtacctcttcttaatgtttctggcggtgtggcgggtgttgaggaggaggccatggaggcagcctctggtgtgctcgtcggcggcctcgtcggtgccgtcgagctcgtcctggatgcggaagtagtccagctcgtccagcacgtcctcggcgtcgtaggcgaggccacgcagctgcaggagcagctgcttcagcgcggggctgcgggtctccctgccgcgggcgttgtcgagcatcacctgcgcgtagagcagctccagcttgacggcgccgacattggtgccgagctccgagcaggccagccacgcctcgacgagccctcccgacagcgggctcagcgccttgccgaccatccaccgcgccgcttcaacggccaccgactccatcgatcccaacgtgcgctgcagccggaatcgcgcgagctgcacgggcgtaggagcaaagcaagctgcagcaaactggtggaggagtagtggataagtggagtacacaagtgctagctgaacagctcgtcagttcttgctggcaatctcaacttgtttgttgttactactctgcagtggaggacccagcatggcagcatcaactagtccattggttgctacttgcaagtggaaaggtaatgtatctgggagatctctcagttccttcggtgaattacctggatatggaatttacctctcgtcactgcacaatcttgaaactaccgcctgaggacaccagttccagaatgcaatagcttgtcaggcttgccgacagaagtgtgtcgttccatgcatcatctaactgcaagtctgcaactgatactccctccgtcccaaaataagtgcagttttgcactattcacgttcaacgtttgatcgttcgtcttatttaaatttttttatgattagtatttttattgctattagatgataaaatatgaatagtactttatgtgtgactaaatattttcaattttttcacaaaattttcaaataagacggacggtcaaacgttgggcacggatatccatagttgcacttattttgggacggaggtagtagtttgattggacagctccatccatccagtagaactcttgtttgcacaatcaagaagaacatagcccgatagatccaacagacagttaaccaggctgcagtgtgctctgggtctctgtgcagaataatgttttctaggttgccattgttttctgcagctccagaatgccagtggtcttgatcaagcaggcatgtgcctgttaaaggctgtctaagcaggtgctccccaatgattgctggtgcaccatacggagtaggccttttgcaccagcagcatttggcttcatttgcaatgccttaatatttgagaggagctctgctcttgaccaatagcagctgccatttgcttgatccacagagccctttagggaggctcttatggtaatgatcccacacagtcttcgtataatctccaagaatcagatgtgcatcagtgcatgtccaagtcttcgaagctgatattttggttgccattttctccacctgtttccaaaaccttgatgggcacttctaacctgacaaatcctagttgtgtgccatgcgcccatgcttggcataatggcatatgctagaaatagaaccacacacacacgcacgcacacactcgaaaataggttttcaagaataaaacagtaagaagattgtcattagcttgcaactcactgtctctcctaaatcctagtcagtgcaacccattgcctgacttgtactaaatggttcatgaggattgcctgactcgtactaaatggttcctgaggatactaaaccaagtgtgaaaaagttataagccaaagtttgaaatattgtgaggatcagaagtctatatccttacatgctccagttgatcactaaggcactaaacactcaatagtaagagcatacactgtgtattaattgccgccttctatattctattttaccagtttattttttagaaaacgggtaaaaccgggcctctacatccaacgcggatgtatgcaaccaaatactttaccaattcacatcaaagaaaccttaaaatgcattctgtagtttaaaatgagaaattaaagccatgcagccaatcataactgcatctatataaagatattgggatcgatagacaatggccattgggttcagatagtgcctatttcagctaatatgtttacatgggagaacaatatgagagccattcggtttatcctagactgaattgcggatggcagaaagcagaatcatagtcacggtatggaaaccaaaggaattcgctcttgtacctcatgtattaactatttctctaagctaaaaatgtaatgaatcgtccaattgcagaaatgaaccatcgattttatgcattgaaaaaaaatcactgagacattctagctcctaggacatgttagcttgtggcacctaaaaattccccaaaaggaagagatcccaaaatccaatcccttgattcccttctgcatttgtagatgccaggtttacttgcgctgactactatcaaacatacacgtgaaagtaaatagcaaaatggacatcacaatcaaattcaataagcaataacacatcctccatcactggcgcatgaacagcaacgcggaaccaaacagaaaccgctgccataaatgggggagatcaacatacccttcaaaagcggagtggtctctgcgggcgctcgcagcaacagcctcgcccacacgttgctgccggcggcgccggagcgcggcttccacgaggccgtggaggcaccccggcccggccacccgccggagcgcggcgagacggaggcggaggcagaggcgggcgcccacctctccgcctcgccctcgccggaaggaagccagtaaggctggaggcccgtgaccagagagagattttctctcccgcgtgccaacgggccgaaactaagtggcccacgttgaaggactccaatcatccggcccagtatgtggggcccacaaaccgcccggttgtcagcatgggccaggaaccgccatgcgggccccaccctcctcgaaacccgcgtcgagtggggacacacggcgttggactggcccgcgggtgaaaaggccacgtcgagccaagccggcccacgagggcggcgacgacgcgttggcgttggtgcggcggggaggcaacacgccagctgtcccgtctccttccggccggcggcgaccgtgcatgtgactgacgctgcaatgcccgggctgtgtctgtgtgcaccgccacgccacctgtctctcgcatcaccgtcacgtcaaggggatgcatggctagtggggtccacatggaggtggcacagggaatatcggcctggtctactacgagtaatctcctccaatcatcgctatctgatctgattaagcattagcagatgaaaattgctatgcatattatcccattatttgatggggatttgattcatgtagaatttgatcaatggttataaatgttgtagagcatttggataatctatagttgcgtgtttatgttcgtacatgagcaagatttcgtattcatgcttgcataatggcattgcacatttgcgtgcatcggcgtatgctgcgttttacgggtgccatcgtttggcatatcggtggaataagtcaaacggcatatttacaaacgaaaagtaatttgtgaataaaatttttatatatgtattcttagcgatctaaaagcaaagactgaaaaatatacttcgatgaaaaaaaatcccaaaatcaactcaaaatttaacgttgaaaattcaaattctgactgataagcatatgaatatgctaaacgatggggaccgtagtattgtagtattgttcttacatggtgtttccagtcgttagcggtcagaatccggttaaccttaccaactggaaccaggatgtctctcctctgtgcagcgttgaccgcatgttaattgcagcatgttcctgtgcctggtgccagagaatttccgcagacaaattcaatccatacaggtaacggtctagaccaattcgcaagtactactagtagtagtatagttctagcaaattattttccattttagaattgagattattatacagtacaggaaaatacatagttgagaccaaatcgtacgtgcagggcagattcggccataactttcacacaattggagtacagtacagccgtgcatgcaaatgaagtaggagtaagtcttgtccacatcgtactaatactaaaaatctagctgtacttccactactgggatttccctgctgcttcctttgatggcaagatggaaaccggccggtgcaccgttttccttccagatttgcacgtaccaccacccacttgatcgtcttcataagacagtttttactaataaattaatttttatttcttaataaaccgttttagtattactagaaaatatgggtaatcgatgaggctataacctaatacaaaatgtcttaatacaaaatgtcttaatatttttagcattgcaatgtgttatattttatagattagttttctattattttttctgttttataatatatatatatatatatatatatatatatatatatatatatatatatatatatatatatatatatgtaatgctagaaaatattataatatgaaatagggggagtacgcggcagacggggaggagaaaaaaaaatcggtcactaatcagaagtataagacgaggagatcctgctacttcttccccatcaccaccaccaccaccatggctttcttcctcctcgccttctgcttgtgcatccatccatccatccattactcgccgaagacttcgcgcggggagagaggaggcaagcttggtcgcgggaacgcgggaagaaaggtccgagcttggaaggagaagaagaagtagccaagaacgcgagagcttggaaggcgagctgcggtggtgtagctagccaatgccggcggggaactggtagggagggggatggggggagggggcacgctcgtcgacggattccgccgcctcttccaccgccgcacggcgtccggctccaaccagtcgtccaacgccggcgaggaggccgcctcctccgacctcgaggtcgccgacgacccggatctcgtcgccctccgctccatccgcatccgcgtgcccaagcgcaagatgcctctccccgtcgagagccacaagaaggtgaggaggtgcctagtgtgaagtgtgctttgctttgcttcgttttcttttcagtttgggggtgaaatgaaagtttcaggctttctcgtgatccttgattcgtggccacgaggggttcttagactagatcagatcttcgtggcacctgaattacttgcatactgtacaatatcattatttctttttttctatgatctgtgcaaagtgcaatacagctcaagtgcaggtaaagcttgcgtgttctatccaatctttcttctttcgatggttgcttgtaaagcgatagttgcttgtaaactgccatccgattcgtcatcctggctgttgacctgtgttattccagtgatctatgaaacgatcgatctcgtaaaacttaaggttctttctttctttctctgttggcttagttctgaaataacttgctcctgcatgctccatttcttagaggagtgcaattgcagcactactatgcaaaaagcttgtgccctcttttggagctgttctcaacaattggtcccatcatccttgtcatactgatccttaggagctcatatccaagttgtccacttgtggttttggatgatctcatcagaatcggctactaattagtactccaggtttgacttggtctggcctatgtatatctctggtacggactgtttctattgggaacaagtcgcgtcttgcacatggtatggagcaggtgttcctttcatttgcgaataaacctacatgtctatgtactgaaaatgtcaatttttgttaggttggtcatgatattcccagggacaagatcatggttttgtttatagggctattctactactgaagaagttttataaccagccactctgtatttttagttagcttaatattttcttgcaaaattgtgatcttgtagaacacagtggaaatggagttcttcactgagtatggagaagcaagccagtaccagatccaggaagtcattggcaaaggaagttatggagtagttgctgctgcagtagatacccgcacgggtgagcgggttgcaatcaagaagatcaatgatgtgtttgagcatgtatcagacgctacgcgcatattgcgtgagatcaagctccttcgtctgctccgtcacccagacatagttgagatcaaacacattatgcttcccccttctcgaagggagttccaagatatttatgttgtttttgagctcatggaatcagatctccatcaagtcatcagagcgaacgatgacctcaccccggagcactaccagtttttcctgtaccaacttctccgtgctctcaagtacatccatgcaggtaagcttaactactgataatccccaattccccaagaacctacttgaccaccattaaacacatagttctgttgatttatcaattaacatggaattctagcttattctctgataaatcatctatattggcacagctaatgtatttcatcgcgatctaaagcccaagaatatactggcaaactcagactgcaaattgaaaatatgtgatttcggacttgcccgagcatcattcaatgatgccccttcagcaatattttggacggtaaggtgcttatatgagattttacattcctctttaagtctttatgttattaattatgttctactttgtgaaggattatgttgcaacgaggtggtaccgagcacctgaattatgtggctcatttttctccaaagtaaggtcttcaacactagaattctttcaatcaagattaatgcttttgtggcaccatagatgaactggtctagttgtttttagcaatgctttcttttttttttcctttttctttatctatccaacttacagttgtgctaaatgaagtatagaaaattaagttatttttctttttgttgatattttagttgtttgtacatacaattttctatcaaagctgcgccacttgaaactggatgagtaacattcttgtagagaaacaatatactgtgaactcttttgtgcaatgctgatgctctagcgttccatgtgttttatgtgttctaacaatagccaatttgcatacagtacactcctgcaattgatatttggagtattgggtgcatatttgctgaacttctcactgggagaccactatttcctgggaagaatgttgtgcaccaattagatattataacagatcttcttggaactccatcatcagaaaccttatccagggtatgtttactttataccgattctcatatatccttgaacctcctattcagtaacattcaagaagatccaattctctaataagatgaaacaatcaccttactgttttctgcgtctctgcagattcgaaatgagaaggccaggagatacttgagcaccatgcggaaaaaacatgctgtccccttctctcagaagttccgcaatactgaccccttggctcttcgtctgctagagcgtttactggcatttgatcctaaagatcggtcttcagctgaagaagtaagctcaagagaaagcatagcatcctttccaaacctcaaaagtagtttttttttaaaaaaaaaaactttcagaaaacacacattttttatatgttatattctcttccaattttcaggctttggctgatccgtacttcgcaagtcttgctaatgtggaacgtgagccctcaagacatccaatctcaaaacttgagtttgaattcgagagacggaagctgacaaaagatgatgttagagaattaatttatcgagaggtacaaagcaatagctcaagtttcctgctttgtgttaataataaaattttcagcttttcaagattgataattatgaaatgcaaacagattttggagtatcacccacagatgctgcaagagtatatgaaaggtggaagcagattagcttcctctatccaaggtggagtcttgcatta

SEQ ID NO: 23706 - DNA, 314 bp, Oryza sativa
cttgtcatctgttttgcatgtcccttcctttccagtcaacctcctctctgttagttctatcattgatcaattcaagtgcatcgttatatttgatgagaattcatgtctcttccaggagaaggggactgggaggaggattgggactggagtcaggcgtaatgggctgtggtacatcaatcaagaggagatgggattggctgtagtagtgggagatactgagaaggagattattttgcttcattgtcaattaggacatccatctttcgagagtttgagtaagctgtatcctgacctctttaccaaagtggacaaga

SEQ ID NO: 23707 - DNA, 2087 bp, Oryza sativa
ccccctcggggggactaagaggagggcgaacacatcaccctcgggcccgacgtccctcgggggtaccaggccacgtgtgcgattgtgtctgcctcaaacctctagtcatgatactcctgatcccatgtaaccgacaaagggtaattcagcgggtcttaaacacaggatgtttgatcttttagacatgaatcaggctcaccttcatcgaatgctccttatggtgctctggcgtaactggttcgtaagaaatgaaatagttcatgataaaccggcgccaccaaccgaggtgtctagaaggtttttggaaagctatgtcaactcgctgttagtgataaagcaacatccccacattgatcttgtgaaagggaagcatgtgattaatacgtccccaattctccctgaagctcagccgcggatgaaaaatgatggggtctgtaggtgggagaaaccgataagagggtggatgaaggttaacattgatggttcgtatgatagccggaatggaattgggggtattggcttggtaatgcgtgactgcacagggagggccttttttgcctctagtcgccacttggagcgctgtaatagcgctctagaagctgaacttcaagcgtgtagagagggactgattctggggcttcagtacaccctcctccccattgtcctggagaccgattgtctggaggcaatgttattgattcagagcacggagaaggtgatgtcgacggaggcgtttatcgtcagggagattaaggacctggtccaagggaatagggagatcaagcttaacaaggctcagcgctcgcaaaatcgcattagtcactggctagctaataaagctcgttgcgagcatatctctgaaatctggttagagaacaattgtaaccatattttacagctcgtcaatgacgatgctggctgagtaatatatttctcccttccctcgcaaaaaaaaaaaagatacgcacatgtctgacatacacaaggtgttcatttgcatacatgcaccaccaaaaacatccaggtgtttttttttgtgaagacaggcaacatcatctctctctctatctctctcttttctttgactaatctcattttcagaaattacgatgtgcaaaagaaatagcacaactctcacaatctcaatccaatgaacctcgtctagtagtactttttgcatggattattggccacacacagcatcatttgaaaaggaactaaaatctacactgacatgaaaggtccacacggctaattaaccaaaacacacaaggagataaagaaattaaagcacgtgctcgattctgcaaaccgaagatcgatcggatccagcaccaccgaccgctccggatcagatcaaccgtgattgaaatttgaaagaacaggtcccaacttgatgcgaaatcgaccttgagcaaccattttcttccccatatatcatcactattttgcacaatgccatgtcacatcaaataattttggataataaaaagataaatgacttataattttcattaataaaaaaatataatggatcatgaccaattaaatctataagcacgcatgataccgtaggggtaaaatgaatattttcttcctcttaacggtgtttgattaacggttggcggcaatggtatataaataaaaaacaagttgttcgattatatattaaagaactgagctttgagctttgtcagtgttatattatagaatttatactttattgatcgtatagaatggatttactgcacttactgtctcacacgattttctactgcctattacaactgataggtcttgttttattgtcgcacacaacgtaatcataaaacctcaattcttaaactatgagcaaaaatatcccgaaatcatgtgccgaaaactgaaaaaacaaaacagcaaaccaatgacaccactcactgtttcacacgctctttgtaccgccttttaacacctgatgggcctcgttttgctgccgcactcagcgtaatcataaaatctcaactcttaaaactaacggataaataaaatcaaaacacaatatactaaaaacttgaaaaaaaaaccagtaacaaggtgcttcgatg

SEQ ID NO: 23708 - DNA, 1513 bp, Oryza sativa
gcagccccacactactttcagttttcagttgtttgtatcgtcaaatgtttgcaacagtgtgcagtggaatatatcatgtagtctgctgagcttctttgtgagcagagctgtaatatgctgctccaaatttaaaaaatgagaagttccctttttaagaagtgacgtggcaattgggctcactctataaatattattgatgattcatgttcaacctttgtaatttatggatcattttggtacctttggtggtaatatgagattatattacatttttagtagtttcattaatggttcacatatacaggaattctggtgtatcggacttgacagttgatttatgatttctacagctataatcttcttaacttggtcgatcatttccataaacgtggcctgtaccgatcgatctttctcaggtatatttttgtttacagctagttaaaagtagcatagtattgtattcatgtcctccacaacaactcccacataactattgaactatgtgagcatatcatgttgattatctttatatacactaaaactccacttcaacaatatgtttcacagcataatggaaggcgaggagtcgttgcaaaaattttctccactggtgatggttaaggacccagctgctaggtctgcagtatctctattacctcgaatattcctttttcatggaacaagtgactattcaataccatcggctgagaggtgggttcaactggaatggttgatcacatggtgcatgttttcttgtcgtattgattcgaaatcattagattggacaaaccaactatatacttattcagttgttttctcttccaggagatgaatgtctcaggttaagtgaaatgaaacttttctctcgaacaaagtgaaatgaaactcatttaaacctttttgacattattttataataagtatgccttatgataaagtttccacatgctgttactgaccaaacaaaatgagatgactaaaccaaactgagggacttgggtattctaaggacttttggattgtttatacttcatagtgccctgatcttgtctgcatccatttcaaatgaattttccatgttgtttggcatgctgaagaaaaacatagactagtcagaaattgtttcttcttgaatcttattgtagttttgcactagtcaagaagagagataagtctagtgcaacatcatgtcgttgtgccatttcctgttggtgttgagtagttaacactagttaagaagaaacaagtgttattcttagggattctagtgctaccatctagctttcatttaggagatttagtcacttgtttatttttcctcctcaccagtaacttttgtagttgtgttatctgacgaaacttctatattatggatattgccatattggactatttctattgattgacttaattgaaaaaatgcagcgaggctttctttgatgctttacaacagaatggcgctaaagcagatctgttcttgtatgatggaaagacgcatactgacttgttcctt

SEQ ID NO: 23709 - DNA, 717 bp, Oryza sativa
aaagaagaatggaccagagtctcactgataaaccggttcatattccattaccaaaaaagcctgggtttgactagatctcactggaaaatgaacatgcccacatgatgcacaagctggctgcttgctattcattcctccatggacagatggactaatctagtgttacatcagagggattatacattaatccatgcaggggtcctgtagtgacagacagcacaatggccagaagaatatgtgaacatggatgagcataagaagatgcccatcatctcgggctggctggtgcatacttgcattgtccaaagtccaaacttgcagtgcagcattctgcttggaaattatcagcatctggtgcgcctcacagaatcttgcactgatcatcgtcatcgttgtgcactaggagtgcatcctggagacttgttcagacaatccatcgaccgacccttccatttcttcagagatgtaatcatcctaaaggatagcaaaaacaaaagggaaatgcaaagggaaatggagttactacctatgcaacaaaccagtcaattccttttcttttcacgcatcatttcttatacttttgttcgatcgtgcatagctatgcaactttgccgacttataagaatcatagacaaatttcaggcagcaaagtaacagtacctctggttctttattgtccttgacagcgacacacttggaagcactaatgcttgcact

SEQ ID NO: 23710 - DNA, 3686 bp, Oryza sativa
attcctgcagccctgtgttgcggccatatcgagaaaagagaagcggggaattagcacatttacattttggtccttcttcttattcgtatttgtgttgacgggtaccgtggattccaccggcggcgcagagccggagaccggagggcggcggaactccggcgagctcggcggtgaccgacggtggaaggaaggtgcattgttcgtcagtacaccaagctctcatcaactcgccgagcgcttcccctccctccgctccatccatccatggcgtcctccccgcctccatcgacggcgtcccccacctcctcctcgccctaccggaagctcctccactccgtacgcctcgccctcgccctcatcttcgcgtgcgattccgagtcctctcccctgatgatacactttgtttggattccttgttcggtttcagttgatttactgggcggtgcagcgctgccggatgtcggagtcgccgtgccggctcacggtctccgtcaagcgctccccggaacccgctggttcctcgcccctgcgtatatctggtagtgcagctgcgcgcttgcgccgttgtgatctgttgccccttccttccgcttacattcgtgaactactgcagtttcagatactggagttgggagcaagctggaggagttcctggagctagatgcattggcgcgtgagacccccgtggagaaatggggtatgcgatcaccttctctcgctcaatttccctgtttgctggttgtcagtagcatcctcagactgcggattgcatgagatgtgtggttctgttgttaacaacaccgctgaatcatctgggaagttggtttgtacggtatagcctgttaggtacggagtagatatggagttcaccaagtcatcagaatttgcttaagatatattatcactacatttgatatgttcatatgtagaattgtagatggtcttgatgggaagatggatatatgtttttccctgacattctcttgggcaacaaccatgtacctgacactgtgccatgtatcttcatttggtttagagtttgtcataactcttggttcatcattcattgtctcacactaattctttccatctgcagatggtaccctcttaatcacaactacaggtatgcttcgtatctaatctatgtgttacatggttccactgctccatttgtgccatactgacataaaccatttcatcttgtctatttaatactttcaccttattctaaaacatatgtttaagttatcatgtgttgtccattgttctccatggtcccatgctgctagtgctcattttattatctctttttggagtggaaatcccacaaagcctgagaattttcccataagagctgcaaaagttgatagcattgtgggcatacttaaatcggtcgaaccacagtagtatgccatgaaattcgctgtttcactttgctaaaacttatatttgaatcttgctgtctccttggttcctttttgttccttttttgcatataatgtagttctgtacatactgtctaatttattcaaaatggctttattggataaaaaggaattctaaagtcaaaggaaatgttaaatatttatgttgcgtatacttatcttgttatgtttcttcagatattttccagaaattctgtgtgtatgtttattctgttttgaatacatgttatgacacctgtggatccctccacaaattagcatttgccatgcaaatacataaatatatatgttgtaaactattgttttattatcttaattctatgtgtttattcaatgctattgaactttttattgcatacttttccaatctgtaggaatcgatgacaaagctatttatcgttatcaatttaatcttcaagaagacacatcttcaagcacaagatttaccaagctagtgaccacgtacaaaagtcgtgctatattcaggcaggtcctcttgtgttactttgatgtgacctatggaaatctggtgtttgttgaatcgtttatgcctttttcaacacagtggaactgaagtatgcctttgcctgccaactgaagctgatgttgatgacttaatattatggttggttggttttgtccgcaaggttgtattaaggaacattcatattttttaaatgttttttcaccataattttacctgcccaaccttagcaacattagtgatcgttgtaatttgttatcctgtcaataatagaatcctcataacaatcctatattacagacttactatagtcatttgtttccaaatatgatagaattagtaacattatgttgctaaccatttctttttgcgcgattgtcccgaatactttctaactagcatgtttctgttgttgacctttgcagatattcgtgctaagagcatctgtaagtatttctgaacttttttctctagttgtaaccagtgtgttcttcctattttctttgttcactatgttttttttccatatttcataatgactgatcatatttatactcaccattaatccctttaatcctgagtccttaatcctcaagtcaaaatgccaaatgctattcgtccatactgaccatacacactggtgctattgtgtgtctatctcttagcagcgggtgatgctgttctctgaggatgtgtttttcttgttagaataactgtgtcatttacaaagccttctagcttatcccgtatcatgtgtggcgtactgctctaacaacagtacattatcccgtatcatgtgtggcgtactgctctaacaacagtacatttcatgccacttatatcatctaaatcgaatgtgcagattgcattatgtgaatactttttcacacactgcaggacatgtttgatgtatttctatatgtgttcccgttttatatggagtctcatacctttgtgcatgatgtgcaaaatgaaaatacatgttcccggatttaattatttacttctgaaaattcacaaatacaaaagtaacaaaacacggtgttcattggtttatgctacagggcaaaacaactgaaaaccctaatatggagtttcctacaaatgcatttgtttgataagttttaacaaccatctgatatcatatcaccaatttgtctgcctgcattttcagaccaacaatattgtgtatcctgagatgtaattaaaggatataaaactgatgatcatgattcatcctcagtacttggttacattccattcctccgaacatgtctaattttactttgtgtttgcatatgtccagttttagttgttgcacagtaaacaggcctagaattagaagcatctatctgcttttactctgttttttcttattgtgacctcttaaatggttgtttgatgtcttatgtactactcagaatttagcatgtgagctctatgttgcgcaaacacccagtgatggatcaggagacgtttgtatgtcacaagattccgatgatgtccatatttccattaccacatcaagtattgcccgtgtagtttctggccttaaagattatgcactctcacatgctaacacatctgacaggtgtcaagcatgctacatgaacaggtaaacattgcttgctgagtttaactctagacatatttgtttatttctttactttgctattggaaatagatttatgatgtgtgttatcttttggattttgactttcagtgccagctcatcattagcaatttagcatccatat

SEQ ID NO: 23711 - DNA, 1215 bp, Oryza sativa
aagaaaaaataataaatgtcagtaaggcaatcattaacaggaaagacattataaatagtacatacacaaatatcacatcaacgtttctccttaaacataaacaacaatagaagaagctaaattctcatcataatagagttagcttcaggtcaatctcaaatgctgataactctaactgtaataatcactgcatatgacatcagcccatcacaagtcacttatacacaacggtgggacacaattaatgcaaattaaattgttactgctccgtatttgctaatgctagacacatcaaactatgcatatcttttcttctttctgcctgaagacttatatattatgctgatatggtagtagagctaaacatagggggccaacacaaacctgcgggcttgccatcaatctcgacgtcgaagtagaccttgtgggtgacctcagtcaaatccgccttcgatttcttcgcctaaacagcaacaaaaaaaaaaaggtgagtacgcatagatgcacatagaggcaccactcaaaattctaacaaatcagcacaccagggccaattggatccacagatcaaacagatcaagaaatcagcgcacgagcacaaacaatcgaatcagatcggagagcacacgcatcacatcacacgcagatacggggaagcaggaggaggagcgaggcgtggtggagagtggagacggacgaggtggatgagcacctgggcgagcgccagggtggcggcgacgagcacgatccagaggcagaccgaggccgggcgcgacatgggcggcctcctcaccgccgggatcctcctccacccgctccccgccatctcggatctcctccgcctctctctcgctcgccgccgggcaggaatgaaggatcgaggatgggatggatggatagatctgttgctccacactgcggtctccgcactctgcccaagagtccacgaagaaatagtagccaagagggtgaaagcgatgcgctgcctgacaggtgggccctacatgtcagtgtcgggttctgtctcaagcaaagatcttcgtgtttaactccacattaatcacactcattgaggtgctttttttttttgtaactttcgattgcgggttgttttgtgtaatgagggaagtggtgatgcagataaatcgatccagagagcaataaaatttagattctatcgagttgttcttttcaacttaggcttagtttgaaagt

SEQ ID NO: 23712 - DNA, 3278 bp, Oryza sativa
gcttaaaaatgcgtgttttaaactatttattaagtttatttttataaattatttaatttatagtcataatcaaattgataattcatggaataatccgctcaataatctaaatcaaagaggaatatgacattgtgttcgcatgtatataagcttgcattgcatatccaatctgaattgccatgggaaaatattgagagaacactctcattttacaacaattacacaaagcaggtcacattataatcagcagaaacaggctccaaacaatgcatggcactaatgacgtgcacacatactccaatgataggaattcacggtaagtaagtacagctcgttattaagcttctgttaatggaagatcacttcagttcgccgctgtctgatatgaggactttggaccgtggagtaccactctgactgccttcagcttcaatcttgtagacgacgtccattccagaaagcaccttgccaaacacaacatgcttcccatccaacctgcagtagcaaacaacacaaaaagagtaggtcatgatcaaaattacaatttgatcggaagatttctagcaaacaaaaagaaaatttgcacgaaaactaattctcagctctcaggagctgatgaagtttaccgggttagctttacggtggtgatgaagaactgggatccgtttgtatctttcgcatagttggccatggacagcaaccctgaaccaatgaccagccagcaaatcaaacatgaggacttgctgctcaaaagaatgaaatttctgtgcagtaatatagtagtatacaactgggatatcaagaaaagcagttcacctggtgcagagtggttgatcttgaagttctcatcagggaacattccaccatagatcgaatcacagccggttccattgccgctcacggtgtcgcctccttggatcatgaagcctgggatgatcctgtggaatggcgttcctttgtaggagagaggtttgccactcttgccaagtcctttctcacctgtataaatgtgaagttgagattgctacatgaaactatagtagccaagagatgcacttgatagtgcagtggcaaggggtgtgtggtttcaatcctgatatcccgtgttcaatcgccaacacgcttgcaattttttctttaaaaaaaatgtttggagggacatctctctctccaaatctcgtgaactatagtagccaaatcaactggagtacatgacttggggcatgctcagtaagtaccaacaggccccagagtgataaaggaaataacttatgtaacaccgaatatgccaataagtattaaccctatagtataacataaaaaggatgcgagcaatatgccttttcatttgacacttttagagaagaaaactaaaaggacatatagcctttcacgtttgggaattgggatagctgaccaaattgtataatttcaaataatttgtatgaaatcggtagcattacattgaagaaatgtagtatgacggttgggaagaaatacctgtgcaaattgctcggaagttctctgcaaagagcagatgcagagaccattaccaatttgtgtctcagacaaaaacaattaagttgaaaacaataagtaattaggttgatgttatacctgctgttttaggaacagtgtttccaaaaagccccatgacaatccgacctataacaaccaagtagaaacaatctaaacgtcaatgagcatatcatcaatcaaacacgcattattttagataatggaagatttcattaaacaatgaacaatcttcaacatacataaatggcattattaccagagaagcaggcaataacaaaattttggtgaactcaagaaatcagggagtcaggatgcacaaacctgccggcttgccattgattgtgatgtcgaagaagaccttggtggtgaccttggtcaattcggcttctgattctaccgcctgaaaagagaaaacagagagagcaaaagttctaaaacaaatagaaaatcgaacacattggagaagagtgacgtacgagtaatcagatcagatcagggagagtggcaaactaatgatagggtggcaactaagaattgaaggggaaaaatccgggcaatgtgaatgatataaacagaatgagcaagcatcatcaatcgagtacctgggcgagagagagggtggcggcgacgagcgcgagccacaggcagagcgacgcgtggcgcgacgtctccctcgccgccatctcggatctcctcccgattcctcctcctcctcgtcgacggcgagcctgagaatttccgcgctaatgcatgcagcctccgcagcgcagcaacctcctaataaataaaaaagagtagagatcatgcgctggctgacaggtggggccggagcgaacggtcggccccgcctatcagccagcgggttggttaccatatttgcagttagttacaaactgcctggtaggctgacagttttgacttagcacaggctaaaacagcttgggattttacgatgggcatcagaggttgtaaatcacttggccaccaatcattagtgcagttaagatagtactcccttctttttaaattgattatcatataataaaaactaaaattaatttttcaaattgatcacatgtataaggattttattagagcacaattaatacatcatgtaagaatgtgtgcatgctaaaggcagagtggaattgtgcattgtgttttaaccaactcatgcattaggagagaatgtgtgcatattatacatgacgtcttgatcgatgtgatttaaattattcttgttcttggtgcacaaacattatagcagacattattggatgctcaatgtaggatgaagggagtaacaattaccgaatggctcatgcgcatacacaaaacagacaaccttcataggactctaaatagaataacaaatgtgttactaacatgcgagtaattaagggccccgtctggaaacgagcatgttgaattccagtacaaatccatgtcaagccccaatagttttgatttgcattgcacctgactcaataggttcattactcgtccacacaagagccgcacagcacaagaactataaatgaacgagtcattgcacagaagaatctgatatacaacacaaatggtcatcaaccgatgcaaagtctctttaagctcctctcgactagcgaatggaggtgtacatccactgtcagtagctggtaccaaaaaaccaccatgccagcatgttgcctcaagagcaacacagggatctgcaatccaggtctcagtctttagacgta

SEQ ID NO: 23713 - DNA, 2173 bp, Oryza sativa
tcatcttacatgtgcttggctatgatactacctctgatcactaatatttgacaccgatattgatgaacagaggggagtatatcacactatgagaaaacatatcaagacaaggccagtagctcctactcataacatatgatttactcttgaatcttagtgcagtaagtacaaacttaatcagaaggtactagggatgtaactctgacaagcccccaatgcaattgcaaataaagggcctttctaatttttactgcccccaagacagctatcatgactaggaccaaatacacaaagtaatggccacttggaagattaacatatggtgcagtatgaactactgaacttccaaatggcagaagaaaacactatcaactatgcatacatatcataatgatctcacctgctttcctatgctgaatgggacatacttgtacttatcatatgcacaatttgccgcttcattgtcaggacaaaaagcacaacccaatagcagagaagtattggccagaagacaggaacgtcgaatacagagaagaatgtcatcagaaaagcaacacaaaaggcttttgtgatggcatacctgaaaaaaaataaattagttagcatagctgacattttgcatttgcatcgcaaataggccttgctagacacgccaacacaagcacacaaagaaaccaaacccattggcagtagaacacgaaatagggaagtgtttaattacagtggcatgatgtgcccatgacaaactaatgcaattactattcctgatctttttaagaaataaaattcgatgctataaaacagcaagtgcctcttgttttgtgaacaagtgtcaataaagcaacgtgtaaaagcagctcatgaactaagttccataaaaaattgtaagcttgacgaagatgttacgtaatataatatctgaacttaaaaacaaacaggtaaaagttactgtactagtacatcacaagccaacaactaaacaggataagagcacgcaaaaaatgcaatagctccactagaaaaattcatcgcggactttccagctatgcacaacctaagcaattaccatatcaaaattatctatagccctattaagtagtaactcccaatggaatctgcataagccgtaggttagcattcatagtgaagcctttgcctatccatctactacctcatcatccgattaatcagtggaacacatgtgttggtcggtgaattgaatattgatgatccaaaccatctcagctggttcgatcaaaacctcacattaagaaatcacatttgtacggtcgcatcaccaactacctacaccagtttgctgcctaggatcagaagcgaatcaggaaaaatcgtataccaaaacttgaactcggggaggcggcggatgaacggcttgaactcgtcggagccgcgggtggggagggccgggccggcgtcgagcgcctcgagctccgggtcgaccatgggggagaggaacccgatgaggaggttgaggaggtagatgccgaggccgtaggtgacgacgtagaacccctgcacgtagtagacccgcagcgcgtacaccgccgcggccacgagcgtgccggcccaacgcccgccgtgtgcggcgccgcccgatccaggtagtgctggaacgcccgcgacgcctccgcgcgccaccgctccaccgacccggaggcggacccgccgccgacgggggagggctccatggtcgccgccgcgctctggtgttgggggattccgaggcgaggcgaggcgagtcggtggggctaggtttcgtggcgttgccctgggcgatgggagcgctgcgcgtggtttgggtttggtcaaagcgaaagcggagaggaggaggagggaggaggaggaggaggagaggactagacgagacgaggacgcttcacattctgtaaaagcaaatggggctctgagtctgacgcgaggtcaggaggccacacgcatccagcctcacgccctcacgcgtctttctgatatcaagaaggcaaggattcaactcaaattttgtggaattttctacaaaaataatgtaatttgtctgtaatgttatactctatccatcctttctaaaatataagtatttttggacttcgacacggttttcgagatgctactttaaccaacaatatctataaaagtaatatgttttaaatacaaa

SEQ ID NO: 23714 - DNA, 519 bp, Oryza sativa
ctgggactggtatcgattaacaggttaatttggagcgtcacgggctagttccggtcgggactagttcggggcgtgacaccaccccgccgcgcgcgccctcctccttgtgggccggcccaagccgccctccctctctccccgggacgccgacaggtgggccccacctgttgggcccgtctccttcctccagtcggcgccggcgcgcccgcaaccgccgccgcgtccacgcctccgcctcctccgggccacgtcagccacgcccgcgcgtgcgcctcatcaaccgcacccacttctcctctctctctcccgcccgcgcccgcgcccgagatggccgggattcgattttcgaatcccgactctctctcctcccccactccccacgttggccggcaaaatcccgcccctaccggccacgtctagggctcccctcccctatttaggcttccccgtcgctccctctcgctttttccccatctcgccgaactccctcgtgctccccattgctcccgcgccgtgcaa

SEQ ID NO: 23715 - DNA, 5565 bp, Oryza sativa
atgctccatgagcaaaccgaagcttggacgaccccatacatatgcactgtaattgatagaccggagtttgaagacacggtgaaagagatggagaaggtggtgtaaaatgcaacaataggaaatactccagctagcccaaagtgaaaacataggataaggggcggtctaaagtgaaagtttggtaagaaatgatgacccaatatgcaattcactaaaaaagaaagtactaaagatgtgttcgtctccctcagctgggaactaatgccctacgcacgaaaaacggagcagtacattaacgcgtgattaattaagtattagttttttttctaaaaatggatcaatatgattttttttaagtaacttttgtatataattttttataaaaagcacaccgtttagcagtttgaaaaacgtgcgtgtgaaaaacgagagatatggattgggaacctgactaaccaacgcagagtagctcgcacgatggctgttagttcctgtcttttgataagacaaaggtcgcagctgagatggcaactcggtttcaacgtgaagcacatgaggacattcaatgccatcgcattatagagtcataacaacaaataaatccgaaaaaaagaacttgcatatggaattgtgaaaaacataatttcctaacagcatctttggagtacaaacacatctattgtctcgtaagtcatatctatggcacattcgcgcaatctcaattcttaaaaccaagagttcaaaaaaattcagaaaacaaggaaaagcaaaccaaatgacgcatcaaagtcatggtcatgactcatgactcatgtggtcatccaaaagagaccagcaaaaaaaaatagaaataccaaagcgatcgaggcgatactaatatcaatatattacgttacgccgatcatcaagggaagaagcccaggacaaaaatatccgcacgtcgcatccaagagtaaaagaaaataattattttgtgattatccataaaatacttatagatactaaagttttatattgaaaaataagttcatagctcagttcctccactagcggtgtggattttgaagaaatcaaaagggtcaacggcctccgtcctaaaatataaacatatttagtacacagtcataagtcaaacattttcaactttgactattaatagtaaaaaaagattaatcatataaaattgatattactatatttattattaaacaaactatcgtaatatattgttgatcaaaatagcatatcggatattatgtcagagtaaaaaatacttatattttaggacttaactagttaaggtagtaaaagaaacagtacatgaacaattaattatcttgttgattttcgcctcgtagagaaataggcggtacaaacaaaccacccaaatggcgaagcgtcaacgtcgcaaaaagcaggatcaattatgcatgacacagtaatctccacacttctaggatcttgtttccggccagaacgaatcgtatccttttttttttctgttcctttttgtggtctctgaattctgatagagctgtgggacatattcgctcgtttccctggtgctgcttgctcgccaattcgccatggcctccaccgagcagcaagaacacgcagcaccgctgctccaacccgaggtctgtgttcatgtcaattttccgctatccaatatgtttccctcttcagtttactgccatggactgagttactgagctttgctcccgaattagtttagtgctcagtgttaacatggctgtggattttggttgctgcaggtagaagaagcatacacctcggatgggtcacttgacatcgatggcaacccggcgctgaagcatcgcactggtggatggagagcatgccgctcgattctaggtatagaattaatcacttaattactgattaaaacttttcttcttgccaatttgttcctggttaatgtctccactgaggcgatatatgcttattaattgtgcttgctgtggataggagccgagttctgctactgccttgccaacaatggcatcatgtacaacctcgtcacctacctcacaacccagctgcatcagagcaatgtcgccgccgccaagaacgtgtcgatctggaaggccacctgcttcctcacgccgctggccggcgccgtcgtcgcggattcctactgggggaggtaccgcaccatggtcgtcgcctgctgcgtcggcgtcgctgtcagtttgctaagatccccccacttcaatcagtcactgcatcccgccatgaattcagctcaggtttgaggtttggtcactctctgcttcgttcgtgcaggggatgctcatggcgtctctctcggcgctgctgccgcagctgatcgagagctcatcaacactgtccatgccttcagctcaagagttcgtcttgtttcttggcctgtacatgatcgctttcggggtgggcggccgggctgcagccgtgcctgatgtcttttggcgccgaccagttcgacgccggcgacacatcggagcgcgcgagcaaggcgtcattattcaactggtacgtattcaccatgaactgcgccgccgtgatatccgccaccggcttggtgtgggtgcaaggccactacgggtgggcattgggattggggattccggcgatggtcctcgccgtcgggctctcctgccttgtcgccgcgtcgcggacgtacaggtttcagacaacccgcggtagcccgctcaccagagtctgccaggtcgccgtcgccgccgtccgcaagttcaacgtcgcggcgccgggcgacatggcccttctctacgagctaccggatgacgcatcctccatgaagggagttgagaggatcgaacacaccacggatctcgagttagtttcttttctatgtcgatgtgccgtgttggttaattttcagctcccgaattcttgagatgtatctgccatgatcagattcttcgacaaggccgccgtcgtgacggcgtcggatgaggaggcgccgcgcaatccatggaggctttgcgtggtgacgcaggtggaggagctcaagattctagtcaggatgctgcccgtgtgggcgtgcatcgccttcttctacaccgggacggcgcagaccaagtcgacgttcgtcgagcagggcatgccgatggacgcgcacgtcggcgccctccgcgtcccgccagcgtcgctggccgccttccaaatgctcaccaccatcgtgctgatcccgctgtacgaccgcgtgttcgtgcccgccgccaggaagcacaccgggagggagaagggcatctccgaccttctcaggatcggcggcggcctcgccacggtcggcctcgccatggccgccgcggcgacggtcgagacgaagcgcgccagcgcggcgcggacgacggcgagcatactgtggcaggcgccgcagttcgtgctggtgggcgccggcgagctgctcgccaccatcgggcagctggacttcttctacagccaggcgccgcccgccatgaagacggtgtgcacggcgctcgggctcctcgccgtcgcggcgggcgactacctgagctccgtcatcgtgacggccgtgtcgtgggcgacggcgagcggcggccggccggggtggatccccgatgatctcaacgaggggcaccttgatcgcttcttctggatgatggccggcctcggttgcctcgatcttctggcgtttacgtgttgtgccaagaggtacaacaaatcaaggaaggcttgttgatatttcagggcttgttttcgggaggcacaaatcctggccgatgcacattgatgggccgaagaacttgatgctaactggcccaagacccggatcagccaacagagagttaggctttgcatggtaatcacatggtggaaaaaaaatccgctccctccgttttacaatgtaaattattctagcatttttcacatttatattgatattaataaatctagacatttatatctatctagattcattaatatcaatatgtatgtgagaaatacttatattgggaaacggaggaaatacattttaatggacccgcaatattaagcctcggggcatggcccaggtgactcgaggcttgggtccagccctgcaaaccgggctacccgcggattcttgcggtaatacgtataaaattgtcataagctaatttggtatgtgatatttggagacagagtattaggccttccattaggacagttgaaggatggtgaagccacagaactatagaagtggtgaagagctgtgaggtggcaaaggaccactaaaagagaagcgcctcaaacgcagcaaggagtcacaaaacgccgaagctatacacatgtcaaaaccacgaacgtattggctcgtgtaaatggcaaagccatagcggcaacaaagtcatgtcggtgaaggtcgcaaaatccgggtaggtcatttgaagtttggttctaatagacgcactggcttaattaagggccacggcccaagtaggcccatgaatactgccagagtcggtaagataaggaaatgacagggacgcccctttaggtgttcctattagagtatattcacctaccaaattgttataccttaaatggaatttatttatttaaaaaatataatgattagaaatcgctacttaatttttgatggcccaatatggtcctatatacgcacatgtctgcctttgaatgttttcacttcatccagaaaaatagaaggcaggagaaagctgcatgtgcttataaattggatttgtcgaaggcttatgatcgagttgactggaagttcttggagcagtcaatgtatagactgggtttcgcttatcggtggactcattggattatggagtgtataaccacggtgagatatgcaatcaaattcaattgaaccttgctcgaaacatttgctccctctcgtggactccgtcagggcgatccactgtctccgttcctgttcttgtttgttgcagacggcttatctctgttactgaaggagaaagtgatgaagggtgcaatttcccccgtgcatgtgtgtcgccgtgccccaggcatatcacacttactatttgctgatgataccttgctgtttattaaggcaaaaacggaagaagcggatgttattaaagaggtgttgagcagctatgaatcaagtacaggacagcttatcaaccctttctaaatgttccattatgtttggagaggccactccaacggatgtccaggaggcgataaaggcctctcttcaggttgcaaacaatagttttgaggacaaatatttaggcttcccgaccccggagggcagagtgtgtaaaggcaagtttcagtccctgcaagatagaatctggaaaaggttgttacaatggggcgacagtttcccctccagtgggggcaaggaggtgttgataaaagcagtcatacaggccatcccagtatacgtgatgggggtattcaaactcccggactctgtatgtgatgatttaacgtgggtaacacgccatttttggttggccggttaataaagaattaaggaaaccaacttgaaaggcttgggataggatcacaagatcgaaaggatagggctgcagg

SEQ ID NO: 23716 - DNA, 2160 bp, Oryza sativa
tgataccttgctgtttattaaggcaaaaacggaagaagcggatgttattaaagaggtgttgagcagctatgaatcaagtacaggacagcttatcaacccttctaaatgttccattatgtttggagaggccactccaacggatgtccaggaggcgataaaggcctctcttcaggttgcaaacaatagttttgaggacaaatatttaggcttcccgaccccggagggcagagtgtgtaaaggcaagtttcagtccctgcaagatagaatctggaaaaggttgttacaatggggcgacagtttcccctccagtgggggcaaggaggtgttgataaaagcagtcatacaggccatcccagtatacgtgatgggggtattcaaactcccggactctgtatgtgatgatttaacgtggctaacacgcaatttctggtggggagctgataaaggagtgaggaaaacaaactggaaggcctgggataggatcacaagatcgaaaggatacggtggtcttggtttcaaagactatagactctttaaccaagcacttttggcccggcaggcctggcgtcttttggacaatccagacagtttgtgtgcaagggtgctaaaggcgaaatatttccctaacggctcgttgacggatactccattcagtggcaatgcatccccgagatggagaggaatcgagcatggacttgatctgcttaagaaaggtatcatctggagaattggcaatggatgctcggtccgtatttggagagatccgtgggttccgagggacctctcaagaaggcctatcacgctgaggaataattgcaggcttagatgggtgtctgaacttatgcgagaggatggaagctgggatgtgaacaggttagaaagtatcttcctaccaatagatgtggaaaagattctacaaatcaggccgtcatctcgtcaggaggaggattttgttgcatggcacccggataagaatggtagattctctgtaagaagtgcatacaagctcgctgagcagttggcccaggaagaagagagttcgagttcctcgggtgtgagtatgaagaaggcctgggacaacatttggaagtgtaatgtgcccaacaaagtcagggttttcgcatggaaagcaacttccgactgtttggctaccatggtgaataagaagaagaggatgatggcgagctctgatacctgtactatttgtggagtggatagtgaagatacaacacatgccttgctgtggtgtccgcattccagggcactgttcaagtctatggagggtctacactgttcttcgcccggcaagggtgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcaggccgctgagaagcgtaataccctactcctgtgttttgggagatctgtgtatgaaggagctacaaagtatcagccagcctctcccttgttctgggtttctaatctggaaaagtccagtccccatctcagtgggcaaggtcctccttttatatcttaaggggataccacatgcaccatttctctcttttttgtggggacttaccccaccttttcataaacagacggagacttgtatggttgccgtccgaatgaccttctgatgggacggcccatacctacctccacttccgccggaagcaggcgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcaaatcgcctgtcgccacctaacccgcgatctgaccggtctgagactggtcacagaccggataaacgagtgcactgcactgcgttacatacggcgtgacacgctcagcccaaccgcaataaatgtggttaggtg

SEQ ID NO: 23717 - DNA, 12185 bp, Oryza sativa
ctgtagcaccaggcacactttactattcttctatgctttttccgtccaaagtcagagaagccggatccggaaagaacctacctaaggccattcctaacccaaaacactacacatagtgttcataaacttcacatcatcgaaaaactactactagactccattcttccaatacaaacaccattattctatacttaaatttaatgctacttatttcacatgatgtcttggatgttgtgtagaaaccatgtctcatgcaagactcatggttttcttctctttcctcatttattcatttgtcacatcatttttcatcatatatgacagcttatttaatgctatgaacaccattctaattattgggttgggaatggcctaaacttctacccgagatcagattcgaggtcgcacattgttattagtcatgcccgagaggagaccctaataaaccaacaacaatgtgcatacgtactgccctcaccgtctcggtcacacgcttttctaccgctttttacacctgattttggctttattttgttggcacggttagtgtaataataaaatctgaacttttaaaactagtggctaaaaaaatcccaaaaacaatgtaaaaaagggcccggccacaaaaaaggaggaaaaaacccaaagagatgaggtgctagctagtactcttacatcacgtataggagtagtatggttggcaatttgtgcagttttttttttctcaatttgctgcactgagcaaaagtcaagaacatgatgtcacgggtcactttgggactgaaatatttgcatgtcacatccaagagtagaggaaaatattcaatatcggatagatacacatttgaagtattaaacgtagtctaataacaaaacaaattatagattccgcacgtaaatcgcgagacgaatttattaaacctaattaatccgtcagtagcaaatatttactgtagcaccacattgtcgaatcataaagcaattaggcttaaaagattcgtctcgcaatttacacgcaatctgtgtaattagtttattttgtctatatttaatactctatgcatgtgtccaaacattcaatatgacagtgtgagaagtttttgcgtgggaactaaacaggggcctcagtacagcacaagctctccactatactgtagtagactagtactccctccggtttcattttaattgacgttttggacaatggcacggtctacaaaatatatttttgaccttattttcctattataatatacaaaataaataaatgcatgtttacttttattatagtgctttgaaagacaaatctatatatgttgtcctagtttctttaaactaaatatttttaaagttattgatggtcaaagttataaaagtttgacctcaactttgtccaaaacatcaattattatagaactagagggagtagtactacatccgtccttaaaaaaaaactatgattaataaatcaaaaggaataagggatattatataagcaacagctagtagaatgaacaaaaaatggtctacttgatcttaccgtcaattgtcattgttggagaaattgacgctacaacgactaacaaaatgccgaagcgtcaacgtcagaaaagcgcaatttgaatggtaccataccacaccagagtaatctaatatccacacctaaattagtagaacgaatctttccttttctctctttttgtggtttctgattgagtgatagagtagacccatatctcgactcggtggctgtgctatcatctagttcacgagctctcaatcgaccggattttcgccatggcctccagcgagcagcaagaacacgcagtggcgctgctccaacccaaggtctcgctcttcctgaacacctcagcaattcttatgtcgattttcactgtgcacttcagttttctgcatggctgaatggattgggacttgcttgaacaagttcagtgctaactttggctggggattctcgttgctgcaggttgaagaagcatacaccacagatgggtcactcgacatcgatggcaatccggcgctgaagcatcgcaccggtggatggagggcatgccgctcgattcttggtatgcttaattagttgctgatttgttgatgattaatgttcttgtttcaacaaagaagaatttatttctttgattcgtccactgaggcgatgcttattctgtttctgataggtactgaattctgttactgcctggcctactacggcatcatgtacaacctcgtcacctacctcaccaccgtgctgcaccagagcaatgtcgccgccgccaagaacgtgtccacgtggcaggccacctgcttcctcacgccgctggctggcgccgtcgtcgccgattcctactggggaaggtatcgtaccatggtcgtcggctgctgcgtcgccgtcgctgttagtgatgactcgatccccaattcaatcgaatcattgcgtcccgccatgaattcagctcaaagtttggtttctctctgcttcgttcgtgcaggggatgctcatggcgtctctgtcggcgcttctgccgcagctgatcgagagctcatcaacactgtccatggagatcatcttgtttcttggcctgtacatgatcgctttcggggtgggcgggctccggccatgcctgatatccttcggcgccgaccagttcgacgccggcgacccgtcggagcttatcagcaagggctcctacttcaactggtacatcttcaccatgaactgcggctccgtgatatccacctctggcatggtgtgggtgcaagaccactacgggtgggcactgggcttggccattccggcgatggtcctcgccgttgggctctcctgcctggtcgccgcgtcgcgggcgtacaggtttcagacaacccgcggtagcccgctcaccagagtgtgccaggtcgtcgtcgccgccgtctgcaagttcaacgtcgcgccgccggacgacatgtcccttctctacgagctaccggacgacgcctcctccatgaaagtagttgagaggatcgaacacaccactgatctcagattcttcgacaaggccgccgtcgtgacggcttcggatgaggaggcggcgggcgccgcgccgcgcaatccatggaggctttgcgtggtgacgcaggtggaggagctcaagatcttcgtcaggatgctgcccctgtgggcgtgcattaccttcttctacaccgggacggcgcaggtcaactcgacgttcgtcgagcagggcatggcgatggacgcccgcgtcggctccctccgcgtcccgccggcctcgctgctcaccttccaaatgctaaccaccatcacgctgatcccgctatacgaccgcgcgttcgtgccggcggtcaggaggctcactggcagggagaagggcatctccgagctggtgaggatcggcggcggcctcgccatggtcgtgctcgccatggccgccgcggcgctggtcgagacgaagcgcgtccgcgcgtggcagacggcgatggagaagacgagcatcatgtggcaggtgccgcagttcgtgctggtgggcgtcggcgagctgctcacctccatcgggcagctggacttcttctacagccaggcgccgcccgccatgaagacggtgtgcgcggcgctcgcgctcggcgccatcgcggcgggggactacctgagctccatcatcgtgacggccgtgtcgtgggcgacggcgaccggcgggcggccggggtggatccccgacgacctcaacgagggccaccttgatcgcttcttctggatgatggccggacttggctgcctcaatcttgcagcgtttatgagctgcgccatgaagtacaaaaccaggaaggcttgttgatgtttctgggcttgtttgggagacctgctgctgcacctaggctcattaccgctggatgcgccttaagattcggacgtacacgatacctacatgctgtatattgaaacctgggaaatacatcacgaatcgcttaatcgatcggacggcagaggccctaggtgcagaaaaaccacgtccacctgctgctagggctttggtgttttttctccatttgctacacggtgcaatggggttaatttgatccatgccattgcaaatatactaaatcaaaaaaaataccattactatttatgatattggttggatgccactaattataaaattagaatcatgcaatctccgtcacgttttctgtcacgacctttttcttctctcctccctcttctattttcttctctctgctcgccaacaagatcccgatatggctcgacaatgttgcggataggagggggtcgacaacaacgtcgatagcggtggctcccaagacctcccgcccctatagcctgctcgagctcgccgttggctcgagaaggaaggagtgtcgcgtctatctcgcaggtcaagatcaagcagcgccgtgtctccaagagcccgcacagccatgcgagcacaacagcaagccgccggactggtcctccatggaggcagcactccctgcggcgatggcggcgttcgcggtggtgatgcctgctgcgagcgagcgggcacggcgcgaaccagacaataaggaactggttggtggctcgctaccagccatggtcgcagtgtggccgccgacgtcactgagggcacacgagtgccgatgggaagtggccggcttgccagtgacgagctcgcgggcgttggcttagatggatgaggaggtggcacccgtcgagcatggagcggcacatttttttaagagaagggtatttttatccagcctctacatccaatcggatatatacagtctttttaagttaggaacttagcctatcaaacaaggaacttagctctcaaataacccaattcgctcatatgaagatttgaactcaggactttgggtgctactcaggtcactgcaaccaataggctacatgccctttcacaaatagagcggcgcatgctgtagccgtcctgcaagcagtgcaaaagctcccaaagagtgtccacatgtcccaatgacaccgtgcgcagcgtcaccctccccaacctttccgcccattggccttcaacgttctaattccgctccgctcggatgcagcttgagagagagagagagagagggtcgggggggggggggacgaagaagtaaaatgaaaggggagggttgaagaggatgaaactgatacacgggttccatatgtggggggtcattttggtctatctgatgataaaaaacgtgattgcgatgatatgattacacttttaaaaaattcaagtgatacccagccgatatagcgaatattaatattattttctaatttggcacatttataatagcattaatcaaattaacccaatagatgatgtcatgtcagtggtagttaggacagaaatatacatatgtctgcacgtggcgtacaggaataaatgagaaagttcaatacatgactcaggtcctccactacactggtgtggatcgtgattcttatgattaaagaaatcgaaagaaatgagatcgagacgcatattgttacgacctacaatatattccaaagacgaaagtacaagaataatgatcttgctgatctcgtcattgtttgagaaatcgacgatacaaccagaaaaaaaatgccaaggcgtcaatgtcgcaagagcaatcatataccatatctgcatatcatatcactgtaatcagtctccacacctaaactattgttgttttcccattttgtgggttctggtagagttgttggataagtagaccagtataccaatcaggtcgcgcacctggtgctaatagcttagtttgcgatctctccatcggttctcgccatggcctccacggagcagcaagaacacgcagtggcgctgcttgaccccaaggtctcgctgttactcaatgccgatgccatgtctatttttactatgcaatttgcctgaaatttcattgcagccttgcctgaattcaacttggctggggttgcaggtagcagaagaagaagtatacacaacggatgggtctcttgacatcgatggcaacccggcgctgaagcatcgcactggtggatggagagcatgccgctcgattcttggtaatttaatttagtgtgttttgtgatgttttctgtttgaaaaaggtgcttaatttcttgttcatgtgattatctgagtgcttttggatatataggcaccgagttctgccaatgcctggcctacttcgggatgacgatcaacctcgtcacctacctcaccaccgagctgcatcagagcaatgtcgccgccgccaagaacgtgtccacgtggcaggccacctgcttcctcacgccgttggccggagccatcgtcgccgattcctactggggaaagtaccacaccatggtggtcggctgctgcatcggcgtcgctgttagtcacaaccaattcccactacaatcagtaactgtatactgttgaggggatattcacttgttggttgtatatcaaatgattatggaaaaaaaaattaaaaagagtattaatatgtgatgtatcattacacaaacatataaatgcaaatttaacttttatatattgcaacggaaaaaaattgaattacagctagttaacgtatattcagtatttttttttagttgtgacatgtagaaattaaattttaacttgcatatttgtagaatgatatatcacatattaatacgtttttttaatatttattttttttataactatttgagtgacattaaaacaaccagtccacatccccttgagaatttaaaacctactccatgaattcagctcgggacctcaagtttggtcttttgctctgtgcagggcttgctcatggcgtctctctcagcgcttctgccgctgctgatcaagaacatttcgactctggccatggcttcagctcaagaattcgtcttgtttctcggcctgtacatgatcgctttcggggtgggcgggctccggccgtgcctgatgtccttcggcgccgaccagttcgacgccggcgacccatcggagcgcaatagcaagggctcctacttcaactggtacctattcaccatgaactgcgcctccgtgatatccaccaccgccatggtgtggttgcaggaccactacgggtgggccctgggcttagcgattccggcgatggttctcgccgtcgggctgtccttcctggtcgccgcgacgccggcgtacaggtttcagcgaaaccgtgggagccctttcacaagagtctgccaggtcgtcgtcgccgccgtccgcaagttcaacgtcgcgccgccggccgacgtcgcccttctctacgaggtgccggaggacgactgctccatggaaagagttaagaggatcaaacacaccgatgatctccagtgagttgctgttggtgaatttgtagctactcccttagtttcaggttataaaatgtttttgattttggttaaagtcaaactacttcaaatttaacaaagtttatagaaaaaaatagtaatattttgacacaaaataaatttattataaaagtttatttaattattaatttaataaaactaatttagaatgtaaatattactatatttgtctataaacttagttaaaattaaaacagtttaattttaacaaaagtcaaaacatcttataaaccgataaaccgatagtactaattctcaagatgcatctgccatgatcagattcttcgacaaggccgccgtcgtgacggcgtcggatgaggaggcggcgggcgatccgtggaggctttgcagcttgacgcaggtcgaagagctcaagattctcgtcaggatgctgcctctgtgggcgagcattgccttcttctacaccgggacggcgcaggtcaattcgatgtccgtcgagcagggcatggcgatggacgcccgcgtcggctccctccgcgtcccgccggcctcgctggcaaccttcgagttgctcacctccatggcactgatcccgctgtacgaccgcgcgttcgtgccggcggcgaggaggctcgccgggagggagaagggcattcccgacctgctgaggatcggcgccgggctcaccatggccgtgctcgccatggccgccgcggcgctggtcgagacgaagcgcgcccgcgctgcgcggatgggaatggagaagacgagcatcgtgtggcaggtgccgcagtacgcggtgatgggcgtgggcgagatgctcgcctccgccgggcagctggacttcttctacagccaggcgccgcccgccatgaagacggtgtgcatggcgcttggtttcctcgccgtcgcggcaggggtatacctgagctcgctcgtcctgaccgccgtgtcgtgggcgacggcgaccggaggccggccggggtggatccccgacgacctcaacgaggggcaccttgatcgcttcttctggatgatggccggactcggctgcctcaatctggtggcgttcacgagctgcgccatgaggtacaaatcaaggaaggattgttaagttttgagggcttgtttgggaggcttctaaagttgtaatcctgccccatgcagtggttatcccggtacgaggattattgtggtttcaagaatggaaaaggttactgtatgtaataaccgcgtggttttgctaaccgtacccccaacaccatcacttttgttttcattattgtgtattcaccatttgacttggcataatctcccccgccaccacccttctcttcacctctactcctgctcccaccaaaactgtcacaccccaatccggcaccgccgtacaacggcacctaatagaagcgtgtcgtaggaataacggcgcgaaccgcttcctacgaaaccgcgatctcggtaccagtcccaggacatagtgctggtacccacggtgacaaatatgaatcatcgcaaatccttaaaataaatagaggacttatttaccttaacttaggttgcagctcagaacagcccgagaatgcaaccgacgacacggacgaggaaacaccaacaacagcagtagcagcggagccaacggactaacacccaacaccacaggtgacggctgggaaccaggacgaaaccctaatcttcacttcacttcatcttcagcttcagagcgaaggaactatatatatttatatagagcaagggtgagtactttcgtactcagcaagtcatgggaatttaggagtttaatgcaagcttggaagagaggcaaggttgatttgcaaatcctttgtttgaaatcattttgaaatcactaagtgattcacttcttgttaagtttgggctgaaaagagactcgcgtctcaaatcgacttaagagatgcttttcaacaactcaattggtaatgtaccgacctcccgggtcagatcattacctctcggctcccagagtcatttcacttgattaatcggctcccaaagcctttctcattttctcggactcccagagtccagctgcccagcagcaaagcaatccgcttccactcgggaagcctagtctatgatgcccgcagacatcccgaaccacacagattcgtttctgaccactcaggtcatccatctgccacgtaggctgattctggttacgattcccacaccacaacaacttttcacaaagcacaggcaaacaaatctatgaaacgggaaccacctcacatccgcccatgaccgtgggcacggctgttcgaacagttagttaatcctctgcagaggggcacactttacccacaagatacgaacttattccgaacacccgtcggtatcggaggctcgcaacaaagcctttcccaagccgacccagggatacctcatgccacatagaaggatcaaatcatcacataaatataggtcattttagttttcacaaatcaaactccaaccatctcgatcggtaatctggcaagcttctcttccttgccttaccaggaacccggtttggctccaaccgaccccgccccggctttcccaactattggcatgcgaggtttccctgaaccgactagttacttagccagggtgtcccattccaccttgtggttgcactttgattatgttcgatgagtttcctacaggaatcggtccttatatgcgaatacgggacagtgccacgtaggcacaacccccgcatcgcgagttttcgcagctcattttattttcaaacccaccgacgccacatgtcgggttttcaaggcttctcaaacccatttcccaaattttcgacaatcaacggtgtatgtgggatatttggtatacacgctcagagagcacggataccgaggtaccacaagggtggagcgacaaggaattagggtagtacagcctacaggaattagtgcgactactaggtaggtccgtcggtttgacatgcaaaccgaggccaagcatgttataggagtgattctaataatgcaagttgcaaacaaaataatattgatttttcaattataggagcaattgatcaaagggtgacttgccttgctcaaggtcttcacgaagcttcacgaatcttcaagaaaacccgcgatcgacggaaatccggtaaccgcaactatacgcaaacaatcgaaaacctaaacaaagaccaaaagaaagatcctatttagactaattagtagtgccattaaatagatctcaattttatggaaatactggaagtaaaacggagtcaatcagagctacggattgagagatatgaattttggaagtttaattggaatttctgggcaaaggaagatatttgtggaacaaggggaaattgatttatgaaatttatagaaataatattctcaagaatattattgaccgtcactgacgtgcgggaccaaggaaatgatttacggaattttgggaataaggaattgatttatgaaaaagggaaaaggatttattaatccctttggataagaaaaggaaggagggatgagatttagacttcctttggcggctcgggtacggcccaagggataagcgcggcgtggtcgagccaatgggccgggcgcgggcgcgaggaggcggcccatggccgggcaaggcgcggcccaagcgggcggggcgcgcaggaagagagagggggatgggtccgggtggaccggatccatcgtgccgggtcccgggacgggcccacgagtcagcgactcggcacacggggaagggttcatgcggcgcggggcgctagggttttacggtcgcggctcacggcgcggcacgcgggtggaccaagaggtggagggcccatgcgcagcctaagggctctccgtggaccgcgcgcacagaagaaagggcggtgggggcggctgactaggtgcttgacccggtcaagcgggcccggggctgaggttgctgccacgtggtcggccacgcgggcaggggcgaaaggggaggaggaggaggaggcgcccgagatggacggcggacggcggccgagttcaccggagctcgtcgcgacgattcgagagagagggagtacatttgaacgataggacggacgagagggagtgagccaccggatcggattcgccggagggaggccggcgacgacgaatcgcggcgacgcttgccggcggcggcaaaagagggaaacgacgacgatgcgacgagagctcgattcctagggacttgagcatctacgcgacctcctgagttcatttctagagtcggattgggtggagctacaccgaggaaggccgacgacgagcggctactaccgagtttgggcggcgacggcggcgagcctacggcgagcagcggcggcggtcggggcggcgccagcttactactggaaggctactcgcactactgcccagagctaaggagaggagagggagcgaggagggagaacgggagaggcactaccgagccgagacggacgctgtgacgagcggccgccgacgcgggagcgagttctccggcctcgggccggggaaggggaaggagacggcgcctggagtcccgcgtcagctcctcgcgcacacgccggattcaccagcacgcgcaatggaggagggaggcgaggacggcggtagcaaggcggcaagggcacggtggtggcgagggaatgaacgagagggagatggggcggcttggtttaatagatggcaatgtcgatttagagaggaagaaccgacattggcggtcaaggagagcgagctggcggtcatcgacgcgtgcagcaaaggcggcgacaggtgatgacgccggcggtggt

SEQ ID NO: 23718 - DNA, 2080 bp, Oryza sativa
gagaaagatagagagagagagagagagccgagagagaaggacaaccatagagagctcggctcggcttggcacgtgcaacgcacgtgcgaggctgagggaggagaaacggttgagggagggaggtgggctgagggggaatacggcccacaacacccgagggaggtaaaatagacttttgtagagaagactgattaggagtggattcaaattcaaatttgatattcgaactcaagggtttagggatgtatcaagggaaactcaaggagaagtcatggaaaatattcaaaaggaatacttgggtatttgttcttgggagcataaggtgaggtcaaggaaatgattcggatgaggatcgatcctctcgaaatcgagagaaggatttggcaacgagttcaaggaagggagagattgacttccggaattgggatttggatgagagggaggagtcgccaacgggattcaaaaaaggggatttgaatctaaatttgatacttgtacacaagggttcaaggagacgagtaaggaaacaaagtgggagtttgatactttcgggaatgggaacaattatttggagaggattcaagggaagggattgactttcggaatttgatttcggagactcgaatcggaagaggaatttttgaggtggaggattttgatttcgatgaggaggaacaacgggattaaattgagatccttggcacaacttagactctcacacaaagaactaaattttcgcatataagattttgtcgaattagtttttaacgtctcgcgaaaagcggagcgttacaaacaccaccacctttgccgccacctattcaattgtggccatatctaccaccacattcttatttttttttagataatgaaatagagtatcccggcctttgctcaaaaagctacagccaattattacaacctcacacttaaaatgagtgaagttcaaagaaacttaaaagacgaaaccaaccatcaagaaaaaacaaactaaagactgccaacccaagattaagagtacacaattattgaattctgtttgtgaacctccgtccaaaattgataaaaagttgcataacggttgtcttaagaatacggcatgtagcctttaaaagctcactatcttcctcacacttttgtagttgtgcctaagaccggagccaatgggttgccctgaaaattacctgcgtatatatatgaaatagatgaccaccccattcttctagcttgcttgaccaatcaaagaaatatcttatagaggaattacatgttaaaaaaaacatttgagagcctttggatgatatgattgcttcaaaggaattcgtaggacaggaaaatttcctctatattttggagtgtttctagcaaaaggtttagccaaaatttcaatggatttcctctctaaattatctcaataggaaatcaatgtaacatatatttttgaattaagttttcgttacttttcttatgagacaccaaacagttattttatacaaataatgtggttttgttcctgttgggtttaataagccgtgatatgccaaccttatatattcattttattgctatgctttctatattattgtgttttaaagaagctctcaacgcaatcatataatctgaactgttagttccagccaaaaagaaactaacagttcacaataaaaaaaaggaaaaagaaaagccaagccaaatatcacatccaaatcaatgtcatcggaaaagaagtcaaagagataaggtgttacatctaggcatattcagtttaggctgtgtttttgttcacaccaaaattgaaagtttggttgaaattggatcgatgtgatggaaaaattgaaagttcatgtgtgtagaaaagttttgatgtgataaaaaagttagaagtttgaagaattattttggaactaaacacggccttagtcacagcacatgggttgctatcattaccatttaccaatgaaagttaggtcctgtttagttccaaataaaaatttttcacctgtcacaattatgcatggagtattaaatatgaaaaaaaaattacacagtttacgtgtaaattgcgagatgaatctcttaa

SEQ ID NO: 23719 - DNA, 7396 bp, Oryza sativa
gtacagccagcaacaataatttccgaggcttcaatgtcgcagaaacccaattattatgcatgccgaggtaattaataatatactccttcgtatctaaattaacttgtatactaatctttattcgctttattttccttttgggtctctgatagagttggtacgggataaggttgtcctgtatatcctctcgaggtcttgattagcttgtacagtttgtcctcgagctctcgaccggctccggcaatggcgtccacggacactgagcagcaggaacacgcagtggcgctgctacaacccgaggtaattaattaatcgctgttcataatctccttactgctagccttatgccgatttccacgatgcagtttgtttaatttctcatcagtttccctgcagaaaaatattgattgagccttgcctgaactagctactcctagttaatttgaagcagccgctcatggatacgttcagtgctaactaggctggggattttggttgctgcaggttgaagaagcatacaccactgatgggtctcttggcgtcgatggcaacccggcgctgaagcatcgcacaggcggatggatggcatgccgcccgattcttggtaataaacttcattagatatccctgcagctctattaattatttcctaaccttttttacttgccaattttttgatgattaatgtgtctctcactttgtgtgttcttgttccaaaaaagaaaaaaatgaaaaaaaaaataaatgaggaacttctttgttgatgtggttatctgagctatgacaacactgaggagagatgcttattctgcttgctttgtgattgtggataggcaccgagttctgctactgcctggcctactacggcatcacgttcaacctcgtcacctacctcaccgccgagctgcaccagagcaacgtcgccgccgccaacaacgtgtcgacgtggcaggccacctgcttcctcacgccgctggccggagccgtcgccgccgattcctactggggaaggtaccgcaccatggtcgtcagctgctgcatcggcgtcgctgttagtcccctccatttcattcgatccgggttgtgtttagttccaaattttttttttcaaacttctaactttccatcacattaaatttttcatacacacaatttttttcagtcacgtcgtcttcaatttcaaccaaaatctaaactttataccaatctaaacacagccttaattagaattagtcactgtgtccttcctgccgtgaatttatggctgatggcaagtaatcagtcactgtgtgggatgtggatttttatcccttgagagaacatttaattttatattaatattaatttatgttaatttatgttgtcatttaattttatattttatattaatttatgttgtccattttttttaatttttttatgactaattagttggcatggatgaaacgagggatatttcctggagggatgaaatcactttccccactgtgtgctgccatgaatgcaaatccaatcagcttcatggctgtacgtacctaatctgtggtgcagggcatgctcatggcggctctgtcggcgcttctgccgctgctgatcaaggacacgtcgtccatggcttcagctcaagtgatcatcctgtttcttggcctgtacatgatcgcatttggggtgggtggtctccggccgtgcctgatgtccttcggcgccgaccagttcgacgacggcgacacgtcggagcgcatcagcaagggctcctacttcaactggtacatcttcaccatgaactgcgcgtccgtgatatccaccaccgccatggtgtgggtgcaagaccactacgggtgggcattggggttggggattccggcgatggtcctcgccgtcgggctctcctgccttgtcgccgcgtctcgggcgtacaggtttcagacaacccgcggtagcccgctcaccagagtctgccaggtcgtcgtcgccgccgtccgcaagttcaacgtcgcgccgccggccgacatggcccttctctacgacctatcggaggatgcctcctccatgaagggagttcagaggatcgagcacaccgccgatctccggtcagttcatgtctctcgttgcatctggtgtttgtgatgctgtaggtgtaatgtaattggctaattcttgagatgcaactgctcgatcagattcttcgacaaggccgccgtcgtgacggcgtcggacgaggaggcggagggcgccgcgccgcgcaatccatggaggctttgcgtggtgacgcaggtggaggagctcaagattctcgtcaggatgctgcccctgtgggcgtgcgtcgccttctactacaccgcgacggcgcaggccaattcgacgttcgtcgagcagggcatggcgatggacacgcgcgtcggctccttccacgtcccgccggcatccctggccaccttccagatcatcaccacgatcgtgttgatcccgctgtacgaccgcgcgttcgtgccggcggcgaggaggctgacggggagagagaagggcatctccgaccttctcaggatcggcggcggcctcgccatggccgcgctcgccatggccgcggcggcgctggtcgagacgaggcgcgcccgcgcggcgcacgccgggatggagccgacgagcatcctgtggcaggcgccgcagtacgtgctggtgggcgtcggcgagctgctcgccaccgtggggcagctggacttcttctacagccaggcgccgccggccatgaagacggtgtgcacggcgctcgggttcatctccgtcgcggcgggggagtacctgagctcgctcgtcgtgacggccgtgtcgtgggcgacggcgaccggcggccggccggggtggatccccgacgacctcaacgaggggcacctgatcgcttcttctggatgatggctgggctcggttgcctcaatcttgtggtgtttacgagctgtgccatgaggtacaaatccaggaaggcctgttgatacttctgggcttgtttggtaggctcgaaattccggcccatgcactctgacgggccattatgtatgggaataagtccatccgacctccctcatctcttgcacttggtcgaatcgcatccctcagccgcaaaaaactgggtaaaacgcctcctgaatctcccaaaaccggtgcaaatagactcctcgagtggtttggaaggtggtttcagctgacgtggcacattgaccgtgattgactagctgaatcagcaactaggacccacatgtcatcctaatattatcttcttcctctatgtcaacccgtggcagtgccgcctcctttgctatcgcatgcgcgcactcgctcaccgccatccccgagaggttcgcaccgagctctccttctacgagctggtggtcgtggccaccaccaggaaggggtttacgcgcagatgtgcacaatgttcctcacctctccctttctcgcgcggggagcggcggcggctgcgccgtcgctgttcgtgacggcctcgattggcgtggtcggagctacaatgccaccggcgccctcggggggctagggtgcaagtgcgccgatgcatgtgcctgagccagcgggaggacgacaagctcggtgaagaggcgctcggcagtggtgtccgattagttggcggcagcgacccagatgacggcggcgccaacatcacaaccacctccccaacgtgtcgaaacaaattttcggtaatatgaaaagggggtagcgtacgagacctaaaagtggatggatgcagatacagggatttagacaggttcaggccctctcaatgagaggtaataccctactcctgtttggggatttgaatccaccgggtgtttatttatctgacgatcaggttgtctcatgccccctagagggcctcctgcccaccttatataggatgggaggcaggattacaagataaaaaccttaaccaacacggtatcagtttcctaaatctactttacaatattaccaaactaggactttaggccgttctgtaatatacaaggaaacgtaatacccaagtcatgaactgttacatattccataaatataagttatcccctataactagtcggataaccatgccgtgtgggtatggggtacccataatctccacagtagcccctgagaccttcacagtcgaaaagataatcttctctcgaactagattactccaaagccgagtgcttcaatcatctttgccatggtctcccgagtacttttaccaaatctgaagactgtggagggctgaaaaataaagtcaggtgcatcgactagatgcacctaataggtgtagcccccgactatgtggttaattgaacaaaccaagcatatagttaaggaaaaaataatccaaccaaccgagtggctttgataattatagtcaaccaagtgacttgatattaatatgtagcatatgcggtgtgaatccctgaataacatgatccgagtgatataccaaccgctttgtaaaatatgatgagtgtaacctaaagttggctatatcattgaaaattcacatagcaaaacaactataaagaagcttgtatgttgtgaataaagaaattttcaaagtattgggcatacgccatacgcacattgctttaacagatgtgcttaagtccctagaagacacatggttccaccacacctggaaatatatggcatatgtggtataaaatccgagtaaataaactcataaaggatttaccaaccgcctggaaaatgaccaaaatatataatcagcctaaaccataatattggtcaataaaagtgcacacttacgtggcaaaacgcaatgatattgtatccaatcaattgctttatgaacccaaacagcgccttgacttatataaaaaagtcagcggggagccatataaagcattactgtttggcaccttttaaattgcattgtaccaactcctaaaaagttgaataactgcggtataaaaggattttaaggtattgggcacataatcacgcgcacttttgcctaagcaaaaagatgcctaagtccctaaaaaacgtgacaggctacacctgaaaatatgggctgcagacatattaggcctaggccaaaaaatatgccttcgacaccctttaaaggatgacgcatgtaacatattcccgagtaataaatctttcgggttatatagaccaagtgcagctcatatgaatagcttctgatctgaatgattatcctttatgggatactccaaaatagatataataattgaattctgactggcgcaagtattcggttgataacccttacagggaataataaatagtccagtctttgagcgtagaaaatagacccatgatcatcaaattcatgttgcatgtatccggaacaagtccaaattgaagatataaccctcgcgcttgtgtcgatgagcccctaagcatgtagcttatccttctgttatagtcacaattgtccattgatggtagctgacgtagtcggcatggagacgaaatgaccaacatgaagataatatcatccatcaaagctgacgaagatgttggtggtggtaaaaacagtgacgccaattaaaggtgatgaagtcgcatagccgtggagacgaagaaaccagtcggcagcaatcaaatcagctagcagtgaagatgaagacgcccaacaacaccgatagagcagtcggtggcaacgaaagcaagtcgacgacgaagacgtagacacgcatcaacggtgatggcgaaatccaccaatcatgaagatgaagaaaatagtcggtaataatgatgaagacgctcatcagtgtttgcgtagtaggtcaaccgtgaatgtgaaataataagtcggcgaagacataatcatccattagcaacaacggagatgtcagggccgatgaagcagaggtgctggtgatgatgttagtgacaataatccatcaaactgttgacaagatatcaaagctcgagtagtttccttgatgcgagcgtgtgcataaagaaggctgatgcaacgcttcttgatttacgaagatgactgcagaacttagtgttatagatgttgtagatgcttcacttggaggaaagtagatgctgttgtccaactcattgaatcagtgtaataattggagtcgctgaaataaaatgtcggctctgaagcgaagacgaaaataataactcccagagttgacttgtcgattgattgattgcttcatcttgacataaaacttgtcgaattttgagtcttgtatttgtgtatcccctgactctttggttagttggaaagcaattgaacatagagtcgagaactgtagcttcttgtcatcgagtagtcattgcttgagtaaagatatgtgttgaggatgtccgagtaggaatcttgaaaattgtagaaccacttgtagtagtaaaatgacacggcatcatatttggtgacgcataccgagatgcccaagctcttgtagacgtcgtggctggtgaagtagcaaaacttgcgaagtagaggcaatagtgtttgctagtgccaaagataataaatatgaagtcgctccaccatggcgacaaagttgcatagccgtgatgacgtgaacaggagttggcggcaacagaagcaaaccggtggcgaagatgcgcagtcatgaagataaaaacaccagttggcggcggcataaccagtcggcaacggaagaagtagaatgatgatgaaaacgaagacgttttttaacagcgcaaaataggccagccatgaacgtgaagacatcatgggcagcgccgaaggcaaaccggcgatgacgatgacgccagtcaatgatgatgaagacgcgcagccgtggaggtgaacaagccagtcggcgtcagacaagtcggccaacaatgaaaacaataacgtccatcagtagtggtagcaatataaaccagcagtagaggcgacggcactagtcaacagcagaagagacgaccggcagtgaagacgataaggccaatcaacattggcagaatcatgcagccatggaagtgaagaaaccagtcggcagcagacgtagacagcttgcattgaagatgatgacgccgattagcggtgacggcgacgaggccagccgtgaagatgataacaccagttggcgtcatacgaggcggccggtcggtgaagatatagacgtccaacaacggcggcataataggccagccgtgcaggcggagacaccagtcggcggcagacgaggcggccggtcggtgaagacgtagacacccaacaacggcggcataataggccagccgtgcaggcggagacaccagtcggcggcagatggccggtcggtgaagacgtagacgcccaacaacggcagcataataggccagccgtgcaggcggagacaccagccgacggcagacgaggcggccggtcggtgaagac

SEQ ID NO: 23720 - DNA, 10900 bp, Oryza sativa
taataggccagccgtgcaggcggagacaccagccgacggcagacgaggcggccggtcggtgaagacgtagacgcccaacaacgacggcataataggccagccgtgcaggcggagacaccagtcggtggtagacgaggcggccggtcggtgaagacgtagacgcccaacaacggcggcataataggccagccgtgcagacggagacaccagtcgacggcagacgaggcggccggtcggtgaagacgtagacgcccaacaacggcggcataataggccagccgtgcaggcggagacaccagtcggcggcagacgaggcggccggtcggtgaagacgtagacgcccaacaatggcggcataataggccagccgtgtaggcgaagacaccagtcggcggcggcgaaggcaagccggtcagtgaagacgtagacacccaacagacggcggcataataggccagccgtgcaggcggagacaccagtcggcggcggcgaaggcaagccgatggtgatgttctgactgatccattcctgaagcgtaggagataagcttaaagccatgaattccttttatgcatatctggatctggatcccacagaacaaacagataggatgagtagtatctgatgtaaatataatactcgagaaaaattcaagcattttaaaatatttataaatatgtatttctcctctcgtcaattttgatttcctcgagtagatgactcattacgtttaaacactctgcccgactagtcatagccaccaagcaccgggagtcggcctaggcacttcccaaacatgcatatgagtaacatgagttcgtcattaatggaacaaagtttcacggatcagaatttactactcgggtacttttgcaattattaagagcagaaaataaattatcttatctctatgcttttgatttattccgaataatacttagcaccttgcgttattcggtccatccaacaagccctcgggtgctaggaatcggcccaaaggcaactatccattggcaaaccaaacggaaagcataggaagatggaaatccataactcgataggcacttttgtactcagattatgtcacgagcaatcaagataaatattatgaaagttatttaaaaaatatgatataacatctgtagcccctgactcactagtcaacgacgaaccagttgatgtagtgaggcagaggaaaagaaaaatatcatataaggaaaaatgatgacttagctttgtaatatctctcttaatgacggcagaggtggctgatgtgggaacaaagtcgcctattaatggcaatgaaaacaccagtcggcggcgaaagaaggcggtcgatggtgaaagcgaagatgcccaccaacggcggcataataggccagccgtataggcgaggacaccagtcggcggcgacggaggcaggccgacagtgaagtcgtagatgcccaacaacgacggtataataggccagccgtgcaggcggaaacaccaatcggcaacagcagtgccacagcattacatgtaaacaacaggaaataccaagagattaatctgatatttagagatcaatctaataaacaacaataagttggaagggaaaaaacccggcggagtcggagatttaaattgttgaactcgccgagattgattttctcgaccggactgactccgagacggagaaaattggttgctggtgttgcactctgtcgctaggactaatcaagcgatccatggctcggcgtgcttacagaacaagacaacaaaccaacttggttaatgataaaaatatataggcatgattaagtaaattaatggtgcttgttgatcggtaagatcaactttctgcacgtgttctctcctgattagccataggctggctgttcccatgtgtggcccgtggtggccatagcccgcaggacgtccatcggtgatgctccgagattcacatggaaacaaataaaataaatctgattaatatcagcaaattaaatgtataaatctcagcgattgaatgcatgtatggctggattaattaatccatgcatggcggttgaatcgacacatcctgtacatctccagcgatctcgtcatgtgaactttcgtgcatgcctgtccagcccacgagttggattcgctcagagagtggacggcttcgccttgcgtagcgacggcttaatcataccgtgcctaattgaacaccttggtcgccggcaacatgcatacaccagaagaaagagcaaagaggaaaaagaccatcaatcaatctgatttaataatcaatctaattagcaggaagaagattagatgcatatgccatagtcttgctccctgcttgaccctcgtcatgtgatgcacatgccgatcgatctgacgcgtggactatacagccgcatggatgtagatcgatcgaggtggtcggccggattgaattagaccaagcgacgtcgacggagatcatgcgccggcggctggttgctggcggtcacgcgtagctgctcgccgatccggaagtccaaacagcacacgaccgatcggcgcgatctctcgatctggcaggcgctcaacgctctgatgagacgcgccctccgtgcttcttgcggcggtgaatgacgcgcgtgtacgatccggtcatgttggtgattgattccaacgcactttaccgacgggaaactcgacgcacccctccctggcgcgccaactgtcgaaacaaattttcggcaatatgaaaagggggtagcgcacgagagctaaaagtggatggatgcagagacagggatctagacaggttcagaccctctcaatgagaggtaataccctactcctgtttggggatttgaatccaccgggtgtttattgatctgacaatcagattgtctcatgccccctagagggcctcctgcccaccttatataggatgagaggcaggattacaagataaaaattttaaccaacacggtatcaatttcctaaatctactttacaatattaccaaactaggactttacgccattctgtaatatacaaggaaatgtaatacccaagtcatgatctgttacatattccatatatataagttatcccctataactagtcggataataatgccgtgtgggtatggggtacccataatctccacacaaccagatcgccggccctcccgtccaagaagatttttcaggccaagaatcgtttccaaggtcctagatctcgtagctccaatccacaccgatggcagagcgaccaattctcatagtgattgcggtgttctgtagttgtgtatgtctaaccaagtaattggcctatctctttctttcttaggtgcgtgtccgcctctgcgcgtgcatggacgatctacttctcgcgcgtgtcactgccggccgacgagatcctcctcccgtgcaaagccggccggtgagatcctcccccatgtgcgccgcttcgctgacatgccaggagcgtcgcttctgcttccacgatgaagacgacaacacgccatgaccgccgcttccgctgctagttgcgaggggagagagaggaagatatgaaagaggaatggggaaggacagcagaggcggcgcgtggaagcgggcgcgcatgcgcacgcgatgccgacgttgcaggtggccaatctgctgttaccgtgggacgggctgtcgccggcggctcctggtgagggggggaggggggagaggtgaggaagaaagataagattaggatgacatgcgggtcctacttgctaattcaactagtcaactacccacgtcagctcaaaaccaccttccaaaccacttgaggagtctatttgcaacggttttcggagatgtgggaggtgttatatccgattttgcagttgagggatgcaattcgaccaagggcaagaaatgagggagccaaaatagacttattccttatgtatgtgggttatgggaattgattacgggcctctcaaacaaggcatctgagcatcggcataggtactaggccagctcggtacaaagaaaggcattttattagaccatcaacaaagttattagtctaaactgtacagcatttgagtaaatattattttttgagaactgcagttaagtaattagagaggaaaaaatagcaggattgttgtaataaatggaatcgtttcgcttattcgcggaataagcaaaacatcttatttacaaacgaaaagaaatatgtgaataaaatttttatatgcgtattcttagtgatctaaaagcaaaagtaaaggctgaaaaataaacttcgatgaaaaaaaccttaaaatcagcttcaaatttaaagttaaaaattcaaattttagctgataagtataaatataagcgaaaagatgagaccctaatatcttcgctctgttcgtattgagcaggaaattaatttggctacagcgttaccatagtgactacaagtctacaagtcatactaccttcctctcgtataacttgtaattctagtttgtttagcaaatattaaggtttaagaagaaagactataatgtgtcccttattaaatactccttccgtttcataatgtaagtcattctagcatttctcacatttatattgatgttaataaatctagatagaatacattgtgaaacggaggaagtagtgtatactatataagagtggaaaggtaatcgagggtaaaatagaaagaaatttaaatgagaagtgattaatgagactattagtactctattgtgataattattttgggacaaattcaaattctagaaatacaattattatgggacggaggtagtacattttatcaaaccgaggagaagaagagacatgactcaaatttcaaactgacgcaacactattctctaattcaaatttcagtatccgctactactggtggcgtccacttcaaaactgatactttccggcgagtcgctgagcaaacaccgcacctcgtcgagctcgacgacgtcctgcgtccatggatgctggtgcagcttccgcagtccgcccagcctctcggcgacctccttcatcgccggcctgtcgccgccgcacatctgcaggcactccagagccagcagcgtgatctcctccagcaactcaccgctcgcctcgctcttcacctgctcatccagtatcaaatcggctctgttctccctcatggcggccaagaacctcgccgacaagctccgcccctcatccggcccgtcgaggcagagcggcttcttgccggtgagcagctcgagcaggacaacgccgaagctgtacacgtcgctcttctccgtgagctggcatgtctgcatgtattctgggtcgaggtaaccgcacgtcccctgcaccatggtaaaaaaagacacgaatattaggaaatgacctaatattaaaaaaattaagtaattatttattcttttcatatcatttgatttattgttaaatatactttcatgtacacatatggttttacatatttcacaaaattttttgaataagacgaacggtcaaacatatgctaaaaagtcaacggtgtcaaatattttgaaacggagggagtaattagaaagggtgaggctttaaactcaggtcgtctaacccactaccttgtggagctagccggaaaacctctgggcatttctcacctgcaccatggtcatcatttgggcttcgtcagtgggagccaagatggaggcgccgaagtcggacaccttggccatgatgctctcgtcgaggaggatgttggaggacttgacatcgccatggaggatcggcggcgacgcgaaggagtgcaggtacgcgagtgactccgccgactcgtgggcgatccggagacgggaagcgaaggagatggcgccggcagatccgccatggatgagctggtacaaggtgccattggggacgtactcgtagaccaacatggggacgtcgacctcgaggcagcagccgagtagcttgacgatgttcttgtggttgacctgggagaggatcagcatctccttcccgaattccttcttgttcctctcgtccattagcttgcaccgcttgatggcgacaacgaggtcgtcggaggctgcagccacccagcccttgtacacggtgccgtggccgccgcggccgaggacgttgctctcgtcgaagccgttggtcgcctgctcgagctgctcctcggtgtatatggtgaacgcgttgctcttcctcgcgttcagctcctcgtacagaagcaggccgccatgtcgcttgaagtagctgcgcttgatgtcggcaagcgctcttcgctggtgtactaggtatgagctcaggaagctcatcacgatgatagcgatgccaccggtgacgcctgtttacgagggaaaaatatgatagtctaagagcaagtatatatcgagaagagaaataagaagagaagagtagcgggttacagatttatagtcagctgtatcacaaactacaagacacaatatgtttatgataggtgggaccacatattactaatgcgatatatatttattggtaactatgtgtatgagttggctattaaattgactatagatgatttaaagttagtggttggctatattattaaacttgctctaagttacgcttgaaatactttatatgtatatacatcatgtttgacttttttttgcgcttttcaaaatacaaatttgaccacaatatattctatattgaattaagcatataaaaattatcgaacttattaaagtccaggcgggcaaactggggcgtgcatatattagagtagatgatgacagggcaagctcaattgcatttgtgaaagtgcatgtagcctaatgggtacagtgacatgagtagcaccctaagattctgagtcaaatctctatgggagcaaatttttatttaagggctaagttttatattcgatagggtaaattcctaatttaaatgactgcatatattcggttgaatatagaggctgggtaaaaaatatacccttctctgaaaaaaaaatttgctcaattgcatttttgttacgtaccgatagctatgatcgctgagaccgggagccggtaagatcgtttaaatttcaggtccggcaaagatcgtttcaggtccggctcgcagatgagtactccactcttgttgctcttgtgctctccttctggacacgagcagttgtgtccgccgggaaaattactgcaaatcatcccgtccggacacccgtcatttccaggagcacatacgtcaatatctgcatataggatggcattggaaccagaccaaattaagagcttgtttggtttgtaggatttttaaaacataggaataaagaaaacatagaaatagtatagaaatgcatgtataaacttaaggattgaaaaacatagaaaatttttctatggttgtgtagcaaacaatccaaaggattgaaaacattgggttggagtggattatttttttcctttgttttccctaaaaaagtggagggataggaattttagtttggtgcattcctttgaaacgaatgacagtatagtgtccatttcaaaggattgcctattcctgtacttttcctttacaattcctttgaaacgaataagtcctaagcatatagaaaattttttgaaatccagatgacactatataatacagttagatgcatgttacgtgtgcattcatataagttcacagggatgaatacgtgcacatggtgagtgtttggtttccgttttctttgttccttaaaaaaggctgctatataacggaatccgttttcgaacgggatgatcccgagtaggtatcaggtgtgatacctatcaggtatcagacgattctacacatgttttaggtgacacttgcaaagtatcatgtgatacttatcaggtatcatgcgatttctaccacgtatcgtgtaatactcgcgaggtatcatgtgatacctgtcaggtatcagacgatttctaccacgtatcgtgtgatactcgtgaggtatcatgtcaggtataagatgatttatacttatatatcgcgtgatacttaagagttatcggatgatacttaccaggtatcaggtgattcctagtagatataattgtgcatcccgttgggggaggagcatcccgacgcgctgccggccacctgcagccctccccctgtagacgaggatggcgacggcgacggcaggggacgggcgcggcggcggcggcgagggacgacgacggtggcgggtgcgggcgtggcgacgactgtaggggacgggcgcggcggcggtgggggacggggacggcggcggcgggggacgggcgcggcggcgagggatgctgacggcggcggcagcggcggtaggggacaaggacagggatgggcgcgcgctgatggcttcggccgcgtcgcatgagtgagaatcgcatttgtggaggaggagtatcccattggggaacggtatcccgtcccctagcattcccgtaaaaaaaaattatagtacagttaaatgtacatgcaactcaggcttggtttagttcctaattttttttcccaaaaacatcacattgaatctttgaatcttgtatggagcattaaatataaattaaaaaaactaattatatagttaggggttaaatcgcgagacgaatcttttcaatctaattagtccataattagccataagtgctatagtaacacatatatgctaagggcatgtacaaaaggtagagttagatatgaactctacattatttagagactagcatcctacaacaattagagacaatatagtctctaataattaatgtatcaaaatactttttcttactcttctttcctttctttcaacaccatgcaacaaaatttgctctaataaatgctaagaatcgactctgagccgttgtcatgcataacaaccgtactcctttctctttcttccatgtcatcaaatttacttgcatggcaattgagagagaccactaataaacaccattgtacatgccctaatgacggattaattaggctcaaaagattcgtctcgcggtttccagacgagttatgaaattagttttttcattcgtatccgaaaaccccttccgacatccggtcaaacatccgatgtgacatccaaaaattttcttttcgtgaactaaacaggcttcagtaggactaaaagatatacttagtaccgattttcattattaaaataaaaaatcacgtgcaactccccacaaatcattctaaaaaaaaactctccacaaatccgggaactcaaatcagtggtattggagacggacggacgtacctgtgcatccgccggggaggtaggggttgcccttgtacccactcgtgcagttgcacacgtagccatcagccgtgccgacgcacgcgctgtggtcgctgacgcacgcgtaggtatctttcattcttgcttccttgcacttctcgctgcccgccgcgaagttgagcacgacggggaccgtgccgttcttgtttctgaaaaacttatcggttgtcgcgtagtccctctcgaagctgaagcttttagcctccatcaacacggcgtggctgcaccaggtgtaattgtccggcgaccagctgttattaaataataatggcccgctgaattcaagccggtaggatttgagtcccacggggatggccatctcgcagcatcccgcgccagagcagtagccgttcctgatgttgctcccgttgccgaagcatgtggacatgcagacgttcaggatcgggtcgactgacgcctcctctccggatagcaagacgagcacgttgcagccgacggtgacgaattggttgtcctcgtaggagaagcggtacggcagctccgtcacgtcgaggcccatccacgagctgttcttcaacggggcgccggttgggtcgttctcgtccttgcactgccaggagatgctgttggcaatccggatcttgccgtggagcaggttgatgtcgagcacggccaccacctgctaaaaagaacacgaatattagggaaagaccagtggcggagccaaaaattatataagactaagaataaggtagggctcgactaatggagttttagttttctgaaaaatttacatggtgaatcaacaaaatttaagcaagtttttggagacaggcctagggctcaagccttagctgctctaggcctgtctccgcccccgaaagacctaatatcaaatataattagaaggggtgaggcttcgaacccagatcgtccagcccactactttgtgaagctagccaaaatatccctaggtgtttctggcaccacttgctgccgatcggtgccgaggcgaagctgcggggtgtcgtggacgcactcgaggctgaaatcgtcggacagcgagcagtttggcccgatgccgaacgggtactcgatgtcgacgttgccgcacttcttcggacacagcggcgacggcggcggccgccgtgatgcggccgcgatcagaggctgcagggcgagcaaagctaggccaaggaagagcagcattggatgatgcttcgtcatccgtgcctggaggtggctgtcgtagcagatgctaatttttgagaggagaatgtataggcgtgttaaattcttgagaaacttgacatctatgctaagctagcttcatgcatgttatatagtacttgggcgaacccgatgacttgagtgttagaataattgggctaggcccaacttataatattaaatctcaaaggcccataataagtgttgaggataataataccacctcaggatttaagcgagaaatatctcaacctaaatagggagttattggaggctccctgttgaccagttgaggtaggggtcggaataccacacgcgcgcgccgggccgtgggccaaggcgagggccaaggcgtggatggcggcgggcgggcgttactatccttttgcaggcactaacccacgttcccacgattccctccgca

SEQ ID NO: 23721 - DNA, 2127 bp, Oryza sativa
aagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgtcatggagcagttctatgactacaagatggtcgatgaccgttctgtagtagaacaagctcatgagattcagatgctggctaaagaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtgcggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtatgggcattgggccaaggactgtcctgagcgcaaagacaggaagtctgccaacatggtcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtttctaaatatgggacttttgttggaaaaggttatgacagcggaggcttgttccgcttttctttgaatgacatgtgtaataatcataatgctgtgaaccatattagcgagaatgatgagtctaatgtgtggcattcgtgactctgtcatgtgaatttcggttgtatgacgcgcttagctaacatgagtttaattccaaaattcactttggtcaaaggttccaagtgccatacttgtgttcaatcgaaacaacctcgcaaggctcacaaggcgtctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgatgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaagtaacaccattcgaggaatgggaaaggaagaagttaaatctctcatacctatgaacatggggctgtttggccaaggtaaatgtacctatagccaaaaagcggaaacttggaccaaaaactgttgattgtgtgttttttggttatgctatccacagtgtgggttatagattcttaatagtaaactctggagtacccgacatgcatgctggtacaattcttgagtctagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatact

SEQ ID NO: 23722 - DNA, 688 bp, Oryza sativa
caactattcttgctagttttcatcaggacacacattgaatcttagtttggtggcaagccacaaatgacatggcctaacatttgcgtactgtcagttcaattactacaaacttgaaaaatggattaatctgatattctagaacaactttcatatagaaagttttcacacgaaacgcaccgttttacggtttgaaaagcgtgccatgagttccaaaagttaatccaacctaaggtaacttgatgtaacttgttattgcctacaatttgatgtaacttgttctttccataattcaggttcgcgagtatgtccctgatctcgcagaatcgatagctggcttaatcttatcatccaatgatcaagagttccaagatgagtgcatcgctcttctcggcctaggctcagatcaagatctcacagaaggggcggttagatcctgcatcggtgagaagatgaaccgtatcgtagagatgaatgacaccaaggagaacgtagagcacaacgcaccttatctgttcgagtgcgagaggttcgatgaagattatagcctactggatgaagacgacccagatgaggatatgattttcgatttctagcatttccaattgtctcgtagcactcctaatccagagatctcctatgctgtgagagagctttactttgaccagagaactttataaacactaacaaa

SEQ ID NO: 23723 - DNA, 1022 bp, Oryza sativa
agcagcgattaggagaggcctttgaggtgaagaatcttggaccttttcgatactttcttgggattgagggtgctcgatcatcaaaggggatagttctttttcaaagaaagtatgttcttgatttggtaacagaaaccggaatgcttggatgtcgtacaagtgctactcccattgataggaatcaccaattgagtgcacagtcaggtgatccagttgatagggaaacttatcagaggttggttggacgtttgatatatctatgccacacgagaccagatatctcttatgcggtgagtgtggttagtaggtatatgcatgatcctagaacaactcatctagaggtggttcataggatcttgaggtacttgaaaggaactcctggtaaggggttgtggtttagaaagaaccaacacttggatgtggaaggatattgtgatgctgattgggcaagcagtgtggatgatagaagatctacatcaggatattgtgtatttgtgggtggcaatgttgtctgttggcgaagcaagaagcaggcggtagtggctcgatctaccacggaagctgagtatagagccatggcattgagtttaagtgagatgttgtgggtgaagaatctattgttggagctacggttgttcagaaataatactgtggtgcttcattgtgacaacaaatctgctatcaacattgcaaacaatccagttcaacatgaccgcaccaaacatatcgaaattgataggttcttcatcaaagagaagatcgataatggggctcttagactacaatacattaaatcttctgagcagctagctgattgtttaaccaagggattaggtcctagtgagagtgagtcaatgtgtaacaagatgggcatgattgatatcttttgcccatcttgagggggagtgctgatgtaatatgcacttgtattggggaccttcttgcatatgtagctaagtgaaatagtgtgtgtgtgtggctgtgaacaacacaccagaaaaaatccccaaaactgaacttta

SEQ ID NO: 23724 - DNA, 19678 bp, Oryza sativa
  unsure (1)..(19678): unsure at all n locations
ttcctgcagcccaaaaggatcactgtgcatttataatcttgaaaatgcacagacaggggaggaagcaaaccttttaaacaaaaggcacttacacaagttagtattaatttggtctgatgattcttcacaagcagaacatgttcttgaaaatcttaaaccacatagcaatcttgcccatcatggttgggtgttaacttgtctaccaaaaacttgcaagctcttcgtttggatagcatacagtggaacaaatttccccctctaggtgagttgtggttggttaatgcgtccggtgaagaatccttgggttgtacaacaagtcagagctttcaaaaattaaaaaggttagagctgcttggcataccacagctagcaaaatgggttggaaatgatgcttcccatgtgttctccctgctagaggtgttcattataagagattgcccagaacttatggagttgccattttcacattcaacttgccctcgatcaggacaggagatgaacttgacccaattccctacactaagggagcttgaggttgtaaattgtccaaagctgtcatcatttcctcacattccttggacaagctctccatgtcgtgttcttattgatgaagtgggatcagattttcagcggttggattactcaaaaaataaccaatctgaattttgcttgaaagttgtgggaaaggatggccatctagatatgtcattctggaatgtattggcatttagtaatctaactgaactgaaagtgttgtatttgaagaaatgtcctcctttgccactgaaacatctcctagtgctatcatgtttgaggagtcccacgatacatgattcaagtaatgtcttgttgaatgttgaagctgagaacactgtcggctaccaatttcagattgagggtctcagtatcgatgactgtagctgtagcgggaaggaactgacgctgttgctgtctcttttccccaagctgtcaatgttttcattacaaggttgtgggaagataagagtgcttggtgtggcgaaggagcagacaatggcaatgtcagcattgtcgtcgtcaccttctggtcataagttggaggatgcacatataggacaggagcaggagcaggagcaactaagaggagaggatgagaaagcagcagctgatgcaggactgctgctcttgcctcaccaacttcaggatttgtacatagagaatatctcaaagctgatcctgcagtttgattctctcgtagatggcatggcaggaggcttaagaagcataggaggaggattacaaggcctgcacttcctaagaacactcactattcggggttgccccaatttcctctcctcctactactcgtcctcctcctcgtcttgcttcccatttccatcctccctgcaatatctgcatcttgatggtgtgggaggcatggagactctgcgcctctctcaaacctcagctctctcaccagattaaccatacggaaatgtatggattaaagaggtgaggacttgtcttctctcctcgcccatggccaactcacaaacctgaacatcttcgagacccccaaattcttcgtcgggtgtggctctgactccttgcngctgcagtgcctncaaacagatgacatcacaaaggtccttgccgcgcccatctgcagcctccttgcttcctcactcaccagcctaaccattatttggaacgacgaagtggagcgcttcacaaaggaacaaaccgcgggacttttgctcctctcctccctccaggaccttgaattttggtactgctcggagctgcaatccctctccactgggttacacagactcaccagcctcaagagattaaagatttggtcctgtccacccatccgttcgttgcccaagggcggccttccgagttcactggaagtattagatgtccgttctagcaccaacgaggagctcaaaaggcagtgccgcgacctgagaggaaccattccgatcatcaaagacagacgatactactaatccaaggtaatggtaacaaaacacacccttgtttgacatgacacatccccagttcacattctgtttggcacaccactgctattgtttaattcatctatctgaccaacctgcttgttctgatctactgtgcaggcctccttttggattaggacatgccttaccttcacagttgtttccatgcacaatataagttaataaatgacttgtgcctcttccaccgtgtgtattattacacaaaaactgcttggtgaaagcatacaagttcatctctgcagctgattgtttggtcagtcaacttttcctatttatcatatctttcagcggttccgggttttaatggaactattaactttgagaaaactgttgtgtttcactgaaattttccttgtgtcagttcttatcgttgaatttggcactcttagactcgatatgtaaagtacctttctgattaactgaaatttataccctgttttggcctagttcagttaaccgaaatttatacgttgcgttggcctagttcagttaaaatatgttatcagcgtgctatactaatttttcttcttcttcagttcatcaaggtagtgcaatgtattcatatagtcagttaatacttgtcggtagaaacagacattcttcttgaactatatgaagtacaatcttcattatttccctcagcttctgacagcaaacagcttccacttgtttatcagcaggaggtacttaacaatgtcaacaatttcaaaagtatggtggcttcacctggagagttctctcctgctcaattgcctgcagttggtgtggcctgcaattccatgacaaatgagtcaaggaggctgatgtttacaaaggacattttccacaacttgtaagcttgcagtttgtaacatatgtacttctgttatttcactagcaaataatgcatatgtggccgtcagtagttgtgcataacttgcttgaattgacttgtcacttgtggctacctcaatatgctgtaaaagagctcacttcaatcatatatatgttcatttttgcagatctctagctgatactgtatttttttccctctgtttctagagaaaggaaggagtggatgaactgaacatgcagctctggtagaagttcacaacctttcttccttgtaaccacagctgcaagtctcaggtctgcaacagcaggtcgcatgcccctgtttgttctagtgcttgcagttatttaatcagctccattacaatcacatgctcttactccatggaaactattaaagtaatagcatgcttagttggagaggatcaaagaggactggaagagtatcaagcaagggcaaatctacaggtcatcagtgacctgtacgcatacagattgcctaatcctttgatccttatctggggttatctccggtgcatctcgagctggaacacgccacttgctataacaaatacgcagatatgtatatagcgcgcgaaggtgctctgaacccaagtttacccaatgaacagcgtcaacggagcagccgtcagaatcaggataactcgaaggaggaggttgatttggttgatttggttgatttggtccctcgacttttaatcaatgcttactttagtccctcagttttcagaagagtctgtttgtgtgtaattggatcaaatttatccttctgtttgtgtggcgtgatgagggaatttatatggctcgtctctaaatctattttttttactcgtttctaaacctaaattttttgaccatcccattctcattggcatggtaaggatttgaccatcccattatcattttagtaaattttaaagtagatctagccgtgtaaatgcgcatgccaccctattggttagtattgtcaagccatgagtagtaccgcaacattagcttgccaagtgaccattatgccttcatgctatagaaaaaaaaatgaagcgggccaaggtgcactgaactgaatgaacaggattgcactgtcacagagctgccatttaaaaaaaaagatgatgagctataaaaaagtaaatgaagcaacaaaattaatttatgggtaaaaacattatattgttcggggtttataacccaatgatgaaaattagtaggctacgataaaatgacaaaatcagatctaagattaagtttcaaattttaaattttggatactgcttgagcatcaccaacagattatctataatctccccctaaaaaattgtttttggtttcctaaactgaaaataggaagtgaaaaaactccaacatatagcctaaattcaatccccaaaacttaaaagtggactcttctgttaaactatcaacagaaaatttcgtttttttctttcacgcgcagaaagatcgctatctcccatgcacgggaacaggaggagaggggcgggagtgcgaaattggaagcacaactttcgcgtccgcatataaacggagcgagaaatcggaagaagggaactctaaaactttggtaatagagtaggagatctgttagagctgttttttggactaaaatctattaaattagttttgggaatcagataagtagtctgttggtgatgctcttaagtcaacaatcaaacgacgaaattcagataattacaaggagaaaagggttactgatcagtttttttttaaaaaaaaaagaagaaaaactacagatcagcttggtcccctgactttaatcaacgatcgggttcgtctggtggagaattcaaaaaaaaaaaagcctgagcaaatttaactatattaagtatttaccataaaaacacaccgaaatacttttgtgcggctactaatgaactcgggctgtttggttaaagagctagtactccctccatcctaaaatgcttgacaccgttgacttttttaaaaatgtttgactgttcgtcttattcaaaaaatttaagtaattattagtttttatcctatcatttgatttattgttaaatatacttttattatacatatagttttatacatttcacaaaagtttttgaataagacgaacatttaaatatgtttaaaaaagtcaacagcgtcaaacatttaggaaaggtgggagtacttagtttggtttctcgaattgattttttaattggtgtgacttgatgagaagcagattgggtatggacgtgtatggataagaagcaatgttctctttctccatctctcagtggtacttataaatagcatttcttgtaaccagttaataaaatccaatcttaaatatttcacagaaaacccacagaaacaagtcgagaaacaacctgggagatatcttatttttatgttttgaacatctacatagtctcaaaacaaatattcgatcattaatgtttataataatttgtgaacaaaaattattgaagataactactccagtgcttacggccagtttggcaagagaagggaagaggaatgggagtttcaaggagggagttaatggtgggattggtcatgggagttacatttttagtcctcatcccttgtttggtttcacattgaattccctccaagtctcacgaattaacatgcctctcccaggtaagagattggtgggaattcgacattttaattccccatcattccccatcctaaaccccctcgaattctcaagtcttccaaccaaactacagacttaaactcccagatatcataaactcccattccccatcaccaactccctccaaccaaacaggccgttaatgaatccattttttttcaaacggtttggttgttgccaatgttttatataaagaagacatcccatttttttaaaaaaaaaggaaaccaaaccatacaacgcacaattaattaggggaaactggacgaaaaccaccactacaaccacataatgaatctattaagaatattttgacatactacaccttaacatttaatttacatactaataattagaaatgtcaagtttcactacattctataagcctcatctatttaacaatcgacaaaatatctggacgaccaaaatatctgaaacaaaagggcaaaaagcgaagaagttcatgaaccaaattggcccttttaggaccaaagtgagacgagtaagaaagttggaggaccaaattgctcatcatcccgtccaaaatcagctgcccgcgccgacgacctgttcgacgttttaccaccagcgcccacgggattttcaccgtgtcacgccgcgcgttcgcgtgccttcccgttcgcaccacccgcctctctccctctcagtcccatgctgcgaccgcacccaaaactagtagccgtctctgaccgccgcgcctgcggcatcccacaaatacacgggccgcgccgcacgtcggaacggcgcgacatggccattgttaagccgcgacctcgcctcgcgtttcttgcaatcccaacaagcaaaccgtctcatcttcttcttcctcctcctctgatcttctcctccttgtcatgcgatcgagctttgctctgctctggcaatggcgatgaacaagctagtcggcgccgcggtgaggcggcctgggtgggccgacctcccgcgggacctcctcgagtccgtgctcggccgcctccccgtgccggaccgcctccgcttccccgcgtgtgcacggcgtggcagtcggctgatgcggcctccgccaccgcacggtttcgcgccgcgcagccgccgtggctcatgctcccgttcaacccgacggcgcgcaggcagagcccgagcggcggcggcggtggggatggtaggttcttggaggcgaggttcttgagcctctccgatggcagggcgtacgccatcccgcagccggcgccgccggtgtctgagcggctatgtgttggctcgtccgacgggtggctcgtcaccgccgacgccgcctccgagctccacctcctgaacccgctcaccggcgcgcaggtccagctaccctcggtcaccacgctgcccttcgtcgacgccagccgcgacgccgacggccgtgtcgcgagctaccacctccgctggttgtttggggatgggaaacaccaacgggacgaggggctcgtcccccccgaactttcccccccgacaggcttaggtacgatctctacgagaaggccatcctcggtgcaccgccgcggaggcatacaacgccgccggggtcttggggcggctactccgtgctgttcatctgccagccactgtaccgtctcgccattgccagagcaggggacacgaagtggactctcctcgacatgccatcacgatgctgggtttacgccgtgcgcgccgcctccgcccccgccgccgacgggcaccaagcggtgtacacgctggactccgtgggtcgcgtcgaggcatgggacatggacgtcacggcggcgggcacgacgccgccgccgcccagggagatcgcgccgccgtgctgctgctccggccgcgcgtgctccatgtcgatcccctgcagcaaatacctcgtcgagctctcgccgggacacctgctccaggtgcaccggctcagggacaaggcgcacgcgcggtccaagtgggagccccggcaagaacgcgtcgagtacaccaccgtcaaggccgagctcttcgagtggaacgccgccggcggcggccatggcgagtgggcgcgggtggacggcgccggcgccggcatcctcgccgggcgcgcgctgttcttgggcaagagcgcgtcgctgtgcgtcccggcggattgctgcccggaggtgaagggcaactgcgtctacttcaccgacgacgggccatggtcgcacgagaggtgccacgaggtggttcccgacgtcggcgtgctcgacctcgccgacgggagctacaaggtgccacgcggcgccgtgcgcgacctgctctggaagtggccgccgccggtgtgggtcttcccttcctgcaccaactgacgaacgccaatccgtcagtctgaattctgaaatgttcagagttttttcctttttttcagacaaagttcagatatcttcatttcttcagcatctgcagctcaactttttgttgacctgcttgctgcttgtaaaaagtttttttagcttccgaatgcgtgggtgaggtcaacgtcttgttgacctgtttgcaataagttgtaaaaatggatgtgcttgtcagtgtgagaacgaggtcaatctctggttgacctcttgtaacaacaaattgctagttgtggccaagacaggttgccctgtcaggatcacaatgtactaatctggttcattattcaagataccagtgccatctgtgagttttaatgtgcaaaacagatcaaatttcgtagaaactgaaaaaatattcagtgatagtattggtgaaactcacaatattcatgcaaagaagggattttattttgggaataagatcactttgactccatcaactgactaccgaatctaaatcgtatacctcaaccgcaataccagaaatattgacccccgaacttgcaaaaccggtgcaatttgactcccttgatggttttggatggcggtttcgctgatgtggcgcacacgtggcagtgttgacttggtctttgttccacgtggcattgacgtggcgcttatgtgacattaaaataaaaaaatatatgcgggacccatttgtcattcacacaaaaaaaatttgtgggacccactgacatgtggatcccataggtcaccctctcctatctcttcttcctcctccccctcctcccttctctatctctccctctttctcttcgtgcgtggggagcggcagcggcgggcaatggacggagcggcagccgacggtcttcgcgccgcctccgccgccgacggcgccgccgcagtagcaaggattcaacttcggcaggtccgggactggaacggcgctggcgccacgggagatggggatggtggcggggcgagggcatggcggcgagggcacaacagcgatgagcaagatgattccggcgacaatggcgcggggcggccgtggtggggaaggagcgagccgggcacggtggcacgaaagaatgtgcgcggcggaggacaccgagcgcaccgtggaggacgtggaggagcgcaagaacctgccgccccggcggccaccgagccccctactcctgctgccaacttcccgagcctccgcgaggccgccgcgggcacggctggcggcaagtccaagaggaagaaggggcggtctcgcggcngacgtggtcngggagggggcccgtgtcngaggaagaggagctccagtcgctgttccgcatcatggccaggtcgacgccggagcgctcgaggccagtccgccgccgcgcgttggggcgtgcaagctattgctccaaggtccaccgcccaccacagccaccactccgggcacccactcgctgatgccgccaccgagcccccgcctgccatcggctcttgtcaaggggagagagagagagagataagggagagaggaggaaagaaggatagtgagagagaagatgacatgtcccacaatttttttttgtgtgaatgataaatgggccccgcatatatttttttattttaatgccacataaacgccacgtcaaatgccacgtggaacaaagatcaggtcaacactgccacgtgtgcaccacgtcagcgaaaccgccatccaaaaccaccaagggagtaaaattacaccggttttacaagttcaggggataagatttctggtattgcgcttgagggatacgatttagattcgttggtcagttgagggagtcaaagtgatcttattcctttattttgcaagcattggaaaggcccggatcccaaattcatggcccgccgtgataaaccttgctaggcctcattgagccactttagaaaatgaggcccataaattgacagcccaacataaatgggccgcaagtaagaggaaagcccagcgcacgtaggacctcaatctagttcttgggcttcacaaaatcgtaatcccgttacgaccgtctaaccaacatgggccgcaagtaagaatgtacttgtatgtatacgcgtacacatcatcatcacatgtaagtacatcctccctccgtattttaatgtacgacaccgtttactttttagccaatgtttaatcattcgtcttattcaaaatttttgtgcaaatataaaaatatttatgttatacttaaagaacatttgatgataaatcaagtcataataaaatattactcggtctcaaaatataagtatttttagagttggacatggttattaagaaagtaggtagaagtgaatgataaatggttgtgattggttaagtaatggaggtaggtgggaaagtgaatggtggaggggtgtgattggttggaaagagaatgttagtggagaagttatattttgggacaaatcttgagggctaaaagttgttatattttgggacggatggagtaaatgataattacatttttttgaataagacaaatggctaaacgttggtcaaaaagtaaacggcgtcatacattaaaatacggaaggaatacttgtttgtaatcgtatctctaacacatcctcaataggcacatcaatatgtaatccataaattttgagaacatttgtttaaaaaaaaggcctgttcactttgatgtcattttcaaccttaccaattttggtaaagttaccataaaagtggctacatttagtttgttgctgaattttggtaattatataagaaatcctaccaaaatattggcaagttgctaagggcctgtttactttgatgccattttcaacattaccaaattttgataaagctgtaaaaaaagtggctgcatttagtttgctgtcaaattttggtaaccatataaaaaatcctgcctatgccaaaattttggtaatgccaaattttggtaatgctaaaatttggtaatgtttttttacatcaaagtgaacagacctaaaattgagaacctgctgtgtgtaatcatatatcatgattttttaacctttatgataaaggtgctttccccttatgattgactttgtttattcacacatggaaagttgtcgaacgtgattatgaaacgaccaacgcagacgcagtcttcgatttgattaactccgttttttgtagccttgtgatcgactgattgttaatcccacgacaaatcggtttggtacgctggatcgctggccaatttgtacgagatagcccccacaaaacacatgctgcccagggcattggtgctgggagttcatggctgtctgatcgagcaacatcttatattcccaattcctccaagtcgctagcaatgttgcttttgcttcaattcatcaagcaaggcccattctgtagccagctctagcaaatttgcatcagaagcaacagttttattttcagtgcgactacatagttaagtatttaacaaggacatgtcaattaacaaaaggagaaatagaggcagagcagagagtagatgaaagcaaagatccaaggcaaatggtccatccatttgggacttatataaagaagccattcacctgccacagagatggacacttgaaagcaacccttttcatcgtagcaacgacgacagtaagctccgctgtctctctcagttctttttctgaatccctgaaacagatggtggtagtacatcgctacaggttaataaaacggtgcaagaactgaacgagtgatccaaaattccaaatgcaggcataggttcagtgtattattttgtcgttggaaaatgttggttctcgatttggtgagattggattggagaacatgaattggcattgcttgtcgagtgattggtcaagtggttgcatatatacaggtttgttcttgcgttcaggttgatgagaatgaccgagcaactaattgggtggataaatgggttccttttctccctcaagtttcatgtgtccactactatgcagttaagcttgtaggtttgtacaagctaagctctatgcctgattactagtacatgatttatgatcaatttagcaaattaacatcatggttgaaagaaggagtcaactttaatttaatccagcccccggttgtgttggattccggcgtttgaaagccaatgcgaaacgggaaaaacacgtgagcgcgcgtgcattgacaccgcagcatcctgacaaaaattcagttgagatttgaggatgaacatgcctgagacacgagtgttcctctcgctgcccggcgccgccgcgagcaactctgaattaatcaggcaccatctgctgtacatttttatgccatttattccacactgctgtacgtgtcgctgcagcttggtacgtgtacttggtaggctcaaacgtttggtagatctgtgaatctgttgtgatcaccattctgtagccaacgccaacgccaacgccaacgcgtgaatgaaccaacctacctctcgtcatgaagcacgaggcaggcgaccgtttcttcaccaacatcacatataatcgacgcaaagaaaaacaccgggttgacggaaggagcgtcccaaaaaaaaaattgaaaagtgaacgaagcttaactggtttgatttttttgttgaaccacgtacccatcaacaacaaagcgttgttgcgtttgcgctgcctccaaacattttttaagaaaaaaaattatgaacgtgttaggggtagaggttaaacattgtacctcagccttgaaaccatacaccctttatcactgcagtacatctgtgaataagcgatcttatctgcctcggccaatcgacggcgagcgatcggcgatcgggttgttgttggtggtgcactggtgcgctagctgggccactgctttgtctactcgtccccacccctgtagctgtagctgcctgctctgctttgccgtttgcactgtgcagcagctgctgctgcttgtgcttgtagtgagtggttgcgccgttgcgagctccgacccaccacacgacgccaccaacctctggttgccatcgcctcgccatcatccactcgacgcgacgccaccccgaccccgcctttaatactactaacctctctctgctgctcacgcccgatcgtttttgcttccttcagatccaaaccaaaccaccacctgcggcgcgcgccgcccgcggcgagagcccggcgccgatgaaacaccatcatgtggcgcgggggcgcgccgagccgcggcggatgggcaacggccccatggtcatcaccatgctcctctccctctgcgtcctcacctacatcaaggctcgctactgctccacccccttccgtacgcttcttcctcctcctcctcctcctcctcctcctcctccttgttcttgatcgattcatggagtgatgagctttgattgattcatggagtgatgagctgtgagtaattgtggttgcagccaaggcggcggaggagatggaggtggtggagatcgacgaggattacgacagcacgaggtacaagatgacggggccgataggggaggaggacttcgacccgaccaggccgacgtgctacgtcacgagcaagcggtcggagcggtgcgccgccgtgggcgacatccgcgtcgacggcaaccactccaagatctacatcaacccgctcgacaaggagtggagaaccaagccgtacgcgcgcctccacgacgccgtcgccatggacgacgtgcgggagttcacgctcgtccccttcggcggcgccaaccacaccgccgtgccgccgctctgcacgcgcaaccactccgtcccggcgttcctcttctccagcggcggcttcgccggcaacctgtaccatgactacaccgacgtgctcgtcccgctcttcaccagcaccaaccacttcggcggcgaggtgcagttcttgctcagcgggatcaaggattggtggctcgacaagttcacgccgctgttccggcagctctcccggtacgacgtcatcgacgtcgacaacgaccaggaggtgcactgcttcccgcggatcttcatcggcgccacgttccaccgcgccatgggcatcgacccggcgcgctccccgggcggcgtcaccgtcgccgacttcaagcgcctcctccgccgcaccttccgcctggagcgcgccgtcgcgtcgcgcacgggcgcgccgcggcgcgacaagccgcgcctcctcatcatctcccgcaagagctcgcgccgcttcctcaacgagcgcgccatggcgcacgccgccgcgctcgccaggttcgacgtgcgcatcgccgagccggacaaccacaccgacatgcccaacttcgcgcgcctcgtcaactccgccgacgtgatgatgggcgtccatggcgccggcctcaccaacatggtgttcctccccagccgcgccgtgctcatccaggtggtgccattcggggggctcgaatggctcacccgtgtcaccttcaaggatccagccaaggacatggatgtcaactacatggagtacaatgtctccttcgacgagagctcgctgagagagctctacccgagagaccatttctacatccagcatccatacgatgtgcacaagaaaggctgggacgccatcaagacggtgtacctggacaagcagaatgtggagctcaacctcaccaagctcaccaacacgctggaacgggcgcgcgacttcttgccagagccctgacaccatggctggggatcttgatgatgctgatggtagataggagagctcttctgtttttgattcgctttttttctccttcttcttcttgtggtgagattcatttctttcattgttttttgataaaaaggaggagacgagtaagatcgtgtcatagacaagtgtccaaaggttaatttacacttgcacactttgtaaattggttgttgtcgataaaatgtcaacatgaaaaatgctaattatttgtttgtggggagtgatgaacaattcacttttgccaccaccaatagtgttcttccaagatcttggcagtctttaattctgacaacctgccaagcaaatggtgatgatcaataatatgagatgacgatcaatagtatgtaaatctgaatagtccgagcaattttgtaaaacaaggcaatgttcaacttatatcgagaaaagaatgagcaaaaaaacaaatttcagctataccaatctggcctttctgaaacaaaaaagaaatggttaaccatgccccccttgttctcaatcaagaacatagttttcagatatgcattcagtcggaagtctgacattaccttaaaagtacctagagactagtctctttaagcacccactgacattatgtcgttagttgtagctcatagggtaaactgaaacactacctgtacagacaacgaaatattcagagttcatctgagaagccagtttgcaagagctttaaggtaagcactgccaaacaagaccaccacagaaaaggtcttaaaagaatccatgaacccaggtacccaacaagctgcagtggttgttgaactgtttcccacaagaaaaagactgcacgacaagacagtaaaacaacttgaaggagccgtttccctctcatttcctcattactgaaccgacccagagatataatcagtagaaatgtgatcattagatgccatcaatcatatgtggaaaacgcccaaataaccgacaatcgtggccttaatcatagaactttgcctatttacacattctcatttttttcgttattcagaaatgatcagtggtatctttcagataagagacgattagtaggtgtagtattgggatttggaaacagctcagcttccacgataatctccactttggaggagctaccaaatttctgttgcttcctcgcctttcacggtgggatcattgagctgccgaaaccagaaagaaagcactccagaatcatctcctgtaagcaaagtactatctgctttgtggctgatagctgtgtctcaccagctcaagggtgaccgtgtgttgcatttcatggttactgacagaaggacagcaaaatgcttgtctatgcagttaaaaccagctgagtttcgtctactacttatgtagaagagaacggcacctagcttggttggcagggagagctcggctgacagggagcagcatgcttgcctgagttcgaatccctttgatcacaggttttctcattattttcttctctaacaacaacagatgctaaattcctcaacagatgctaagttcctccttagtactccaaacatatgctcaacatagataatgctttatctgtctcctttctagtgggtttcaactttcaaaggtggaacttcattgttttacatttgcaaaagcctcatttgtctctgatcatatgtaaaggagtctttccagggaaatgttactgtacaatagaaatgcagtctttgaaaattctgcactgagatgaaggttctgtggtcagaaatctgtctctgcttttgccaggttcatcagacctttgacctcacagacctaattggcagaggaaatgtagcttttggatgccatcaataagggtggtttgtgcacgttcttctgataaatgcattcttaattggccttgtatattaagctagccaagcagggaagcaattatgatatgcgtccagaagctctgactcaggtcaggtgctgctttatctaaagctttacgtgccgaagacttctggtccaacaatacagggacacatgtatgataaatgataacatctgaggatgctgagtggcggaaagtgagtgaaaaacaagatggagccaggaattttaaccccgaaatatcatattagagcagctatatatatatatatatatgtatatagtactccaaagaaaaatgaagacagaggcgatagagaataagcaagaacagtgataaatcataaactaagaccaagacccaggatgatgatctaagtaccattgtgcctatagaaacaccactacagcaccagctaacgtaaaagcatgtgttttaaagaacaatttttgaatgggaagaccagagaggaagttccagaatctctgcagacttttttgtgctgtgccatctaccaggagacatagggaagaacgggtgggttattattatccatgagttgtaaaaccagaactgtttgttttaacataagagggcgtgccttaattttcaaggatgttgacaaattataacggtgtggtttatgctgtattttcttcatgaaccttgtttttaggaatgcacaaaagctttccatgtctttgcattaaaaggaggaaattcctgaactttgtttctttttcgcattatacatctactataactgacagaggagtagcaacaactaaagcatgtaggaatgtaatatggtactcgtcgactctcagatcgaagctagactagcttggtaccttcctcaggaaaagaacatcgaattaggtaggccagtgtctcataatagtaatttaatgattactcctctttgtcttcaaaagattaacaatagcaatctgatctggtatggagggggaaataaaaataaatttgcagtaccctgccctagttatgctttggtgacttcaatttcagtttctgatggtttagtttcatctactccaataattccacttgggcactaattgtagaaaaatgttggaaaaagcttttcaaacacggaaatagaattgtgttggaaaagatggttaggagttacctttatcgtggtggcagggcgaattatgcagaatttcattcacagcactccatatcaagtatacgaaagaaaagaagtcacatgcccaatcagtatcaattattgaatgtacagctgtcaagtttcaaattatctacagtatcaattactctatatataggactatggaatcaataactgcttttgtggtggtataatcatgactcaaaactggtgaaatccatgttcaggccaatgtgatttttccatttgaatcctgaactttaggccgggccttttcagcctataaagaaaacaaaaataaacgcatcaggacaagttagttatagacaacatagtaagacaaagactgctagcatatcatgtcatctcagcacagcaggaaggactggtgaggtaaggctcaacaggtatgccacgcagactcaatcaaaccagacttccatgtcataccaaaccagttagaaggaaacgattgatatgcatttctccatgcaaattaatttcagaggaaagaataattgcaagttagtttcttgtgacaaagcagaaaaccagcaattcatagatatcagttatgcatccccttccccaatccccactgaggcactgagaagcattcaccaggtgtaaagtcctgtgctgcttcagcaattttgtggaggtcaatgtagccagtggcgaagccaccgtaggggccagggagggccaacacccccctaacccctatgtgacctcccctcccctctcttctcccaaggatgattagcacttataatctagctattaattatatcattagttacagatgagactaactatataggatataagacaactgacttatgaaatgacttagctaactgatttatcattttagaagtgattgcaagactccaattaatggaacaaactgttcaatcatccatatattaaaaatattactgaattttaaattggcgaatcatgatatatgggttcttgttctctcttgtagctaatcgctgtaacatgtatgatatcgagttaccgatcatgcatcaacactacaaaatcactgttcattgaaccttaagtgaattaccatgtctcgtagatggcaccccccatctctaaatcctggctttgccactgaacgtagctactgcccaatctcaatttttcatactactggaacagtgcatgtccttctgttcctagttcctactgggctagagggagatcttgtgccttcgatttttttttttaaaaaagggaaaaaataagcatcaattctttgactgtaaaggttataagtttaagggtgtacctcttcattccagcttgtacgaagcagcatgacaaccagcgctaaaatttgcactgtcatggcgcatattattcccaaccaaagtccctgcacagaaaaccaactcagagtgggattacgacagaacttgcacaacaatgtcatgccagaattgcatataaaaaataaaatttaccttaccatcgatcttcagaacaaatgcaaaagtaacagctgaagggataccaattgtatagtaagcgcacaggttgataacagaacagactttttgccagccacaccctctagcagcaccttaagagtcataaaaaaaataaacaaatggtgactaagatcaataatattgaggtttgttggcatcatggttactatggatgtgatataataaaggcaacataaaatatttgaccaaggttaaaaaaaactaaattatgtagaaatatcatgaacaataacaagtctaaaatatcaaaagattacatcaccccccagaaaatggcatatgaactagcactctttgttctttaaaaaaaaaaacagaacaaaaaaaaactagcactccaatggtattaagataggagaagccacatatttttccatcccttcatttaatccagtggaatatgagcaggtcaaggggtcgaacctgggtctgctgggtgaaagcaatcaacccataccaaccgagctaagcacagttctctacacagtacttatatggtcagccttctttaacacaagcattgctggtagcttgcatagtaaaactcctacataatacttacattaccat

SEQ ID NO: 23725 - DNA, 11796 bp, Oryza sativa
taaccccagatatcccgtaccaaaactgtgatgatagctacaagtatgccttcggttaggcacatgattcctgaaacaaagactgataggcgtgctgcttgcggattcctagcacctagttcgttggaaactcttatactgcaaagagacatgagccatgggccaaaattagataagctttgaggtgtcaaatctcataaaatgaaaggaaaagtcatcccaaatttctgctctgctgaccttattgcactgctgaggccacttggaattgtataaaccatccacattgtattcaggctggaaacaaaccattcattacttcacattatcaagtgtctgaaagcataatccattgaacatgctaagttgctagctgtgtatttcatggttatcacagaaaatttaaaaagcaaatgcatgtaataccatgaatttgaaatgtacagcctattatttatgttttggaacaactttggaactaaactcatttgctagaaactatactgaaaggaatgcagacattctgtttgctcaccttattgacaaaatcgaagtttccagtttcggattaggtagaaagcctgcaaggagaaccaccatctcaaatgcccaatactccaagctgagttatgtcacaagtcaaataattatttccatgcagaaagaacaaggtatttcatgtaacttatctgttaaatcataaaaagagagtatctattgttgaacagggttgctccatgtcaggctgcttaccaagtcataaaagtagatggaatggctagccttagatacatattaacatcctttaacttaagtgcctcccttgaccatccaggccaactccttctgccaacttcggagacttttacatatattgctagcaatatcacattgaaccagtaagataatgatattgacaaagctgcacctctgttgccaaggtcaaaacaatgaaccataacccagcacagcaaaatgtgaattaccaaggtggccccagaacaaactaccagtggatggacaatgttttgagtttgcagaaacttggtaaggcactgaagcaaaccgtatgcaaaaagaccaggaatcacccacacggcatatagtccagcttcagatgatatctcaggatttttgaccaagagcgataagaatttggccagcgaatgccaaaacaaaagccagcgggacacccataagcataagaacaaagatagccctttgcgcatgtgtcccaagcatatcatattgttttgctccatatgattgtccacagaatgtatccagcgcgcttcccattcccagcttgtcatggaataaacagatatgcagttttcattgaaattttcttgcaagtaaaagatcaggcatcatatagtagaacaaaggagaatccatacatattctttaagaaaaacaaacgagattccatacattttataaagaaatgccagtcaccataattccataagcacaatacaactacaagcatatacaaggcctctttagatcattggatggattgtatttttgtagaacttgaactaatttttggatatgatgtcctaccataaagcaaacgcgccgtactttgtactgattttcacttcccaaatttttttgccgaacaaaggagtaactattcatactaaaagaatttaccaacccgaagttaaagtatatgtaattatggtttaagtgttaccaggacgctgaagccggtgacgttggcgaaggaggaggcgacggaggcgccggagagggagagctcgccgagatgtccggcgaacatgacggagaccacctgcaagctgtactgcagaaggctacacgccaccagcggcgccgcgagccccacctgcctccgcacctccgcccccaccgccggctgagggtcgtgggggacgaggagaggggccgcctccgccgccgcctcgacctcgccgccgccgccgctcatttcgccgctgctccgcgccctcgaattccgatggtggctgggtttgactcgtggaggcgatggccatggccggagcagtttcctctcggagtcgcatcgtacgggccgttgactacagcgcatacatggcccgacccacttcggcctcgtctggtagggcccaaattatggcccatatctgaggaaagcccgtaaattggcaccgttttcccggcccatcatggatgggacttatttgggcgaaaatctcaaatgaggccttactatatatgggccttggcctccaaagctagggcctgtttgggggagcttctagctgcagtagagatgcaagtgggtagtcccactacccgtataaaaacccgcttgttaatttatttttcacatggtagtacaaattttagaagaaaaataaactagaagtgagataaactggataaaaaacctgcttgcatccctagctacagcttctcctagaatcaggatcagaaactcctcaaacagcttttggtctaaaaaagaactagaagccagaagttaggaaactcagcttttctagattcttataagttggctaacaaccagctgcttctcagaatcttaagcttcccaaacagtccataagcttcacactacagttttctaactttactctcattttcgatgcgcacttttaaattgtgtgttttttaaataattttacagaaaaattattttaaaaattatattaatttattttttattaatacttaattaatcatatgttaatccgttgctctgtttttaagcgtcgggaaagggttcccagccccaaacaacacagccaaaccctgcctcgggctattaattaactcaggtcttctcttcctctctctgaaaaaaaaactcagagcaagtagcaagagttcttgataagttaaacacaggaatctcgtacggatggatagaaataatgccttatccatctggattagcaggaaaaattgaattaaaatcatccaaagagataagaaattttctaatccaaacaagtgtattggtccagccctccagctggtttgatatacgtttcatgaatttggacgggattgtatgggctaactaaaatcatccaaagagataagaaattgttttaatccaaacaagtgtaatggtccagcactccagctggtcgatatatgtttgatgaatttggacgggattgtatggactgttatagttcagatagtgcttcgaaaagaattcagggttaagtaagaagaacttcagagaggtgtcagcaaatttggatggaaaggattaaagaaacgtgtaatcgccccactgcatattgatttcctaagtacatcactgcagaatctctgtggacatggatagcaacgttttcactgtcatctggtaagcaggcaaggtcagacatggtggcaactgacgagtgtcaattgggcaaatatgaaattgcagctaactgactctaatcatagtcaatcatcctattttaaggattggtcaaccatcctaagataaatgtatgatccatacatcagaaccaacgtggatcagaattaaagaaaattccccatgctattcgcgagatgatctcgcgctgtgtacatgttagctagatgctcatttgttcatggatcctggcgtttacttcttgatccttgtatattgctcatgccagagtgttaatccaggatatccagcttgcagtttttattggtgtctgcaattgttttcttttgtcatgaccagacagcaaaagacgcagttttgagtcattgtatatgcagaagcacaggatgcaaaagcctcagccattatgattatgcaaaatgcaggattagcaagtgtttcacttatgaacaaataatctcccactttatataaagtgcacaaagttcatccaaaatataaatacatataaagtacaaacttgcaatctgagcaatctcccctaccatttcgttgcgtttgctccgcgattcccttaccccccatgtgctcctgtgctatcaaacaattcccttttgctagagcagaatcatgaaatgccaaactgatagatctgaggggtacttatcacgctttttattctttttcagatgtagccttgcagtgtaacggatctggcctctgaactcatcccgggttttcaagtgcaaaacaccattagatggcacatgtcacacattgacttcacaaattatatcgggcagatttgccacttgagattaaaacagtcgaaatcgccaccacaaactggagttttcttgaaatcttgcttctgaattctagctgtttcagagaaaagaaataacagcataaagacgaagaagcaacgtcagttctcgtgacgaaaaaaaaaagaacaaaaaggaaaaggacgcgaataaacgtggtttccatgaactgcccagctggttcaaccgaccaaggcctgattaattaattgatcacttccaaatcatgtagcagtactgttcttcacggtcactattgctcgctgctgcttcgctgggtccatcgattaataatctggtttgttaattcccctggacttaactaatcaacttgcctagcaatgtactaatacatgcaaatgtgatgcatttatggatacctgcatcagagagggagctaagctctatgttttgtatatagttgtaaagctgctgttctgttcttgtccctggtgtgtgggtagttgctgtttcagagatgaaggcagctgtgaggagcaagaagagcaagggctctttctgccaccctcctctgctcctgctcatcgtggcaatccagttcttggtgatttactcaccaacccttgatcagtacatggtgatgctaaccacaggtacgccgtaatcataatcgttttgtattcttcagtttgtatgttgattagtagtactgtcagagaagcatatgctgtttgtcttgtcgatactccattcctgtgcatatttggaaacagttgctgaatcctttcaagaaaacaagttcctttatttgttgggataaaatggtaacagttgctgaatgatgaattgattagttcgttgacaatgtccatcatggattcatgataggctactgctcacgttaggatatcagcatctgttgttattcccatgttcttgtgatcgaaatgggttaactgacattgatgggttgtccctgcaggcaagcctggtttcccatcaatgttgattgatggtaggaggagcttcaaacaagtaggtatgtgtcacataatcttgggaatttcaaaccccacaatgtgattaatttctgacgttgttgattctgagtttatcttggagaaaagattctgattttgttttaatttgctcgatgaaattcttgatgcagatgagttcatcccggagcctcacctgcgatgcgacttcagagacaatagatccgacgtgtgcgagatggagggcgccatccgcatcctcggccgcacgtcggaggtgttcctggtggcgccgagcctcgcctccatctccggcggcggcggcggcgtgaacgcgacgggcgtggacgcgaacgcgacgaggtggaagatccagccgtacacccgcaagggcgagtcccgcgtgatgcccggcatcacggaggtgacggtgcggctggtgaccgccgacgaggcgccgccgtgcgacgagtggcacgacgtcccggcgatcgtgtactccaacggcggctactgcggcaactactaccacgacttcaacgacaacatcatcccgctgttcatcacgtcgcgccacctcgccggcgaggtccagctgctggtgacgcagaagcagcggtggtggttcggcaagtacagggagatcgtggagggcctgaccaagtacgagcccgtcgacctcgacgccgagcagcgcgtccgctgctaccgccgcgccaccgtcgggctccacagccacaaggacctcagcatcgacccgcggcgagctccgaacaactactccatggtggacttcaagcggttcttgatgtggcggtacgcgctgccgcgggagcacgcgatccggatggaggaggaggacaagagcaagaagccgcggctgctggtgatcaaccggcgctcccgccgccggttcgtgaacctggacgagatcgtggcggcggcggagggggtcgggttcgaggtggcggcggcggagctggacgcccacatcccggcggcggcgtcggcggtgaactcgtacgacgcgatggtggcggtgcacgggtcggggctgaccaacctggtgttcctccccatgaacgcggtggtgatccaggtggtgccgctggggaggatggaggggctcgccatggacgagtacggcgtgccgccgcgcgacatgaacatgaggtacctgcagtacaacatcacggcggaggagagcacgctgtcggaggtgtacccgcgggcgcacccggtgttcctcgacccgctccccatccacaagcagagctggtcgctcgtcaaggacatctacctcgggcagcaggacgtccgcctcgacgtccgccgcttccgccccgtcctcctcaaggccctccacctcctccggtgatcgccggcgatcgatatatatatactccggtgaggcgatcatgcatacagaacacacgtacacaggattaattacagcagaagatggagttcattaattaattaattacagtggtagatgatgatgtagtttaattaattttggtggttgcgcaaggcggcaacgtttttgtatgataattaatcgatcctgtttcttttttttttcttttttttctgttgcggagccgtgttgcgacgtgcgtacgtgtgtgttacggtaagttggcctgctgcaattagctggttcaacatgacagaaatgcatgtgacacttccatcctttcttgtacagttgtactgttgttaccttacaagctacgattattggctggaagcctgtgaggaggatactggcccaggtgatctatgggccacagcccatagaaggagctgggctgtgtgctgttgctcgtaatggcccagatcagtctatagtcttgggctctacaaatacggcctgtttctcggcttctcgcaacgccgttgctgatgatgattcagccgaacggtcagggtccaactcgacctttgaattttcacggattaaaactctcgggagtttggccggagtagtaaattctgattcattcttcgcgttggtaatgggcatatgcatggctcagacgtgatatgcgaggcgtcgccatgaacgcggctttgattgctcgcgcttatcccggtggacgtcgtcctctataaaacaaagcactccagctcgatacagcataacgcagttcgcaagttcaatcgcaagagtactctacttctgcaagcttattcttcgactgatcaagcaaggtagagacatgggcggcaagggtggcggcggaggcggaggcggcaagggtggtggtggaggaggtggaggcggcaaaggaggtggaggcggcagcggaggtgggggcaggagcggcggtggcggaggaggaggaggaggaaagggaggtggcgaaggaggttcaggcaagtacggcggcggatacagcggcgggcacgctggtggcggcggtggcgcaggcaagtccggcggctaccacggcggcggtgggggcgacagcatgaaggctcccggcggcgacggatcgtacatctcccgctccggcttcgagtccaacccgcagggctacttccagggcctccatggcgatggcaagtagaggttttggagcgctccaaaagttaggctgctaatcgatcagaattcgcgattatggcccatgaatggtggcttctaaataatgtattatcgagtctgtaaggcagtctactttctccaaatctctgttatgtatcggattatcgtggaaatctaagtgaatgcgttcgataattttatgtcttttaggttggtacgtaatttcagcaagatcaccgatgttcttcttgttactcccctgcagtgtattggaaacttctcgaggggatgtcttctcgtttgtttaaaaaccatccaaactgttttaaaaatttctaaaaaaaaatttaaagcactcatgacatgtctatatgtacaatttcatgaaatcttaggtccaaactcaactcacatgtcgatatataaaaaagataaaaaaaattgttaaacaattactccctccattccataatataaggcacaaccactttttttaagatattccataatataaggcatacatgtatgtatgccattaactataacaattctccattaaattactatttttttaaatccttcactcacattctctaactctattggatggatgcattacatttattaggatgatctaaactacaaggtgataataactatttcttggtctttgggttaagggtggttgtgacttatattttgaaatggagggagtatttgtattcagttcgaaagaaaaaaaaagtacatgagaaatatcccatcgagagtttagaacccacccttatcatagtatgtcttcttttcaataaaagtatgatactccctccatcccaaaatgatatgatatatatttatgtaccaacgttaaggataatttaaatcacatcaatcaagatactatacatacattctttcataatgatgatcaatttaagaaattttggatttcattatatgattatcaatttgggaaggagagagtagtattttattaacaagatatctttgaatatgtgatattttaattgaaatgaggaatttgtgtaaacaattagttatgaatgtgattttaacgttcaaatttgggtttattattttttagttgcaaggtgtttaaaaggtagcagtatttagtttgttcttaagataacttattgattttctcatttcttttagtttggggtctcatggtttatctgccctaatataagtttgggcctcatggtttgctgtttgtgcttatgctagaaactgacccaacctggttcagttgccaatgtgcatcagtgcatctcaggcggataggcacgagcagcggaggaggctacgcacaggcgtttactagcgtttcttttgccatcttcgatgcgtaagccgtcgcgtcaattaagtcttttttttatcaggagtcaaccaagactggacacgatcgagccgattatgcgtgcatggtcatggagggcgagggccgttcaaaattgaaaacgaccacgtcaaaggtcggctcttcgatagttcgatcatctacgtccactaggcccaattgatcggccagattgaacaaaaaaatgaagtcggctatgctagaattctagatgcatcgcacggcatcatttgcattaaatttcatcactgatcaagaacactgaacactcaatgttggaaatatagtcattaatcgacatattttaatccaaaaagttaaagcaatgatcatggcataagcagtatagggtgatcttaacataaccagtagcatactatgcgcatcatgaatgtcaggaacaggaatataccagtaacgcgataacatgctagaggcatcatgtagaacaggaacaaaaacatagcgcacatagtatagcgatagcgctaacaatgggaacaggaatagcgctaacaacagtagcaggaggagaagagtatactccgagaatagccctccgctggatggtgaggcagaattgcctccgttgttgttgtcgttcacggcacctcctggcgcaccagctccggatccagctcccgtcggcggcgtaccacctccgccagcagtggcggcggcaactccagacatggcgatgagcagtcgtgcgggaggcactccccaaaaatctgatcacccgcctacctggtgcagatttcaggcgaaggtgtggtttcggaggcactgctccttccattctctcgtgcgcgcaagagatcagaagcgaggaagcgagagcaattcaggcgcggagaagaagaaactaacaccgggaaagaagctaagaaaacggatcggactcgcggcctccttatctatcaggagaaagaacgtggacgcgctgttgcggagggaatcgtgggaacgtgggttagtgcctgcaaaaggatagcgacgtgacgcacgcacgcacgccgccatctgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaagacaacaggagctaagccttgactagaactgcagcgggaacaccactccacaggcatcctcgacggcacggacgaagcctactcctcggagaaacctccatctgacacatactcgaactctgggggggttgggaaaaatagagcaagactgagtactacccactgtactcagcaagtcataccggaataggggtatgatgcagggaattatcaaagaagagctagagtggttcatttgcataaagcgagcatttataaacagaagttaaaagatttaagcagttgtaataattaattaatattgatcatccgctgtccaacgctatcccacgttgcaacaggcccaaccatccacctaaaccatccaaattcaaaagattacactagggtgagactaatcacggtgaatctggttgaccgcccataaccgcgggcacggctattcgaatagttttactctgatcagaggtatacaactgtacccacaagacacagccccacaacacgtttccgtgcgccgacatgccaccacgacacatcggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactagaggaaggctacactacaagcccagccgttgcccacgctagcttgtggtaagtacgataagttcttccagggcatcccgcgaaccggtccttaactgccatgggtgcgaccagcgaaaccatgcacccacagcccaccatgtgatttattttaattaaccagcaccaaagcggtggcactaatccaacactaccattagaaccaacagtctaaacattaataagattttccccattgtgcactagttgaactaagcatggctaagcaatccctagtccaatctctagtcatgttataaccccaagctgacaaaagggacatggtgcaacaatagcatggctatgacaataggtaaacaccccatagaaatattataaaacaatgcagtatttgaaggaaaacaatagagcatttgcaatataggatcaacatgttcaagtgacaagcatgacttgccttgctctgctgctggaggaacctcggcgactatttcgaagtacaccggagcgtcggaagaaccggaatctagcgacatacaaggcaaacattgcaaacaggctataagactactgaaacagagaacaaaaccatttttaatggattctacacatttttcttgatttactgatacttgaatgggcttaaacggatctcggatgaattagttatgaattttagaagattcactgtgtttattactataaaagaaaaaccttaaatcattcattgcgcaataaatcccagggctgacatcagcacggggggggggggggggga

SEQ ID NO: 23726 - DNA, 1679 bp, Oryza sativa
aattcctgcagccctaccagtcccaggaaacagtgctggtatcacagggagacagaatatcacaaccaccaaaggctttttgttattaaagtaaatgtccagccttgttgggctgcggacagatcccgagctcacaactgcattacaaaaggaaagcggaagccaggacttggaccaatcaacacaggcgcgacttgggaactaggccgaaaccctaaaactcattgtagccggcttgctcctggaagaactcctcatcagcaggacccgcttcatcttcttcagcaactagggggggattatttatatagtgcaagggtgagtacgggagtactcagcaagccatgggaagtaagtgtttaatgcaggcttcaaggaaaggctgatgtttctgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccggctaacaacttttcaaacggccacccaggccaacaacttttcaaacggccacccgggcctagctgatcccatcagctgcagatttttcaaacaccgaaccccttttcacacagcaatttcacaagcagtagtcaaacaaaactacgctaggaatcacctcacatccgcccgtgaccgtgggcacggctgttcgaacagtttaatgacctctgaagagggggtacgctttacccacacgacattactaacccgggtcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctacccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacactcggtacgttccccggtccgcggttttggaaattcatttagttcgcaagcaccgacccaagtgtcgggttttccaagtcttttgtaaaactccagttttacccaacttgttactcaaattttaagtttgaaggcaaccgtcgatactcgaccaaagtgcccaagtttcgaggcgcacctgggtggttacaaggggacatggtatagcaattaacaatggaaggatcaaatgcgacaaattaagtaagtccgccaatctgcttcgcagatggaacaacagattaagtgtgatcctatcaatgcataatattttgcaagcaacataattgaatttcaaatataggctcaagatgttcaaaggtggcttgccttgctcgagatctggagcttgatcctcaaaatcctcgcactgcgggtttcgggctccgaaactacacgcgaaacggggcaactcaacaaacagcgaaaataaagccctattaacgacctctaagcgtgccattagatagatctcgagatttgatgaattttggaa

SEQ ID NO: 23727 - DNA, 1799 bp, Oryza sativa
agatgggccgggaggaaatcggcccatcgacccccgggggaggcaaaatagacttttgcggaggaatttgatttggaaggatttggatttggatttgaactcgacgatagatcggggattgagatcttgagatggcacggacactagacaacaagcaaagaaacaaatttcgcaattaggttttttaagagataattttcccgttaggcgccacgacggaacgggcgctacaggtggattgggccgacggcccaagaagaggaaaaggaggggaaaggaaaacaaaagaaaaggaggaaaagaatttccctgggatttaaaatattgcaagctcgattttaaatggttaaaattattttgagagctctgaaaattccactaaaaatcttgttagtgaatttcgacatgtataactcaagaaaaattccacatgccaattccgattattatttgcattgatttagcagggtttactcttgctttgcaccggtgttttcttagagtctcttattaattcaattttaggcttaggaggagaacttcagggtgtgacaccagccacgcccacgcccacgcccacgccctcgccctcgccctcgcccacgcccacggcccggagcgcgcgcgcgcgtgtggcattccgacccctgcctcaactggtcaacagggagcctccaataactccctatttaggttgagatatttctcgcttaaatcctgaggtggtattattatcctcaacacttattatgggcctttgagatttaatattataagttgggcctagcccaattattctaacaatccccaccaaatttcaaggctcataagaaatgttctcaatgttgtgcctgtttgatataccagggttttggtggagactgttaagttgaacttccacctaggaaatgagctacatcagaccacaactgaacaatggactatgccttgaattgtgagttttgtgtgatcagatttcactcagaaccttgactggtactggactgccgttcgtatcccctctgtttggagcatataagtcaaactccaggcctttcatgagtatctagagatcgcccaaacctcatagactgtgactagcagtcgaactcatataggtgtgttccttctgagatgttctgcaggtcaacatctctgcttggaaaagccactcggatcacattaatacataagccatcctaccatgcaggaaagaagataagcacatcatgaaaatgagcccctttcaagggtctcttctctcagtcacacaatagtttgtttcaccatccaaattcacgggatctccgatcacaatggacaggtttccactattatacaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattagggatagctggcactggtttttcaaccaccggcaaatccatcaggagttcacgaagccactcggcctcaactgtcgcagtatctagtgctgtaagttctgcttccattgttgacctcgttaagatggtctacttgcaagacttccaggaaacagcgccacctccaagtgtgaacacatatccacttgtggcttttatctcatcagcatcagatatccag

SEQ ID NO: 23728 - DNA, 695 bp, Oryza sativa
aggtggttcacttcgttagccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggaaatatagtcattaatcggcatattttaatccaaaaagttaaagcaatgatcatggcataagcagtgtagggtgatcttaacataaccagtagcatactatgcgcatcatgaatgtcaggaacaggaacataccagtaacacgataacatgctagaggcattatgtagaacaggaacaagaacatatgcgcacatagtatacgatagcgctaacaatgggaacaggaatagcgctaacaacagttgcaggaggagaagagtataccccgagaatggccctacgctggatggtgaggcagaattgcctccgttgttgttgtcgttcacggcccctcctggcgcaccagctcgggatccagctcctgtggggggggtaccaccaccgtcagcagtggcggcggctactccagacatggcgatgagcagtcgagcagtcgtgcgggaggcactccccaaaaacctgatcacccgcctacccggtgcagatctcaggcgaaggtgtggtttcggaggcactgctcctt

SEQ ID NO: 23729 - DNA, 540 bp, Oryza sativa
ggggatctttaccttatagatgcattgccattcatgatgatcccctggcattcgtccattcagccattcaccattcacccattcactggaattttggttgaatgccggaattgtgtccacaaattgtggatggatagttggttggctggctggatggctggctggatggctggctggatggatggtgaatggctggcggcggttcggatgctttgaagcatttgttgctatctaaattccatttaagggcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgc

SEQ ID NO: 23730 - DNA, 13871 bp, Oryza sativa
ggatctcccaccgtggtccacctcgcgtcgattccttcgggattcttgatctacataagttgatgaaagctcgtgccaaatggcttcacttggcacgaacccggggaacctggttgacaagcaaagacgaagcagcggcgtccagagcgcgacggtgttccgagttacgcggtcgcgttcccggagatcggctgcactaaaagaggcgttcttggtggccgttagaaacggcattcagagggaattacagaacgcttattgaacggaaatggagctcaccggattgcgacggcgtcgaggacttctctcaccggcgccggagttggcacccccgttcccggcgaatccgaggcggggtacctcggttcttccgcgaaacgagacaggggcgagagagagtgagagttggtcggccggtcgggttaagtacggtcgccggcggagatggggaggaggagctcgccctcttccgcgctcaacgcgtgctcacacgcgtggcgcgcggggtctgagtcgtgggcccgtgtggagagggatgtgaggctgacaatggggtcccactaggcaagagagaggtgtagaaggaggaagtgttggacagggctgaacctagcctaaggcactgacaagtggggccaactcgatggaaactaggccagggagagagatatgggtagaagaccggtaaacttgatttttagattaattttcggaattattttctcctctaactttgtaactacataattcaatgtgtggaccaaattaattagtgctgattttactggaggtaaatgattacacctagattccattttatttggttgcactcaaaaataatgggtggactgctcacaaaaaataaacaaagatgggctattagaaagctagattgaatttttaggaggcttaaacagagaaggaaaattctagaaaaattacatttattcatgataactaatctagtatttgaataaattattttccatgttcacttatgtgcagttaaatgtacttttggatgaaatatggttttagccgattaaaatttaatttgatttcttttagttgtctgcttcgaccgattaatttgagatatcaacttgagtgttaacacgttaccaaattacggaggataagtttgtgctaatcattgtccacattaatttttccatgattttatcttgcacaaaatattttagagaattaagttgacctttatttgtatatgtgttcccacttcataattgcatctaatattattatagggattacattaaacttcttttagactgagaagatgatatttgagtttaatattaagtccacatgttatcacccaagattaacagattaactataggtttgtttagtgaagtaattcttttagattatgctcatgggacctattatggaatgcaagaccaaaactccaaatgcacaaagaactcgagcctaggcatgcattatgtacatgtatgcttgatgacatttctagtctaatgttgggaatgaaaagattttattttgttctcaaattttaatcatgcaatggattaagttggtcatcacctaaattaaaacggaaatttttggctctcaaaatttggagaagttaacctctaactagtttgacaagaaattttaagtcctaaaatttcgggtatgttacacaaatatgattatcgataaaatgaaagattgcccatgctgagtgagatacagattttgtattgcgcttttgacttttgatgttggtagttgtagatgtagggattcagttgatagttagccatagaactcgaacttgccatataccacgtgggatagccgtgtgcagtgcaatcatgcgttgcaatttgtcagtcacaatcactgggatgcatatgtgtggaataacttgaagaaaagacagattcaaggaggttacatagcctagatttgatttataaggacaatctccagagaatagcattgcttgggataagtaatggtcaatttcgcttaactgaaagaatagtattgttttagctgcatgattttttttgaaaagggcgtctaattattaaggacaaacaaagaagattacctttttgccttctgtactacaaggtttcgacagagaaaatgtgttttcttccagcacactaacatgatcagccaatgatgctatgagatttagatgagtcctcaagtcagctttcatttctgcatgttgttcctggatgccagtcagttttttctgcagttacctttttgccaattatttctattggattatgtatagtttatgtgacagtatttgttacccgagagcccagtcaggggttattttctcgatagtggcagggctcttgtagatcaactagaggggaacgcgcgctttgcgggctgcaccattggtgccattagagagaatcagtagacataagttctggtaggtagctaaaacaatgttctttgtaagttcagtgaaggacatgtataagtataacgatatgttgtatgcaaattgtggacagtaagtacataacaaaacctgccatttgtttgattacaggataggcagtacatggtagctttatagcagtagcattgcaacagttctgctagatgagcacatacaactacattacagatggctaaattctaatgtggtttggatgcttttgcattaattgccctttcccccatgaattcagaggattgcattactgctttactgcaagggccttcttgttgatgtgcaaacggaaggcacacatttttttttactacgatgaattgcttccacttatgcatagttactcgagaagtgctgcaaaaatacaatttttgtgtcaatactgggagtcaacaatcttgtggcattgaactactcaacaatattagtcctctcctaattttcttttcctgaatgtgaataaaataagttaatggagttatttttgtggcatatgttaaattgtaaggatgaatgcagtagtggtgtaatatgtgaattaacctaaggagcaccagcaggtactataccaattttagaccaatataaggaaatcaatcaaacatctcaatgacagggaaacacaaaaaggttttcaaaaccgaagtaatgatttatccatactaaaaacacaacaaacatgtaagcaacctaaattgttctcttagtaattttctcataatcatgaaagtgaaccaaataatttattcaagaacatatttatccagcaaataaagttgaaatggacaggattgtaaatgtcaatctatcaagttaaactattggttttgggttgtgcatcttttacatagattataggtatgcgattttaatacttaatacattgcaagcacaacatttttgtgagcagatactatcagtatgtttaaaggaatatcatgaaagttcaagctagtcaaatacataatttggttacaagggcaacactcaacgtcaactgaagctttatggtagcacgacatgttggttacctattgttgaccacctgaaatgatgatgagcagaaacaaaccaactctgcttccaccaattcctacacctataaaaaaagtaaattacttatgaaaagatcacatcatttagtatgtgtccaaattgtccagcacactatcgcacagcctatagcttaacaatatgtcacttacttaaaaagcaagctgccctgctgaaagctcagaatgagaaatggcactcagcagcagcaccaatagaatgttaaaaagagttaatatataagcaaaggcctaatcaaagtgcaaaattagcccatttggaaatgggctgaacaaataacttgtactatataaaataaatatgtagtttgttcgaaaggggaaaaaattgtcttgcaagcaactgtgccactgtcctagccatcatataaactacatcatactatgttttcaacttaatttgtagaaaagcagggacaggtaagcaaagcttttgctttaaagtcgcaatggacagattgattaattgtatacttgtttcaccagagagaaccagtagctaataatagaggttatatcttaaaaacttcatatagctagcttgtcttaaaaataattacatagtattttacaaacttttgaatgatattttcaattttaccttgaattaagggaggtagaggtaaaaaatagtactaaatagttggtggaaaacatatactccagatgaagggctatattaaatcttttgaagattgcttttgttccctttcctccaggctgctttttgtcctaataagatgcaatacaacaaacatgtggagtgcagtgtaagtgatagggaaatgattcattggcaagagaagggagaagagtgcataactgtatatcgtttgccatcagctatgtccaaatatgccagattggggcgatccatccctgcagctcttcaagcgaagaaccataaaattagtttaacagtgggcctataaaacgtaatctggtagttttcttctgtcaggctagcaacacattttatgataaatagactctacaaccccagaaataaacactccatatattaacgggcatatttaagaaaaaagaacattggaaaatccatttgttgttttaaatttcctgatgtctattaatatgggttttcatcctttgatgaacaaaagcacattagtccatcatggatttagagccaaaccacttccaagaacattttaggtgggcatatttgcaattgaatgaacacacaaaccctatagtgttttgttcttatgtatttacaaatacaattttggtcaaatttatacaatgaagcaagcataagaaagcaacaagaggcaagcacatgcaccttgtcaattgtggaggccttcttggagttgaaggtggacgtgcaagtgtggaggcaaagtggaaggacagcttgaagccaaccgctggtccacgattttctggaagtaccgctgcggtggatggaggcatccttgctctgccctgaactccctctccttttttactcttccatagctattagctgctgcgaaggaagcaattccataaacacatagctgctaccaatgaaaatattgttcagcaaaggatgaaaacagatagactacttaggaatttattgaacagtttcaaatatcacaccatatgatgagctaacaaaatagtaataatcaatcatcactaggtttagcaaaaagaaatttagctgcgaacttctgttccaattatttttctatattttcatgcaaatttagaaggaattgtattaattgcaccaaaaatagtcaatgatctgaaatcaggaaagatctacacatatacaaagcaaacctgaagacatttttttatcaagagtgcagcatcatttttttctagatggaagggtcggattaaatttaaaacggaagtgcagtatcacacagctggaagagtgacaagcatgattagtgccgcgccaacatcgagaatcagatttaacaaatactttccaccaaacatacgcagctcgaccactcgctggttggccctgcatacacctctgctgttgtactattaaatgaactcgccatccattcctaggaccagagtgggtagccatacagccatgttgaccacgagttaaaacatttagatcaaactgacaggtgacatttaggagctaatgcatctaagaactactttagttctaacttaattggtaaaaaatttaatcactcaccatattatctgaacataaaaaattgacacaaaacactaaaaccagaacttcagtcctatatttcaactgtattatcagcattgaatgaataaaatgtagtatgtacactgctagtaaatggataagaggagcactttttagtggctcctggttgttctaatggaatatagcttatagttctcagtaatggaaataaaaaattctgagtaattgaaaatccaagcaaatttaacacttgaaccacgtcaaggaaagaaaaggatacagaaacagatatatacctatgcaagatccccaaagcactttttgtaactttgcatgattaatctattgacaaatgcaatgcaggactttattcactatcacattagtaagataaaggaataaattgaatcactactggtcgtgaattggaagcccagcctgggcatagtaatacatattcgagaacaaaagatgcacaataaatttgaagttttcaaatttgaattgaatgacatctcagcaaatgtactacatccactacatagtagtctagcagtaattttcctcaaaagtaaggtacacatcattgaataaaaattgcttcctgaatttagagaaagatttcatgaacaaatgaaggtaatagacaacatggcttggttacaatgtgatctaggcatactacaaacaataaacagagagctctagactttgtgttggcctacggtatctgcagtagctagcttcaagttcttttcaacagaattatcctggtaaaatggttgtacagataatatagttactccctccatcccataatataacgcatggttaaagttgacacggtctccaaaactaatctttagcttataatttctcatatactataaggtttgtagccacaaaattataaccatatgaaagtaaatgtaaatctcaatctaatgatataatttttaacaaataaaatacatttcatattatactaaatggtggtcaaatgttttaaagtttaaatcttgaaatgcgcgcgcgccttatattatgggatggagggagtaccattttgtatggagcctaactcttatataattcaacataatgaaaaaactaaaattaaatgaaatcaccatgcaactttgagaacttaatcaataatgcatacttgtacactatgttcgtcaagcatttcattgagtatatgatatacacaagcatgtgtagaacatgagtgtccggttaacttaccttctatttcaaagagttctacacaagcgattgtaaccaagatcgagatcaaaccatcttgcctgtaagactgtaaagaaaataaaagcttttgaacaaaaaggagaagaaagatgtattacctatcattctaacaagggtcgtccgggtgggtgcacggcacttaatggcgccttggatgcgctctgcgagccgaggcgctgagctgccgtgaggaagagggtttgcagcctatgcccttcagccccgtaggcctgtgtcctctcgtcccttcatgaattcaccggctgctcagctcagctcatggagcatgggcacataatgtctctctctcggatcatcgtcttcaaaacctgtgttcgctacaggacgatgggattgggaacatgcagcgcagggaagaagtactctattaacgcgggattatgtaagtactagttatttttttaaaaaaaatagatcaatatgatttttttaaacaactttcatatataaacttttttaaaaaaaacacaccgtttaacagtttcaaaagtgtacgcgtggaaaacaatttttcatggcgttaccctgtaattttcactaggacccatacgcgaaaactgccagcaaaaacatatctaggggtgggaggccatggaccaccagcgaaaaccgatttttgctggcgaccacgctaagatgtccgccataaataaaaaactctattttttcgagcggacctcttaagtgtccgccagcgatcgctggtggtaggtaataaagaccgctaaaaaattttttgaggcgaataaaatccaccgcgcgcccaccgcctagtccatcctcgtccttatcccttctcgcagtctctcttcctctctcccttctcgcggtctttctccgcctctctcccttctccgtctctcctccctcccttctccaccgccgctagctcgtcgccaccccaccaacgccggctgccgtcgcctcagctccaccgccgcatatcgataaccgctagcgaagatcgatatttccctggccttttctttgtggcggctgcaatttccgctaggaaaaacctaaaatagccgccacaaaagatgattttcgtagcagtggagtgttgggaacttgctcttgcaaacacacggagtttctataagaaattgatctgtgttgtatatatatatttttaaagtggccaggggtttgtagtttagtttcgattatccccaaggataaagataaattagcgacaatgaatctaaatcaacatcccagcgccatttgtcactaaaaaactatgaggaaatggtttaattagaataaaaatccttggccaagaaataaatctaatagtattgccacactcaggaaaaattataaatctaatagtgaaaagcaaggcctcacatggaaattacaccgccagacaggccgaacactactacacagaaggttttctcgtgcggtcgaacggattttcgcgtgcggagcttcggcccgtctcgagcagttcgtctataaaaatcgttatttgtgcgtgcgggcggcgcaactgcacggaaaaataaaaaatcaaaataaaatcgaaaaaacgaaaccctaaccctagccgttgccgccttcccgtcatcgtcgccgtcgtcttcccgtagttgccgtcgccttcttgttgtcatcgctgttgtcggagggctgccgcccccatcacgccgccggatccgcgcggggggtggccgccgccgccggatccacgcagggggcggccgccgccgccttcgcgacgccagatccgcgcaaggcctccgccgccggatccgcgcggggggcggctgccatcgcctacgcccgccgcacgccgtcgtcgccttcgccgcgggctgccgccgtcgccgtcgacgcaggccgccgccctcgcctacacccgccgccatcaccgtcatcgtcgccttcgccgcgggcagccgccgtcgccgtcgccacaggccgccgccctacatccgtcacgtgaggagaggagagaggagtgaggagaggattggaagggcacgcatgaggagaggataggagaaagagcactgagagaataaaggagaggaatgggaccgaggcgtggaaaaaggaaaattttgaagtgggtaggagggaaagaagggatgattatttttccgtgcagctctcttaataggcccgcacggaaaaattggtttatttttctgtgtggttcatttaggaggaccacacgggaaaatcgattttcccgtgcgggtgatagcccgacacccggtcccctatttttccgtgcggttccacttacgaaccgcatggaaacaaaaggggacggcgtccagaaaaatcaatcctctagtaatggaagagccgcccatttgcacatgtgattttcgtaaaagaagagcatgtggaaatcaatttcataggtggttttcataaccgagaaaaaaaaagatacatcttacgaaggggtctaataacaaattaacaaattaaatccggtttcctcatgcctaaaagagcaactgttagcctctgagctatgatgcgaaggggtctaattacggaggggtctaataacaaattaacaatttaatttcatatattgatttagtttgtagcatcatagttattagaccgtaaatgatagtaaattaaatcaacaaattaaatccggtttcctcatgcccaaaagagcaactgcgagcctctgagctctgcggtcccctccccaatcttccccattcttccccaatccggtttccattggtcatcaccatccgcgcgattcgcacaggcttggagctcgccggccgcgctaccgagtccggcctccaacgaggaagggatgaagccagaggacgggaggaagagaagtgcgacggcagtggcgaggaaatgtcgtccgtcggtcccaaagcgaggaggacgaccacgccgagcgtgggaggagaggagagtcgggatcaccgccgtatcgccgccgtcgtcgagttgtcgtcatcgacgcccaccagatctgcgctgctgtcgtcgattcggtcggtccggcaccgccgcctctgccgtctcagcctcctcgaccgccgccgctccggatccaggccgtcgcgttggcctcctcatccaccgccgctcaagatccacgccgtcaccatggtctcctcgacatccgggcggcgctggtgttcgtcgtcgaggtgggggagagaccggcagcagtggagttcgtcgccgatgtggggagaggccggaggcggcggcggcgccggtggagctcgccgaggttgggtgggtggggaaagtggagaggggttgtgcttgtgcgattgtgtgggggtgcctgggtagcaaggtagggttgagattttgtatattttctccaccgtaaagtgttaactgtaaaatttatacttgtttataaattgaaaaaagtattagggctgaaatcaaaagtgataggggctgaaacgaaaaatcgaaggcacccatgagaccatttgcaatgtggggaaccaaaatttggatacggtgctttttagcctatgtggcattttagggcccatttgatttggaggaaaaacatagaaattgtagagaatttcaatcctatagtaaaatttcctatgaagccctttgaaacaaaggattgaattctatccaatcctttaaaattcctatggaatggacaattctataaagattttggaggaaatttagcaagagcttcaacctcttgctaactttcctttgagtctatctctctcatccaattcctgtgtttttcctgtgattcaatcaaacggtcatttctgtgtttttcctgcgttttacaatcctctattttacacttacattcctatcaaaatcctgcgttttttctattcctatattttctcaatcctgcgatttaaaggggccttagtttcctcgagtgggtagcttgcattgctactacccttattgcgctccagaacccataccggactgctccagtgaaccggtgccagcgttgttctctctgcaggcggctgcagcgacgtcttcgtccttgctgtcccagccagagctacaccgcgctagcctctgcccgtcaccatggcgctgtttacttcacgaaaaagaaattttttagatatcacgtttgaccgaatgtcagaagatgtttttttttatacgaatgaaaaaactaattctataactcgtctggaaatgacgagaagacgaatcttttgagcctaattaatccgtcattagcacatgtaaattactatagcatttatggttaattatagactaattagtctcaaaagatacatgaaacgaagaagaacggcaacaacttctcctgtgcctcgagtcctcgacaattgcagtcaccggccagaccccagtggatagccgcggtggtgatactccggtctgatttacaatcttgctatgggctgtctacgacgcatcgggaagctcctgatcactctaaacctggccggaggaggaagacacagcgggctgaatccaatcgttaacacgtgaatgaatggccgaggaatttccgatgacgtggcccatggaaggtcaagagatgcccgactccaaggtcaggttttgtcttatagagatagtggcccccatcaatggatcaacacgttatcagtcacttgctttccgctgagcgtacataacagaatagagcacgaaggcctaacgcaaatcgcaagggtaagaacggacctctcgccaacaaccattattggtacactacacgtcatcgccgtggcctctacttccgaagcaaaattgcccctccctctctcatttttaggggtggacaaaaaaaaccaaaccgaaaaaccgaaccgaactaattgggaccgagaccgaaaaattcggtcacaaattcggtcatcaattgtaactaaccgaattttatatggtcttttcggtcatttagttcggttaaccgaaataactgaactgaccgaatcactgtgaaagcccaacaccagccaatagcccattagctagaaaaccctaaccttccttcccacaccacacgatccttcccacttcccagtccccacatgcgccgcctctttctcgatctttctcctcctcctccccgcctcttctccgctttctcctcctcgcacgcgcctctccgccttcttctcgcgccgcgccaccgcctacctcgcaccgcgcctctccgcagaacttgcgccgtgccaccttctcctcctcgcgctgtgtcgccaccctctccccacacgtctgcgcgctcgcgacctcctcctcgcgctgtgtcgccgccctctccccacacgtctgcgcgcccacgacctgaggcctcgatgatggaaggctgatgggagacgcgagatggatgggatctggagttctggaccgtggagtggttgagatcgacgggatcaatggctagatggattttcttgatttgattttttttccatgaatcatgctctacttgctacttgctggtggcatcatcatattttagtccttcttcccaattgctttttcatcgatcttgtgcagagtattcttttttgggaattgctacacagctgccggctgaaaaaatttgttttatcagctgaattagagagcgttcgatttttctttttttttgcctggtttttttcatctggttttttacggacgatggaagcacctcttattttttaagtagtatacatatatatatatatatatatatatatatatatatatatatatatatatatatattattcattgtgttaagctaacaattaggtgaagagatgtcctataagattgatcaatataaaagcaaataatcgttccatatctctacattaaatgagagttgaaggtcatgaagatctagaatagcaaggtactgttagtgatcaaaagctaattttctttggtttttatttaatgggtttcgctacaattgtttttgccatgctactctggtgtgcacatttctcggtaagttagttcttactaagaaatgacccatagaccggttttctaccttggaagtggaattcgagggtcgctacaaaatctatgaaattggagactgataaaataagctagacaaaccaatagatctatacaaacgtgatgaaaataacaaatatatctaaaacaactgtacggttagagaaatatgaacttagccagaatatcggactcaaccgagaaggtcctaactaagccgataggaccctaaattgtgatacagttaaagatagaaatactatatcagataggcaacacttgagtcaacttgaatagaatatcagacttaactgaggaagttctagccacgccgatacaagcgaagttgacagaacttacttcctcgctagagattgaacttaaccaatgcagtcctactcgaaactaagaactcgcagggataaaaggtggcgatacgctgaaagtaattgtattgatcgatctatgaagatagattacacagatcctgggtgtacatatttatacccttgggttgatactagtcccgaccgaacaagatacaagtttcctaaagataaaagagaaaagatattagtcccgatgaataaaagttaaataaaagttactaaatcctgtcttatcctataatactatacaagtgatccccacttagtgtagttattaggattttgctgagttctagtgaagccacgtcactctttaatcccaaccgttcgatcgcgctgcaaacggtccgatccgttctatcctaccctaaccgctctgccttccttctccaccgagcgtagattctccgccgccgccgccgggcatactcctctccccacgcgcgtgactcctcccttccccaccagcccgcgctcgcttcctcccacatcgcgcgcaccaggcgtgg

SEQ ID NO: 23731 - DNA, 24018 bp, Oryza sativa
gattctttatgcatgccgtcttgatggctcacattaacgcagttactcccagtgtccgttacgcgaaatcatcatcatcattcacttattataatgtgccttcgatccacaaaagctcatgtcattcgtcgttctctaccatccttgtttcatccgagctttcacttctacaaggttgtgtgttctcctacgggatccataggtacgactcaaaatgcttccagttatttcattgttagggtgttgtattcttcttcgcctccttttcatctctttgttttttatatgtacagaacggtatttcgtgatgcgtcacccacagccttcctctagagtgtattttgcagctcctgtcgattttcgatctgcagagataatcccaatatgtagcacttccagcctttttttactgttaagtttatattcagttcaagcaattcccattgtgtgaattcagttcaagcaattcccattgtgtgaatatacttcagttgttatatttggtcttcattattgaatcccgggcttctcagaacatgaacatagactcaattgatcatccagtaactcttaataaagccattggaaaaacaagactttttactgtaggaatgaatactgattcatcttctaattctaagttccctatcagctaggtacttaaaaggagtttctcaattgatgatgctatgccaaatcctatgctgccatttgaaaaggaatatcatctgaacatgctatttattattggctcaatattccaactgagttaatttaggggcaatttcgtttctaaccctacttcgatgtctaatattgattttacccctacttttagggttttcgtttttgcccccacttttttggaaccgaactatcgttttacccctactttggatggtgaagttaacagtgttaagtaattggcaaaaggacatttataccctctcatatctctcttcattaattatatttttgccccattttatgcatgtagctttagaactttatttttgtgagtatatttaaaattaaatgaagcacattgactaatatctaaagggaacagataattacattttacaaaatgttgtcaaaattttgtttaagttctatcaaaatgctgatttttgtcaaaatttcatcaaattcagaatttatccaattttttatattagtcaaagcgcgtcatctaattttaaatatactcccaaaaataaagttccaaaactacatgtataaaatgggggcaaaaccacaattaatgaacatacatgagagggtataaatgtcattttgtcaattacttaacaccgttaacttcaccatccaaagtaagggtaaaataagcgtttggttcaaaaaaaaaagtgagggtaaaaacgaaaaccctaaacaataggggtaaaaatcaatattagacatcaaagtaggggcataaatgaaattgcccctaactttaactacctaactaattcaactttccaagagcaaagatcaactccaactcccaccaccaatgaaatatacaagtagcccaaggtctattgttctctcatatttatctattcatcatatccatataagactatacttactaactgctaatgacaaattcatttcagcacacctattgataacacaggagtatctaaagatagtacacctccagaatcatctgcaactgtcaacatatccacagaaaagaatatatgagaattgcatattctaactacttaattaaatacattcatttattcattaaatactttttttagtttgagtcagaccttaaaatttcatagaaattccctcagattaagtttcagtattgtttagcacaatttcaaattaattattgttgttcttattgacaaatgtgcaggccaaatttataacatggaaattattttggtttgtaacatatttttttgtagtcaagggatttcgatcatttatctgcaaagggatatactgttgtaacataaatctggtttctttaggtctacaagtgatataacgctgtaaaaactcatggtattactaggttgaggttgaatggcagtattgcactactgcagcaattgttaaatgaacatcacttgctgctttctttcctgaggtcatttctgttgcctgggctgcatcaagctcaattgtgaactgaatgtgcatcaatctaagaacatgagttcgccatgccaaatggataatatgtagaatagttaagcatatgcttaagccattttatttgtaatactcttcctaatattcccacaaaatagcatctatcattatcttagttgagtccaggttaaatatgtgtgttggttaaacagttcttgattctatgaatcaatctttctcggttgggacagtagctgcatgtagttaatcgatcaatgtgcaattttttctatccttgataattaaggatgtgcggttggtgataactaaattagcttcagtagtcccagtagatatactcggcacttttactttacataactgaagctactatttgctactactaaataactagatttataagctatagcaatttgttacagcaacacatctacaaaataaagcattgatttcagtaaggactccgttgacaaaactaaaaggtatacctctactgcacatagctcattcagttatttaaaatttactcttacaaacattttattcctttgcaataattttcttcttcatgggagtaccaaacaacttgatctaccttgttggtgatatgggcccggggtacgcacagtagagggaaataaccttcccatctggcggcgtggccgtgcggcctggcctttccccacctccatggagggagatcaggtagcgctgaggtggccaggggcctcggggtgccacgtcacccctctagggggcgtgaggcatgctgccccaaggccctcgcctggcctccacgtggcagggtaagtgggcggcgcaggagatgctgtcctgcgtcattaatgagcagtgccccaaccgtccctcgccgcatttaatgcggtgtgggcggatgcgcggcaccgctcgattgacgcatgtcaatcaaccttgaccagtctgtgaccggtcgcaggcgataggacgggcggtagtgcccccacgtcccaccctgtgtcaggcggagtcggggcaggtatgccccgtcccatcagcacactgccaagtgtgccccctgtgtgtgatgagcccaccaaagtctccatgcatttacgagggaatgacatggatgttccccgtgtaaggcggaggacggtgtcggaccccacttcgggacagacaaccactttacttccggttgaaggcacggatagtgatctgaccagggccatgtgggcccccctcccatggaggggtagatgtgaacggtgcatgtggtatccctttgaactataaaaaggaggaccttacccaccgagaaaggggacgactctcgatagcttgagctctagaggaagcatagctagggtttcccaggagctcaagatcccttgtaagaattccaccataataacacacacaggagtaggatgttacgcttggtagcggcctgaacctgtataatccctcgtctctcacacagatccgcaagcgatctagtagttagaccataagcggagatacgctcttgatcatcgcgccttatcccctggccaaactcacaaaggggggacgtgaggtttcacatcccccgctagagaggatcactcctcgacatacctattggcaaacgtcagaaggaagagtttgtacttctaaccctccttccaaattgcaaagtgaaaatataatgctaattccaatttcttatgaaccatttcaaacagcaaaaagatctaaccagcagtgagcgataagttaacacataaatctacataatatgcatggtacttgctctttacagtacttcagatacaatacatcatcatacaagcaaatgtcattatgattcattctaatgcattgtccaacgaaatttgcagctcaatacataatatacaacttaaagactacagacgcttccgaataatcatatgccttggttactattttcgcagtcacgctctattgtaatttgttttcgttgtcaggctatgtccaaactaaatactctaggtgcttccaaataatcacatccattgtgttaggattatggataccacatacctaatagtagttgactaaatctcgacaggacccaccacataccatgtcttatacggaaacaaccttcggatataggaggagttccgtataaggaaggatgaatagagttatacatggaaactacaaggactactcggattatatccatattggtttccctatttctacttggataaggggacacctatgggtataaatacaaggccccttaggaggagaggggacacggaacaatagatcaagacacaagatcaacatacaagccaacatgcgccaagacaagacgccgaatatcgacttcagagataagcatggttagtcccctacggtgtctacggatactatcaggagagaaatagcgttgtctttaatctcgccggatgcggattcgaggaggaaggctaccctgttgtcgactacgagtcagcacttcagaccgccaagtcgacaacagttagataggctaccccaaatattatactggtgtgattatggtgaataagagcaacgactggctttggccaacatgagtagggttattacctgacaattcagaggcccgaacctgtataaaaatcctcgtctccgtcttttttactacaatctcgcgtatatcctagtaccaacaattcccatactatgcaaataccggaatcgcgacatcaaacgtcgacacattgattattgttttctcattcccagttccctttcatgctaacaaaactttcgtgtatcctatcatataatcaaagtaatatttacatattatctttagaatccttttattttcaatacaaactattattcttttttttcctacaaagttccgcagcaacgcgcggggtaccttctagttaatagatagaattaagttgtgatgcaatggtcttcacgattcctttttaacttggtctcttttcgataggcttctctcaactgatcaacttcttttattaaccgaatccataaaaaaccgtaccaaatgttagcgttaacaaacatatgatcaaatgttatgtaaaaaatcaacgccgtcatacattttgaaaagaataatatataagaagtggccttttgtgttagctagctaagctaatactcctccgtcccaaaatataataacttatagtatttagaatttgtcccaaaatataacatcttcttcatcaatattctctccccaaccaatcacaactcttcaccattcaatttttccacctacctccacttctcaactaatcactagcgtccgatcatttaattttatttactttcttaataaccatgtcgaagacagagggagtagcaattatgtatcgagaaaatggcttatggaagatgcacacgtacaggtggaggccgcagagatagatggagctacaaggagcatatgtgtaccaaaaagagctacatgtatgtgtaataatccaaacaagcacgtagtacaaggagctagtagcacgcacatgcatgtagatgggtataaactcaatctctagctctcactggtacgtacacctcaaaaaggagcaaattaaacgagacgaacacacataacaggaagctagctggactgaccgggccgatcaataaccatacacacatgcatgcatggtgatcgatggacctagctagctcatcttttattccagaatacagatactactagtagtattggatacagaattcggctccacacacatcgacccaggtggcaaccggcgcgctgctgtatatatatgatcatcgatccgatcgatatagctcgatcacctcaccctgcacacgcacagtacatatatatagattagatgatatagatacttaattatcatacaaagccatgcgtaattatatatatttaacggaatatataggattagatgattaattacctagagcagtcgatggaagcgctgatggtgtaggggacgctgacgccgcacttggaggggatgctggcggcgttgccggcgttgagccccttgatgccacgggcggcgttcttgaggcagttgcaggcggtgcgccggtcagcggtggttctggcagcggacttgaggctcctcacgccgttgcagcaggccgcggaagggccggcgccgccgccgcgggcgtaggtgaggcaggggccaacggctgagttcacctggccgcaggtgatggccacggcggcgtgcggggcggcgaggagcagagctgccaccacggcgaccaacaccaactgtgcacgggccatctcgatcgatccagaggatgctagctagctgagctcagctgacttggctactgcgcttgatgctcggtgttggttaattaccttgctggttgctgctgcgagagctaggatgaatgaggagaatacgcgggaatgaaggggcttaagtagatatagagatgcatgtatgtgtggatgatgcatgaacgcaggaggagcaagcatggccggtgtatggtgtttagacggtgcgtctgtccatacattcattcaatgcgattgggagctagcttagcagcgggtggttgggtgttggtgggaatacaagagctatgtccctccatctacagtcgacagcattttatgccagttctaaaaccggcaccgatgactttcgatgaccgaagtcatcggtgccgtctctatggtgttggttgggatatctggcatctaaggggtttaacaagcactaagaggtttaacaagcaccaattaaagtttaagtaatagtgatggaataatccctaaattttactgacaacttcgtatcgctcatatttctgttgcctggaagctttttgggagtaaggtatatcaagtgtatatgaacaaagaaatagagagaactaaatagtcgaatcacttcgccatttaattttttattgttcttgttcgtgtatgacagcaaagccttttaagccttaccattaattttctaagatatttcaagaaattcaattcatatattttgcaggcatgattcaaatccagatgtgccaaggtgatgggcgtaaagcagccacagaacagatacatcatacattagtgtaaacagaggaaggaaatgaggtgcttacaggagtcagatcataggcagacatcattcaaacatatatttgtaagagatcaaccgacatgcatataatttgctaaaacaaagatgctccactggaaatcaggacctgaaagcttccattcttgcctactccttatccaaaagaatttctcccgacttctcacctgcaattatttatcatttttttagtgaatgtcaattatttatcattctatagatcaatcttaaaaaagagaccattatggatccatacattttgttttaggctaaacatgtgatccatcttttttccgccttctattaaactctgtcagtgatttactccagagaactttgttgtcttacagtggattgacaactcatgtgtgctgtgaacaatcaattggcaatttttgtaacctaggtggcaattgtgcagtgaacaatcaattgacaactcttataactatagatattcatttttttttctctaaggaatggtaaatgatcttttttttttctctaacgacagatattatacaaccacctccgaatatatatcaattgttgtcaaagatgtatatatcatcgtaaattaaacaaccacctttgaatatctacctgaaaaacaaattattgtcttttggcagatttggaattccatatatagcaaatggaaaatctaagtccttactatgtcttttttgtcccttcctcctcgttgatgtaacacgtgcatcggttatctccgatacctccctctaaaaagtaaactaaataaagttgagtaacaaccgtattcaacaagccaccactacaagatacattagtgcatatagggatttaagaatggcttagtttatttgcatcgagctggttgtcacaaaccatttcattgatccatggcttagcgattttaactgaaaacaaacgttatgtccacgttaatatccatcaatgcgagctgcatccacctccccaagctttctcctggttccgtttaccctcgtgttcaattttgacttggatgtatgccaacataatccatataccttcccaaatttcatataatcaagtttaaaacttctagactagtcaagagtagtagatgtcctgatgctccttcaagcgtgagcatagatattcgaatagatttatttttttcaccctacaatagatgtatgctttatcctcaatctgtagcgcacccaacacgtaagatttatcacggctcaggctttcgatttcccttgcattacagcacctgcgccaaagacaattaattctcattcatcactggtgtactttttctagtaacgtttgaatattcgttttattcaatttttttgtgtaaatatgaaaatatttatgtcatgcttaaagaacatttgatgatgaatcaagtcacaataaaataaaataagtaataattacataatttttttaaataaaacgaatggtcgttggataaaaagttaacggtatcatacaacaataaaatatggaggtagtagtatgtaattttcaccgtatattttctctgaatgggaagcagggttatacaacctatttacccgtgtacgcgttaattcgagtggattaattcctgttgggggcaaacgtggtcgcttgacacgcggaaacttctccaacctcgtcgccggaaatccttgaccaagcttcattcccacgagcttctcaactttccatccagtaacacgataacacggccatagtccctaacacggcggcggagtcaaataccatctcgcgctttcaacgtatacttggcattcgcccatcaagcacaagttaggctgatcagtgatcactattatcccacaatcaacacctttttcttttaggcttcggaatcatcaaaaattagctaccaaaaaagatgtgccaagtgctgacaagttccagccaagtacataatttattgatgaacaataattaaagcagaaacatgcaatgcgctttctgagccactgcactttgagagagcagactcacgcggcaaataaattagagtatcatagattgcacattttcagaaagtaccaactgttgtgaatattttgagattttaaatatacataaaaaatcgagaacagaccttaataaacattttttacatgtcgttctacagtttacacgtgccaaaagtggttactttgctcatcacaggattcagttcacaaatttcgcagaaaagaaacgtgccagggggaatcgatgggaactttgatagactgcaaattttcagaaagctagcattcttgaatatggataaaattcttaaaaaaaggcattcaattttttttttaggctgaccacttcttctgttgtacctgtcgttcaacaacgtacaaaagtataatcaaccatgtaagcgagctttacttttgtaaaaacacatttacaaaaggaaaccgattgtaaactgaatcttcttgaaaacaaaaccgattgtaaactgtaaaaggaaaactagacagcagacacactattcaattatgaattatcaattccttgcttatgttacgccgaggagaaaattgttcgtcgaagactaaactgtcatttaaattcttcaagtaaatatttgatgaattccagaattgcttcatctttatacgtttccgtgtcattgttatgttactcaaaaccaagctaatattatctaaggctaaataacgaggagttattatagtttagagctgaataatgttggttttaaacgcgggatcattttctaacttcggttaaattaaattcactttttctgtttctctatatgtggtttcatatccttaatacactgacactttttaaaaaaaagatgtgtgagaggaccttatacttgagataaatttaagttatgtgacaattgttaccacagataaaccattgctcacaaaatatatcaacagaaatagagatcaaatttgcccaaattccagaatccaatccggcctcatgtgataatattgaattcaaacggaccataaatcctacacatgagcttcattttgggcatatgcgtacttgatagtaatagtttggaggtgtttttccaactaatccaacctcacctccaaactacaaatgaaccaatgacaatggcagaaataagatgatgcaccatctgtaacagccctatgaacttgtaacttcatctataacccaggtctgagtgggtgtgtcccaacttggtagagcatgatcgtagggaccacatggtcatccttacatctatttacaaagttaggtatgcgttcactatttctcaggttctgctagattaacagttagttactactccgtccgtcgcaaaatataacaatttctagcctttaaaatttatcctaaaatataacaacttctccaccaacattctcttttcaaccaatcacaaccccccaccattcaattttcctacctaccttcacttctcctccaatcacaacactctcccatttaattatatcaacttttattaataacagtgaccaactataaaaatgtttatattttggaatggatggagtactattttgcctgtaattgcacgtatcagttagaccgcctagctacttgtctttggaaccccgcttttgtgagtaatttagattgcttattcattttattattggtagttctcaattgcttgtaggaacaaatgccattggggtttggttgatcgtgccctgacaagatcacgagcatccttggagttagtgtaatgatcactaagatgcatcatccctatatagttatagtcaagtcgttaacttattttccaaactatcatcaaaatatcaggacacaagattaggacacctaagagaacttcattcaggaaacaaagtaccaacacagaaaaaatcgctccaaaaaaaattacattcaaaatgaacaaaatcttctacattttcaccgatgctgccattgataaaagagaggaggaatatagaaccaagcatgaactccaacgcacaatgacttttgaagaccgcaataaaagcaaaatgtagatgcacagttgataaagagatgctaaattttacattggaaaatgatatttctgatatattttcaggcaccataaaacctcttaaaaataatataagaagagtgattgctttgctgatcacttagttcatcaaaagatttttcgatgctaaagatcagattagaattcgaggcttttatataaaaattcatataattaattaacgtataagaaacaatttagtttgcagagataattgaaaaagtttctcatagcaatgataacatttgctgagatcacagatttgtcaggcaaataaacgtgctagctaggggaatcaaatgggaactttgatatgatggtcaaagtacagacatctcattactacatatcaagaatcggccagagcccgttcccatttctttttccaagcacagaattatgccctgtccaaattcatcagggatctggcaacaacgcaagtacagagactaacaactgactagtagtctactacgtgcagctgaccaacagctaacaacccaagcgtcgtcaacgtgtcacacctcgtccgccgccgccgccgtcgcggtcgtcgccgtgatgccgctggcctcgccggccgaggaagcagcgacctggttccggcgctcgtcgagcaccttactcgccttgaggtaagcgatccttgcccagtcgtagcagtgcagcgcgatgtatactcccaagccggcgatgatgccgttggcgatggagaaggtgagcggcatgagcaccatggtgacgaacgccgggatggcctccttcatgtccgcccactcgatgtccttggccacgcgcatcatcatggcgccgacgagcaccagcgacggtccgacggcccacggcggcacgctcgtcagcacgggaccgaagaagagcgacgccaggaagcacgccgcgacggtgatggcggtgacccccgtccggccgccctcccgtatccccgccgtcgactcgacgtaggtcgtcaccgtggtgctcccgagcgcggcgctcagcaccgtcgacccagcgtcgaccaggaacgcacggtactcgccgtcgaacccctcgacggcgccgtccgtgaatccgccgtactcggccatggagtacattgtccccgtcgtggcgaggacgtcgacgtagaggagcgtgaacacggcgagcagcgcgttgccgtggcggaggccgccgaagctgagccgcccggcggtggtcgtgatcgtgtggaagtccaccaccttcttgaagtagtcgaagccggcattgcccgccgcggtgtccgggaacaccgtcacggcggtgcccctgatccacgacacgacggtgacgaacacgatgccgtagatcatgccgcccttgacgtccctggcgaggcaggtggccgtgatgaggaagccgacggcgccgagccagaatgtcgggctccgcatggagccgccgaggcaggcgccggtggcagggtcggtctcggagcacgcggtgagcgtcaccagcgtcgacgggctggcgccgacgaggccgacgccctggtgcgcctgcagccccgtgaacgccaggaacaagccgatgccgaccgccgtggcgaggcggatgttgcgcgggatcatccgagcgagcctcgaccggagcccgacggcggacaggatgaagaacacaatgccctccaccatcacgccggcgagcgccgtgctgtaagggattgaacccgagccatggaagccgaccatgttgtaggcgaagtaggcgttggcgcccatcccgggagctagaccaagcgggaggttagcgagcgcgcccatggcgaaggatccagccatggcggcgaccgccgtcgcgacgatcaggtcgctcttggtgcgcccaaggcactgctcgtacccggggttagacccaaccgtgcactcggggccgggcacggccgtggagttaccgacgaccaccggcgtgcagtcgctcacggtgcacggcccgccggagtcggtgaggatggcggcgttgacggagatgatgtacgccatggtgaggaacgtggcggcgccggcgcggagctccttggtgaatgagctcttgcgcgcctccagcttgaagtacctgccgacgcgtgtcgccgccacggcgcggttgacggcgtcctcggcctcggtgagcttacgccatggcgatgacctcttcatctttctttctttctttctctctctgtgtgttcagcccctattcgtgtcgactcttaggattaggagaggaggatctcttcttcttataggcgcgaatagagctaaagcttatttgccttgaacagaatgttttgggtggtgggcccacacttggtgtcctttgctgggaatggtgccagcacataatttaataggggccacttttcagagagctaatccctcttatccaaaatggaactcatcatgtttgattttttttcatgcagattagtgtgctttgacgactactgccgtatactgcatgataccacgagccatgctacgaaacattaatatctccaatctcaaaatattgatacttgtctacatacataaaataaatattattagtatatgttttaggacggagaggtagcttactaataatatgcaaaacaatactaatacatataggtaaaaagagcttacttctcgctcacaatctttctataatctttgaggtaaggtaggaaattaaggtgatatcgtggagcatcaaaggaacactgaagttaattaggagtcaattttgtaaaaatatagatactttgattaaactattgcaaaactacaaatttaatgtgcattcataaaaatacaaatttagcaataaagttataacaaaactatgtatttaaagaaataattatttattgtctatcaatcaacttaatcctgtttttccaaatttgtttatttgaccttgtttttttttcaaaattgaagataaatattaacttattctgtgaaaacaagataatcatgttaacaaaggggcaaattattttttttactcttgctcattaatttgaccatgctatataaaagtttttttatttgattctttgacatatttgtaataaatttagcatagctttgacaaatttagtttcaatttgacaaatttgacaaaaatcaaattaagaaaattgtacataattatggcttaaaatttaatagattcccacagcaaattgtctttttttttgtccattttgaattgcatccaatgaagaaaaaacagcaaaaagcaaaaacaaagttgagagccagtccaccgtcgcccatgctccctgccgcggtgccacctctccctctgcacgtcactgccaccctgctcccttcacacaccaccatcgatccctccattcgccgtctccgccaccaccgtcgctccctccgtgcgctgccacctccacttccaccgtgtgccactggccccgctccctctttgcgttgccatcacgtactccctccgccctggttaccatctgctacgccaatatccagagatgctggatgagacgaatagaggaaaaggaatttggggatagtatgtcgtgttcttagaggccactttgtcagtttagcatataaattcatgtttttatttttttctaaatgaaaccctgacattgtttgaaaatagggtcaaacggcaagtttgattttgaaaagggggggttaaataagcaaacttgaaaaatagtggttgagacatattttagatggaggaagtgataatttatctctacactataaaatagtgtagtattaaagtgagccactagacattaatgtctaatgctactcatctacttttttttctcgtttctagccattgaataagtagcacttcatctctttcccgttttctcccattcttgcttcctacgtattaatgaagagcatattagttattatattctaatggtccaacaaattcatattagttttattctatggcttaataaatatttttagatacttgccctatcctaatttctctgtaaaaaataatttttctatacaaggaaccctatagatcgcagatgaacagtaactgtcgcatatgcaaaaattgacatccattttcatagaagggaccttaaaaagagcgcatgcaaaaattctattttcgcagatgggcatgttaaggggccgtctgcgaaaatgagcttattttcacatgcggtcctcttaatgggccacatgcgaaaattgcagagctcttaagtggtccgcacgtaaaaataccctctcttctcgacaaatttttttctccctctactctcttttccctctcatcatttcaaaatttttctaactcctctaccatctctctcttcctctcctctcatgttattcactcctgcctctcctcagctctcctctctctctttctctcttctctctcttcctctccgagtggagcgggcttcggcgggcagggagagctgcaacgatggtgagggcggcggatccggcggcgccccctcgagagggctggattcaccgccctcgtgagcggttgcagcgacggcggacaatgagggcggcagattcggcgtctccatcctcgggagcggctgctgtgacggagggtagtgactacgtcgacgacgagggacactagacgaagttgattttggagttgagatttgatgagaatgtattttatatctacgcatatatatatatctctagtaatttttcatgaatttacaaaaactgatatgcatactactctcactatctcttagctctattatggcgcatatatcttatctatcttgagaaagccaaacaagtcatgtcctcttttttttagaagggtattttttaccaggcctctatatcctctctagaacctatcaggggagaaaaacgaaagagaaagaagggatacataattaagcgtgttttcgagtcctaagacgtaaaccactgagagacgatccatcgtgttcttctgtactcatgttttgtttatagatatggaataattgtatctaatggatgctacagtgtaaaacaatcatgtctttacagaatcttcttatcaacgtttctatttgtattgccaagcatatattatgcaacatacgtatatgactttttattacaacaagccaaaaattctaatgaacatgccatatatacctatgtttcgaaactcatcagcagacaaacattgcgagatggtactccccaataaaataaaataaaatatcgcgaattgacattctccgacaacacgaggacagtgtaccttttaacttgtagagaacctgctattcatttttgcgcatatatatacaaagcgttgacataagctgtaagcatcaggctaacatgcaaagatacgctatgattcattttgaaaaatgcgacacaaagcaatgtcaaattgtgtctacaacgctcacacctaggttgggaatctggaggacgcacatcttaatgtgattagtgcgacattttagagagaatttcttgttcaatatccgcaactttaaacatcaccaaaataaaatcatgtgatcccatgttggagagactgcttaatttgtcaaaaccgtcatacctttgttccctcatgcatgatgtggatgttttggagactttctgtaattcaaaacgtcaaaccttattggccaaatatgctgtcatacatcagttctttttaccaccgtatgttagaacacactacaaacgttatacttcgctctaggacaccacaaaacgctccctatttatgtcatagcataattcatcaattaatataaatcattttcaattcacacttatctccctaccctcttccatatcctccctccctaccatctcactcttagacgaccatcgcagtagcattagcatatatagtctactatctccaccagactaatttacaaacttggcctgaaactctcaacccttccctttctaacacctccatacaaaacgattcgatacacttctactctacattagtatccctcattataaatctatacctatactaatcagacacttttttggagctctcacgttaatcaggaagatcaagccattgattaaacaaaccataatatgtcaaccgttgattacaatctaatccaagttccacgcggtgggtcttttaaagcccatgtaacctatattgtcaagcccatcgatatgatccattcacgcacgcattcttttttctttttcttttgaacttgggtatttgtttctttttctaaaccgatgagtccatccatatttactgagatcgatctgatcagatgcagtggaagatacgggagggcacagcatagccatcgcgctggccggcagtggcaaacaacggagaaaggcaggaggaaacagtacatacaagcacatcgtatgccagttatgttctgctcgctcggccgcggcaaaggcgaatatatcaacgttatcggatctagcagcacacaatcactaaggcgaggttgacgtgcggccggtgagcgccggaaaagcacacaacgtcagccgaatgctaattgttgttttctccattgttaaggtttgattctaacttctaatttccagttcaattctctttacatgcatacttctcatctgtcacagcgtccaataggaattaatctacgtcatcaccatactgtatatatttttgatgttcagatgttgattcagcatcaacaagttcgcaatcacctgacaagccaatccatggtcatcgtaccataataattcatagaagtcttccatctatttgctttgacaaattcgctggcatttaggaagatccatagtggtcgccgcatgtactattcatgtaagtattccatcaatttgcatagtctaactttttatctgtatttgatctacttttaccattcttcttatattcactctctccttaaatataagcgatttcaagagattaggaatgaaggaaaaatgaagataaagtttaaaaaggggtgaaggggcagtagaacgatggttagggataagattgatcgaaaaatattaaatgagaggtggctttacaaagttctactcttaaatcccttatatttgtggatagaatttgaagtctaggatcaaaaatatttgtggatgaagggagtatatttgttttaaaatgtatttttttcctatgtgatatgaatttgctacccttattattatattgttaaaaacttttttcatatttatgttcaaaaatatgttcggactttcctaaactatccccgcaaaaaaaaactctctgtatattatttagttgattttttttgataatggaacgtaacattccggcctttactcaaatagctacagccaattattacagaactcacacggaaagtttacgatagcagaaacaaagctaagcaaagacaaactaatagacaccaacagaagaaaaagatcccctaactactgaaatctattagagaacctccacctgatattggcaaatagatgcataattatattatttagttgattcatcataaattttgtgttatacaggtggtcatgcaaaggcaaagggcatggaaaaaaacaatagatatgcatgtgcagtttttttcgataataatgcatgggtggaaaaaagcaatagatatgcatgcgttgcttcagtaatatacatgcatgcatgaaaaagacaaatggtgtgcagtgaaacatggtttattttcgtccctattttccaaaaccatggaaaaaagaataatcccatgcattttgctgatcctactttatcctaacatggcacacaatgaaaaattattggacacggaaccaatccatattaacattatggtaggacagtacagcagagttcttgatttggctcctagaactaatccattaatatttatacgtagtacatggtttcctcttactatatgttaatactatatgttatttgattttgatcctttattatgccatgttctcacgataaataagtatatatatgtgtatcatcctatatcactataatctgttgtatgtttcatccagttgaacaatttatgttttcattgatattcattacttcagaaaaatacatcattcctccaacaaattcagatgaagtacttttcttttaatcaatgttgagggataaacatgactaaaattgttttatttattattaatctaataatagtatattgggacattgtattaagaaaatatgccattggaagtcatactcaaaatgaattaaaaaaatatgaattttatcgttttaagtattctattgattaggaatcaatatttaacaatgtatatttcataaaactcttcttttaatataatctaagagccattgtaattagaaaagaccacatattcatacataactaaaattttaatatttatgatgatataaataaagagcccgtgcaacgcacgggttgacggctagtgtttactaattccttaggcccaagctagctacaccattggtaggcactatactttctttgctataaggcacaacccatcaatacaaaattaagataatttttgcaattcatataatttactattcacagctagcccaaatttccatctgcctgtgaagatggctaaggccatcttaggatcatagaccatatttgaaaacctatctctgcaggttggttcttaagaaaaccatccagaagaatagggacactttcgctaagagtttttaaggatcctcctatgaaaattatgatttgtagagatggtttcttaagagaactactcgtaaaaatatgatgattttcgcacatggttctcttaaagaaggatctgtaagtcaattttaaacagaagttcactttaaggaaccatacttaaaaatgggggaaaaactatttcaaggcaaagatatataattctttcatatgaagtaggatgatgaaaatttcatatggaggcaacttgttataaatgaacaatcatattaaaataaatatcctaataaggaatatggatacgaccatatgaaagaaaattttgtatgggtcatatacaactctggtttagcctcagtaggactttaaataaatttcctataaatttttaaagtttggttatttcaaaagaataaggaaaaacgtttcacaggtgaactgcgtatactaattggttagtaaagacgattctcctaacaaactgcctttaaaatgaaaagaagacccatatttttctaaaaaaaattaaacacgcatatgaacttgtttggagattaaatctatatgcaaattatatcactcggtcagatttaaaaccttttagttgaatgtgttttcatttgatatcgtttaggggcgaatattcatcacaagctcagatctactttttaaaaaatgaatatttgaaattttcaaaagacatcagatggaaacatgctctacaccaaaattgtagggcttgacaacatctacaactatgtcattgatgatctttttatttgattttgatgttactaggagtaagtgttgcaggttttaagtaccgtgaagtgaaaagaatttcatctatctctaattatcatgaagttctcgtaggtatagaacctcctatacaaaataactgtgttctagaagccctaaatcatatatggttcatacgccggtacaaatcggttgtaaatatgattttcccagtattgtgtaaatggttgccttggttcatagtatgtctagtatgattgggcagtcattcctctttttactgtaccaccgcactactcccttcgttctagaatgtaggaacctgggacatcatctagtccaatcactacgggagaagtgatctttgcaggtcggctgattttcataataatcccggttctaataagaaccgggactaaagattgtttttagtcccgcttaaatttttttttgatctctagtccttgttagtatctttagtcctggttcatcccctctcagaggcctgtcagggggctgaggatctctagtctcggttggtactaccaactgggactaaaattcaaccagtcttatataatccttaggacttatcctcaaatcctctaccgcaaagtctttctccccatcttcctcctctctccctctcctctctctcttatcctctcctctattcttgctcttatccactctttccttgcagaggcggcggtggtagtgaagaggcagtagcgaagcggcgcggggccggcagcggcggccggcgcaacggcgggccagcgctcgcggcaggcgggcaacgcctctgagacttttttttgagaatttgtgtttcggatctgagatgtatttgatttgtgtgtaatgtgaatatatgatgtatttgtgacgaattttttagaatttgtgatgtaatttttttaagaatttgtgatgtatttggagatgattgatttgaggatttggacaggatccttttgatctgtgacgtgataatcgatttgggatttcacgatttggggatgattgggaatggagtgaaatcaatattcaatgttaaaaacaatgaaaaaaagaaaaaaaaaggagcaaccgggcctagcctggcttcatttttagtcccgattggtatggatttttactcccggttatttcacccggaactaaagatgggcatctttagtcccggagtcgtagtcccagttgtataaccaggagtataggggttcccaatcatgtctaaagcccctttctccattagtgaaatctgaatatgacccatgttcagatatgttgaattaggtgatgtctactttgctatattttagaatggaggaagtatatcaagaaaaataaccacacgatcatctaccgtgcaaagccaacttccaccttttcagcactagttatctcacctccctgttgctagttgtgtctatctctcctatgttgtctgtggctctgtggtattttaattttacaggtaaagtaaagtatagggaactagcacacatgagacagctcggtgtggtagttggccaatgtgggccactggtaaaataataaatgtttacatggggaggatgcatagccacattgttgaatgccatttagcaaattatggccacgttgttgaatgtttattagcaaattatgactttgacggtatgtttcagcaaatgatacccaaacaaaatttcctccggatatactcatccattttctaagatatgacaccgttaacttttagatatacgtttgaccattcatcttgtttaaaccttgttacaaacataaaaatataaatcatacttaaataacatttgataataagtcaagtaacatcaaaataaataatagttacagaaatttttataataaactgaatggttaaatatatctaaaaatcaatggaggtatattgtttaacagagggagtatcaataacgcaacccaaaatagtcaaacggcagcattcactttggttaggccagtttcaaccttttttcatgagtggcttgggcaacgaagaaaatgaatccgaaaggtgatggactcattgataaaatttacgagctttatgcccttctgcctaatttccgaatgacttgacctaatggttaactggtaagtaaacccctattttcaaactaacaagcctaaaagggacatactatatgactgagcttaggcaaccaccatatgcacctacctaagcaacagacaaatggccacaactgtctaggaaattagcctgcttgccgcacatcatgtggagctagtgcattagttgagatgcacaatcttgcactaatcaacaattaattaatctatttttttgtgttataaactatggccatgtagatttttaggaggaagtaagtgatcttttaataatactgtgtggacaatatggttaattaataacctaatgcatggacaacatagttaataatttaatgcatggacaatatggttgtaataatttaatctatcaactggtacgtgcgtgttgttggttgctctgctgtttcggaggttgcggcctaagctggatcttcggctcgtgaacgtgatcagacgactttctatgtacgaaatgtcgttttaatattcgccaaggatacttagtgctagtctggctctaatcagttcgtattcaggtcagaattcgtcattgcagattccttcatatatatcatagtccccgtgcacttaaacaagacagcaaaaatatggtggatcttttcggttggaatgttgaacatgacaagtgcatacctgcccagctttgcatacaggccagttgtccggatactcttgagcaacataaagaaaggggtcttcgtgtgtagtgaaagcttacttgttagcatgaatttgggttttatcttctcctagatagaaacgtacgtggagttgtgtgtgccgctatatcttcacattaattattataaacccctccaaaaaaagagaaaaaattaaggcacttgattgccctcactgtacacccgtgtttccagatatctcacaggtatattatttgtgttcttttgatccatggacccttgttttttataatatttatgttattttaaggcacctgatgatgtaaaagatacaattgcttaatataatttttgtgcatttgtatggttcattttagggatgagaatgtgtcggataccaacgggtgcatccgcgacatttcttttcatttttcttatcgagaaacagaaatacatacaaaatatgaaacc

SEQ ID NO: 23732 - DNA, 44019 bp, Oryza sativa
aatttggaaacgatctagctacgtgggaatttttgattttgttcatgtgtttatgcttgacttttccctgtctgattctgaggatgcacgcagctgtgaaagcgcattgtgacgggacgaatcgaagtgtgacgattggaaaattacgattttttatattaggtatagatatagaaaggattgaggagggaaggaaactgtggagtgtggacacaatcgaccggagaaatcaactctcctttgctcatgaccgaggcagactcgcttttgatggacgaacgctggcggaagcagaaaaaaaaaatcaatacggacacgataggacgaaatcgtgacgaggacagacgaaacgtcctatgaatatggaattatttttaatttttataataggtaaagattatgataagatgcatctagcaatcgtaaatggattcggatgaggtaccaaaatcttgacaaaagcatcttcaacttttataatagtagatgttttagtctttttatctctcgtctagatttactagcatcaattagatactatcacccttacaagtcacttgtattttcacattcacccctacaacttaattaggtacaaagacccccataactcaatttcccttctaactttccctccatcagaattaattgatctctcctcgtttgctcaatttctcatgatttcatcttgtttgtcccagtttctagtgacccgtgagcctccatgggagctatgtttataggggtggacaaaaagctcgggctcatgagcttggctcgggtttggctcgagctcgcgaagctcggcttggctcgaagactaaacgagccgagcccaagctgcctcctgagctcgtttgtaaatcgagccgagcccaagctagcttgcaagctgctcggtaggcttgtcaagcttgtgcaaaatctgacctggcccattaacaggtctggcccatgagaaaccctaacctattatgcgtacagcacaggcactgaggcacagaaacccttcccttcccagttcccacacgtccacgccgccatcatgagtcagcgatggtcgagggcgaggggcatctggactgggcgacagggcgtgaggaatcgagggcttgagggcctcaccggcgccgccggccgccggccgccacctccctcccctgcactgtcggccgccatctccctaccctgcgccaccggccaccgccgccgaaggccgccacctccctcccctgcgccgccggccgtcgcctccctaccctgcgccaccggccaccgccgccgaaggccgccacctccctctcctacgccgccggccgccgccttccttcactgcgccgtcggccgccgcctccctccctattcctagaggccacgccgctcgacgccctctgtgccgccggcccgcttcctcctccccgtgcgcggctgcaccgccttcggcctccctcctcagcgacgctcgtcgacagttcaagctggctcgagctagctcgagctttggaacgagccaagccaagctgcctttttgctcgttgtatttatcaagccaagccaagcctgtccctgacaagctttcacaagccgagccgagcctggctcggctcgtttccacccattacaccatgacacaatgacaaggcgagcacatttagggcatgtttagttggcaaaagattttgcccctgcaatgtcatgtagaatatacggacacatatttgaagtattaaacatagtctaataacaaaacaaattgcagattttgcctagaaactgcgatatgaatttattaagcctaattaatccgtcagcaaatatttaatgtagcatcacattgtcaaatcatggcgcaattaggcttaaaagttttgtcttgcaatttcctgaagaactgtgtaattggttttttttgtctgcatttaatactccatgtatatgtctaaacattcaatgtaacagcatgaaaaattttgtttgggaactaaacagacccttagaaatggtgatgggtggaagaccagaagaaaacgaggtggaagtttcttacatgctactaaaagagtactactccatccgtcccaaaataagtacagttttaacacttttcatgctcaacgctcgaccgtttgtcttatttgaaaaacaattatgattagtatttttattgttattagatgataggaattcctagatgataatacatgaatagtaatttatgtgtgactaatatttgtaatttttttttataaaattttcaaataagacagatggtcaaaacgcgggatacggatatctatagctgcacttattttgggacggaggtagtatcaaatttgaaactgactttactgctttggattttggacccttcaggacttgaaacattttgggacatgtttgttgttgtgatgttcaaaattcgaataatgactgacagttaactacacaagagaccaggctgagttggtttccaaattttcccaactcacctctctcttttttatcatgactgaaagatattggtttgttttttaaaaaaaattctatacgaaagttgctttaaaaatcatattaatctattttttataaaattgattaatatttaattaatcatacactaatgagttgctccgttttacgtccgcaagggactagttcccatccacaagtgccgaacacagcccatgtgtcatgctgcacccttgcgctatgattcctatcacaccaccatgttgaaggttgacatgggtcatgagaaattgagcaaacgaggagagaaattagtgaaaaatgaagggaggggaagttagaagagaaatttagttgttaggggtcttttatatctaattgagttgacgaggggaggatgaaaatacaataggggatatttggatttttccatatgaaattaagatatatataaaacacgatcccttttaaaatacctaccaccacacgtagcattagtagtgtagtaggatctaaatccgaacattgattattatggacattttaggttttttcttaattaaggtggaagggtattttagtgtttttgttgtggtccgaatcggtcgaaaagatgggctgctattgatcggccccagccgccctactctcgcgaaggcgcaggacgccgctgctcttctcacgctcatgcgttctcgcgacttccatacatcgtcactatgtgcgatagggtcagctcctacttttcctgtactagaaaaatgaagcttgcttatttatcttgtgatttttttcctggagcacatgtatactttttaaagtaattactttgagactgataaaatctatgtaaatatcatatattaaaagtattattcaatgtgtacttggatttatgtttgtagaatacctaggaagaattatagcatgacagtatacacaaaacaaacaggtgaatttcgtctcacttttgtaaatttaaattttgcatataataaaatactttttatttcttgctatttttctaaaaaatgttttaccttttctataatatgggattaacatgtttaagttacatgcttccaattttaacatatcacacttagcactaagggcatgaataacggtacaatcaccgtatacgagagaatgccattccgtatatattttctaatgtggaggtgagtgagagaagagagagatgatatgtctgttaattgctagatatatatgctacacacaatattttagacagcttaataccatatatgcactccatatacaaaatatagaactaaatttataatgtaggtaacatgttatatgaattctcttgtatatcatgtaaatatgttgtgggactattatagggcaaccgctctctaaactatttatcatgttctttttggatattgtgcaccaacatcctaaaatagtatgtaaatattgaaatattagtagaattactattttttgtcagctttttatatttgtttatacttatcttttttatacacaaattttattatttgttgttttatttttaagtaatatatgaatattataacccaatctaagcgtgtgcatttttttctttattacgttgcaaactatatcgtattctcttcttgagaaacatatgcttttaaaatggcattgacactgaaatttgatcattaatattcatgcaaattatattattattattattattagctataaaattaatactaatttaacgtcacaataattgtatatgagaccaatatactttgattttttttattccaagcatgttatatgctgcagtactcacaccaagggttcagctcgactcggctagcacaggcgcacagcacggccgaatgtggttagctgggatgagtgtgtttggtctagatagcagggacggcaggcgagacatccagaatttgcttgttattttttgttttctcccgcaccaaaacagcagtaaaacagcagtatatgcgtgtgacacaatggcggatttagtggatggtcccacccaaaaaaacagcatcaaccccactataaaaaatagcgactattaaaaagaaaaaaaaagcgatctattctactccatccgtcccaaaataagtagttttgcactattcatgtctaacctttgaccgttcgtcttatttgaaatttttttataattaatatttttattattattagataataaaacatgaatagtattttatatgggactaattgtttttaatttttttataaattttttaaataagacgtacggttaaacgttagacacggatatccacggttgtacttattttgggacggacgtagtatttctctttcctggcgcctggcacgcacggcccataggccccacacgcgagttgcgcgtgtatcgaattgatcgacgcgactctctcctccccctagcccgtagccctagcgacgacgcgatcgggatcggcgatctctgagactctgatctcatctgattttctcacgccacggccacgccacgcgattacagttcacacttcacagagccacgccgccgccggcgctcgcgcgagcgggcgcccccacgcccacgccgccgcgcgcgagtccgcattccgccgctggatcaaatcaagcatctcctgcgtacagtagctgccagccatgatcacttgtggcagcaatactttgagggcatctcgatcgttttcaggacgtctctggcttgacagctgagttgagattattcaggttgatctttttgcttggttcagatttcagacccgtcagactattcaattctgttttcctactcgttttacaggttctgaatttgccaaatgccgaccaaacgaactcaacatgacgtgattttgttggatgaagagaacataatgaagactttcatggtcattagaagacatagacccgataagaaaaaaaaaataatatggtaattttctttagactttcatagccatacaagcttctgtaaatcaaaattttacttaattactagttttatctatgcttgcattgtacatatgtgtttaggaaaaaaaatttaggtcagaccacccatatcctaaatccgccactggtataacaacccatttgcccaatgctttaatgacacgtggcataaagttaaatggtaaaaatggaccaatcagagataattagatttgcgagaaattggtgctgttccatagcactcgcgagagatgtggggttgggtgcatgtgcctgcattcgttactgttgccgctggtgaagttggtgatggcaaggctcttctgtcacgtgccactcaggtatctacatggctttagaagattggactgcactgagacctagaaccttccgcagggtatttcatgaagtatcagatacaaatcacacctaaaacggattagtgatatgcccgtgctaaacactacggtgtaattttaattttctttaaagaattttaaaatagcatgttaccaaaaacaatttcttgtatgatctatgcagttgagtcttaatctaatttatgtcgtctgtcaaatatattcatggcaagaataatatactgtgtgggtttaatagaacggattttcgccaatatctatttaaaagatgcattttcaaccctctaatttaaatatttaccaaacaaaaatcaaaaggttgaaagttttaaaaattgaaatgaaaatttaaaattttcaagtacaatttttcataattggagtaaacaatttaaacttaaaaagtggattaaaaatttttatgtgcatgaagatgagcggcgagtggtgacgagatagataaggcacacgttggccgctatcctttgagcacatagcacaagggcatgaatgtaaacccaaataacagtttggtatgaaacatatgtcaacgtaataatagcatgttcgtgctaatgctactgcggcatttggagcaacgactactataaccacaaattcacaaataaacaaccatttataacacaagaagttcatttaaaaaatcatatcgatggtgttcaaatccatacaaagattattacaattttggtcatttactcattgctacatttcatcaaagctacttggaaaaaaatatcatcttccaggaatcaagacagggatgaacgatttcatatcactggaactttaacccatgtctcacccttttgctaatacttcatttcactcttcacaacatagcacaactactgcactttagctaaaaagaacttctcagccatttcacaagttcacatgaacagaacaccatgttataacgaagcagccatttaataaaacaccttgtaaatgttataaccaataattattgatcaatttgtaatatatactgcaggaaactctggtatggtgttaaaaaaatagatacgcaaagtttctagcagcaaattaccttgttgcaatttacagggagaaaatgataatactcatggcaatacctcagattgagggcaaattaccccgcaacaggcattggtattccatcaaattttatgactgcaaaagaataaaaaaaaacttagctttgatactgaataccatcatgtttcgttttctgcccctcaaatcatttgatctgaggccaagtagagggaggagaagaacaacatttgcaggaacaaagaatcatgcagaagaaattatgcagtaattatgaacatctttacatttgatttgagaataaaattataagcaaattatggagcggccagaatcatgtatgaatgatccgtagttatcaactgatctacgatacactaaagatgcaaaatgtatgatcagggatttgctattaaaaaaataaaatggaactggattcattgttttgaagcaatgcatttgctgctgaaatggggaggattcctaacatgaggtgcttttatgtttcgtgaaaatcataagatatccatggcaaagggagtaaaccatgaaggaaatggtaagaaatgtgctcccggtcccctggtataaaactcatttacagacatgtagagtcaagggaccaactttgaaaaagcttccatcaacaactcgccgaacaatatgataagcctgcacgttttctacccagggataactccagatgattcatatcatgcaggtgctaaaacgggtgattaagcacatatgcttgacttgtgattcatatttcatggtaaaggctgacttggattttgctaacacatacagacaaaattgttgcattatactacttattttcactgcattgctatcagaaaccaagttgtcgtttaatacgatacaaacaaggaattcaattccaaatccttttcatggaaggacaacaaaattgacaatgcactatgatgatgggtgaaaaatcatgaaatttgtgcaaagtcatgattgacaatttaagaaaaatagtgtcacagttgtcccggacaagaaatgccagggaagtgcagctcagctcagatgatgatgatttacttccaaacagcaggcaacacttgtctaaccgaaagtgcccaaccattcaactttcattctgaatttccgacagacgaccaaaagagagtaaccgcaaatgaagataatggagataaattacaggaaggcagtgcatctgcagcacaaatatgactcactaattcagacaaagaataccaaatcaaatgcatttgttcagatgatttagatgagacattcagatgtatcccttgtttcagagaactttgattctacgcaagtgctgagcttagttgcatctaaagcagagctagaaaggctaatgatcttttgtgttgttttctctcttggggaggaaaaagactaatgatatcaattcaaatgctattttgtcagtttaatcaaccacggttgttgtgttccgttcgaaccatcctttttttttctaatacttataactccatccactcagatcaatctcaacttgtttaaaaatgtgtacatccatcaggtattttagttgatgcagagacacatggaacatatattactcccacagatgtacacctacatagcgaaagtagtagaaagaactatccatgtgacaaccattaaaaacctgagaacaacctagttcccactgataatatttttggtcaggcaatgcagtttgaaaacgaacatcacttattgagccggtgtaaatgccagcgaactccaactaatataccctcttcctactatcgcaatcttttcaggttttgaaggcagatcaaataatgttgcatctgaatagacatgatctattcctagaatatttgccatggatggacagccaccaactgctgtgaagtaaagtgttcccatggtcatatcatcatcacctcaagggaaacaacattgcactgatgtgcaaaagaaaacatgcattttagtttcaggtgtatttgagtatgcagacagtaaaccaaatatgaaagcaagctaaaagtactaacttctgatggaaagtcatatagttatttcacaacatcctacattatgaagctatatatgaaatctcaaaaagctacatatggatggcagggagtttcaaggttggtggattccgaccacgcaccaaacattcattggtcttcatgatattagtaaattttgttactggtgactaactctttagcttaagcgctagaaaattcaatagaaaagctaaagatagatcatgaatttagtttagcctgaacttaaaataaaatgatgactaaaacatatcatcagctatttatcattccatatataggcaattcaattacagtttcacagaaacagaggagaaaaattaaggattttcagacaactacggtctgctgcaaattatatttaaaatagaaaatccattaaaaggtcacctctaatgtgcaaattctgcaggatttataagaccgggggataaggacataagtcttcactgcaggttacaggaagatgagcagctatacaagaaatcatgcaaattggaaaaaccgaggaattgtaggaaacctttccttcactcccagatcacagaaaagcaaaagaactcaccttcaatgtcatacaaggaattgtagtgcacctcacccagaaggttaaccaaagctatagaaaaggaacgaagggaatgatcaaataccaccatttttcattgggatagatttaccaaacccatgtgctaccatgaacctggtgccatacgattggaggtaaaaatatgagaaataattgcagtgtgtacaaacatggtagcatatataccttatcaagtgtaaaaccaacatatacttttgtattaaaaaaatcagcataagcatttacatgaaaagttcagcatatacgcatctacaggaaaccagagaggccttatttgtgtacatacaagatatttttaggtgacatgtctagtattcatttgaaaagggaactttatggcaacaataaccagcgcacagatttaacaaagaaaacacgactcatataattatgaatcgatacctagaatgacccaatagaacattcagtttatatactgaaaaggtaattcagtgaaaacattaagcttgtatataaggcaatacaacttctgactattgactaaaaaggccaattaatatcctgaacttcgcttctttttttttttggcattggaagaaaaagaagtatgtgcaaccagttcgtattagtaaaggattggttccaattaaatatcattttcattatctgtaaatattattaggtagcttgagcaattatttaccttgcaaaaaaaacagatcatatcattgagatgttttactgtgcttacaaagtaatagaggtactttcactttaaagagatataatcagcagtcgatcacctcaagtgcattaccaaatattgtcggacgacgcggcagtggcggcggtggcagttgaggcggaggccgaggaggaagtcgtcaaagcagcgctcttgacaaccgagtctcaagcaattcttacactggagcacgtcaacccttttgcctgatccatgctaattctgctgaaaacaaagaaataacacatatataccctcaacaaattaaagaaatggcaagtactgaagtaggtacttgacatatagagcaagcaggtctgaagtaggtaaattcggcagaatactggagctagtttatggtacacataaatttgtaagacttgatggagcaggccttcaatataatggtaaatgagatatttgcttaaagttgtcttcagctacaaaacactctacagaaaattatgctcatatacattgtaattaaagttgataattctcatggccaaaaaaagtgcagttaatgaaatgaccaaaggttgaaatcccaaaatttcactaaacgcaacacattggttgtcattgaatcactggagcatccaagatagaaatcacaaaatacatcaacctaccagcctcccaggtgtttgcagcaggaacacagggggacagggcactacctagtggttaccccaataacccactaaattttgcacaaacactcatgttcttaggttacagttcttgaagagtagttttgctgttgatcgcgacggagattggggatccgcagtaccggtggcgggataacacgacggcggcggcgcgggcaagatgcagggcgacgggacggtcggcggttgaagagggcgaggcggggcggcacggcgcgacggtcagcggtagaagctggtgggggcgcgggcgagattagggttaggggagggagcaagggtgagagcccctctggaaagaggatggtggaattgcaaagaggagggagggaggaatctgtggcggaggggaggagaccggcggtgagtcggggcgaggggagtcgatcgcgaggagggcgagaccgcaagagtgcggaggaggggggcgacggaattcagggagccgaagatccggaccattacacgaggaatgaaagaataagcgatgagtgaaaccatttgttaaactatagggttagagaagatagtaattataggcaaattttgctacagggcactttgactttgtggttttagctgtgggacatcgtccgaactcacttttggagaaaaacactccataacgtggtaatttgccaatcgacattgcgctgattagaataataatttccggttggagaggagagagaaatcgcatgaaatggccaatgcgaagagaccagctcttgcacgccggacgtcaaacgacacgtttttcgccgacggcgctggtcttgatgatcgtcgcggcaggcatggcggcgtcgtcgtcgcggcgatcggggcttctcggcgagctgccgccgggaggaggactgtgtctttttgcgcctcgagtgctggtgatgatgctgatgcttgtgcctgatgcctctccaatggctgtggtggctgtcagccttcctctccggcggcgtcgatgtcgtcgctgcggctcgtggcgtcgccgtcgagttcagtggtggggccagggcgtcgatggtgccgtttctgttgctctctcgtttgctcgggagcgtcgatgatgccgtgttggatggagttcttctcgccaccccttctccgccactgcgtattggtgttacggtttcctcctgctgttcctgtgatcgtgtgacctcctcggcagcaccgtcaccgacgtcgagtcgacgacagccacgacaggagtgccgccgccgccgctgccgacactcccgtcggggaagggaatgaggcgtccgcggtggggccgctagcgaaggtcaccatgagtgcgacggagaagcatgccagcacggccttgctaatcatcatcacatggccgtcgccgccactgccgccgtgcttactgccgccgctttgtaaccgttgagcaacaatgacgatgaggacggggagaggaggccgtggagctgcacgtgtagcgacccgctactcccgcctctgccaacttggtccagcaccgacaaccatgccttccttgctatctcacgatggcgttatcttctaggagagaagatagagagaagagaagagagataggagagctgacgtgtgggcttaagggtattttttatatttcgcgtgatttctatctcctctttaatcggaaattgttattctaatcggcgcggtgtccattggcaaattaatgtaaaatcaaaggtgtttttttattattctgtgataaacaattggcattgaagattattggttttgttatttggaatttattcacgaagtggttttggagatgattggatttataggtaaatcgcagattctgttatttcatgtgaccggtcagaccgggcagtgtgtgccggttagaccggcgtgtattgcgcggtcagaccggcgcagcccgcggtctgaccgactgactctgtgtcagtttcggtttcgggttgtttgtttggatatccgtgattgtttcatgattatggcttctagatggatactatacgtatgtaatactattgtttgctactaatgagtcaagttggagatagcttggtctcggaatatggtttctttgtttattttatgtgtaggtgactcgatgcctcgggagagtatttgcggtgatggatcgggagtcggcttggggataagacgacatccgtggtggttagagatcacgcgggatacttaggctagagttgatgcacgtggttgatggagattccatatggcatacgatggaggtatcgtgtgcgtatgggatacggagttgaatttggaaggagtccaaatttgatatgattggttatgtaaagtttgtgtcttgtactagagggtttcctaaggtgtttaggacttctaatatgagtttggttcgtggctttaggctgcctacctcgggtataaatagaggaggagcgtgatgcttccctgtatcgctttagagagcaattgagttgagttttgagttggggtttcgagtttagtcgaaatttttgtaaggagtgctattggtgcactttgtaaacacagagagaatcaatacagtcgtcatccactttaagagttctttgatttgtgtttcatcgggtttcggcggtcagaccggcggcgggcagcgatcagaccggcgggagcgaggcggttagaccggcaacgacgacagcaagcggcagctgatctcggcggtcagaccggttaatctacatcggtcagaccgacgacatctgagtggtcagaccggcatagcaacttcggtcagaccgatctccgtcgaattcgagggtaacttttatttccgctaaaagttttcggtttttgggtataccaaccattcaccccctctggttggcttagttattgtgattcgatgctacaattaacacgtttatggagtgttttcccccaaaagtgagtttgggaggtgtcccacgactaaaaccatgaagtcaaagtgtatgtagcaaaatttacctagattgtaccatacatcaatcacatttttttttccagatgtacctttcactacccaatactacaccatctcatgtatggtacaaataaacctcatttattggatctaatataattggtggttcacattcacccgagagtacttacaaaaattctaaaacgaaaccatcttataaacgtgcatccttgcgagttgcgatggaagttggtcatcactagtctttttttagtcacgattgaatagcgaagtcaacaggtttggtccagtacatttatcttcatcacaatcattaagaaaatggaaatgagacagatcaacagtcaacgctccaccttctcctctcaactctcttgctgagatcctgagacccgacttttcacgctgatatcgccgccggcagcgcctgttgctgctactcatggatgtggtgggggcggcgtcctggctggttcaggtcgtcctggagaagctcgtcggcgacggcatcgacgccgcctgggccgcggcgcgcgccgggggggacccgggccgcgcccacggcggcgacgtccgccgcctcggctcccgcctccagagcctccacgccctcctctccgaggcccaagagcacgcgcccatggcacgcaggcgcagcgaggccctccttcgctctctccgtagcctggagagcctcgccaccgatgctgacaacctgctcgacgaaatgctgtaccaccaaatccaccgacggctacatccggacgagcctagtacctcctccaactcttgctcctcattgtttgcagtccaactagtggagcccaataatcgcgttgccaagagggtgcgccatagtggagatggcgataccaccggtagaattaaagacatcctagagcggatgtgtgaagccggagatgatgttcgtgaggcaatcaagatggagaaactggacgtcagtgccgctgggggaggccaagatgatcgtataattcaacggaggccaacaacatcttactccactgagccaaaggtgtttgggagggacaccgtgaaggatcgcattgtggtgatgttgattagctcagagacatgtggtgctgatttggcagtccttccaattgtggggaatggtggcgttggtaaaactacactggcacagctagtctacagtgacacaagagtgcaagctcaattcagcaagcgaatatggatttcagtgtctgttgacttcgatgaagttaggcttactcgtgagctactcgattgtgtgtccaatggtgtcaataagcatggtggtatcactaacctgaataagctccaagagattcttgaggaggatcttaagtccgagcggctactccttgttttggatgacatgtgggaagacaatgataaaagccgttggaacaagctattagcacctctgagatgtagttcattgaggggcaatgcaatcttggttacaacaagaaatcactctgtagtaaagatgattgctacaatggatcctatccatttggatggtttggaagatggtgacttttggcttctgttcaaggcatgtgcatttggtgatgaaaaatatgaagggcatccaagtttgcaggttattgggaagtgcatagctaacaagttgaagggttatcccttagctgcaaaaagtgttggtgcccttttgaatagagaccttgatggtgggcattggatgagcatattgcaaagtgacgaatggaaactgcagagaggacctgatgatatcattccagcattgatgcttagttacatacacttgccttttcatctacaaaggtgtttttcttactgtgcattgtttcctaagggtcacaggtttgatggcttagatttggtccgtgtttggatatcacaaggttttgtttcttcgaacaataagaaaatggaggacattggccatcaatatttgaatgatttagtggattgtggattttttcaaagaagcacatactattctatgcacgacctgattcatgacctggcacatattgtttcagcagatgaatgccatatgattgatggttttaattcaagtggaatagctcagtcaaccattcaacatttatctattaatacaaggtatgcttataagtgggatgtatattcccagaagttttattcaaaagatgacttccagaggaagcttacttatgttggtgaaacagtgcaaaccaggaacttgagtacattaatgctatttggaaagtatgacgcagacttttctgaaactttttcccatatttttaaagaagtgcaatatcttcgtgttctgaggctacccacgctcacttatagcatagactatttactctctaacttcagcaaattgatccatcttcgctaccttgagctaatatccagtggtcctggtggacccttgccagaggttatatgtcagctttatcatctacaggtccttgatgtcgagtactgggtacacctctccactttaccaagagccatgaatgatcttgtcaacttgaggcattttgttgcccgtggtgaattgcacgcactgattgctggagttgggagattaaagtttctccaggagttaaaggaattccgagttggaaagactactgactttcagattggacagttgaatggattaagggaattgggaggatcattagcaatttacaatctagagaacatatgtagcaaagaggagtctaagaatgctggattaagggataaaatatacctaaaggatttgttgctatcatggtgtagcaaccgatttgaggtaagttctgttatcgaggaagaggtgcttgagagccttcaaccacactctgggcttaagtgtctaagtataaatggctatggaggtatttcttgcccaacatggttgagctccattaatccactcatcagcttagagactatctgtctagatagttgcacaaaatgggaggtccttccaccgcttgggcaatttccactccttagaacactgcatttgattcagttgccttcttcaagggttgtaccaactgtatccagtgacgactggactggttctgaaaaacatattatatttccatgcctagaagaacttgtgataagggattgccctgaactaaggacattaggattgtcaccatgctcttttgaaactgaaggctctcacacatttggccgtctccatcatgctactatctataactgtcctcaactaatgaatttaccacaatttggtcagacaaaatatttgtccacaatatctattgagggagtaggatcatttccttacatccgattgtttgtgcgagcattgtatatcaagggatgcgctagcccaagtaaattggatcaaatattaatgttgattgagggcaacctatgtcttcttgagaaattaacgattgagagttgcctcgatcttacatatttgccatggaaaacactcagcaaacttgtctctttggagatgctggtaattgtggactgcccaaggctttctttgactttatatccatataaccaagatgggggtaatttttctttcatgtcattgctcaacaagcttgtaatccgagcatgtagcattacagggaagcagttatctcacttgatcttacagttgcccttccttcattacttgacaattggaaagtgcccaaagataacatccttgttgcttggtgatgtgattaatgggagtgacagctcttcaacatctgattacctccaattgacaactgatggcatgttgcaaataccatctcatctcttaattcaacttcagtatttgagcatagatgactttccagatctggttctactctggaaagaaggcttccatggattcacctcacttcggaccctacacatcacaggatgcacacaacttctctcccccatgataacagaaaacaaaagatccaacaaaaactcttccctcctgccaccattactacatgaccttatggttactcatgtgcataatgagttgctacctttcttgctctcgaacctcacctcgttatccatatttgcaatatctaacagtccagagttaacatcccttgttcttcattcttgcacatctttagaaactttgatcattgagaaatgtgttgggctgtctgctctagagggtttgcattccctccccaaacttaagcatctacggatttttcaatgccctagtttggctaaaacatggggcccttcctcagtggacaggccaggtttctctttatatctagacaagcttgaaattgataccactgtgttatttaacacagaagtttgcaagaagcttccatctcttcgacatttagtgtttttcatggtaactattaacacaattagtcaataatttcgttggaacagataaacttgctcaatatacagtggtttctcatcacttcattttttgcaggcaaagaatgtgagatccttcacagaagaagaagaaaaagcactttgtcacctcacatctctccatgtacttgatttttgttattgccctaatctcctatcactgcctaaaatgttgcattgcctttcttccctgaagcagttgtcaatcaaggcttgtccaggaattaaatcattgccagaaaatggcctcccagcttccttacacgagctctacgtgagcagttgcagtgcagaactaaaggagcagtgcaagaagacaaaaaatgttagatgtgtttatgttgatagaaatgcaagcaaattcatagttatatgcaagctgctacgtctctattttaggtattattttacagttttaaaaagattagcaattttattttgtgttttagacactcgtggaatgggtgctctctgtataattgttttaactgtatcaattgattagtatttatttttgttgaataactggtattgctaacctcagtttattttttgccaacctggttcatttgtaggaaacggaagagatgagaaaaatgagaactactagttatgaatgaaccttcagtttctcaatttataaaaggcatgcctatgcttcgcttaattgattattttttgtcacaagaggaggatagaagatattactgatgaaggttcacatgcagatgaattcaataaaccttgtgtgcactcaaccattctgtttaatatagtagtctcctcagatatctgtaactggatggagcttgaaatgaagatgccatgacttcagcagattagttaggctgcttcatcaccagctggatcaataactactgtctacatgaagtcaagacaacacaaggtgtggctacacttctttgcagaagatttgtttcaattgcgtttgccattattttgtattaaatcatcttttcataacaacaaataaatatttatttgcgatacctgaagtgtccttgttctgactgtggaaagaacataggtgcaactgcaagtttgcaaactactatattatatagaataattgatctttctcttggaaacaaccactgtttagtatatgttcattcagtagtcagcacatcagtaaaataaaacaaaaaactatttagctgctatttattcttgtaaatgagggaattacgatattaactatatagttattctgatttgattttgtttaaggttttagcaagccgatgggggatttatttttgtgtgttttggaggatcaccaagctgggagcatggcagcgatcactatggctgcaatcaagaactgggggaagcaatgagctcatggtcctaaccaagtaagcagctggcagctgcactgttttactgtggtagtattgctctattctggttctgcattaccgatcttcatggctgtgaatagctaggaattttttaacagacaaatcgatcaccattgcccttctcttttccccttgagcattttggttaggtgataatggggaagtctgcactccgagagtgggactgggagcccatgccctttctgcagaacttatttgtctctgcacataataatatatcgtttaatttcttcagagtcctatttactatcgccactacagttgttttcagaactggactagtcatctctgaactctgatagcatgcataggaatgctggacagtgctatatatctcctttgattcttgaattagtgatctttttttccttcaaattgactgatgagttacttatttcaatcctgttcgacatcctacctttccactttccatgtcccattcgaatcctttattctgttgtttatttctgcagacctacttgtgtgctgacataactactttattgtgcctccatttcttaaatatcttcaagtccgtacatacacgacattttctcataaataatatattagatggaagggccaaaatgtttagcagcacatacttgttctaataatcatggccatcttagtagacgcttatttttttgcattcggcttgtactagtctaatacttatacttgcatacatttacgatagatattgcaatcagttgaactatgctgctccaagacagggccggccgtgatagtgtgcttttgcaatatggcgggctggcctggggcagcgttacagtgcgatcgtcctggctatacacagctatacatgcatatatagtttggttgctttgcgctggagtattagttaatctcacctttaaaaccaggccattaatttatccttatcatcactagtacagaaccttctatgtgtaacggcctctaatatgccttcagccgtcttgtcgatggcagttggttctctttaaacgtcctgagaaacctaccccaaaaaataagattacaatgccttgggctcccgtttgggccaactgggggtgccaacatgctcaccatgtggtgagtggtgggcctggcgagacccaacctgtccgaaacggtgccacggatccattcttgcccatttggctgtgtcaggtgtcgctgggcatgcacgaccatgtccagggctaatgacttagctctagtgtcttatctactacgccttttcgacttcagattggtgggggttccttccataaacccatttcacttatggcagagagcattgcttcacagctgggtgttgtcacagcctgaatttccgtttcaggatttataaattatttaataaactagaaaggtagcccgcgtacatacgcggcaactgggcacctccaaacataatatgagtgaaattttattataaatatttatgtgcaggtggatttttatcaaaatatttttattttattctaaactaaaattaaacttattttatgtgctttgaaccctgcttatttcttttacaattaaccttgcaacatataaattataaaataaaattacttgagatcgtgcgattttgaattgatgagaaaatattgtgtcgaaatagtggagcgattcttaagagaaaatttaggatattttaactccctagaaatatatcttacaacccaaaagaaatccaataatatcaattttttgatttattgtattttagtttttatattttcttttcattgcaacagtccttgtaaaatgtttgactttttctatttgcaatgggttttagatctagcaacatttgttcaaatttcaatttatgtcatgtccatttttatttttttgggagattttcattctataaaccatccttgaacttgaaatgatatgatctttgcaaatcgagacaaaaatataaatgcatataacatggcatagcgtaaaggcatacgctctaaatttctctcatcaaatattaaagtaatggtcatggagtttttagcaaatcatcactgaagtggagtatcttataacaaatacatgtttatagattgttctacactttataatttactgtagcatgttttaccaaaaatagaaaaatggacatggtatttaattattatatgaaattgacttgatttattgctaaggccaccaccaggttgtttaaatattaagattttttggtgcaaaccacacgcttatcagtatgatattcaactggacacatctttattttcaacctattatctatattgctagatgaatacttattatgattatgattagtgacttgatagatcatatgtgtaattcggatgctatgatcatcattcttttgaatatttatttatctcctaataagatcattttaaaagtaccaaggtcaatttgtatagatacatagccctcgtatgcatgttatgagaaattaattaagctggtagaaagtcgttagatgcctaacgggatatgagtaagatggaggtacatttgtgtttttttccatatagagaattttaatttcaattgccaaggagataaaaaacagagagaaaagaatggcgcacactgtacacgggcagagaggaaggggggtttggatttttttttctaaatgattaatctaacaacctaaaataatgtgtctgatgtttaagtcaaagccgatggtcaaatgttttgttttcttgttagaatttttaggattttttttacttaagaaaatgatgtaatatcttatgagcgttctctgatttaagagaatgacgaaatatgttaagagcgtttataagatgtgtaacggactttttcacaccgcatgccgcaaagaagaatgatggagggaaggaggttggatttttttccccaaaatttctaagatttttctataatttaggaatgtcatatagcagcttgagaagcgtttataagatgtttaatagattttaacgccacgctgggatggggaggaagggcaagaagtttaggttttttcttattacaaaaacctaacaaatcaatagccggatgctttgttctttttaaagattttctagtattttctctaatttaatagtaccacgtagcagcttagaagcgttcattggatgtttagcatgccagagcgagaactgatagacctagcaggtggaggtctatttatggtttttttaatgtagaaataattttgattttaatttcatatgaagatagctcgttcgtacctacgtgacgggggaggttctggatgtgtcttttttctgaaaaaaataatctaaccttctaaaataaaataatggatccactgatttaaatgaaaatcgatgatcggataagagtaccacttggcgacctaaaaacattttgtaagttgtcacttggcggcttaggagcatttatgggatgtttaatggacttttaagtatataatagtattttttctataatttctaagattttctttaatttaagaattaatgtcatatagcagtttagaggcgtttataaaatatttaatgaacaccgcacgggttgggaagggagggagagaggtttgggatattttattaaaaaaaatctaacaactaaatgtatccatcaacttaagtagaaatcgatggttggttgctttgtatttttaagattttctagtactttatataatttaattgtgccatctaacgacttagaagcgctcgtaggatgtttaaagtgatggaggaagagctgctagacctaatagttggtctatttgtgattttctgaaagaaaaaaaattgattttaatctcatgaaatagaaaataacagatgaaggaatagaagggaagtaccacagtagaaggaaagtaccacagtacgtacgttcgtatagtacatacgctaggaagttcgtatgatgccaaaactatgattttgtttgtttgtacattggttttggatgtgacttttcttttctaaaaaaaaagatctaaccatctaaaataatgggtccaccaactttaaaactagatggttggatttctcttatttattagagtgccactcggcgattgaagaacatttatagggtgccacttggcggtttgagagtgtttatagaaagtttaatggaattttagtatataatagtagatagattattatataatttatattaaaggttcattaatttacaagtgaagttaaatgtggaaaataaaatttcctaagcataaagcatggttggatttaattgatatttgtcgacgggggatacccgtagaccggatatagagggtattgggatacgctggtacgaggatctacgtagtacgacatcaagcaaacaggaaacaaggattatactggttcagaccccttgataggtaatagccctaatccatttgatatgggattatatagtggaaaccacagactacaaagagaatagcagaacttgatgataccgacgagaccgtagttgagttggctcgactagatcaccctggcgacttggttcctaaagactccgacttcgtaggctatggtggttgtgttggcggtaagattcgatcccttaggtcctctcgggggtcccttttataccgcaggtcagttggtctccaagtaggattcggagacatcggaccctacatgatacagtgacgacccagttctgtccaagtaggactccttccatctgtggactccgtgatggatttccttagcgtgtacagagaacgtccgtatacgcacaggtatgccatatcagtgtatgacgtatatccaagagtagagggtataccttatccgtaaccctgacagtagcccccgacttctgcttaaatgaactcatgtaactgattgcgacttcagatgtcggagtcgttgtcattctcgactggtcgatctcggtgtgagaacaccatgtgaagttcaacggtcataagtgaatttaaattgaagtccaaaaactgctgcgcgtaacggacccagaaatttccggcggccatctctctccttttcttggaattcgcaccgtcaatagtgcgcctatttaagggagttttgtggatccattttgaagtccgcctggtgcgaaaaactttccagcctccaagctttcctcgtcttctccgctcccgcaaaaagaaaaccctagcttggtcatcttggtcccttctccggcgatctccggcggcaacggatctcgacaagtccacttccaccagttcgtccctgaagaagctgcaggaagacggcgctctccttggtcgtgggactatggagagagaaccaggaggtactgaacccaaacccgtcctaggccgcatggttgcggttgaggactatattctttatggttttcttcctccaccttccgagtttcttctcctcgtcttgaatttctacggtctttctttgctccacctgaaccccaattctatcgccttcctcagtattttctcctatctttgtgaggcctacattggggtagagccctttcttgatctcttccgtttctactatgagttgcgctggatggaacctaaaaaggtgtccggatgtgtcggtttcaggcttcgggatggcatgaagtcgcgatacatccccttccagtgcccctcttctcgtagcaaatggcgggggaggtggttctatcttcagatagagaattcggatccagtcttcattgttcctgaggagcaaccagataagattcccgaatggaccaccaaacccgccctaaccccctcccttcagtctttcatcgatgtcattgatgacctccgagtacgaggattgttggggtatgaagtcactgccgacttcatcggtaggcagattcagccgccccaggcctgagcccacccagcctttgactattctgggccagaggacgcgacccgggtttctcctcggggtattgttctcgtatttcatattgcattctttatttgcgtgtttctcctgacttatcgagttccaacttctcgatcttataggtttaaacagcgaaaccgtgaagcgccgcgttggtcaggtgatgattagcggcactactacggcgagtaaagtccccgtccccctttgcgagaagggaaaggtcgatcgcgaggctgcgatcaacgtgagtgtatttgagaactcctttacttcttcttttctggatcgcactgtgacttcatgtatgcaggtccttcctctgactgacgtcatcgggccgctcgtggaccaccaggtggtggcttcgttgaaagagggcgtcgcccaggaggcgtccgacgttcctgctgctgccacgaccagtggcggcaacattccgaagagggggaggaagttttcctccgtgcttggtaatcgtcggaaggcgcccaccacatcggtaagcccctttggttctttattgcgtagtcgaaatatcttgtcctcacaccgtactcgttttacttaggcctcggatgcgtctcccccgcctcagcgacggcagaggctggtgacacttggcgagaagtaagtagacgaatttgaggtcttttaattcatcaaactttggcagcctgtcttcatggcaatcacggaaatccttcacagggcggcgcgggcgaaggcggtgcaagacgggtctggagggaactccagtgcgtctcctgcagcggcttcgacaaatgttgtggtcgtgcccaggagttgtgaggcgacgcccagcggccttgccggcggccttgtgcctgctcgaggcccgcccgctgacatcctcacctgggggagctccaaatcgagatggagcgcatcctccaggccggtgctcgcggcatagggtgcgagattgaggaggcgaaggcagcggcggcatcgtcggcgaacaaaagcaccaacaagctggcgcgtgacctggcgcggacctccagaagatgagggagctggtggccggcaacgagcggcaacgacaggggcgcgagcaccgcatgtcggagctcgagaacaacctatcggagatccgtggctcgctacgggttacctaaccagcttgcaccagctcgccggggagtgcggcgtcacgaccaccatcccggcgaatcccgatgagttctcgctgacgtcttcgctcgcggaactggccacggcgatggaggagatcccctccaagcatgcggccaggatcggggaggagacgtccaacgggatctacaccggggcgtgccacgtcctcgcgtgcgtaagattggcgcaccctgaactcgacctcgaatggatcttggatcaaggggctgctagtgacgcgcgcaagggcgtgatggaagaagtcggtgacttgggggagtctgttctccccctttttgaagagtaggattttagttcccctgtactccttagtcaattatgcttgtgaaacttttgttggttcaaactgctttgtgtgcgcagtcatctccttcgttttctttagcatattgatcccgagtactttgttgtcgttgtagagatgtcgatgttgaggatgtccagtagcgcgggcagcctgagtcactggtagtcattccggcacttgcgcttgagctatacgtgcctcgggatgttaatcagaacttgtccatggaagcgggcatggcgacgacttccataggttggttctttgatcttcatctcctttgctctttttgttaggatcgacttaatttgccgtgttctcggaagaggggcacgacttgacttagtcatttccatgttgagcagacctcgagagtgcgttggccgaccgagatcgtcggatccaatattggaggacgaaattcgaggtggccgaactcgagaggactatggtggaggtgaagaaggaccgagccgtagaagcgctccggggtcgcgaggtgtggttcaactcgtacctcaggagctgttgtacggccatggccggagtctgcagggaactccgagtaccttgcggggaccctgaggagtcggcggctggatacatctcgtggctgaatggggcttgtgctcagcttgaaggcgtcggcaagcgtatcgatgaggccctgaagtaggagtgtcgtcgatcgagccgatatgtaggggggcatgtgctggcctgtatccgagatcaccgcccacagctgcacctcgagttcctgcacgaaggattttctcgttctcagaggactcccgcagagatagataatctggcgaagtcgatggcgccgcttgtagagaaggtcttccagtccatggactgcattggccttcctggtagtctttatatcctgtaaaaaatatctcagggagacatgaaatatattttggaatattcaggaactgtaagaattacttgtgaaatagaaaagaaatctatctaactaagttttcttactctggatgcggtgtgtacgagtgtcttctcacttcgcaacttcgatcagtcacttgagtcatacactccccctagcccccagccttgtcatcggagaatttttctcgaaagataaggctcttggacctttgacctgccttggttgaacaagcactgatcctagctcccagccgtgaagttggaaaacccaatttccgattacacggcttggttaatacgcatgacgagaactcttacatgaccagatcttacatggtcatttgtctctacataatctgacaaggccttatccgctctgggcgtccccagccaaagttcccttaggttcctcagaggccttgtcaagacggcgtaaagggacatgaggataggtttcaacgctaagtgtcgtcgtggtaagggatcgtcgggaaggaacactttgatcgtagtctttacctgaaatcaactttattaaagtcgtaagatgtcttacaagtatggatactattgatttatacaaaaaatttacgtaattgatcaatgttccaggaatttactaactcgcgaccatcgccgtctgcaatcttgaatgcacctggtcgcaagacttgcatgatcgtgtatggtccttcccacttgggtgagagcttgttgcgccctgcttggttttgaacccgacgtaggacgtagtcgccgatcgaaagtgtgcgtgctctgatgcgcttctcgtggtatcggcgaagggcctgttggtagctggctgctctaacggcgactctttctcgatgttcctcgagtagattgacgtcgtcgtttcgctgctcctcctgattctcgtcggagtacttctgtactcatgtactctgatgtcgtagctcagtggggagcatggcctctgagccgtacacgaggaagaagggtatctccttgttggacgttgttggtgtggtacgcacggcccatagtaccgaggggagttcttcgacgcacttcttgtcatgtgacatgagcctgtcgtagacacgggtcttgattccttgtagtactatgccgtttgccctctcgacctgtccattgctctaagggtgagaaaccgaagcgaagcagatcttgactcccagcccaatgcagtaatcctggaagtcggcactgatgaactgggagccgttgtccattatgatgcagtgaggcaatccatatttgcaaaatatccctttaatgaatttgatggcgttgtcggccttgatttcccctgtaggtgttgcttcgatccacttggtgaacttgtcgatcgccacgaataggaacttgtagccaccttgtcctcgtggaaatgatccgagtatgttgagcccccagcacgagaacggccaaatgagagggatagtttggagcgcttgcgttggtagctttgtgtgtttactatgaaattgacaagcttcacaccgctgtaccatgttgcaagcgtctttgagggcagtcggccagaaaaatccttgtcgaaaagcttttccatccaatgtgcagccggcagcatgtgacgagatcccacagatcccttcatgtatgttgacgagatgtttaccgtcgtcggacgagacgcatttgagaagtaccccgtttggcgccttcttgtatagatcgttgctgatcatatagtagattttgacatggcgggttattttctcggcttttgcatcgtccttgggcaactcgtcgctacttatgaatttaatgagtgggatccaccagtcatctgtggtctcgatgtcggcaacaacgcgttctgcctctgtagccaccgagctgatgtcgggggcgagtgtgctatcttcgtcgtttgcctctttcaccaatggctttgtccggatgtccagaaaggtgctggattcgagtggctcccgtctggacgcacgccgtgcaagatcgttcggttcgatgttgtccttgcggtatacgtgtcggacctcgattccatcaaatattttttccagcttcctgacttctgcgaggtacttggataactcggggctagagcacttgtagtctttgtgcacctggtttgcgactagttcggaatccccttttacgattagtcgcttgactccaagtgcggttgctactcttatcccagcgagtagtccttcgtattcggcagtgttgttggtcgccctgaagttgaggtgaaatgcgtgcttgaactgatctctcgaaggtgatgtcaagatgaaccctgcccctgctccttggctgttgagtgcgccgtcaaacaccattgtccacgtttcgttgtcggtttgattgtctgacctgttttcaggcatagtccaatcggctacgaagtcggcgagaacctggtacttgatggctgttcgtggcacaaagtgaacatcaaattggcttagctcgactacccatttcgcaatgcggccgacaatgtctttgtttctcacgacttcaccaagaaggaagtaggaaacaactgtgaccctttgggcttggaagtagtggcgtagctttcttgacgtcatgattactgcatagagcagttttcggatcagtgggtatcttgtcttcgcgtcgtggagagcttcgctgacgtagtagactagtctttgcaccttctctctctcgacaacaatgacagtaatcacagaatatggcgtggcggcaatatagaggaataattcttcattaggttggggagcaacaagtacagggggatttgacaggtagcgcttgagtgcgatgaatgcctcttcggcttcctgtgtccatacaaatttgtgttgtttctttagcagagcgaagaaaggttgtcctcgttctcccatcctagcgatgaacctgtttagtgccgccatgcatccagttagcttctgtacttccttgagtcttgtcggcgacttcatgttctcgattgccttgatcttctcgggatttgcttcgatccctcttccagagacgagcaacccgagtagctttcccgacggtactccgatgcacttctccggattgagcatgaggcgatatcgtcggaggttgtcgaacgtttcccagagatcgtcaatcaatgagtcgcttgtcttggtcttgacaacaatgtcatcgacgtaggcctcgacattgttcccaagctgatcattaagtgccccttggaccgttcgttggaaggtgtttcctgtggttatcagtccaaacggcatcttaacgtagcagaatacaccgaacggcgtgatgaatgatgtcttctcctcgtcctctttcgccatgctgatttgatggtagccggagtaagcgtcaagaaaacttaacaactcacaaccagctgttgagtccaccagatggtctattcgaggaagagggaagtgatccttgggagacgccttgttgaggtcggtgaagtcgacgcacatcctccacttcccgttggccttccgcaccataactgggttggctagccactctggatggagtacctctctgatgaagccagctttgagaagcttgtcgagctcttctcgtatggcctgttttcgatctggtgcaaatctccgcagtttttgttttactggtttggcatcgggtcgcaccatgagtttatgctcagtcacctccttggggacccccggcatgtcaaacggctgccaagcgaacacgtctgcattatcgcggaggaaggtgatgagcgtgagttcctatttctcgcctagtgatgccccgatcttgacggtcttgtcggggttggtactggagagcagaacgatcttgattacgccgtctggtttcggcgtcttgttcgttttgctcactttcttgggtggctcagctgtggcgggtgggctgggcgtctgctcgaccatgtcgaggctccgcttgtcgcattgtaccgtcagctttgcgttcccttgaatagtgattgttcccttcggcccgggcatcttgagcacttgatacgcgtagtgagatgcggccatgaacttcgcgagtgcagttctcccgatgatggcattgtatgctgtatcaaattcagcgacatcaaaggtaatctgctctgttcggaagttatttgcttggccgaaagtcacaggcaacgtaatcttgcccaatggtttggacgatgactgaggagtaattcgatggaagggttgatcagtgggcgtcaactcgcttcgtgggattcccatcgtgtccaaggtgctggcgaagagaaggttgatggagctgccgccatcgatgagaacccatgcaaacttgatattccgaatagtgggttcgaccacgattggatatcgtccaggggtgacagcagtcttggggtggtcttcatctcagaactcgatcttctattcagaccatttcatcttgggtgcagccccccgccatgtcgaacaaatttcatgctccactttcttgtactcttgcttcgaagagtatgccgtagaacctccgaagatgtgcgagacatggaggtcggaatctgggtatgctgagtccgagtagtgaatagctgcttccgcggctttctcgactacatgtactcgcttgcccttctccaatgccagttgctttgtgagcgactttttgaagacgaggcaatcctccagagagtgtctgtccgacttgtgtatagggcaccatattttgttcgtgtcaccaccttgtgggtctgggtgcttgggagggtccgcgtattctgccgcaaggacttccgcttgagctttccttttctcactcttgtgacttttcttcttgcttgattcaggtgcgtccttggctggtttcttctctccccctgtcttcagcttgtcattcttgcgtctcagtgcgtcgtccgcgtgagcgtatcgatcgacaatctcgaatagtcttcgagcagtcgtgatccgccttgttgccaactcctgggtagtatagctatctctaacaccggtcttgaaagcgtggatcacagaggtgtcggtgatttcggggattgtatttctgcacccattaaagcaccgaacatagtccctcaatgattcgcccggattctgtgtcaacacgtgtagatcgtcttcgatcgtgtggcgcttctaagttccttggaagttagcgacgaactgctgccacatatctgcccatgaagaaatcgagtagggcagggggtgcatcagccatgaacgcgcagaacctttcaatgccgtcggcaaataattcaccaacgcgttgtcgtctgctccggcagcgtagagtaccgtggagtagacctaaaggaattcttctgggtcgatactcccattgtccttctttattgctcccggtcggaatctctcaggccatcggacatcacatagcaaacggctgaaagctctacacccgccgctgggggcggtgggttatcggctatcgtatgtccttcgtggatgtctatctgacgatgaggatgaagaggatgatgacgacgacgatgagtcactcggttccggtgtgcaattccgaggatgacgtccgagttctcgagaatcctgacgacgctccccgttgtcgttccggtgtcgatctccgtcgtcgtcatcgttatggcggtgccctcgaccagtattgcctgccacccgctgttcgtgatcatcgcgttcgtggcggctgtggcggttatcacggtcttggttctcgctcgggtgtcctcctcgctccttgttccctcgacgttgtgaagagacgcgatgtcggaaacgattttcgttgtctcgcgcgcatcgtgcttctcggcggccattcaaatggtcatggagatcgctggtgccgcgaggtggaggagtggctcgtcgaggtgatgtccgctactcaggtggttcaccatcggcgccgccagctatcagttgttctggctgtgctccggcagcggcctcctcgaacgcgttactaagattagccactgattcccgtagccgttctgtccactgtgcaaggtcatcgtttagaacgggatcataaggggtttccctcagtattgcgttgatggccccgatatgctgggccggcgtaaccacttgattctccgcttctgcgttagcgcgcgctgacgtgctggtcccatcgatagcaaatacatcacgtggtgtactcgtcgacgatgagccctggtcttcgagcaagtgtagaactgacggctcgtggggatcgatgtcgattaccccaacgaatcgatctgagataactgtcgctccttattccttgtccgcatctctaagagagattttttgacttctggatcttaggaggcgacgtcttcatggcgctgagaagaaccttgcagcttgagaggtcgtgattctttgtcttgtggataggacaatagacatcacgagttagaaaagtacgttgaattccatgctctttgcaggcacggatcttagcttgtacatcgagaaaaacccaacaagcttgcaaggtgtgtttcctggttttgtggataggacaccaggaccttgtcgcctcggaagttatccttgtcggctcgtgattcttgtcggaaggacaagatttggccatactaggatcttgctcgggctcagatgtcgtcgatgttccgttctccacttctatgggaggatccttcgacatggagtcgcctagggttttaaccatgacgttctcgcttccggtcattggtggaccagtcgagatcagcaccctggtgtaaatcgagaaaacaatttcgccgacttgggtccacaccagcattgttgaagtagaaactccttggttgatgccggtgttgacgctgttgtcgatgaagcttgacgacatagtagtagaaccttgagtaccaaaagcccctacctggcgtgccactgtcgacgggggatacccatagaccggatatggagggtattggggtacgctggtacgacgatctacgtagtacgacatcaagcaaacaggaaacaaggattatactggtccaggccccttgataggtaatagccctaatctagttgatatgggattatatagtggaaaccacagattacaaagggaatagcagaactcgatgataccgatgagaccgtagtcaagttggctcgactagatcaccccggcgacttagctcctgaaggctccacttcgtaggctgtggtggttgtgttggcggtaagattcgatcccttaggtcctcccggggtcccttttataccgcaggttagttggtctccaagtaggactcagagacatcggaccctacacaatataatgacgacccagttctatctgagtaggactccttccatctgtggactccgtgatggatttccttagcgtgtacacagaacgtctgtatacgcgcaggtatgctatatcagtgtacgacgtatatccaagagtatagggtataccttatccgtaatcatgacaatattaaattctccatgattaattatactctccgaaattttctcggatttttcagagatcaattcctaattttaataatacaaagaatatttcagtaattattcacatattaaattaatcgttaaatgagctggattcaatttttttaaatactttgagtgcccagttattttcaggatttttcttcaaattatttgagcattggaattatttttaacaattgaaagatcatttcagtgattaatttaattagaaaagtaattgaaatcaacttttccttttcgggccgaattaggaaaagtcctctcacttcctctcggcctgcagccctctccctctctttccccaagtccagtttcgttccctccttcaatcgggccgaggaaaaggaagcccagccgaagtcttctttgcctccctggcgctacagtactctatcttcaacctccagacagagcccgagccgtcccaagcctgtgcagccgtgccgatctccttcccaattccgaccttcccgttgctcctctttctaaattagttgcgggaatggaatcctctcaatctcctctacaatttcaccaaaaaatccccaatagtttctatataaatcctttccaatttcgcggatcaatctttcctttctccggcgaagatcctaaactttcccgagtttttctcgtcgatctgggcccggacccgagctccctcccgtgcctatataaagtaccccctagtcgtcctctacctttcccctcaagtcctgtccttcgccgtcgccggaaacgccctccccgcgagcaccttctcactattacctaatgatggatatttaattgtagctcacggtggtcaatcatgattggttaattaattaattgcgaattaaaacttgctaatggtgggttgtgagcacatggttttgatggtcgtgctcatgacaattaagcaccgtttcacgagtttcggttgtaaaacattaatcgtgccaaccactagccagcatgggcaacggctttaccttttgtatagcatggttcactgcagggcaccagattgagaagtagcggagataagcccacgggggtcgctgggagcccatgccttattttataagggggtgattatgatcaaggaacggtgcgctgtggtggattgtgttatgcgaggggtagtgtcacaactcctttccgaggtaccgtggtggtattgaggcgcatggtgacatgttgtggggctgtatcttgtgggtacagtggtacatccctgtccagagtaaaactattcgaatagccgtgcccacggttatgggcgagtctaataatgtcttttgtgattagtctcacacttctcaccataataaatgatgctataactggtaataatttgattagctcctggtttagaatggtacattcctggtttggaatggtacatttctgatttggagatagatctgtacaacctggtatggttgttcaagattggttggacctgtgcagcatgggtgtgctgttcagtgttgattaatattgatgattaattactctattattttacaattctcaagtgtttgctaaatactgcttttgtaaatgagccctatattatgccattctgtggtatctttgtgcacttgcatagttgtgtggcttgcagagtattccatgtactcaccttgcaataatcaattaaaccttagttgaagacaagttgcgaaggagaagacgtttggcttataccccagttgagcttgcctgtgggagtggagccggagcttcgctagattttattttccgctgcagttttcttcgtggtgaggactaagtgcctcttatgtaagtatttattattttagttattttgatgaatctgtatattaaattatcagtttgtgtacctcggctgattcctggacgaggattttaatacacattagttcggaaattactagtgaatttctgggcgtgacaggtgtgaagtacgctcgtcatcccaacccactctggggtcgtgcccccacatccccgaaaaggtagttatgctatttttagacgagcttgttgaagatgtttttgatgaatagatgtatatcttatatgtctccatgctcctctcactgaggaaagtgtgacttacaaggcaaaggtgcctgggtcctcggacagggccgggtccgaggcagaactttgcttatattctttggttgtatatcttataggtctccacgctcctctcactcagcgacgtgggacttataagggcaaaggtgagcccgggacctaggatagggctgggtccaaagtagacctctgcttatattcttaatatgtataactcgtaggtctccacactcctctcaatgaggattgcgggatttacaagggcataggcgagcccaggacccgagacagggccaggtccaaggcagacctctgcatatattcttaagatgtatatcttataggtctcctcactccaggacctgagatagggccaggtccgaggcagacctctcctcatattctgaagatatatatcttgtagttctccacgctcctcattgtaggacttacaagggcaaaagtgagcccgggtcctaggacagggctaggtccgagaaagacctttgcttatcaggacataagtcgttcaaggttctttctagaagagtttttagtcatctggaagagtttttagtcattgtagattttatatgtttcaacctcctctttaaccaagaagggtgatacatatgttggcaaaagtgggcccagagtcactgaatggaccggccccaaatctatcttttccaatcattattaagatgtatttcttataagcttcgctacccttaggagagatccgctcagcctacacagacccggggggctagacacaccacgtttaacaccttaaaatgtagattttgtacataactatgctccaacaagtgaagcatgcatgatttatgaggacgagggtgtgtctggccccagagccaattgggaccttggtcaccttgatttttcattcaatccagtggacctaatatttttaaccattggatcaatctctaatctctaaaagacttaaaagactgttcctttttcatttaaaagacttatcttccaaattccactccctaccagcactgtacatggagtcgtaagtatttatgtgcttatccttggttccttggtccacctctacgcctcctctctttctgtttctttccctctcttattcctatttttatacaatattagttagaaagcacaatacatgagcacagttgatgattaaaaaaattataacatcaaaattgctattttatctgtttatatcgttagattatttatgactaaatatatggttaaagatcatattcattatatcgttagcgaatgaatataagagacgaatgccaatgataattaaacaaattcactaaattccacgctacttgcatgtacaagcctctaaggtgtcaataaaaaatcaatagcatttcttataatgatatgattagaaatttcctaccaaaattttattttaagactcattgactaggtatttttcttaaaaatattatagggtcctacatataagaaacacaatataagatatacatatttgataaattaaaaaaaaagagatagcaggatggtgtgtgtgaacacaattaagaagggcaatacctcactttattgaaacttattttgttatacctgtttttttaaaccaaattagaacaagcacgttcgtgcgaatgcgcgggctaccttccaaaacaatcaggtaacatcaaagcaaaaccaacacataagaaataaacaattattaaattttattttgtgaatctccatccatagaagggaactatatattatatataagtacttccaagttccaacaaacagccacacagccacacaggtgcacattcgggccattatttagaacgcacaaagctgatatatagcatgcagccatgcacgcatgcagatgcaggagcatgacagacccagtgtcagccactccagtacatagggctacaattacaactatatatacgcgaccaatccctaaaccgagcaagctatatgctgcttcaggctgcagagacacccacatagttttaattaattaagggattgatctgtcgccggagtttcatcagttggcgacgacccggagtttcatcccggcggcgcagtggccggggacgccgcagatgtagtagttgacgcccttcttgaggaggaacgacgcggtccccgtcgccgccgccaccgagtccgccgagctgcccaccttgcagctcctgtacgtcgccgcgtccacggccagcacgttgtgtgcgcccggtttgtagttgaaaactgcatgcatatatatatatatatatgtgcagagagcagacagcagtgtagtcaggacgatgagtgatatatttttgttctttacagaaagggaagtgtaacttccgatctccgtaacaactaaatatgcacgcggttatattcatggacatgggaatttaaattctgatgtgtgaagtcatacaaccatgatttcaccattgcaaccttctggcataacttatagcaactaaaagaaagcgtcttagatgtatatggacgcatgtgttggcaacaagacataatataagaaactattaatttgcactcgttttaactgatataactggcttgaaaaacgttacttatgctgatcagctatgtagagcggaaaagatatatatatcatcgagaattatatatactccctccatccctaaatgtttgacaccgttaactttttaaaatatgtttgaccgttcgtcttattcaaaaaatttaagcaattattaattcttttcctaccatttgattcattgttaaatatatttttatgtatacatatagttttacatatttcacaaaagtttttgaataagacgaatggtcaaatatatttaaaaaaatcaacggcgtcaaacatttagggaaggaggtagtagtataaagagagaagatatatagagcgagactgtctctgtgtataccaagagtgtcaccagcagcgaagacctttccatcagcccagctatcaaacgacacagagaagtcccaaccgttggagtcaccaacaacatgtgtttcagccagcacagtggtcgaaaacgcaagggccagcaaccctaaaaccacgagacccacactgtacttccccatggccctatgcgataattacgaactaactgtgtttacagcaagctagatttacttgtctgatatgatctatctgaatgtgcatgcaaagtagcaggcttcatggctccatttatacccgtaagcttgctacctttttgtgatgcttgtgttagtgcatacgtgctgattttgattcctctagataaaattatagataactagttcggtcaccaagctttgtggtgcatgagtaggcaagcatgaaaatgttttttctagcttgtgagtggttaattattccatcgggtgaagccactggtaacgagaagttaaccatgggcacaattttaggttaattttggacataccaatagcctgagcacttgtacaaacccttccatagaccatacgaagataaatcaatgttatcgtttctctgaaggtgtaactattgcgaaccagctagtttaaaccacgggcccaaggtaggatttgtttctggttggatgctgtaaagttcagttacagtgcatgcatgtacctaaaagctgtggcgaagttgtaattaaaaccagtggacaccctacgcgttgtagcatgataatttagaaattcttgccgctggaaaaaggctctctactcccagtttacaaccccttcaatcgcaggttgtaaaccgggacgtccaactctggttaaaataaccgggactaaagatttatttttagtccaggtgtataacaccaaccgagactataatatttagtcctagttggagttacaaacagggactagagtttttctttttttcattgttagttttttcttttatcttattgttttttttgttgcttgcatctattgatttcagtaccatcaccccaaatccccatagatcatacacaacaaaatcatccacaatatattcccatccacaaatctgcaaatcattcacaaaataatccacaatacatgcccatccacaaatccacaaatcattcacaaatataaaaatttttacagcatctacaaatcatcattcacaaaataaaaaaaagtccacagatccaccggaagtccacagatccaccggccgtgcgcggcctcccgatcgacttccatcggaccgctgcctagccggcgcccggctgccaccgcggctgcttctgccggcccacctttccctcgtgcgccgcccacctgcgtcggaggggagagggtgggagccgccacccgcaggtgaggggaagtggaggaaggggaggagagaaaatggggagaggaagagggagaggaggggaggggaggggagggggaggagataagatcgagactgggagaggaggaggcacgctgggagagataagatcgaggctgggagaggaggagtgagatgaggaggcgcgcggctcgggtagagatttttttaatcttggtcccggttgttataaccaacatataaaacccgggactaaatatgaatctttagtcccggttgatattaaacataatggagtactcacaaccggactaaagataatggagtactcacatgttcgtgaaccgggcctataacaaccgggattaaagataatggagtactcacatgtttgtgaactgagactaaaaatgatctttagtcccggttgacaaaaaaaatatgtttagttccggttagaataggaaccgagactaatgtagtttttagccaacccagcaaagatcaattctcaagtagtgtccgttacagagagatcgaagtaccaatcctaaatgctgatataaaatggacgcattaattaaattgctgacataatttgatgatatggctaaacttaagagatattttgtactccctccgtttcacaatgtaagtcattctagcatttcccacattcatattaatgttaatgaatatagatatatatatatctatttagattcattaatatcgatgtgattgtggaaaatgctagaatgacttgtattgtgaaacggaggaagtagtaattacttcctctgttctatattataaggcgtttggctcctccatttttcgtctatattcactaacatcctatgattttagatatatatatatatatatatatatatatgtagcacatatatctatccatgcatgaatttatttaaacgtcagaacgtcaattaattctaatggtggaaaatccctattacaaaaatcatctgtgaaggccatatgctttccttttcaaaggcggtaaaaaaaaactgtatgtgaaaatggctaatgccatctcagggtaatgtttgtggaaaatatttttacatgcatatccttagagaaacctccttgcatggacagttttcctaaggaaccgtctacagaaatctcaaggaataagtttataaaaaggaataagttcactttgactcccttaaaagtgacccgaatataatccatgaccctaaaccgcaaaaccggatatctcgaccccccaaactattgaaaccggtgcaatttgactccctaggcggttttgctgacgtggcgcctacgtggcggtattgaccgggtcttttttacatgtggcgcttaagtggcattagaattaaaaaaatatgtgtgggacccatttgtcattcacacaaaagaaatgtgggccatgggccctccctcgctctcccacttctctctctttctctccccttcttcttccccttcggctggtggcgcgtggcggtaggcaagctaaggcagcgaaggcgagctagggtgccgccaaagttctcgctgctgccaccggcggcggcatcgtcatggtcacctcgtcggcctgcacggtggccccgcgggcacccgtcttggtgtccaccagctgcacgcaggcggaggagcaagaaaacagattaagcgtgaccggcgtgacccaacataacacacgaacaaaaagaagaaaatggaaaacaaaatattgtactccacttgtaatcgtagatgagattgagaatgatgagcagaacaaactgcattggcattgtatatagaggagaagaaataaagaagcggaaattgaggtgaagtaaagaaaaggatgaaaactttgcaaccaagggagcagaagcggaatgggtcgaggaggtcgagggcgcagatctagcagttgtaaggggaggcggcggcctcgccgacaacggtgctggcgtcgcgtggctgggggtgctcgttgaggaagaggaccttggcgctgttgatgacgtaggtctggacgccggagatgtcgaggacatcctccacctccgtcacccgcaccacatcattgtaggaagaacgccgtatctgcaccaaaaaccaaatcgataataatcttcctggaagttgtttgcaattgcaattgcaatagaatgaa

SEQ ID NO: 23733 - DNA, 20336 bp, Oryza sativa
tgacatgtgggcccacatttcttttcatgtgaataactaatgggtcccacgcgtatcccttctttctatatagttaagaccgaaagctgatttctggttgagccacgtcacctgttaaatcttagtcattcgatgtaatctggacgctcgcagctgccaccgccagatgcagtcgcttctcctcccttctccttcaccccggcccgcgctcgcttctccgccccgcacgcgctcgcggtcgcttctcctccgtcccctgcgagatgcgcggcgggcccgccgcggatgcggtcgattccccttccctttgcgctttcttaggatgttcgctgtcctccgcttccccccgcaccgatcctccccctagcccgtcttcgccccccatcgcatcgcctcccgcaccatcaagattccggggccggagtcatgcccccagcgcagcaggtggaccctccgccccatggccgcatcgcctccccccagcgctgcagtcgcccctcccgctctgccctgcgacgtcgcaccctagcgccgcaggtgcctcacacccccagcagccgcctcccagcctcttcgcctccttggcttgtatggagaaagggaaccatcgttgggcgcacgctgaaacggaaaccgttcgatccccgagtcccatctattcatcttcagttttttgaaacagtacgtcgccgcttgctttatactggccttctttcccgtcctatttatgtatgatgatacacacaacagctgaagaaaagtggtacacagcagctggatcaatctgctcggccagctagtagcttctcctccatacaagcacatccttggattgatctgctctaggttgtccactgcttgccgatctcacatgttccagcatagcttctttccccattcagctaaatttttttataatacatattgtttgatgctaattgtgtagtcacactaatttcttcgtgattcaattatcaatttccaaccgatttcagtatcccaaattggtcccttcttttttccctgtataacagtatttgcactaacagtttaattattcccttcaatttcttcacaggattaactacttcgatttcgtcttgggtttattactggattaagtaatccacaaccgttttacccaggttgttgaactattatggggaaatttctttgacggtaatacgtaacaatataatcctttttcccctaactatacaatttctattattatgctcctttgttttccatatttatttgtcatattgtgattattctggttaccttgcatctatcaagcacctttgtattttaaggttttagtattctattatgttacatggaaagtttagtagtacacttgctgcactgaatccctacagataattcctatcactgaacaatgtttagtgaatcaataattcctatcactgaatgacatttagtgattcaatgattttatatgtatcttgtatacttggagtactaaatgataagatgaaatataactgcagataattcccaacttatcaaaagtttggtgatcctttagtcagccctgtaagcatgattcagtgaagccatggctcagatggctttggcaattctttcagtaaccatcaataatgtaagtgccagctacagtttgtataggtcccagtcttctttgatttgtttaccaaatattacctgacctgagttcacaatttaagtcataatagtatgatctcaaaattctcaaattaacttaaaatatgttacagtttattttacctcaaacttacattgattcatataacatgtttatcttcctcatgtactgagaaactgcataatttatcaacttttcatgaattatatttcctcttctgaggtagcatcatgtcttttgtatctttcatgaatcatatttcctcttctgaggtagcatcatgtctttgtatcttaggtgaatcctgtttttttagatatgatgatgatcttcaaacttccatctgtagtgtgtgtgtgtgtgtctatatatatatatgtaagacaaggactgcattgagtattttcagtattgttcttcttgcccccatagatttggaagctagcgtttgatcaatatactcctattttctgtcaggcactattgtggtgttttacatgagggggtctcaatgcactcaaagtgaagcattgctatcagattattccttgcaaaagttgctccactatcatccagaatttcagactgcagttggtattgcgtcagtttcccttctttgcttatttttttttatctcacaaagtgtacttggatttttaaattctatttcaatacaaatatcccgccgcaacgcgcggggtatcaactagtttattttaattctaatgccacttaagcgccacgtcaacgccacgtataaagaagacccggtcaataccgccacgtcagcaaaaccgcccttcaaaaccgtcttaagagtcaaattgcaccggtttcaatagttcaggggtcgagatatcctccggttttatggtttagggtcatagattagattcgggtcactattaagggagtcaaagtgaacttattccttataaaaatgttgtaggttttacaggtgttttcttaaggaaaaggtttgtaaaagaatgattttcacgagcggttctattaaggaacagaccttaaatacaacggcaatatattttaaggataaaatgtcgtaactctttcatatgaagttaattgatgacaaaatttgcccaaaaaaaaagtatagctctcaatgagatcaacattatgttaaattatttttttacatttgaaattgtttatggcctaaatattcgttacaagctctaatatatatttttacaagtggttctttaggaagataaaactttgagaattcattttgagtccaattgaaatgaacggaagttatctgagatccttacaatatttgtttcaaacagaaaaccaggccattcgcatggatggttcatgggcctggtttttgcccataagaaaagagccgttccagcatcctcggatccgcaatggctgaaatggatcgatgaaacgtcggggaacacgttctactagtggaaactattttgatccctcgagaggatgccccctcgttgtttacatgtcactcaaatgatttttaaaaaaattaaacaaaattgagaagatgtattaacatatgatatatcacttcacaaatatacaagttcaaattcaacttttacatctcgcaacgaaaaaaaacaaatttgacttatatattcgccttgccgccctccccgagagtggcagggtctgtttctgtaaatatttttgccgataatatttctgtaaatattaaaaaaataaaaatttaaaaatgaaaaaaaatcagtagtcttcctatcctgtcctatgcactctgtccatcaatccatggaagacgagtccaacaattaattaaattgcatgaattagagctgatatcagttaattaagtagatggaccggatatgaactatcatgtgcgtccggcgctctaggagtgatcgaacaaagcgtctcctaggagttagcacgtgtgggcccccagctttacacacgagaaaccccatgtgtcttacagtagcacgtgtgggcccccggctttacacaccagaaaccccatgtgtcttacagtaccatttcctaaatcagtagatggtacacacatggcacgcttgaatatctcaagctgacatcattatacaggttgaactgtacattaataatagaagggtagcctaaataggacccaaatagaccgagcatggtcataaacaataccaaatatccaaagaagtagatgagctaacggaagcgaagcagcggcggtccaacatactccacaggcatcgactggtgcacctaggtcccggctccacggtcttcgacatctcttcatcagctagttcccgaatggtcgactccaacttctttctaaaagatttagttaagcaagggtgagtaccaaccgtactcagcaagccaccactacagaatgtatttagtgcacacagggggttaaaggatggcttggtttatttgcaaaaagttagatttcacaaatcagttcacaaacctaagacctagcagttttaaatgaaaaacaacgttaagttgaagttgtcattaatccgcgaggattcatccacattcccaaagcctcgcttggtccggtttaccctcacatccagttttccacattcccaacatcacaatgaccttccctgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaattttaatcttacaaagagcatttcagtaattacccacatattaaattaatcattaaatggtctaattataattttgttaagtactttgagtgtccaagtattttcaagatttttcttggaattatttgagcataggaagtatttttaacaattcaaagatcatttcagtgattaatttaattggaaaagtatttaaaatccccttctccttttcgggccgaaataggaaaagttcagcttctatcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatctgaccttttcccttgtgtttttctaaaattagttgaggggaaatattcctcttatcctcctctatctttacccccaaaaatcggagcaaatcgttgagtattttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgccgcctccgtcgtcgccgccggtcgccgtcaccgccgtaaggtgcgccgaggtgtggagaagcccggccgctctctccccgctgtcgccggtcaccggagtcccgtcgccgccgtcgaccgaagccgtgccgccgctagacctcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcctcatgatgtcatcatcgtttttctttttcctgttgttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtgtagcgtgattcattagagtgcgccagactgagaagtggcgagaagtccacgggggtcgctggggagtccatgccttgtttataagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttataactggtaacaatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccgtcgctagatcgttattccgctgctgttttcttttctttgtaagtatgtaacgttattattaagatggatttgtatattaaattgtcagtttgtgtacctcggctgattcctggacgaggattttatgcacaaataagttcggaaattactagtgaatttccgggcgtgacattcccgcccatcgggcaaggtcacaacactttcctaatctaagcaatattaaaatctatgaggctagtcaagtgtagtacaagtcccggcgctcaataaccgcgagcacggctattcgagtagatttgatttactcacactgcagtggatgtacgcttttaatcccgcactccatgacttgcccaacacattagcctaatcccaacacatgagacttgtcacgccccggtttttcagtcattcttgcatttcggcactcgctccaaggactataaatccccattgcactcccggcacaacacaccacctcgagccggtagtgaggagagtcctggcgctcccgggatcacaagaggttacattacatataggtgaggtgtgttttaagttttgccgcggcattcaaacgatcgatccaatcgatccatcacacttcccacacaaacgtcaccacttcagaaccaccatggcagtggtgctgtcccacgagaatttcttagtccaccgggtctatacccactcgagaagtgtggtcgtactctgatcgtttcctgcataccttcttgactcggttcttaattgaccagggtcggcgactagccgtttccagaaccacccatattctatccatgccgcctcagtcgaaagcattttgtctaattaggtttttggttttcgcaaaggtttttgtgtcgcgggtggcgctcatgcctccacccgccttctggcaatcactctcgacgagtgaccaccgccaacacatccatatccaactattatggagtgtacaatcatctatatatataagccatactaagcaaatgtcaatatttgactacgtatgaataaaagactcaggcaacaaggatataataaaggtaacaatatcaatgatggttcacatacaactttaggtacgcattttataattagcatgcgactttatttataaacaaaacatttataaaatgggttcaatatgctcaaggaggggagcatactgacttgccttgcttttagaaatcgatatcttcaagaaatccacgcctgatgaatatccgcaatacccaatacgcggttagcacgagaaaaccatataacaacctccgaataaagtaccaaacagtagtgccattggatagatcccgattttagaaaaaaatccggaagttgaacggaatcaatcggagtcacggtttggaagatatggacttccgaagtttagatgatttataaaccgaggaaaaggatacccaaaataggattccttttattttggaggaaatattcctaaggtcattctctggaatggaggaggtatattggacttgggtggagatgaatactactgctgggctactgcccgaagcttggaggagggatataatacagacttttctgtgggattgattctctggcttaaccaaggaagtggggaatttttttcatttttcaatttaatttttttaatatttacagaaatattatatcggcggaaagatttacaaaaatagaccctgccgccctttatttgggcggcaagctgatgtggtacacgacgttatcacgacgccgtgtgcattttgcgtttaggcccttacagccctctgtaagggcggcaagaggttaaatgcaatttttgtcctaccaaaaaagcaattggctagttctttttgcatatgagccctttcccgcctttgggaatttggcgcggagaccccttgcaacccaaacatagggcggcaagggggccacgtgcaaaattcgcagtcccccaaaatgaccgtcctgtgtgccacgtcagcttgccgcccaaatggagggcggcagggtttattttttaaatcttttcgctaatataatatttctgtaagtattaaaaaataaatttaaaaatgaaaaaattcaggaagttggggaggtgatatagactttttgggtggccaaaggtttccaaggggtcaaacaggtgggtcccacggcccccttttcctttttcttttctttcgtattccttctctctctttcttatctactactccctccgtaagtttttgcttatagtgtttgaccactcgtcttattcaaaaaattttagaattattatttacttttttagaattattatttactttttattttttatatttgtataaattttttaaataagacgagtgttcaaacattacaagtaacaaaaaaaaaactcaaaattcatattatgggacggagggagtactctcggtttctcgtcacatctctctctcggtctctcctctgcctcttcacgcgtgcctgagaggaagacgccaacgacggcagtcggaacgggacggcgatggggggaagagagtggaataagggagcagcgccggtggggaaagggaggctggggcgctggctgctcgggctgggcggcgtggcaagaggcggcacgacggcgctcggcgcttggcgcggcggcacggccggcgtccgggagccagggacgacggcgacggcggaaaagaggaggtggcggcacgaggaggagactgcctcggcgctgtcggcggggctgtgcccggctgagctccggccggccagcgtggtggagggagggcggtggagatcagggagacggcaagaggaggccgtgtccgtggtcggcgacctggtgacggcgttcgtcccggcacggtgacgccgccacgcgcaagggcggaggcgtgcgggatgacttggccgcgcgcggggcggcgcttgcggcaggcggtactccactcggagcggcggtgacccagatcaaggtgacgatggcggcggaggttgcagtagcccctcggatgggcggtgatggaggcgttcgcgggagctgctcacgtggccgatgtggctgtgtgcggcggcaccggccccgagggtccttcggccgagcggaggtcgaggcggcgatgggaagtggaggagtgtggcggcaaagcgatggccgacgaggttgtggcgaagcggctgtggcccgtggcacacgggtccgagcggcgtggcgcccacaagctgctcgtccgtgcgccctagccgacgggtgatgatacgaaggtggcggcggggattggagtggcgacagtggaggatggtggagtgaggcggcttctctagccattgatttgcttggtgatgcggatggcttcgagggggaaggaaaggggaaggcagaggtgatgtggcgcgcgcccattgcttggacggcggcggcgtgggcccgggcgtcgacatcgacacagtggagcacgtgtcggcggtggatgggatggacggcgatgagatgccgacatccacagggtaaggcttactccgtccaagaaaaaaaaccctggatttcattatgtaacgtttaaccttcatttgaaaatttgaaaagaatatgaaaaaaattaaaaagacaagtcacgcataaagtattaatcatgtgttatcatttaacaacaatgaaaatactaattataaaaaaattcaagtaagacggacagctaaacgttggacatataaatctagggtttgtttttttttttacggaggaagtacagggtaagcttcgcctctgagattagagaactagctctccccttttcggtgtggactcggctcttctattcggcgtgaaccatcctcactgtgcttttggtgtttggggcagagattatgtggactgggtgcatggcgtaggaggggctgcgccagtgcggctccccggcggggattttggactttatgccatcttctccaacgcctcattcctaaatgccaccctcctgaacatcctcgctaatttgccactgggccccacaaaactgttgtttctatgccattttcctctaattttaacgccaccacaccggcagacgtggaattcggatggtgaaatgtccatcttgccccttggcgcgcgtggacagaaaaaggcgttgtttcttcgtcgtttcactccgcctcccctaaaaaacatgagcagccgcttacgaatccaccgagcagcgacggcggccaaaccgtgacagcaatcccaggtaggagatcgatagatccaccatcttcccctcttttggtttagtttggcatctgtttccctcacttttttctccggattcacttgtttttttttaagatctgatagtctagggtttgttgagaaggaggcatggttccgtctgagtggccatcgtggtaagatccaaaattcctgctttattctgtgttgctttcatgtgtccacacaccacaggggcaagacggccaattcaccatcgagattccacgtccgctgttgatgtggcgtcaaaatgggaagaaaatggcatagaatcaaccgttttgtggggtcaatggcaaattagcgaggatgttcaggaggatggcatttgggaatgaggcgttggggaagatggcataaagtacaaaatccctccccggcgtgcgtgcgttgaacgttagttcggggcggcgcacgacactgctcgtgctgccgcgtggtgcggcgcgacacggtgtgcggtgcgactcagcgcgggagcgcaatgcggcgcacgcaaggaggaggagcggtgcggcacgtcgcggtggctcggtgacctggtgcgccagccttgctcggctcggcattttgccgaccacgtggcgggcggcgtgtcggcctggccgactgaggcaaggaaggaggggaagaagactcggctacaatggggcaggggacgcagaacggacttatgctgtaatgagctgttgggttggctgagaacaggaaagcccaagcaataggagtatttgaatgactataacaaggaatttgtaactgggacttgaaattggaatttgtagattgcctgtaaacatgtaatggattgtatggttgtaaatggactgtataattggacaagtgactttgagccgagatttgggattgtgcacggactgtttaattttgggtatttggattggattcgaatcggcctctcagttgcccaagtatttaacttaggttttcttggcaaccgcttgaatgaaaggaccgctatatcgacggattttagaacgatgcttggcatacaaatccatcggacgcagtagagctccaaaggtagggatgatatcaatgataggattaggagcggcgtatggcacacaaacccatacgttgtggcaggattcaaaagttgatatagggtggaggatcaaagaattacgtacgacaattaaatatgccgaacgactttagggttttaagcgaaagccgcactcaaggacttttgagtagcatgaaactaggaaaggaggggatccgagggaggccaagttgaagagacgaagcaggtctcgattcaatcgcaaggttccaagggttggggaaaagaaatgatgttgcggcaaaagaacatgttccaggacttcgattagcttatcatcgaagcgcttagcaaaagggaaggacgtcgatcgaaggacatcctttaggaggaatgatttgactgcggtattccaacgattcaaggacaggacggatagagagttgagaggacataggagggatttcacaaggattgatggattaactgagatcttggtacaaacatatgaatgcacacaaataacacaagtcccattatgtgggtcggcttggcctttcaaggaggaaagctaagatttttccgtgagttcttttgaaataaaattcttttaagattttagttcgtaaattgagttttcctagtaaattccttcttgtctttcattgtaaaataatttccaaacacttataatttcaaaatagggttttcagaagttaactaatattagccctcatttgtaaaaatagttttctcgaggaaatatctctcaaagtatgttttctaaatatttagtatttatttttgtttatacatcaaatacatcaaataggttttatttcaccgaaaaggggtttcagaaagataaatagtattttttaaatattttcttaattaatatatttcataatcatggttctcttaacaaataatatttgaatctaaataaatttgtccctagatttctgtcctcgtggtccaagcgcaaccgaaaaatgggagataaaatccaataaaatccagcatgactgattttggagaagatttttgattatcccgaattttcaatttcgcaaatcaaaatagaaattttcagggtgtgacagaaactcatagaagtggggtcttgctggagagtcttgtgcatataaagattgagccataagttgatcaaccaccaaggtcctccaggattggtgatcggctgaccagtagctagcttagccgatacattgtgcaacaacgaatatactgagcctagcagatgcttgcccagagggatggagtggccagacacaagtgcttctgttatcgcctggggatttgtggtcgggccgacagtttttccacagtatatgaagcgttctagccacatgttgaggaatgcaacgtgatccctatcagtgacggtgcttgtcttcatgtggtgagccatgtaacctttccaacctccggcgtccttggttttcagttgataagtgggtttggtcatgaggtggaaaggattgtccagagccgatatgttaagtgatgttagcatgatgacatctatcaaggttggagtcatcgacccacgtccaaagagaaaggcgttcatggcgtcagaccagaagtgggcagcaactattaacattgattcatttttggccatgttgaagagggaaaagttaatgcactggtttatatcataaacttcccatatggtactcttagcttcagagacgcggaggtaccagttcctccatcaaggaatggggattggccaagatctgaaggcatttgaccactgtgatagatccaaatttgcatgtttgaagggcagacgacctatttttagattaatcggatctgtggggtatagatcgcccatcggtcttaaacatactaggacaggtctatcttccaaagcgatgataatcatatatctcagattttagatgaaaaaacagaaaagaggaaagaaaagcttgaaatcagaaaaatggcggaagatgagtaaagaagatgagaggatggaaaatggaatcggggattgtcctgatggaagccatgagagtcgactagagaagcttgctgcggtaaaaatcttgttcttgaggaggagttcttgaacttgggcagatgggatcttgagagcgggctctgtttggaaatggcgaaagtgaaggaagaagaaagggggcagtcgagtggggctttataggcttgcggtgggagataaggctcgattttcgaggcgtcgtttgtgcaagacacaagagaccaatcgctgtgtggcgcaagaattgaggaaagggtgcaatcatgacttgaaagaatttcggaacaaatccatattttattccgaaattggggggcatgtgctgacaccttttttacatcaaactggtcaaaatgtagtcaaagatggagcaagccgatgaagctgacatagccaataaaactgctgaggccgatgaagcatgcagccgatggagccgacgtagcgtgtagccagtaaaggactgaaggattagtcgacgtatggcattgtggggccacgaagagttcggcttgtattaggagagtctttattttaggaaattgtaattccttttcggtcaagttttgtaagtcgtagtcgacaaggagtctttagtttaaactataaataatagcctgatggctttgtaaaaagtctttacctaccaatcaaacaaacaagttcttacttttcattgcaatttattttcaaaccctagttttagtagttcatcaacgagttctttcaagttaagcagggctgcatcatcttgatctccggcttgcctgtaagttccgcttttatctggtgcatctagatttaaacttccgggtgtatcgctgtagtttgatctagtttctcctaagagttatcgtatatactagatttagggcttaaacgcatcgttttgtcttgatctagttgttacacaatttatcgaacgtgtctgtcctgccaatcaaagttgtcttataggctttctttgctctgttttatccatacgttcaccaagttatcgatatttgttaaatcttaatagattaattatttaaattttttaagctttagcttttatcacaatttatccagtccacttacgagcttctcatcggcttcaaagcttttaagcgcatagccgatctagacttggatttggactttaaactacgcatcggctgattctagccgatataattttcgaagacagttcggaatcatagccgatctgtgaattttacactctttatcccttgtcaattacaggtcaaattgactgttatgccccgaacctcaagatttgcaggctcatcattggagtgaagcaaacctctgaccccgaacctatgtcgcgtgatgcttacgtgaacaatcatcgcctgatttttgcgtcaataactcactgtttgatatgatgccacggtactgcgggcacgacgacgtacggtgcgcgttcgcacagggaggacatgcacaagctggcatttgtgtacatagcctgcctgccgcaatggtttccaagttggaaataaacggtgctctatcaattaaggccagtctcactgcacagtttcactacacggttacctagaccagaaactaggtaactgagccaaaggagtttcatggtgatgaaactcctctcacataccactacgtcaaaacccaataaagaagacacaatttagtgacgcgaatttgtcacacgtctcaaatatgacttcagtgacgtatcggtacaagacgcgtcactaattagttcaccccggtcatatgccagcccaggggaggcatatcacagatgtgtctccacaaaacgcatcactggagttgacatagtgacggctcttgttgagacgcgtctctgacatgtgggtcttccagagatgggtatagtatgagcatataccagagtcgcagttttacaatccgcgtcactattgtggataatattagtgacgcgttattacgatccgcgtctctacctcgggtaaccctatacaagtgatgcgtttggtagaaccgcatcactaacgtcagcttttggcgcgtgggcccattttcttcccgcgcgccgccggtgcatccatcccggccggcgctgtcctgtccttccatctcgtcgccgcccgtacgtccatccatttgccagcagcgatgcccaccaccatgcaccacccatccgagccaaggctgctccctccacgccaccaccgtcggtaggtgctagtttctccctccgcgccggcggcggtggcaggctgctcctctgcgccgcctcgtccatcaatccgccggccgaccagtacttcatctggtgctttgctgaaggaaattgatgatattcatattcaatgtataagttgccatgtgctgaatatgattgttgatgtaatgaaagattgcccttgttgactgatatactgattttgtattgctcttttgagttttgatgttggtagttttgtaaatgtagggattcagtagatagttggtcatagaatttagtatataccaagtggtaggtctgttgatgcatcatgcatgagatcatccaatacttgggtagcgagtagattacactagtacagatccttccatttgtgatggcccctaacaagacaggaatttgcgggaggaagtaatctcaatcgggccgaagtttcgcccgattgagatatggtcgcacagccatgatagatcggcataaaactaaaacccgtcacggatgacacttatctgtgacgggccataattgaggcccgattgagatgagggttccatatctcaattgggccctaaaagaagcccgtcacaaatgactgtcatctgtgacgggcaccaaccagaggcccgattgagataagtttaatgcccgtcatagatgacactcttctttgacggtcttttattaaggcccgatagagattacttgtatgtccgtcatggttgattgttttaggaccgttacagatatttgttgcacagtataaatacccccctccacctagtgtaactgtatcccactgttcactattttggtgggaggctgcagggggcgatttttttgtcttttttccaaggaaaacaaaaaattcccaaaagtgatcaaaatggagcaatcaagtgagtaatattaatcattaattgagcaatttcatcacgtcttacttttgcaatactgatcttataagatatgcctctgatttgttttttttattttgtagcaattgatcgaagttgggtgtatgcgaaaaatttgaaacgtcattctacggagtacagaaagggcgtaataaattttatgaacgccgtggaggaggatcggaaaagaagaaacagtgattacatgtgttgtccatgtgtagattgcaagaatgagaatatgtttgatagcggagaggatgtacatggtcatctgatacaacgaggattcatggacggctatacatgttgggtgaagcatggagagctagaattaggaagtggagcagcaacagacagaagtggtgcgcataatcaggaagatgaagatgagcatgacatgtttataccttctccattgggcggtgaaacggttgatgtggattacgatctactgcaagacatattacgtgaccttgaggacccagcccagaacgagagagattccatgaagttcagtaggttggtcagtgattccgagacgcctctgtatgctggatgcaaagcaaatcacactaagttgtcagttaccttggacctaatgaagctgaaggcaagtagtggattgacagacaaaagtttcacagatcttttaggaattttgaaggctatgcttcctgctgagaacacattgcccgagacgacatacgaagcaaagcaggttttgtgtccactggggttagaggtccgtagaattcacgcttgtccaaatgactgcatattgtaacacaagcaatatgcggacttggatgcttgtcctgtctgcaaggcttcttgatacaagtgaaagaaaagtgctgacgaaggaaagaagtcaaagaggggtggtccggcaaaggttgtgtggtatctacctatcattgatcgtttcaagagaatctttgccaacccgaacgaagcgaagttagtacattggcacgccacggagagaaggaatgacggtatgcttagacacccagtggattcgattgaatggaggaatatcgatcgaaaatacaaagactttgctgccgaccctagaaacatgaggatatgtctgtgtacggatggcatgaatcctttcggtgacatgagtagtactcacagcacttggccagttcttattgcgaactataacctcccgccatggttatgctttaaacggaaatatattatgttgtacttgttaatccaaggtccgaggcaacccggcaatgatatcgatgtattcctagaacctgttatcaatgatcttgagattctttggaaagaagatgtggaaacttgggatgcatatggtcaggagaacttcaagctaagagttctattgttctgcaccattaatgactaccctgcactcggtaatctttccggacaaactataaaaggaaagaaggcatgctccgattgcaaggaacatacacgaagccggtggctgaagaaatcacgaaagatggtatacatgggtcatcggaggtggctcctgctacgtcacacatttagaagaaagaagaaaatttttaatggtaagagagaacttcagcctgctcccaaagatttgtccggagatgaggtcaacaatatggttaaggacataagcaatgagtttgggaagaaaagaaaacgtggcaagacaaaggagaagggtatgtggaagaaaaaatccttattttggtggctaccttactggaaagatcttgatgtccgtcattgcattgatctcatgcacgtagaaaagaatgtgtgtgagagtttggttggcctgatgttgaatattcctgggaagataaaggacgggttgaacacgcaccttgatctacaggacatgaatattcgtagtgaactccaacccatatgagatgcagagacaggtagagtagatattctacataaaagggtgggatacgccgatgaaccatttgtacttgcaaaacaggtcgagtagatattctacataaaagacccttcaaacaagaagatgcacatcgtgagggatggcaagcgccgaattgtaggagttgacaacgtcgtcgatgaagaagaatacaaccagaatcttcatgtaagacctcacattgaccttgacgatgatccccaagagcctgcggcatatgctcgttcagatcatacggaaggtataaccttgtgaccgatgcatttgtacttatctattgtaatgaatgaagtattttgttttattacaaagacttgatatgtgtactcatttatatggctaattttgttttattacaaatgttgtttaaatatttcaaatattcaaattgaatttcatgctattgggaatatagttatacataaaagtaaccaaaataaaagttgtagatcttgaaaggctctacgactttgctgtttatggcttttccatttgaaatcatttaatatttacaaatgccgtttaaatttgtcatatattcaaattcaatttcaaactattgggaaaaaagttatatagaaaaatgaccaaaataaaagttgtagatcttgaaaggctctacaagtttgttgttgaccatatttatatttgaaatcatttactatcctaaaatgtgttatgactaataaaataaattattacacaccagctatatattttgcactcacaaatacaaatactttaaatggaaaaaatggaaaaatagtcatcggtgatgggccttagtttaagcctgatagagattaatctatctctatcgggcattaccgtagggcccgtcactgatgactcatcggtgacggggtgcatactaatgcccgattgagatgacaatcaggcccgtcactga

SEQ ID NO: 23734 - DNA, 3986 bp, Oryza sativa
tcaaattcaatttcaggctgttggaaacaaagttatagagacaaatgaccaaaataaaagttgtagatcttgatgagaggatcaacttttttgttatgcctttctcatttgaaatcatttactatttacaaaagctgttttaatttgtcatattttcaaaatcaattttaagctgttggaaacaaagttatatagacaaatgaccaaaataaaagttgtagctcttgaaaggctctacaattttgttgttgaccatatttcaatttcaaatcatttactatctgaaaatgtattatgactaataaattgaattattatatagcagctatatattttgcactcacaaatataaagaattgatgggaaaaatggaaaatagtcatcggtgacgggccttagtttaagcccgatagagattaatctatctttatcgtgcattgtcgagggcccgtcgaagatgagtcatccgtgacgggcctaaatgtcatctcaatcgggcattagtatggagcccgtcaccgatgagtcatctgtgatgggccctacggcaatgcccgattgagatgactcatcactatactataactagggtttctcagatcggatctaaaatttttctaagtcccgctacagttcccgcctccttagaaccctagcaccgccgtcgtcctccattgccgagcccgccgccgtcgccatcgagcccgcggtcaccgccatcgagcctcctccgccctccattcgaactgccgccgcctcctcaccgacaacccccaccgagcccggtgacatccttcctcatcgtcgtcgcctcctcctctccgacgaccgacgccacctccaccgagcacgccgccgcctccaccgaccccggcaacgccctctaccgagcccggcgccgccgccatcgagactatccgccgccgccaactcctccttcgccgactcctccctcgctgagcccgaggccgccgcctccaccgagcctccgacgcccgatgccgcctccaccgagcctggcgcagccaccaacgacctcggcgacgccctccaccgagcccgccgccgccaccgagcctgccgcctccaccgagcccggcgccgatgcccaggtgagtcctccatcgcgcatgaatgatgaatagatgaatgtggttcgattgatgaatgtgatgaataaatgattagatgaatgtgtttgaatacttgcatgtgtatggatagatgaatgtggatgaatagatgattagagaggaatgtggatgaatagatgaaatatttaatttatttatatgtgatattcaattcattttacatgtggatgaatagatgattagatgaatgtgtttgaatagatgaatgtttatggatagatgaatgtggatgaatagatgattagaaatggatgtggatgaatagatgaatagatgaaatgtttaatttatttatatgtgatattcaattcagtttattagatttgtgagacgtgcaatttagtttatttatgtgaataagtgattttagaactttggattctaagccattgaagcattgaattctgtattttcgttattttgaaaaaaaagtagacgatgtctcagcaaggcgaaccaatgtcgacgacaactagtgggtcctcaagggcacgtactcctaggacagggaacaaaatccctaaggaacggttccgcataacgacagtgaaccaagtagggttgccgacaggtccaaggaaaatattgagccgatttaggtctatctgcggggtcatagggaggcagaaattaagtattctgcaagatgacattaagcaagtgccggccgcagagaaggatagtgcttggctagcgttcaaggagagcttcgattatcctgtagagcacgagaaccttatcaggcaggctgcttttaaggtcatgggcaacgcttggaagaacttcaagagtaagctagtcggcgagttcgtcttcaacccggcgaatcctgatccaacagagaaatttccttggatcacggaacaggtctgggaggaattccatgtgaagaagtcgacccccgagtccatagctagaagcgaggcatatcgcttgcttcagagcaagaaccagcatccgcaccggcttggcaccgccggatatgccggtaaggaagaggaatggcagcatgaggatgaagaagcggaggaatcgaacacaccgctcgtgtttggcgatatcccacaccctcgggctaggaactgggccagggccaggtaccagaagaatgctgatggcacaatcttcatgccaaatgcagaagatcaacgagtgtacgaagctatagtaagtgtctagtcaaactagatgttcgcattgtttcccatcttgcagtttatttaaccccactaaattgtaatgcagaaggaattggttgtcgagcaacaagcctcgcaagaggccagctctcaaagacgtgaggatgacctcctcacgaaagcgttgggcaacaaggaacaccgtggacggacacggggagttgggtcctccgttccctggaagtatagatttccagactacgcgtggcagtacaagaaacgaacttccatcaaggcagagaaagatgcacgccttgaagccaagatccgggcgtcgatcagagcgaagctgacatctgaattcgacgaaaagctcaagtcgatgagggcaaatattaggcaagagatccgagaagagcaacagaacccgcaggccgccgctgctgctgcgcatgaagagttaggaagtcccacccaaaaacgcagcagttgcgcatcaactgagttggcggaaaatccaacatcggtcgacagcgccgtcgaccacacaatggtaaaagtttcgtacacaatgcatgaaagggttaaccaaatccatatgatatataataatctaaagaaattgatgaatctatcgcaggaaccaaccagctacacctgcacaggtagggtgattgcgaactttacggtttcaagaggccgaggaccttggttccagccgaccccagagacaagagtgcgtgactgtgcaaaagttcaagtagactcggttaagcccaaatacgagctgttcccactgaggtacccaccgaacgacgaggtcctctcactaggaaatgcccgtggtacctcatccaatggcccaaggacctcattgagataagggttacagcgagtccaaccactgcaccaggcggtcgtccgccaaagagacccgcctttgctccttcagcccctcctgctcaagatcgtcctgcacaatcttacgatgacattaatatagtacaagcccggtgacatcccacaccctcggtaagaacgcatatgattggaccccaattcaactagcgatagatgaagcgtagacccaatacgtgcaaagaggaggcctcaggaagacaggacatgacaccctcatccacaaaaaagacttcccggtgaagcaacaaataggtgaccagtgcggattccatgtgtgccacaacatgcgccttctgtacagagaaaaggtgaagactttggctgagtttgaggtcggtggtctcaattgtgatagactaactacattttagtacttatatatgatcgatcaactaatctggaattatgacaatgtagggcacaataaccaagtctctgcctaccagctttgaggagattcgcgaggagatagccagcttcatcctccgcgaaataattaaccccaaaggaatgtttaggcttaaactaaaatgatgagcaatgttgaacttttatgtctagagaatgatgaacacttattatgcaactgtgatgatgtaactgtgatgcttatatttatgtatatatttcatatgtttatgttaagacttgctaaataaatatttgatccaattaactcggttttgcaggtgaaatacgataaatatttgaatggatgtgaaatatgtgaatggatatgaaatatgagatggttgtgaatgtgtggttgtgt

SEQ ID NO: 23735 - DNA, 11552 bp, Oryza sativa
  unsure (1)..(11552): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttttgaaaatatattatcgtttagtgatggtggtgtgcataactaataagtacaaggctaaggtgtatatatgtagtcctctcggtatatatgtatagttgatgatggtttattcaatatacaatttcctcttttttccatgtatagctggaaataagaaacataatattggttctcagtttatttgctccatgtcacgcacaatatgcttgaaagtgtattcataaacgatctgttattcaaatgtcagttctgaattgtcataagaaattcctgtaaattaactgtttagttttttttaaaaggaagacaaaagctttgacttttttatattgataaaggagtttaactgtttagttaccttgtagctttccagttgctgtccatgtccagtatattttcctaatatcttctttttagcgaacgtgaaatattttttttcactaaattgattctctctgttgtaatttaaagccgatcccattgatttgaggctcttaaatatataaatctgcctgtggctattgcgaacttatttgttctttttcctgtgccaggttcaatgaaaatgttgtgaagaaagctgtccacctgcaggttggattcctaggggggttgactgttgaggaataaagcaatccaatggatatttcaaagtaaaatggtctaatgatagttacaggttcaggaaccttatcatcagcaattgagatgggcctcagatgaggaagtatgtccccttcgttccagtcaccaaacattagctaaaaaacgtgtcccctgcactaatctagctgttattttgatcatatgtcataaactgttcaaaaaataagtccactgactgttgtccccagtctatgctgttccatgaaatctgtaatttaatcaaacgttgaagaaccggaacaataactcttatcttaattgcgtccccctggtagtactgttactgtactactaccgaagtacggattgtagttggtagcaagagcaggtcaaagatttcatcgaggaaaaatatttgacacgcctttctctaacacaagcagctactcctattcgtttggtcaaagttgaggtccaatgtgttcatcatctcggcatctcgctcgtgagaacgcaacgacaatgcgctatattctgcgctgacaggtggggcccagaaaggatgaagcgcgtccgtagactccgtacggggaagttgctacgtaccgacgccagctggactttgtactccaacaaacggcagcgatgacgccgaccgacctaccttcccgcatgtggacccgacacgtcagcctctacattcggcctttggacagcgtcctaaagatctcgttattttttatatttattttctaaaagatttaaaatataaatttccatttcaaatattttacatgaaaatactcctcccggtagaagtatatttttaaaactttgaaatgataatttatttttaaattctttttaaaaaataaatataaaagtttaaacaatccaagatctcgctacttccggcccgggccgacctgccgcttcccttgatatgacgcacacgattttactgctggccccacatgtcacaagcacagccacgaattcggaacgaaccataaaccgcacccgcggacgtgacacagccacgctgactatcgtgccccacaagaaatcctgcacgctgttaactgaaacgcttttgactgacgggtgggaccaaatttacgggcccacaggtcattcaacaaggaaggtatatatagcaatatcgcataaagtattttgcaggccacgcgcctttcgtgatctctggtataaaagtctactcctaccaattaacctcctactactagtacaccagacgacaacacacacacaaaaaaaaaaaagaagagaaaaaccgaacgaaaatcccctcgcgcagacgactactacatccttctcgtctcatcccgtcgacccgccgccgcctcaatctcgaagcctcggcgaggctagggtttctgcgtctccatgggctctaagaagcggtcgcctcagcatccggccgccgcggcgccccctcccgccgtcggcggcggcggcggcggcgaggtctccggcgatggtggcgcctcgacggcgaacgggccggtggtgccgaagccgtcggaggtggcgccgttcctgacgaaggtgtacgacatggtctcggaccccgcgaccgacaacgttatctcgtgggccgagggcggcggcagcttcgtgatctgggactcgcacgccttcgagcgcgacctccacaggcacttcaagcacagcaatttcaccagcttcatacgccagctcaacacctatgtgagattcccttgatccctgtgttcgtttgtttctgatgcgcgaattcggtgccatttccagttggttggacgaaatcggtagtgaaatctgagtttctgttcccaatttgttgtttattatcacggctagacagcaaatcttgcttgcaattataaattgggcagtagcttccgatgcactgcatatgaatttgtttgaatcgtgactgcgtgttatatgatgttactttcttctattttgtgccttttaagttgattgcgtgtattagggattatctgccattttggagttaatcacttattaaattttaactacgttggaagctgttggcgatatagttggatgcctttcttcttctagtcgaaagacacaatagaactagtttctgcggtggctttctattcaacaacaacttctagagttctagtacataaaacacgtcattgggggtggggactaatattgttaattttgagaccagtttctgttctcttaatgttttgtgaatttgatcgtatgaaagctggctgtagaaactatgccaaactcttggctttaaattacaggggaatgatatgtgttgcctatcactacttctaaaagtctatttcccccatatttgtatttagtgaacttcagaactagagaaagcatgatgttataacctaccatcatgctgtataagaagaatatgttccctcttgtttggctgaaagaaatgcatgtttggttgtgctgatattgtactgctattatcttcttctgtgtcatttgcctcaatacattgttttatttgaatttgaacttccttttcacaatcgaatttgtctgatgaaatataagattatgaatttgctcttttattgaactatatggacacttaattttgtgcttttggcaaatccatgtcctcattttgatttctggataaatcactggactcttgcacccaggatttcttctgatgtctaattacttaaatgcgaaaatcacctgacttttgctcactgggttgctttcctgtagttaggagtagttctatttaaccatctattagttgttcttggcttcatatactcagtaaaacttaaaaacaaagcctgaaaagtgaaatctccaatgggatcagtagaaacattactttatctgctttcattgatgttctctattcttttggagcatatgttttatattagctgaagttactcaagtttcctttcataatcagggatttcgtaaagttcaccctgatagatgggagtgggccaatgaaggttttattatgggccaaaaacatcttctgaagaccattaagaggaggaagaagtcttctcaggaatcacctagcgagatacagaaggcgcctgtcaaaactgcacctggtactgaaaatattgagataggaaaatatggtggccttgaaaaggaggttgaaacccttaagagggataaagctcttctcatgcagcagcttgtagatctcaggcactaccagcaaacatctaaccttgaagtgcagaatttaattgaacggcttcaagtaatggaacagaaccagcagcagatgatggcacttctagcaatcgttgtccagaatcctagttttctcaaccagcttgtgcagcaacagcagcagcagcgcagatccaactggtggagtcctgatggaagcaagaaaaggagatttcatgctcttgagcagggccctgtaactgatcaggagacctctggccgtggggcacatattgttgaatatctcccacctgtcccagaaacatcaggtcaagtaaatccagtggaaggagccatttgttcggccaactcacaaccagttccaagtcctgcagttgccacacccatggacatgcaaacgtctaacgttgctgatactctcggttcatctgaggagcctttcgctgataactctactctacatgaatgggatgataacgacatgcagcttctgtttgatgataacctagacccaatacttccaccatttgagaatgatggtcaaatgggccctcctttgagtgttcaagattatgattttccgcagttagagcaggattgtctgatggaagcacaatataactccaacaatcctcaatatggtaatgactaattactgtataccctatgtttttgttcatcattttgtggaaaacaagcgtgatgtcattttagttaactgtggagtttctatgtgcatgtttcatgccaaatgccaaacaatggatgtttacagaccacccttttagtctgttgtgctaggatttggcaaagatgacatggagccttattcaaagttcaatacttgcttctcaaatggctttgatatttccttctgttatttcacgaaagtagtgtttgacaactagagtgatatttttttttatatctggttaattggacaattttgatcacagccaaacctcttgatttagtttcctcaaccaaaacagatctaagctgtgcctgcgtcacattgattattttcccaatcagcctattctttgtttgatcatatcggtttcaattcactctgcagtacttctatacatgcctgacatcttccctttttcatcagctgatgtcattaccgaagcttgattggtggtccaggagcatacttgcagtaacattaggtgggtacagtccatttttaacatgaaaaaggaattattccttaatgtgctttgttaatggaatgcttactttgcgttgcaataccaaagtaccaaactgaaagacataccatccttgtttaattcctctagccgttgtttcttacagaactttaggctagtatttcgtgtcaggctaggactatatggtcaactaaccctgcaaccgcctccaaattgaaattcaatcgaaaaaatattgaacttaatggcttgaactgaatgcttactaaataaacatgattggtcgttaaaaaaatgccatcagccatttcttgtaaataaatacacgaagctatattttttttatttgtatgaccaatgtttgttccagtactgatccagtttcaacatctgcagttcttcggtgaccaacctccgggcgcatctgcaccattggcatcccgaaatggcgtcctcagggtgtaccgatgaattatgctaacacagaagaagatataactctaatctggttgaccatacagaactacctttcttgttcaaggcactttttggggacaggggacgccttttcgcagttctcgtcgtcttacactagcgatggttgctaccatcgaattcatttggtgtatatactgttgttcgtcttataaaacatgagcagttttgtacatttaccttgcgtatcatgatcgcagctgtgtacctctgcattgcattactcttacctttttgcacaccaggctgccggccatcttgcgtgatgccgtttatgtagaagcgcctttccggctttccgtcgtacagagtccaccggttttttttggactgctgaaggatgaaggatgcattcactgccgtttattagcggacgaccaacgattcctggacatccaaatttaaaggggaacaagcttccagcaccaaagaagcgcatctggtgtagtggtatcatagtaccctcccacggtactgaccgggttcgattccccggatgcgcattttttggttatagccctaggttctgtgtcctttaccatgttctgtgtcatctttttgccacgaacaaatgcttgacgatgacgttgcaatgctgcatagcctgaacaaacatccatgttctgaatagccgcacgcgcttcaattctcagtttatcacacatgaaatggaggtcacgactcgtccgacgagtcccgaccatcgcgcaccgcagcagcggccgctaaagcttataataggctaatagaactgagcaatagaacatgccgacctctgtaatcgcactgctagaaaaactatttttcagacgatgacatttttttctctgacgggtatgccacttagagctaaatgaccgtctgtgaaaataacaactgagcgatatcgtcgtccgcttgcaaaaaggttaaacatgttaaaaacatcatctacccaccaaaatgctaagtcagagcacttcgccctcacacctctccctcctctcccctctcacctctcctctccttctctcccgccgcgggatccagtcggagggcggtggtggcggcggctaccggcggtagcaacgcggagggtggaggacgcggcggcttcctcccagatccggtggagaccgcggcgacggcgcagagggtggtggtggcggcggctccaagcgctggcggttccccttcctccctcctagatctggccggagaagggaggggtgatggtagcggtgcagctggaggtgtatagggcgagggatggggtggtattttttttattctcctaaaatatctccgcaaacgagtggatacgacgcccgtgaaaatcaactattttcatagacttgtgcgcataggcgggccgtcctcccgtctaggaaaatgatttttgaccgcctgaaaaaatgatttcttagcgtcgagctctctcgctgcctgactcatggagagattgctgggacatgacgcaaaggcccaaggaggcggagccacgagcccacggtgaactccgacctgcgatctcacccggtcacgccgctctgtgcttctctattcacatcgtcctacctgtccatctccgtcccggttggcctcacaccactcgtgccggctcgccgccgtgcctcgtcatctctcttatcccgtggtgccccatccgcatcgcccgatggcaaaccgacggccttgatcgcccaaccggatcaaccaccgcccccgtcttaccgttacgttgatccagtcagtcgcgtggggagatctgatgggccaccggccaggccgcccaagtttttgcacctgcgaacccaccgggcgggctcctggtgggcttcgccttcggcgaaacgcccgcggccggtgcccttcttcttccgccgaggcaggaggcagcggcggcttccggcttccttcttgtggctggtcgaaccgtctccgatgataccttccacgcaagcagctagtcgatcgcgccaacgggggaaaagccattcctatcatcctgtggacgcaataatgcgccgtcagttatcaggtactgctgcctccacttgtgctgctgctctccataaatgtccaacttgacaaaacggcgactttgttgtaccctggcccattcgatctgcagtggtacacatatgatacgtacccgcagcgactgttgctcgttttcgtttttgcggccgtgtggccgtgtccaaactgggcgcagagccaaccctctccacgtcggcttgggaatatttttggtggccttgctacttgataaatatcttttgtttaaaatgtgttcataaatacttactccgacttataaaaattaaaattctaactccgaggctttatcccataaaaaagtatttctaatcacgtgaaactcaacaagtaatttaagaatgctaattatgtggattaattatcttaatttttttaatcaattatatatatataatgtatgtatgtatggggttcattatcgtggtcatttgtctatccttctaatatgtcctaaattagctagaattttagtttttaggatagaggaagtaaatagtaatatttaggttatagcttctccatcctgaccattccttatttattttttattaaatcctttatgaatacttatattcgtgaacgaggaaagtattttaggatcatgattctgaagtctgaagaaagtattttaggatcatgattctgaagtctgaagaccattttggtcaggagcctgatgaaatttcgtagcaaatttttaccactcaatacaggccaaaataaatcaaaaccaactttattaatattttaaatttaaattatagctttttaagtgtcgtttttttaccttgcttgagaattgagatatggtggggggattttcaggatcctgtggttctatatgaggagagtcccctagtcaatatcatgcgcatatgagatttgacacacaagatgcatatatatatatatatatatatatatatatatatatatatatatgacactctcactacacatgctaatgaaggatccaattggcgatccatcgctgcacatgtacaatgtgttgcctatagcacatttatggacgttttattattttgctcactacctaatggaatgagtacaacactgcagtagttgtgctgtctatctaaaattaaaacatatcgtcctttcgaccggttgttggagctacattttcagctcacagcgacccgggttagtttcctgtacccgtttttgttctttacatcttctgtttatgccgctgcatctctgtcgtatatgttggtatgagtcaccacatgaatccagcaactctaaaagagatttctttttaatcaatccactaatactaaagctagctcaggcttgctgtattcactcagtcacaactttatctcctttacagatcgggaggcacaagtgggggagtttacaaaagcaaaaccattgaagaaaaatggcatgtgtcctggcccattggaaaatagaataatttcttaagagaaggtaccgtgtctgtgtgcgtatgtttttttaggacatgtggttacgcagtacctgttcatttgaagtttttcaaatgaagcaatctgttccatgccgtcaagtttcctccaatgttatagatgtctctaatataagttagctttacagtaagcagcatgtggtgaatttatgaatccaagaaattcgatttgtttttggtaatatcgcttttataataagatctttttttttttcgaaaaagacggcaggaggactgtctcttatcattaatagagaatgagagaatacagattatttacaaaataagaccaaattgttttatgatctgaaggagcacatgttttatgatctgaaggagcacaatatcatggataatttttcttgctgtgctctgggtttcacgtagttgcagaacttgtagcaaacatatcattcagacaattgaactagactctttagtctctcattacgattgcacaaaattgtgtcttgcaatttgtaatttggccaagaacgaacttaaaaaacaaacaaatccttggatggcaagaagtgaaaagagaggaagaaaaaaacacacgggacaaagctgttcgtccacgtggcagagattatgtacacgtcatctctgattggttcctaaatctgcagagttaatttaaccggcggctcgattggctatagatcgccgctctgctccgcctcggcgacgagcgcggcgagcgagcgctgcgcatcggcggcgtcccgctcggcgatgaacgggtgctcgagcagctcgccgaccgacgcgcgccgcccggccttcttctcgaggcaccgcgacacgaagtcccggaactcctccgacgcggcggccggcatctccggcgcctcgccgaagcatatggcgcacatgagcgccgcccagtcggggcgctgccccacggggagaagcgggaagtggccgaggtacagctcaaggatcgctaccccgaggctccacacgtcggcggcgtacgggtcgtagtcgccggagtaggcctccgggtcgaacctctccggggacatgtaggccgccgtcccgacgtaggacgcgcaggggtcgagccgccgccgcaggaccttgcccgcgccgaagtcggcgatcttgacctcgccgtcggcgccgaggagcaggttcgacggcttgaggtcgcggtgcacgatgcggagcgcgtgaagggcctcgagcccgagtagcgcctgcctcgccacggcggcgatggggcgctcccccatcgggcgcccgagacggcgaagcaacccagccagggaacccccgggcatgagctcgagcgccagcgcggcgggctcctccaccccaccggcggccgacgggaccaccgcgtggagcctcacgacgtgcggggcatccgccgcgagcctgagtatctcggcctcccgcgccgcggagaggtccccggcggcgaagagcttgagcgcgagcggctgctgcgcggggcaaccccgtcggtggcgcgccttgtacaccgtcccgccgttgccgtggccgaggacggagatcctctcgaagtccgagaggcggacgtcagaggaggtggacggcgcgactgcgggctgctgctgctgctgcggcgccggcggcgggcggagggcgaagtgatcgagcgggagggtgaggtgcggcaggtggcgtcgctggcggacgagagccatcggttggagaggagaggagaggagaagagaagagaggagtcgaggagagatgggagctgacgaggagggggaggggagggggagcgggcgtatatatggagtggagaggagagagcagagagggggggagtgagatggaaggcgatgtgtgggtgcgagtggaggagagtgtagtgcgggtggaggcaccgccgggtgagtgattgtgtgtgattctcggtaggatctgagttctgttttttccgtttccgtttcgcttctcctgtcatgtcctgccgtgtgtaactgcttcatctgggcgcggaagagatggccagtgtagcgcccattccgtcgtggcgcctagcgggaaaactatctcttaaaaaccctaattgcgaaatttgtttcttcgcttgttgtctagtgtccgtgccatctcagatctcaaatcctcgatctatcgtcgagttcaatcccgaatccaaatccttcccaaatcaattcctccacaaaagtctaatttgcctcccccgggttcgatgggccgaatctctctcggcccatctcccc

SEQ ID NO: 23736 - DNA, 29620 bp, Oryza sativa
cccctccgctccgcccgcgcgccgcgcgcgcgtgcgcgcgagagccgcgccgagtgcccctccctcgctctgcccgcgcgccgttgttcgcgcgcgcccgcgtggtcgtcgcccgcgtcgctcctgcgccgtctgcgccgcccggccccgctgccctgccgcgcctgcagccgctcggccccgcagccagcgcgcgtgcccgagccgcgtcgctcaaaccgccgcgccgcccgttgcttcccgcgcgcgcgtgccgtggtggccgaccgcctggtcgccgccgccgtcagcctctgccgcgcctgcccgcgcctgccgcccgtgtcgtcgcgccgctccaaaccgtcccgccgccatcgccgtcgtcatttcctcggccccgccactccgcgggcaagccgccaagggacggaggcagagccctcctccctatgctgcgacgcccccgctcccctcctccttttcccaaagaagcaaggggcgagccccctttctctccccctttttcctcctttttccctttcgccggcgtcacctcctggcgccgttttggccgccagccggagcgccagctcgcgccttgaccgccctaagtcggttcccaaaccgacattgccatcctttaaacccaagcctccccctttcccttcctctcccattcgcctccgcgccattgccgccgcccccgtgctctgttcgccgtcgccgttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgcccgcccgcacggtagagcatctccccgttctccctcctcgctccatctcctccccttagactcgggtagtagcacaagtagcctcccgtagctagccggcgccgccctggccgttgccgtcgctcaccgtgtgctcgccgccgttgccgcccgagctcggaagcgccgctcgtcgccggcctcgctcggcatagctccgcccaatccgacgctagcaacggattcccgtagccgcgtagatgctctcgccgccgggaattggcccctcgtgacctcgtcgccgtttcccccttccctcgccgccggttgccgccgccgcaatccgccgccgacgcactccctccggcgaatccgagccgttggctcgtctccccttgtcctgtgcaaccacccggtgtgctcgctctcgcctgtatcgccgtggtttgctccgtcgctcgccgctgtcgtccgccgtccgttccggccggcgtcgtcgtctacctcccgccggcccgcgtggcagccacgtgggcccgccgcatccgcatccaccgcgaaccgtgcgcgtgcaccgcgtccctcccccaccctagcgccgcgccgcgtgctccctccgcacggtgagccgagccggtgacaagcgggtcccacccgggaccacgcgtggtgagcccggcccaccggccctctctctcctcccctcccgcgcgcgcgcttgggccgccttgggccggccggcccatttagctcggccggaccgctccgtttctctcgggccgtgccctagccgcccgaggaaaagtctatattcccttcctcttttcttttcttttcttttcttttcttttccaaaaaggattttcctttagaccaaaaatccaataatcttagaaattcaatatcttcccaaccgtaaatccgtttggctccgttcaacttccaaaattcctcgaatctcgagatctatctaatggcacgcttagaggtcattaatagggctttattcttcgccgtatattgagttgttccgtttcgcgtgtagtttcggagcccgaagacccgcagtgcgaggatttcgaggatcaagctccagatctcgagcaaggcaagccacccttgaacatcttgagcctatatttgaacttaattatattgcttgcaaaatatcatgcattgataggattgcacgtaatatgtttgccccgtctgcgaggcagattagtgggcatacctaacttgttgcatttgatccttcctttgttaatcgttacaccatgttcccttgtaaccacccagttgcgcctcggtatccgtgcactctgtgcgagtatcgacggtcgccttcaaacttaaaatatgataaacatcttgggtaaaacttgggttttacaaaagacttggaaaacccgacacctgggtcggtgcttacgaactaaatgaatttccaaaaccgcagaccggggaacgtaccgggtgtacgatttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccattctgcacggactggatgatccgggttagtaatgtcgtgtgggtaaagtgtacccccctctgcagaggttattaaaactgtttgaacagccgtgcccacggtcatgggcggatgtgaggtgattcctagcgtagttttgtttgactactgccttgtgaaatttgctgttgtggaatgggtttgatgtttgaaaaatctgcggctgatgggatcagccaggcccgggtggccgtttgaaagctgttggccgggtgccaatcttgatcaattcaaaagactgatacattgcacatactccgaccggacgagacgcactgtctcatccgtgtcgtttgagaagcactcacttagttgtttcagaaaagagttcaaataaaatcaattgcaaaaaaataacagcctttctttgaagcctgcattaaacacttattttccatggctttctgagtactcccgtactcacccttgctttatataaataattcccccccagttgctgaagaagatgaagcggatcccgctgacgagaagttcttccaggagcaagccggctacgatgagttttagggtttcggcctagttcccaagtcgcgcctgtgttgtttggtccaagtcttggcttccgcttcccttctgtaatgcagttgtgagctcgggatctgtccgcagcccaacatgactgtacctctactctataataaagagacctctgttgctgtgatattctgtcttcctgtgataccagcactgtttcctgggactggtatcgattaacaggttaatttggagcgtcacgggctagttccggtcggtactagttcggggcgtgacagccagctggggacatttcattgttttctatgagactgtctaggctcgtttttcttagatgatgaaatagggcattatggtctttgcttaaaagttacagccaattattataatctcacacttaaaataagtgaaattaaaaaaacttaaaaatgaaaccaatcaacaagaagaaacaaactaaagagtaaagattgtcaacctaagataattatacaattattgaattctgtttaaatttggattttatgaaaccaactcattgccccggatgcaacattccaatatgatttatagattgctgtgcattaggaagggtatatacagtggtgtgatttcagctggctgggaaatttggcacgcaaaaatttcaagtgacgtgaagaacataataatatcatctgttcaaacatcttgtagatagttttatagtattatctaaaatactgtaggaactgcctatataatcagttcatttcgtgttaagggtggaacccatgcacccacgtcgtgacgtcgtccatcccattttctccgtcttgccattgctagggggcaaccccatgtggttgcgaggattacattggcgggctctcttcctctctcacaccccatctatattggttgagaaagtttgtattccctctatcccaaatataacaatataaaagaggattaaacagcgtatccagattcattatatctaatcttttttactagattgctatattttaaaagagagggagtatatatctactaataaaaatgacaaaaaattgtgcatatctaacaaataccatcatactatacttgcaagagcaagttcccaacactcccctctcattttccgcgtgcatgcttttcaaactgctaaacagtgcgttttttacaaaaaaaaatttctatacaaaagttgtttaaaaaaatcatattgatccatttttaaaaaaaatagctaatacttaattaatcacgtgttaatagaccgctctgtttttcatgtatgggagatgggttcccaacacccacctccaaacacagccttagagcatctccaaattccactctccaaatacttatatatctaactctttaactgatttgggtaatcaaactaggtgttcactccaacagtctctctatttacatctccaaaataacaaagggacccacatataagcctctattaccttcttcctcttctttctcttctcccacatcgacccatccccgcgcgaggtggacggcgaacggcgacggcgacggcgacggcggcagcggcggcggcggcagctcctcgtgcgggcgaggcggaaggcgacggcagcggcggatccccgcgcgcgaggcgggaggcgatggcggcggcagctccccgcgcgcgcaaggcggacgacgacggcggtggctccttgtgcgcgcaaggcgggaggtgacggcggcggcggcggcggatccccacgcgtgagggcaatggtgttctgggcggagatgatgaagacagtggcgttgagtggcgacctcggcagcggtcgacggtggcgtcggcaacgcacgacgacaaggcagcctcggcagcagagggcaaccggcggcgggcccggcagggggcgacgacggcggagtggtggcgccggcggagctgtatctggggagtggtgaatcggagaaattgcagagagagtgtgggatgggagggggaaaaggtgtgggatccatgtttggctaggccattttggctggccaaagttggccagcgtgagaagtgctttggccagccggatggcttggctatacggttggctagtctgttagagcatgattttgatctaaaattgccaaaatttggcttagagagtggagtaaggaggctgttggagatgctcaactttcaaaaatgccggtttccattagctcatagactatatgtattgaagaaaagtacatttttttcttatatagtagtttgtgcctacggagtcatgtagatatttacattacctcatgcgttccaaattgctgatcacgtggtatattagcagtttgttagcacacgcgagctaacctcgagagacttgtcattaatcaggttcatagcttatgcctacattctaccgaccgagttaggttaggtaggtgcacgatttgtttcagtctgagatatctaatctgctcaaagtccggagccacaactgacaacaacaaaattcggcaggggcggccgcgcgcggtccttcgattttctccgtttctttccaatcctctagacttccgagtgggattggttcttcgattctccccgtttcctgcctttctctcggtctctcgcgcggggaggtcaagtccatttccgcaaattctcaaaaaaaaaaaaagtccatttccgcagcggagccatcctcgcgcgcggtcccgagaccggtaaccacaccaacttccgcaggccagtgggggcgaaagcaagatctaaccgagaaagtgagggcgaagtgaggccccgcgccgccccgcgcgataaggacaaggatttttctccgtttcgtcctgatacgatatgcgtgacgtgacggcggcagcgagcgaagggcggcaggcaggggcattcgcgaagaggggaagaactttccgacgtcacggcgcgcgcgggcaacttgcgcccaacgggaggcaaccgcatgggggacggggcgcgtgcgtccgtgcgtgactcgtcgcgctcttacgccgtggcgtggtgttccgttttgtgcttgcgcttggcttgttttgttttgttttggggtgctttgcttttgcagctgaggtgccactgcccaccacgtactactgtgcaaattggccgcaagaaagcgatgcttggataggtacttgctccgttgctcgtcgtgtggcctggatcagtggatctcggaggggataagcatgcatgtaccgtgcgtgcacctatagaagtgtaagtagcgagaggtgaactattgggcgaggcaactcgaaaacttgataggtggcacggcagcgaacacaagtacacaacatgtagtagtagatctttattttttcaccagtggtatggctaggaacgatcgtggaagcgtgagtgaatacggtgaattttttgcggtgatgtacaacgggccaaccttttgattttattttttatttttctgtgcgtggggccaggttagtgtcaatttcagcgtcgttttccaatggcataaacaatgctaaatgacgcacgcattgttcgtgataggatatccatcccgtctctctctctctctctctctctctctctctctctctctctctggccccggctatcctctccctttcttcttttttaggcgcaacttgtcagttgaacccatctcgctcggtattagctttgcgttcggttctcgtaaagacggaataaaaaaaccgtaatacctttgtgaagtaaaagtaaccaacccccatcattcaatccaatccaacctgaggtacacgtgatcgaatacgaagcgcgcacgatggcacgagaggcgcggcttcttccgcctcgcgcgattcgcaaccgtccgttcctgcctccttccatttaactgtggatccattcctgcctcacccctgcaaatctctgtgcgccttgcaggttggaagaaaaagacaagagatacgaagtggtctcgtttcatctcgtgcgctagaaatgctgagatgatgcccagtttttttaagaaagtttctcgtggaattatggtggtttgagctcacatcagccgcccctgttggaggaaatctaacgtccgaaccatatattacgaagtggatggattaggtgtgccatgtttagtttttcagataatgatgcgatgattagctagcagaattccagcaactaaacatcgtactacgtagaaattagtaattggcatacgcgcgcatttgtctcattgtggaggagtgagtgcttgaagaatctcacctgctggccgtatttggtacgaagccgctaagccatcgaaataaatcagtggaaaacgaaaaactcattgctagtcatccaagaagatggatcaaccaactatgcttaaacgtgcagacgattgttggaaagattcttcacccccacttactagtgttctgttttgtccgatcctgtgtatagaataaatgccaactattcttactcgtagctaaaaaacagagtacagtggttcaatgtgaagaaccgttcctggagtatatcccatttcgttttctcaccgcaccaaaaaccaagcaaagatttaggcatgtattgcttgccatcgcacgatacctgatagttgatcaatggattcactgttatctaaccatcatgaataagacctaagcagcgacttgatgtacgagtagttatcggagttcctctcgctggcattgaaagaaattgagacaggacgctggcagagagcgattggatcactgaaacctttttggatcagctgaatttcaatttgcaagagatagtaacatcgatacattaacaagttgctccataattcttaagaggttataccacttgaaacataacatatcttatgtttccatatttaggataaatgccatgtaagacacatgcatggctttcgatcacctggtgagttgcttgtgatattaataagtcctaaaagagacaacttccattctcaactcgcaagtaatctacattaccatgttacttggaggtgatctataatattaatagggtagaatggttggatatatattagagcactgagtctacctgtatataaatttataattgcttccaaatgacttataatcttgcccacagttattatgtaagaaattcagctactctctccgtcccaaaatataacaacttctagcattaaaaatttatcccaaaatgtaacagcttatccaccaatattctcttcacaaccaatcacaatccttcaccattcaatttcttcacttacctccacgtctcaaccaatcacaatattctcctattttattatatctactttcttaatagctatatcaaattataaaacttctaatattctgggacggaggcagtagcaaattcggtaaagtcatcatagttcacaaatattataaagattatgagcattttcaaaactcgcctatagctctgtactgttctattatattattgcatataaggtgaaaagttcacaaatttttcaacactcgcctatagctcttagactgtcatattgaacgggatagcaaactttggaccaactcactttgcatttgcctccatgcatctcctcattgccaacccataggaagcgcacctcttgttgccttgtcaatatcttgaatggattgttttggcggcttcaacactgtgaggacgtatgttgggatggcacttaggactgagttcaccataatctagcgtccccctgcatataagaacgatggattccatctcaagagacaacccttaatcttgtgttggacaagctgcagatgtatactttgtgcaaatggccaagggtgagccgtagtccaacaagttggtgggaaggtagccctcaccatagaggagttgcacaaaacgtcatcgagatcaatttcctgacatcgtatgggtgccaacaggccctttccgagattgacatgcaactctgttgcctcgcggaagtccctaagaatgccaataagattttcatagctccacttcattccttgctggagtgaggaaaacagccgcatcacccacatataagattttcggatttaaatgccaaagttgtagtatagtactaatataattatatttataggtagataaaaaaatatcggtattaaaaacaaagaaaacgactaaaagtaaatttacaggagacatggatccacactttgagagagtgggaaggggcaaataagcatttaccatttttcgatgtggcgttaaataatttgtcacttatatgtttatgatttgtaggtttatgtggtaaaatattacatctaaaagtgacaaataattaaatatctctgtcgatgaatggagtaaccacttcaggttcagtagttcagtgccgggactggttgatcgccacctgctcttcacttcagcagcagctgaaagttgttggcacaccacattacccgtcgccggctcgccgctaacgtgccgaccctattcactctagaaccccaaaaggcagacggctcaacgagagcgcgggcgcaagtggggctgaaaggggggtgtacgcgaacgccctcccttctttctgcagacgcccccaacattcggggcacatgcatgaacaacactctgattaggatggctcaacaaatgccacgcacttcatcatagagaaaagaagccacgccctccccacctcgttttcctcatttttatggcgtgcaggaactctcgcgatccgagtttttaaagtggccgaggcatcgggcgcagccggggtccccactaggccactcgagcagcggcacgaagatgaccgcttcgtccacttcaggtagcccacctggatgcagacccttcctgttgcatcctggagatagattggaatagagaagtctagagaataaaactagagattagtagtagatgttttgatgacatgtacctgagcaaacgaggtggtactctggatcttcagctaactgaacatctgtttgcagatccagaagaagatgatactactagtagcattttattcatcccagaatctgaaacctgagcatcagagtatctgagtatgcgtctttcagggtcacagaatcgaacctcgtgcagtgcaataccacccggagaacaaatttcattctggcaccagttgcaatttgtaaacaggatgtttgattagaacaacaaagtctcaacctttggttgcccttaacacaacgaaggctgattttaagacagcttacaacaggaggttagtcgtagtcactgaagccggcagtagtagcaaaatttcgtggttgcgatgctccctataagtctggtgccatcacaaccacgtttagccggcttctttgccctcttttctaccctgctgtcaaactaatgctatgcacgaagaattagctacagtgcacgtgtactatatacacctcctcctaagcgactctgtacgtactacactgtgtttctgggaatgggcagaagattgggtcggcatatcacctgggtttgttcaaatcaggaagcataattggtcaaccattcgagactctgcataaaaggattactgcacgttatatgccatggcacgctaaagatccgggtaatagtcaaattgctgcaaactgtgtacaacacttttcaccagaatcataatttgaggagaaaacaaaccattaggcattcaggcagatcatcattcttcgttctcatgtgagtctgcatttatgtgaagagcaagtggttagacatttgtattctttgcaaggatcagtatgttgtgaattggaataagcatgtgaagacctaggtgattcatggcatttgtcatctggctacgagataaaatgaaagcagcaacatacaaaactgagcaaaagttcagaatctttttccttaaggaagttctgaacgaatagcagactgcagatataagagaaatagcatagccagtgatggaagattaaagtatttacctccataaccaaatggcatgatgactcattgtttgtggcaaggcaagcaagggctaccactgcggctgccacagtggagggccagaaggagagatgtttgtggtccagaagtgagagcaaggccaagtacttcgccaggtcctcgactctgtcatctgcattcgcagccttcagatagaacctgcaaagttgaaccaaacaattgtaagtttcttattcattctgtccagctgacacagaaaatgaagcaaacacacaggcatagtaccagaggaaatgatgggttgttgtgacaaagcactggaagtcaaggacctcctgaaccagccactccatggcgacgacctcacttcggctgtaagtattgatccctactttgaaagctttttgaaggatgctgaaagagatcgtattattaggttcctgtagagtgttctaaagaaaaggtctatattgcacattgcccttgacagaaactaggcgcttgaaacaaatgcgcatccagaggcaaactcataagttcaaaagtgatacttcgtgcaaagtagacaggcaaagaagaatagttcctgggttcacttcacatgcttctgtgcagtaataagtggcacataaaacattcatttactagcaagttctcagggatacaaataaggtctactttcaaaaatgttgaagattcatatgagtttagtctttaaaacttaagggaaaacacagagaatatctcgcccaccagagcgctgatgtaatagctttattgtaacatcaaaaacagagaaataaaactatatcaaggagatctatgcaagtgataatttctcaaaatcgcatctctcccaataattgatagcttagttctttttttcttaaaaaacaatagctcaaggatgccaactggcgcggtaaattattttgagagatgcttgatcatagtcaacacaatcaagaaacttctggtgtgtttggttctcagccaatcaaaaccataccaatattttggtctgcctaaaattttgttagctttctttttgtcaccaaattttggcaacaccaatatttttccttggtagcaaactaaatactaaactaatcaatcttgccaaaaagtttgtcaacaaaccaaacaagtcctttgccaagattttggagtggctaaatcttgccattgccaaaaaattggtatggcccacaatggcttagaaccaaacaagcccttcatttctaaaatacccatcgtgtgaaacctttttgtagaacaatggtccaatggtctgagttctcacatgcagtgctcagtattgaaagtgataaatagctactagatgagatatgagttaccatcggatgttcctgttgttattaagttatttatagaacataattaaactcataaactcatgctaatgtctgttagaattaagttcaactttcagaaaaatcaaactatcaaagaatactaaggaatttgcagcattgcaattgagcactatcccatttaataatacatgctatattcaaatgagacgaactatttaggtgagtaccagacaagcagacaccaacaacttgcagaagtattcatactgaaactggtcatttaagggagccattaccaattatagggttgattctcttcaatgcgggttgccaaggtggtgcaggcgattcccagcaactgcaggttcctagagccctttacatatccacgtgtcaagaagcggtccatcagccctatccccatgaacacggtctctggctgcagcttcatcgcttgtgaatgctagcgatgcatagagaacaagtcattctttgcaagttatgtatgaactctatgtaagaacaaacatattctccacaaatgacagtacattattttcagaaaaatcaaattacaagtataaatgatcatatcacttaagtacttatcgctgagttgcccaaaaaaacttcaaacaaaaaacacacagcgatttcattttcaaaggctacctgaagtttcaatgcaaatataaactgatggaactagagttagaaaagattaaattcagatgatggtggatacacaaaaaaagggaatacactggcaatatgtttttctaacacttattgcatatataggtttagaagtaaaaagtgatgcagacatttctggaggccatatgccaatgcccaatgccatgggatttcagatggcaaatgactacagagcaactttcaggtgcgaaaataaacacctagaaaaatcctatgtatctcttttcttttcatacaagcatgccattacatccaaaaaaaatatgcaagcatgccaaaataagcacctagaaaatctttatcactgctctatagaacttgaatgcgatgacataaaagttaatgactagagttacattgaaatcactaggattaccaccacactgctggcagactaacacggggaatgctgcaaaatgtacaggcagctaactgtgtgataaacgaatcagcaaatgcaatgcgtatattggtatcagatagcttcccctacacaaaatatgcaagatcacaaccggatctgctacctcagcactcccacccagcacagcatttacactgcagagtagcatgttagtgcaaaatgcaagcaactactgttcttgcagaacacatcagtcagacagataagctgatagaatctagatcagtacagcactccgaaagtatacatgtgcattatcagcacaatacccgtgcaacaaacatctgcagctaccacacaacaaattgcgctcgagctagatgaattattggaccaaggcaaagtcatggtcgcagcatacgtgtacaatgcagagcatactgacctccatgatccagttcaccatgacaacgcgctgctccacgacggcgcggccgtagctgccgagcatggaggagtacacctcaatgtagtcgcgggctaccacccctcgccgctcgcgccgccggaaccgctcgtagctcacctcattgtccaagtcctcaaatctcttcccctgatacaataattcccatctgattacatcaaatgtcgcactgattcgggagagagcagccaaactccaacaaatttgagagaagctgtgtggaacctgcttacctctcccgcttgtagagcgacatccgtggcggtgggcgttttgggatgcgtgaaggggacgaactgctccgccaaggcgaggaacagggagaaggtgggggagggcacggcgttgtcgtcgtcggacgacgaggacgactcatgaagggggctaaacgagcaatcggtgcagatgcagggaccactgcgcacctcctcctcctcctcctcctcctcggtctccgacagcgtgaggtcctcgcgggctgaggagtaggcggtcgtctcggcgtcgttggcgagctgctcggggcaggcgaggtaggactcgaggacggaggcgaggcacgacgactcggagacctcgacctcggcggcgcgcggcctcgcgccaccgatgatctcggagcactcggaggcggcgggctgctcctcgtccacatcctggtaccgaggccgcttctccgggcgctgagctgcggcgagggaggtggggcaggtggtggaggtggcggagatgacctcgctgtggaagcaggaggaggccgaggtggacgactccgcgggtcgcttggctgccgccgccgccgccgccgcgatctgatcagggagcagaggaggagccgccgccgccgcgcctcgccgccggcggaagggatgggagcgcggcctcgtcggcaccgatgcaagcatggtaggaggcattggcgtgcggcgctgtgtgctttgtgtgtgaattgtgaatttgtgatgctacgggcctacggctatgttcgtttggcttgctagttatatagccgtgacttgaggcgtggagaggaagggggagaggagtgttcagcaaccttcggctgttcgccgcatcgcctgatcggtgaagtgttttttgaacttccaaaaatcctcaagccacgactgtgctgcgacgatgcacatgcgccgctcgcgctccattggatggcctgtgtactccagtccgtgtagattcgccggcgtatccctgtgggtcccagatgcatctggtgcacgagcgatccgccggaataacggccttgcctcccgtgtcccagcctcccaggcaaatcgaggcgtttgcttccagtggggaatgtcgggctggggccagcgcatatgcgggattggcggacggcggccaggttgtcaaaatgctatcctgaccctgattaattccttacccgaacaatctcgatcgaacgatccggttaacccagttgggatcggggaagaattacccaatcccaaccaggttgtctccaattgggtcactgcatactcggatcactacgtttttaaggaagtacagttgaagctcgattgtttgaatctgctggtattccggtggtatttcaagttacacatagctcctttgatttgtaggaaaaatgaaggaattttggaggatttcaatcctatgaaaaaaaaatcctatgaaggcatttgaaacaaaggattgaatcttatccaatcctttaaaattcctatggaatggataatcctatgcacattttggaggaaagttagcaataggtctatcctcttggaacatttcctctgagtctatctctctcatctgattcctgtgtttttcctgtgatccaatcaaatggccattcctgtgttttgcaatcctctattttacaattgtattcctgtcagaatcctgtgtttttcctattcctctgttttttcattcctacgattcaaagggcccttgaaacggcttggataaggtttggagcaaatagctcggtaaagaggaaatgaaagaaaaggaaagtgtatgcatgtagatgggaccctgatggactgattgatagtctgatacacacttctgaagaccgtcatttgccgcagacttcagaaacgtctcctctgaatctgaattctgaacagagtaccgaaaaccttggttcccttgtgcatcaccctggggaaacacaagagttcccgtaaaacaacattcactactaaagtcagtgaactaaaacacttgcatcaaaggatgcaagttggaacattctagctgtaaatcggtaacctgatcttgattagagttggccgctatacaacggaggtcgaagaactactacaagttacagtgtcagcatatgtgttctttaaaaatgtaaaacatttgattgatcaccacttaaacaaacatatctgtttgggagcatactaatgaggaacctgagaattccatcgcaatcatagttcacatgtcctgaagcatcccttggactggaggatctgaacagagttcagaaaaactacaggaaatgggcaagtaaatgaagtaactcatccacattttgctcacacaaatcactctgtgctgcaccctatccccaccaatctatttcagcgtaacaaaccctcaaagccttttcttgctgtaatcatgcagcacggaagcatttttcttgatttgaaatcaaccaagcatgatacttgtaggagggttcggatcacacattggttaatgtgacagcacttcagagcacctcctcagttctgatatttttggtgctagctcctcatcaccatattgctttagcaaatccatcaaacgatcagcacaagaagcctctatgagaatccccctctcagcaaccttcttagccaacgccaaggcctcaccaacatgcccttccacacacagcctaagcaacaaaccattgtagacatcagtgtcacagagcaccccgttctcttccatgactcctatccagtagcaagcatccaatagcctattcctattgcaaagctctctgaccataacactggccgcaagagggctcagccgcacccctttcttcatcatcctctgcacaagcccttcagcttcaccatccatcccaaccctccacaggcaaataagcagcacattgtagcattggtcgctcgacacactcccatcgctgaccacacgctccactacagcataagcgtctgcgaccatctcctctgaacagaatccgccgacgagcgttcgcacgaacacccggttgggcatcacccctcttcctgtcatcctatccagcaagctcagcgcctcccccatcctctttttcccacacaggcatttcaccaaacacgtatacgacaccacgttgggcacgcaccctgcacccaagctccaaccctccatctcttccaccagcctcagcgctgcatccacctccccgaaactgcacatcccgtcgagcaacgcggtgtacacggccacattggtcacgcacccaaactccggcattttctcgatcagctggcgggcaccgacgaagtcccccgcggttgccagcttatgcaccgaggtcacaaccagtgggacgctcggcgagacaccgcacgccgacatgataccgagaacggcacagacatcgccgggagagccggccgagcggagggcggagcggaagcaagcagcatcgggggcgaggccgaaggagcgcatgtgccgcaggagagcgagggaggcggggaatagtccagcgtgtgcggagatgcccaggaggagggcgtagtgcctgagcgggagaggttgcggcgacgaggagaggaggaggggcacggcggacgggagatcggggagcgaggcggcgagcgaggagagggcgtacaaggacgggagcggcgagaaggggggaaggcgccacaggaggaaccggagggagaggagtggggaggggaggagcgggaggagggaggggagcttgccgagggggaaggagtcggatggggacgggaaggcactggagagtgcgcgcgggagcgacgtggaggatgctggcggcgagcggaggaccgagaggagggcggcgaggtcgccgtcccggcaggtggagaggcggcgggtgaggggcgccaggcgcggccgccgctgaggcatcccgtgccggtttggggtgggggatcgcgctcctctgcggaaaggcaaaggcacacggtcacggacgacgggactagtcgacgaggtggatgggtgaatccagtactccagggagaatttactttcgagttgtttttttgaaactcaaaattgattcacctttcttaaaagttaaaatcaatttcagaaatgaactgataaggctgggaagaatttgagcgagatcaaaggcggacaatagttgaaataaaaaaaacaagaaagcttcagaacacaatattcattggaattttggaacaagaaactcacccataaatattgtgttttctattggtttacttttgtgtcggtataattcgtaggaacaatggtttaagtttttaaactgatttttttttacagtttagtttataagtcggtggttttttatgcctcaagtttaatggtgggtcctattaaaagtctcttcttattcatagctccacaatttttcttttccgcgaacgcctagctccacaattttcatggttcatgtattaattctctttatttaagccactctttgcatgcataatgtcacttctctgttagtagaaaaggagaacgaacatgagtgaaccagtttttgataatctttgatcatttcatgggaagtgaaaaaactacatttctattgtaaagccaccatattgcaaggctaattcgcaaacatttgcatggctaactcacgtgagcacccacgctttaatatttctacaaccatatatttccttttttttaaagtctatacaccgagaatttatatataaaaataagtatgttctattcggaatcgaacatttatacaccgaaaaattatatgtccgattccgattcggaatcaaagtttcttatataccgtatgctggagagattctcggttggtgtgtccattgttccagtgaaaaaaatggaaacgtgaatatatatatcgcgatgctctcaaaaatgcatatgaaatggttttcctttttagaatgggtatgaaacggcatctttagaacgtgtatgcatttaccccttgacatatagttggatagatttaatgcgaacgttaaaactctgtgggatccagttgtcatacagagggcaaatgtagagtgaaaaatgtccgctgtttagtttaacgtgttgcgtttctttccttctacagccaagtgccacctttgcctctagcttcataaaaacccagtcctctttggcacagtactatttgctcatgttcgtgaaaatcattgagctctgcaaggtgcaagctttctgctctcagccatcatgtttccctttggctccaaacccatcccgtcaagcaacaaggtaaggaaagagctaggatacgataaattcaatggagtacctccatttctttttgtttgacgttggttagttctttgactaatcaaggctgtaaaaaaaatagagggatcatatgctattttgtttcatagcacctttcttcaaaaaagatttcgtagtatatttgaaaacataatttcttcgtttttgcatatatcaatcttttgggattcttgtaatgttgtaaagcctggttttgaagaccatgaactcaactatagtgttttcagtcgttttttttaatttttgtagaaacggtatgcttaatttctaatatatgaacatgttgtttgaatgattggagattatgttcaatccgtttggattggcacgagaattacagatctctggatatccaagaaaattggatctactgtctttttatttagtcaagccctgaatggatggcaaataaattataaaggggtaatggagggcaaaagccagctgttcacaggaaaccaaaaccgtttgaatttttggcagttctcaaaccttgtctgtcatatatttcttcttttagttccacatatatatcttaggtttaatgataatagcaataacaagatgaaattgcttgcgaagttaagaaaaaataacacttgtttgtgtacttgccggtcgatctgagtgtcttatgtaatttttcagttttctttgtgggggtatggcttgcctattttcctgtcaatgtttaacttttaaaactatccttccaatcttaatgaattttggttagtctaatcctttggctgatccggccaaaataaaaagtatagcctaagctcaattgcctatttattttggtgccaaggaccccatcatttcgcttattgacggaataagcgagaaatgacatatttgtaaacagaaaataatttataaataaaacttttatgtatgtgttcttagtgatctaaaagcaaatactgaaaaataaactacgatgataaaaccccaaaattaacttaaaattttaggttgaaaattcaattttttacctataagcataagcataagccaaaagatattttttatgaaatcaaactatctggcactggcatacctgtcagtgtttcatgtcgagaaaataaaaatgacaacatagttgcagcagagttcatgatcctattatttgacactctatattctacttagtgttaacaaactatttgccgttatcttccccaaaggggggaaaaatccaatctatccaaatacaaactgactaatcaatcagcccatcagtttgtggtgcagcttaagggtaaggagaccagggcggagccggaggtttccagcgtcagcaaggcctcggggggcagcagcgagcacatcaacaagctgccaccgccggtgccggtgcaggaggaggaggaggcgccggaatggctggacgtgctgctgcggacgaaattctgggggcagtgcaagcagcactgggacgcgagccgcgcggaggtttgcatcttctgcctccgctgccgccaggtgctctgcccgcgctgcagccatgacgagcccggccaccggctgctcaaggtccgccgctacatgtaccgctccgtcgttctcgccagggacttgcagggcctcaacgttgacgtgtccagggtacaggtaagtaattaagcgcgtgttggccgtgttttcttcctgtctagtcttcatcaagccaaactccattttaaaacatgtaacattgaaagtactcctaaacatcttatatttaaaaggaaaaaaaaagtacaaattaccccacaaacccgaaatccatatatttttcactctcaactttcgttaccatatgaccccccagcagctttgcaaagcggttttggtctacgtggcagtccaatcagcaaattttttattaaaaaacgatggggcccacctgtcagatctttccagtctatctctttccctctcacacacctctctctctcaaatgtcggcggctgcgacttaagcactgacggcagcggacgacccctccgtcgcctcgacgagctgcgtggcggtggctgcaggcgcttcctccgccgtccgagctccgcccgccgccatcctcggctcgctccgccgccccctcctcctgccgccccgagctccgtcgccctttcctcccgccaccccttcggccccgagcttcgcccgccatcatcccgagtgcccccttcgccactcctcctcacgccgccatcccgagctccgcccgccgccgtccccttttccgcccactccacccgtcgtcgttccgacctcttcccatcgccgtcccaagcttcgtggccccttcgtcgccccgagctccgcctgccgtcctcgaggtgagggagggagaagagagtggattttggagagagatagagaggtaagggaaaaagagagggtgggagactgacaggaggggcccgctaatttttaaaaaaatgaattcatgtctggactttcacgtagaccaaaaccgtttgcaaagctgctcgggggttttttcatccggtattgatagttgagggttagttgagggtgaaaaacatccttgtttcgtgtttagggggtaattcatactcacccaatattttagggggtaatttgtactttttcatatttaaaacgacgtgactaaacaacgtatagtcgctgtattgtctaaacgcagcccactttttttcctaaatccgtacatatacggatgtgcgtctctttccgaaaacggcactctgctcctttttatgctgggctatctcacaactcaaacgacagatagtcattaccatgtctccaacaattaatgcttaaatatacggctaattcttttagtggtagatgatataccgtcgacagcgaaacgtctatgttacttgataaatcttaagatatattagcctgatctttgaaggtattcataggggatggcatgtatgtattcatggggataaatatgcatcaagttttgaaaaaaaaaaaaaagctcccgtgattgttgaaagcctgaagtactgaaactcaatatgctcacaaattttactcgtgattgcagacatacattgtcaatggccaaaagggcgtgcacctgaggcccatgaggaggtccccgcaattcaagcctcacgtagagacacctcgctgcttatcttgcttctgctggctccgcagtgctcccaacatattttgttctctcagctgcaaggttacattctcttaactattgttctcaattacccccctttctaattgtttgcaaattaaaagcatcgaaattaaaagggtttaaaatctgatttttttttctctttcttaattaccaggttggtgtagatatatctcaggatgatttctcaggacctgaagctgagcgtaggcataagcagactctgggaattgtggtggagtcatctcctcaacagagcatcccacaaccatttgatgcctcacctgtgagaaatgaagatgccaccatggttgaagctgagtgtggtcaagttcagacgaatgcgacggagtcggagtcgtcagcggtaggagatgcagatgaggttatacctaaagttactaagttcaatgttgatatccactctttgaggaggcgagttcgcaagcaggcggcaccacagagggcccccttcttctgaatttttgatatctcgaggaaggttgtgccatggttaagttcgaaagtagtaataaaatctactagctatgacagctaggtgagacatttctgctgcgacatgtttttttcagggtgaacctgctttgctgcacgctgtgatttttttttcattagctactggtttgaatgatgtttttgtagtacccatttggaggtgctaagctctgtaataatactgtaggatcgaatcacaagaactaagccaaccagagaagggtgaatggttggtatacccaaaaaccaaaaacttttagcggaaataaaagttaccctcgaaatcgacggagattggtctgaccgaagttgccttgccggtctgaccgctcagatgccgtcggtctgaccggtatagattaaccggtctgaccgccgaagctgctcgccgcgcctgttgccgccaccggtctgaccaccgtgctcccgccggtctgactgccgtagtgccgccggtctgaccgccggtgagttgccggttagaccgccaaaacccggtgaaacacaaatcgaagaactcttaaagtagatgacgtctttattacttctctctgtgtttacaaagtgcaccaacagcactccttacaaaaatttcgattaaactcgaaaccctaactcaaaactcaactcaattgctctctaaagcgataccgggaagcctcacgctccccctctatttatacatgaggtaggcagcctaaagccacgaaccaaactcatacgaggagtcctaaacaccttaggaaaccctctagtacaagaaagaaactttacataaccaatcgtaccaaatttggactccttccaaatttgactccacatcccatacgcacacaatacctccatcgtatgccatatggaatctccatcaaccacgtgcatcaattctagcctaagtatcccgcatgatctctgaccaccacggacgtcgtcttatccccaagtcgactcccggtccatcaccgcaaatactctcccgaaacatcgagtcacctacacatggaacaaacaaagaaaccatattccgagaccaagctatctccaacttgactcattagcagcaaacaatagtattacatacgtatatagtatccatctggaagttataatcatgaaataaactcggatatccaaataaacaacccgaaaccgaaaccgacacagtgtcggccggtcagaccgcgggctggccggtccgaccgctcgatcaccgccggtctgaccggcaacacctgcccagtctgaccggtccacataaaatgataacctgtagattcacctgtgaaatccaatcatctccaaaaccacttcatgaataaattccaaataacaaaaccaatcatctccgatgcataattgttcatcacagaataataataaaaacacttttgattttacaaatactagcatctcagcgatacctgggactgctttaatttgcactctgctgtagacgtttcttatttctcggtattttctaaaagtttcctatttatcattcttccatttcactaaaatatgaaaattcttctttgtttatcactcctcgtgccactgggatgtgggtctcaataccacgtgtcaatgaggcaatgagcataaaccaggaactggaaacttttacagtgccgaacaaggaaatgctattgctagagtgagatgtgttttgcttttgctaagcgagaggttaggagtcatttttggagctactaactgctacagcttataaaaaaattattttagttacagctgttagaaactctcaaacaatatatatttactctttcatgggtagaatgtactggcggttcttaaacttgtacaggtgtgtcatttaggtccataaactctcaaaatgcatattcaagtctaagaactcatcatagtgtgttatctaggtctcaaatcgccacaaccccttcaggatcctacgtggcgttgatgtaatatgccatacatacatgacgtggcattattttaactgacaaataggacacatttaaatttttttcctttttttcttctcttttttcccctttcttctcctttctctcacccgtgcagaagaaaggaaacaaaagaagaatgagaagaaaacgaaaaagaaaaagaaaagaagaaaaaaaaagaaaatgacatgtcacgtccatatggcattgccacatcagcgccacataggatcgcagaggggatgtgtcaatttgggacctaaatgatacactttgacaagttctgggacctgaatatgtattttgagagtttaggggcttatatgacacaattctataagtttaaggaccgccaatgcactttactctattttgatttagattatgacaatatgtagttgtagcatcgaaaaatgaagtaagttagaagctggaaaatttaatattttcatattagttttatatgaaaactttcgcctgagttagttcaaagtaaaactttgaaaaaaaagcttagcccaaagtatacattactctttgattaatcatacaattcgttgcgttttctgcgccggaatacaacaccttcgaactaagtactaaggccctatttagttccagaggtaaaaagttttgacgtgtcacatcggatataaggacacacatttaaagtattaaatatagactaataacaaaacaaattatagattgcgcctgtaactgcgagacgaacttattaagcctaattattccgtcattagcaaatgtttattgtagcacattatcaaatcatagagcaattaggcttaaaagattcgtctcgcaatatgtgtaattagtactccatacatgtgtccaaacattcgatattacagagccaaaagtttttacgtgggatctaaacatggcctagtacttggaaatgaacatttcaaaacgggaagtcgctccaaatgatattcccgtaatattaaccgccaggaggggccaaagcgcaaaaactgagaactggggagctcaaaacactcctaaaaccctagcctaccggagcgagcgccgacgccgagacgccgagagcccaaggccggctagtcggagagtgcggccgcgtgcgggtggctgctgcgctgcgcgaactcccccgccgccaaagatgttctccccggcgatcaagaagccccacctgctccaccgcagggacaaggaggaggcgtccccctcaccccctcccgctcccgcgcacacgcccgcgcctcgtggatttgccgtccacgaccgccccgccaccggcaccccggcgccgtggacctcctcctccctgctcgccaggttccgtttattccccatttttctttgattttatcagaatcaccgcatttcatcgtattttcgtccccagttgaggcgccggaagcgagcgattcaaatgagctcgtttgccctttttgcagtagtctagtgcgttaactacaggtcattgtgctgcgatagttttataaactttttattttgaaactttttgcaaactagcaggatttcaacatcaacacgaacagacaggacaggggattctggccagatccaaccggtgcatgtatccgaatttccccaaatagttcgaaatgctcaagccaaccttctgcaaaagagtttttccggtaactattcctgtttgatggtcctgtgctagtttttcctggttattagtttgcttgtaccatactgaacagtagatgcttgttaaatacatccttgtaggcaagaacatgcttgctggtggcattgataaagaaacatcccttgcatggatgttatgtggaaatgagctttttatctggagttacctggcttctgttgcaaaagactgtcttgtacttgaggtcccttcttctcttatggggaacaaagaagaaaaatctctatgtggtaatcagtgggcagtttgcatagtgagatggggtagtagtggtgcatcaacacggagcagtggagatatattgcatcgaagaagttcgactggttttatcctgtgcaacaaaagaacacaagctatagcttattggtctgatatctatgctgaaagcagtaagagttcagttcttgatttaattggatatggtgatacatcttcaggtgatggcacatctggaaactgcaggattaattctcttattgcagtggcagttccaggaggtattaatgaatgcattgtgattgcttctcagccaacaggcacattatggatgttctggtgttcaccagctgcagttcgtcgaagagaaattcataagggtacattaggagtttataatgctgatcattctcagaaaaatagtggtggaaggtccttggcttggctaccaagtaaagcatcatctaaggctgctgaacggacgttctttttattgactagtcatgagctgcaatgctggagcatctcattcgggcatgatatcaactgcaaaaaaatagggtctcaggaaattgttggtagtgatggtgatatgggaataaagaaagacatagctggacagaaaaacatatggcttttggacatgcagatagatgatcatgggaaagaaattatcattcttgttgctaccttctgcaaagatcgggtgagtgggtcgaactacactcagtattctcttctgacgatgctgtacagacctaaccaaaagttttcatctgaagataatgtgattaaaactgaaaggtttttggagaaaaaagctccttctcaggtgataatccctaaggctagagtagaggatgaagagttcttgttttctatgaggctaaaaactggtggtaagctttctggttctgtaatcatactgtcaggtgatggaacagcaacaatagccatatactggagaggttcaacccgtctctatcaatttgatctgccttgggatgctggaaaggttctcgatgcttcagttatcccatcttccgaggacagagatgaaggagcttgggttgttcttacagaaaaggcaggagtgtgggcaattcctgagaaagctgtgttagttggtggggttgagccaccagagcggagttgtcaagaaaaggaagttgcaatgaagcagttgctgaagagaaaaaagaaatcaggcattcaatgctagtgttgtacccagaagagctagttctgaggcttggagtgctggagagaggcaaagaccagcattaactggtatagctcagcaggctgtggttgatgaggagtctgaaatgttattaaaccggttatttcatgattttgttttgtccggtacagttcatgaagcacttcaaaagcttagagcagcaggcgcatttgacaaagagggtgagatgaacatatttgttcgaataagcaaatccatcgtaaacactctatctaagcattggacaacaactagagaagctgaatttcttgcttcaacaattgtttcatccctaactgagaagcagcaaaaacacaagaaattccttcagtttcttgtcttgtctaagtgccatgaggaactctcttcaaagcaaagtatggattttcttttgtgtcattatttatattcattgatttattattttaggcatatatcatcctagctatgatattaatcgaacacattggttctttgttattcaaaatagcataatgaatgctgatgacaattttgatggtattaaaactataggagctgtctggtaaaaaagaagaagaaaatctagatatgctgctgtaaatcatgaaaaatacaaacttcttagctgattttaaagccgtatacagttgtagaactcttcttaccttcatttctgtatacatgattgttgaaactggtgactgagcatgtaactctattggaatctttacctagcgttatatagggatgctaattttggcatgcctgatgggacacggacatatattatgcactcttagaacagcttgcacctttatttctgctaaaagatggtactgttactaacagtacagtatgagctgtaatattgacaaataaccatacaggttagccacaatttttttcaaaaaataactgccagtgcatcattttgcgtgacaacttctgttggaaaagaagtaatttgattgtcttgtaggaactgcgatgctaactgtcatggagcatggagaaaagctctctggaatgatccagctcagagaattacaaaatgctcttagccatcaacgctcaagcatacatttatcacctcagtcaaaaaaccaaacaactggtgcattgtggaaccttattcaattggttggtgagcaatctcgaagaaacactgttctcttaatggaccgtgataatgctgaagtgttctacagcagagtttcagatatagaagatctatttaattgcatatctcatcagcttcaatacattataaccggagaagaaaacccttctgttcagatgcaacgtgcacttgagttatcaaatgcttgcatgaccctagttcaggcag

SEQ ID NO: 23737 - DNA, 5594 bp, Oryza sativa
tgaagcaactgaaaattggttagtcataccttagtgcaaaaaagctttactttggtaaaagtggttgacctaaattgtttcattctgagaaattaaagaactttggccttctgggggtttaagttcatcgtcggcactgataaagtaaccatggactattccaaaacagtaaactgcaaagcatatgacctgtggcctgacaatggcctcctgaactgaatccataagctatcaagtgaaacagggcacacaaaatgattcaggtagatattctaactttcaataaagaaagatgtcctcctagaaaatttaaagagtaaactatgaaaagctacaatatattaagtaaaagattgatattccacagttccatcatttagtcaaatgatgaaaaatacttttaacacagatgctcccctgtaccaccaccgatcatccgaatgtctttgagatccatgcacaaaaaatatatagctacgaaaaatccatgcacagatctcaaaatgtgccatgacacaacccaagggcattaaaaagtaggatggaatcccattaagtggttaaaatctatctccctcaaatgagatcatgcagccaaagtgttcttcaaagggccaggattaatcagagtttgtcatgcttttcattttttcgtcaaaagctagtaaaacacaacgtgcaacctatttataaggccaaactgtggccggcttttttggtaatgcccaggtccaactcaaaagttttatcccccggatcaacaagatataccataacataggcattataatctatctcaccttcatgttcaatacctgtctttgctttgctattagtctaagtttagttgggcattgatcgatgaaacaaatacaaacctggtgaagaagagctaggccatgaaattgcacaagtgcaaatcttgattgaacagcttcctgcacttcgttgctccatcttttcacgatttctggatttgcctgcatataataagtacagtttttgacttccgaaaagaattatgttttttttcgtatagaactatagaagtgtacctgaagcagatggatgccactaacaagagcagcactagcaaccacaggattcttatcaactatagcttgtttcaaatatctctcaatttgagtaaggagggtgccatcaattattctacacagaactctgatagcattggcacggtacatatccgtcttgctgttcatatctttcattaatgagcttgtgactatgataacctgttgtgtaaaattcaaacaatttagaatgacaatacaagaaacaagttataattcatggatctaaaaacagtttcctttgacctcatctgatgatggtgaaagctctttgatcattaaatacaccagccgcctaagaccagcatccttggactggaacagctttgttactgcaaagaaaacttctgtggcctcaacctacatcagaagcaaatccatcagggcattgagagcataaggcaagtttggttgcacgagatgtagtatcctacctttgtgaatgtctccccttggttgagtaaatacaatagcttagtgatgacctgagaaattccaagacacatcaaacaaagagcaaagccataataatgaataacaagagggtgaaacatacatctgaacacaatactcagaactgatatgaaaatgagagaggtcatgcaagaaacacttacttgcgagcacttcctggcatcaagctgcggatcatggaaagcccttgcctcctgcagaacggctcccttctcaatcccataaaatggcgagtactcaactgtaaaagcatccatgggttaataaacaggtaataacttgaaagcattttactacactgactgaattcaatctaaaaacaagagataggacactctctataaaagatcaaactgcaatatcaaaatgaaatgctctgacgttaaggtaaacaccgcatgtaaccagcttgcattgagcaccaaaaaccttaccatatttggatcatacaaattggccgaacacccatatagactaagggggtgtttagatccaccggcaaatttttttgccccgtcacatcgaacgtttgaacacatgtacggagtattaaatattgataaaaaaaaaactaattacacagtttgcgtgtaaattgcgagacgaatttttcaagcctaattgcgccatgatctgacaatgtggtgctacagtaaacatttgctaatgatggactaattaggcttaataaattcgtctcgcagtttacatgcggattatgtaatttggtttgttattggtctacgtttaatacttcaaatgtgtgtccatatatccgatgtgacccggcaaatttttttgccagtggaactaaacacagcctaaggaacggatctactcctatatgcaaattagacgtgcgaatctccaatggaaagtgaaacgaaatggttccagcacacgggcgcaactgaatctcatctcactattggatcaccaatgggcctagccgactgataattagaggatgaacataaaaaaaaaacgaagtgcgtcggaaccgaacgcctgtgatgcctcagaggagtgatcgagcgcactccagatccaggtaaacccaagctctcccactccaaattctcagggccaaagcacgccaagtcgcaaaacagaaggccactctgaccagcggagagaatcaaacattcaaacaggaagctcgcacaaccaccaccacaaactctcgggggcggacatgcacacgaggtcgagatccaccgcgagatcccgccagatccggcatctccgccgctgggccagcggctcccagatcgcagcgcggccgggagaaagccaacaggaggagaattaggaggggggagaggggactaaccgtcctcgtcgtcgtcatccttcttcatgtacggctgcgccatctccggatcggtgaggtcgccggcgagggagcgaggcatgcgacgctgtggcaggcggcggcaaccaccgaaccggggagcgtggggtggtaggtttttgagggccgtggggtggtgcgtggagggaagcttttcccccttgtcgcgctccggatcctacgaaacggtggcctggccgtgcggtggtggtggtgggggtggcctggccgtggtgggggagctcgggacggacgggacggggaggagctctctttgctcgcgccctttttgcacttgggtccctcggtcgagtcgagactcgagactccagactgtggaggccggtttgttggggttgccacttgccaggtgttgggccagccctgcctgatggaagggacacggccttttggcccaaactgtccagcaccaacctcgacccttttgggaattttgaaggtaggaaaaaggccactttgactcccttaaaagtatgctgaatctaattcataccccttaactagaaaaccaggtaaaatgactcctctaactattaaaaccggtataatttaactccctcgacggttttggatgccagttttgcttatgtggcgctttgacttggtccaattggctgactcagcgtgtgggacccacatgtcaatgtcacattttccttctctctttctttctctttttcccctctttttctcctgcctccgaatgacgccacaaattgtcgtcattcatggatacttgcaaggacatcgtcgctgcccgtctccccgccgcgggaactcggccggtgacagatgctcatgtgcctgtgcgcgacagtccttctcctcacttcttatcacctgctccatccttctctctctttctcttccctttcctctcccccaaggcgaagcgacaccgtggcctcgaggcggagtggtggctggaggtcctgatgcgcggcatcggcctggcctcaagcggagcgactttctatgggagccgtttttgctttatttgctggattttactattgggtgggtaaaatctttggcagacatatcctgaaactttaggataaatccatttttcgattactttattcagggttaatctgacattttttcccatgcatttcttaggacgtcggcccggcgtagagggggatggcggcgggccggcttggagacggggtggtggcgtggcgcgcccagacgccctgcggccgcctagggaggtcatggaacaggtcccctccaccgtcggcagcggctcggctagctcggaccctggccgacacaggagtagcctcgctgcaccgcctcgctccaacacgaaggtggtcctccccgccatcgctgacgaactgcggcgtgtcgaagttcacggacacgccgtcccgagtggtggcactctgtcacaccccgaagtttttctccctagccaaaatttaatttataaacgaccccaagaaaatgcaggtgcaaatcaagagaaaaccctaagaaagtaatgcaaataataatcggatttgatatgtggaatttttcttgagttctacatgtcgaaattcattaacaggatttttagtggaattttcagagctctagaaataattttaaccaattaaaattgagcaagcaatattttaattccagggaaaatcctttttcctttttctttttttctttttctttttcctccctttttcctcctttttttgaatgggccgccggcccattctcttcttcctccccctcctccctccgaggcccatccaggccgccccgccactctcctctcccggggtcgccgacaggtggggcccacctgtcgggtccttcccccacctcccgccgctctcgctcgcgccgccgcgcccgcaaccgccgccgcgcccacgtctccgcctccttcgggccacgtcgaccacgcccgcgcgtgcgccgcgttccctgcgcccactcccctctctcttccgttcgcgcccgcgcccgagatggccgggattcgattttcgaatcccgcctctctctcttcccccactcccccacgtcggccggcgattcccgcctctcccggccacgtccggtcctctctctctccctatttaagcttccccgtcgctccctctcgctttttccccatttcgccgacctctcccgagctccccattgctcccgcgccgtgcaaccacccgccgctgccgtttccgcaactccggccgccgctagccgccgctaggctcgccgccgcaccgcgccgtcgccgccgttgggttcgtgcggccaaggtccacctcgtccacccctcctccgtcgaggttcgccgccggagccccattcccgtcgtgcgtcggtgagtgacgccatggccgccgcttcggccggcgccctcgtcctctcgcactctcctctctccctctaacccctctccttttgttcgttaggaggttccggagctcgtcccgccgtcgccatcgtcctccgtcgcccgccgtcgtcgaccgttgtcggtgaggcctctcctcctcttttttctctctctcccgcaccgtttcgccgtcgcgcgccatggtcgccgggtcggtttgcgccgtgcccgcgcgcaccggccgcgagctcccgccgccgtccgatctacccttgggtagatcggggccgtcggttcg

SEQ ID NO: 23738 - DNA, 11184 bp, Oryza sativa
tggataccatgctcctttgttagcttggggttataacatgattagagtttggactaggaattgcttagccatgcttagttcaactagttcacaatggggaaaatcatattaatgcttagactgttggttctaatggttttgtggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcattcaggcaagggtgggcgtgatagagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcacgaaaacgtgtcgcggggctgtgtcttgtgggtacagttgtacacctctgatcagagtaaaactattcgaatagccgtgcccgcggttatgggcggtcaaccagattcaccgtgattagtatcaccctagtgtaatcttttgaatttggttagtttaggtggatggttgggcctgtcgcaacgtgggatagcgttggatagtggatgtttaattaattattacaacggtttaatctttcaacttctgtttataaatgctcgctttatgcaaatgaaccgctctagctcttctttgataattccgtgcatcatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttttagtcaaggcttagctcttgttgtctttcttttcttccgctgcatttatgtaagacttttatgatgtttgtaagacgtggatctgaatgtcaacattgtcgtttgtgtaccccggctggtcctggacggggaatttaatgcacattctgcttgaaattctattcgggaatttctgggcgtgacacgctcggcgtactccaccaatggcagtggcacgggcgcagccgcacagagaagacgcccacgtgctcctctcgccgtcagtcaccgcccactcccagcgccctgaagaaaaagaggtagaaaaagagggggaaaagataaaagaaagagagttgaggaaaatgtgacattggcatgtgggtcccacatgctgagttagccaattggaccaagtcaaagcgccacatcagcaaaaccggcatccaaaaccgccgagggagttaaattatactggttttaatagttaggggagtcgttttacctggttttctggataaggggtataaattagattcgagatacttttaagggggtcaaagtagactttttccttgtgttaacagtgaaatttggtaagcccggagtaatcatcggcttagagtcagcatcgacttcgaagtcctgagattagccgatgagacttatcacgtcgtcagttgccggattcttgctatattcggttaaggaaattgatctactaaaggaagcttatccagaagagaccgagttcaaagagaatgcgacatagcaagttatctattaattaggaataatttgttagtttccttttatctttaggaaagtgtgtttaatgtcctataaggactttatcttttccttttatttgtagtttcattcttgtccgacaaggactagtatctccctatgggtataaatatgtacacccgaggtcattgtaatctatcaatctctcgatcaatactactctcggcgcatcgccaccctctttaccgaggtttttacttatcatccgacggaacttggcacctagttgcattgtgtttagagacgcatcaatttagttggaatgtctcggttaggtccgatcttctgtcttagccaatatatctctacaatcacaaaggtgttctaaatagatttgttatatccatcacattagacagatctatcggctcatcgagtattagattatcatatacaatctcgtgctgcatcggttaggttcgacctattagattgttgttgataatataagtcttgttaagccgataggttcatgctggtgtttatcggggtgctagccgataagttatctggacgttgcatcggcttacaaggattgcatatacatataagtttgacttagccgatcgcaacaaaggtttcactgtttaatctaatcttgtggattttatgacatcggacctacagccgatgtatgttttaaccgtcggatcagtgcttattctatcatatcattgctagctaattagtttctaatggattatgttattgttatactacattatcatcagccgactgcctttatatcattatttaagtcaagtgtcagactctacattggacataaagccgatagctcagaaacctatcgctatcggctggcatcggttatcggctggtatcggcatcggctggaattatttcatcggcttgtcaaccgatcggctatttgatctactctttacatatcttgtcagttgcagaatcaaactgactagcacgcccgcatctcaccaacctttggatctgcattggagctaagcagatctcaggccagtgtgtgtttttcgcatcaacaccttgaaggtattctggaggaggaggaagttcactttaggtcccttagttcgtcgcccaatctatttttcgtccttgatccaaaaaccggatataatacatccctcaacttatataaccatacaaacgaagtccctcggtagtattgactccagttttaactgacatgatgcctttgactaagtcttcgtcccacgtgacattgacatggcgcttacgtggcagtttgacaaaaaaaataaatggaacaaaattaaagactaaaaaaataaaacaaaatatacgggacccacatgtcagccaaacaaaaaaaataggacccacatgtcagtggttcccacttcttccacctcaccctcttcccctcttttccaatcttcttttgggtgtccatcctccatccttccccgctcctatggcagcggcaagagcaagagggagaggagcgcagcaaggacgccgagcgcgacgggcggcgagagaggagcagtgtgcaacaagcggtgagagtggagcggccgctctccgtggggggggggatggccatcggggagaagggcaatgaccggcgggaaggagctaggcgatgggcgcggtgtcaccgagctcgaccgctgtggggaggtctagggacctccgctcccgcctcgccatcaggcctcctaagctcccgccgcggcgaggctaagcaccaaacccacgacaaccacggggatttgggtcccctcccgtcgatgatggatccaagagccagtcaaagttggatcccctctcgtcgcgtctcctaatgccgccatcggatcccctcctgtcgtcgttgagttccccttttgaaggccgacatcaccattccctctctctgcacagctgcttccccacttctcctgcagacaatggtctccattacaacggaagaggagcaagccggcagtgacctcgtctcccatcaagcggtgccagtgaagataccccccttctccctctctatgcatgctcgctagggatgcaagtgggtagtcctactacccgcataaaaacccgcttgctagtctatttttcgcatgatagtacaaaatttagaagaaaaaatgaactagaagtaggataagcaggaaaaaaaagcctgtttgcctgcccggcttgcatccctaatgctcgccagccgacgagggagcttgaggagagaggaaggatggccgggacacggcacaaagaaacacgtgcagtacgttcgacgcttttcaaccgttccattagggcagtcccaacccatattgtccataagcagtgtctatggtgccatgtcaataagacatcacaatagaaactacactctacaacctatggtttcttaaagtgggccattaataaatataaactacactctacaacctatggtttcttaaagtgggccattaataaatacatcatctctcttctctaccaatcatatttattcttcatctattataaagagactattctctccaaatgcaaaacttgatagtgtctagtgcatgggttctcgtgttgaaactgtgtcttgcatgagacccggtttcttcctctattcactctctctctcttaattaatacagtgtcacataagctaaaagtcctacatgacagtagttaatgccatatataccatcttagatggagagttgggaatgcccttagaaacaagctgactaaacttatgtaagttccttcgaatgtatccttaacttcaaacgaaacctctcttcttccttttctcgattcagtgcaaacctcaccagtagatatatgcaagataagcgcaatatcgcattactcatcgatcggatacatcattaaatcacacgataatacagccaacaaagcagtcacgtcaaacgatcggcctgcaatatgcacgacagtatcccaattcccacatacacggtacgccccggttcccatcgatgattcgccatctcgcaacaccacacagtttccactttccacactcacgcaccgaagaaatagtcaagtctagctcgacgcctccgatcatacggctagcgatgctgttgccgccggggtggctcccccgagtcggcgctggagtgggtcccgtactcgctgctgtcctcgatgctgctctcgaaggccaccttcctcaacctgttgatgtcggaagcgtagttgccggagtcgtactccgaccccgtgctgaacatcatgctctgcccgggcttcaccccttcgttcaggtcgtccagcgacgcgtcgccctccagcgcacggacaatctgcaatacacgcaaagaagaaaaaatatcatatattgccaggcaaccaggtgatcgatgatcagtttgatcactgtgagctgtgcggtttcaattacctgcttcatctttgggcggcgcttggcggagtggcggacggcggcggcagcgcatgcggccatgcgctccatctccagccggtcgaacttgttctccaggcgctggtcgatcagctcgtcgaaactgccgtcctccgacaaggcgcgcgccaggaggggcctcgcctgtcacgaccaagcgatcgagtggccggcgtgtcagaaccacgtatgtaagcttaggatgtagtagtggtagtttgcgatggaggcgagggtgacgctcacccagtcaaccaagctgtcctccatgtagttcgttgggtcgaccggtcgccggccggtgatcagctcgagcagcatgacgccgaaggagaagacgtccgatttgtccgtcagcttgccgctcgacgcgtactcgggagccagatacctacacacatgtaactgggactcgtcatccgtgcccgctcgtccgtcatgcatgtcaacgagcgagccacggtctcatgttgcactaacccgaaagtccccatgacgcgcgttgagacatgcgtgttggtgtccgtggttagctttgcaagcccgaaatccgcaacctaatgcaaatgaattcaaacaagtcaggactagctagttcaatcttaaacgcagcttaaacaagctggtgtgttcaccttagcatcgaaattctcgtccaagaggatgttggccgccttgatgtcacggtggatgatcctaggatggccttcgtacgtgacaaccacaatgcaacaaatcagatcgttagaaggacgtacagacaggatttgtccctgcagactgcaaattaaacgaaaagtttattagggaccttacaatcttcgtgaaggtacgcgaggcccttggctgagccgagcgcgatggcgagcctcgtcgtccaggccatcaccggcacgcccttccctgcacgcatccggcacacgcgcgtgtcagaatcgaacaaaaatctcacgtacgaatggcgcgttacgatggctgggaaaagagcaggaaagatatggagaccgtggaggtggtgctcaagggtgtcgttggggacgaactcgtagacgaggaggcgctgggatgagccggcgatgcagtagccgacgagggagacgaggtggcggtggtggacacggctgatgatctccacctcggcctggaactcgcgctcgccctgcccgctcccggccttgagctgcttcaccgccacctccttgccgctgcccgcgaggacgcccctgtacacgtacccgaacccgccctgccccagcaggttcgccgacgagaacccgcccgtcgccagcgccagctcgtcgtacgagaaggagctcttcgagaaccccagcgccatgcccggtgacggcggcggcagcggccccgccccgtgcgacccgctcatctcgctgctcggcggcgcctggcctggcgagtactgcgcgtgccagccgccgccttggtccacgctgttctgccacctgggcatgctgttcgcgtagtacactttccctgcatgcacgcggacgcgggagcgcaccccatgtcaactgcacaagatctctctgcggcatgcgtggcgagcgcaccatgccgtcgcgtcgcgtgtagatgtgtgcttaccgttctcgtcggtgtagtacggcatgtgcatgtggggaggtctcttcttcttcttggagcagcacacgcaggcgacgatggccagcagcagggcgaaggtgaagaacccgatgaccatgccggcgatgatggcagcctctggccccggcctgttgccgttgctttcgctcttgccacggtcactcgagctgcctccctccttggagctcccactgtccgaggaggagccaccgtcgccgctacgcttcggagcgggttgagactggacggcctttggcgctggcggcgagccatgcgatggtggtggggacccgccgccgccggtattcgccggtggcgccgactgcgacggggaaggtggcgacggtgctgagcccgaggaattggtcggtggggccgacggtgtggacggtggcgggctggcaggaggcggcgatgaccccggaggaggtgactgcgacgacggaggggacgacgacgtggagctcggcggtgatcccgtggagctagagctgtccgcgcctgccgatgaatccaatccatttccatcaaacagattatctagcggggaatcgtccatttcccgccggacgtcgagacggatctcgccccggcgatgatcaagacgattccacccctcccacgagaggatgttctggaatggaacggcgcggcgcgcctccccctcctcggctcctcgtcgcgataaacccctgcaaaaatatgggaggaaaaaaatggtgatattatctaaaaggaaaaaaaaaagaaaggatgcataaccatgggagaggatagtgagggatttgaggattttatctgcatttgagggacttgtctcatgtttcatcagacctttggtttagttaacatgtccattcatacagaactacacgctgaaaagcagtccttttttttttgtttatcttacattttagaatcctggaacatcaaggaagatagttcaaaagctactttaccttacatcttagaatctaggatcaagggaataaccacattcactttaagaaaagcaaacatcatgcaaaagaaattggggtttatgaaactggaggtgagatcgaatacaacattcagagtaccaaacaaatagaggaattgaaatgccatgaaattgaagaatcaataatgtaccttcctttttccctgttctttctgaaaaaaacagaaggggttgaagcagaattgggaagggaaaaggaagtaggcttcaaagcgctggtttcgtcacattgtccaacctccaccgcaccgcctcgcgcgcatttctgggatacaatctctttatattttctatttttggtctccatgccaactgggacgttcccaaccattggagctcagctgacaaacatcattatcattggtggtcaagggagcttctgtgtagattcaaaaaaaaaaaaagagcttatgtttttttccactccgcacgagatctagtactcattgccatttgtgctaaaacatgagctaccctatttgcttctctctttatcttgtgcacttgcacttgttggaaacactacatcactcctttaatctcttcaattgtcgtcgcctatttatcttgtgcacttgcacttgttggaaacactacatcactcctttaatctcttcaattgtcgtcgcccaggccgatttcaatggcccctgttgttttatgccatcgacaatttcagcattgtccatctccatcacaattggcatgtggatcaattcaaccgccgatcacagtccttctagacatgctagcgcctccgcctgggccgaagaaccgcattgatgcaaggttttgtggccagcaagaagcaccaaccccttcagtctctgaatataaatccgacgcttgcatccccagactcttctctgtaaccagcgtcaacattcagtttagcgaaatattccggcggcgcacaccatctgtcagcctgtctgttcatacttgtagttggaacttttttattatgttccatatacatagggcccttccctttgtgatcatcttcccgttgtcggatcggctacaattgattttcatagcttaccaggaagctagccgagtcagctattgatgcatttcctttaccatggatcacgtcatttcgcagatgccaggctctccaaagtaaatacatctgccttcgctgaagtactgagactgtccagcagtactaacagccaatcaggggccgtccatgaaaaactccaaaaaaaaaaggagtttatgtatattaccatgcaaatgctttgtgccatgtagatttcttttctttcttttaataaagagccagtaatagaaattaaatgaattttgtatcagtaaaaaaaaacagtgactgaatcttcggtcattaacagtcagcagttgtcaaataacaaataacttatgcccatataagaaaacagcatcgaaactggtgtactgaacactatcgttccatgcatctttgtgtaacgtcagacaggacagggaaatttcatacaagtaaaaacaagagcataaggatagattttgctcaaaagtagccagtatcccattaaataaagagcccgataatacaatgtagcagcagctcaattagaatcgaagcaaataaagtatttcactcacatatctaaaccagaaagaaatggacatccaatgaagaaacgtatgcaaattactcagttccagggttaaccagtgaatgtttggagcattggacaatgcatgcactgtccgtgttcgaaactcatacagaaacaattatagcacatcacccaactatacaagtgactcagataacatactattcaaacaactgttccgaatcagctatttcacttccaggagttcctgccgaagatttaacaaccgtctcttgatcagcataaataaaactctctggcaatttgagtactgctcgatctccatcagattcaccccggtaggccagcccaagagcataccccaaagctcgagcaactggaattgcaaccgcattgccaacctggatatatttacattgaacaagaatacatagcataagaatggaactacacaacactcatctgtcatatactattatatctgtgagtaattcaatccaaaatatggacactaaagtccatattactgattcctgaatccactacaatcgatacaaacatcctataagcacttacttctcctttagtgggccgatcaatctgtaatagtcaggaaaaccttgcaaccttgcattctcgcgaatagtcagaactcggtcttggctaggatgcaaaataatctgcaatatgggggagtccgtttatgcacaatacaaccgaagtggcattaagatgggaaaaacgccaaaaaaaaaatgatacctggttgtgaggctcagctctggtaactacagtgggaacagtttcatcccaccacaggcgtccaaacggtctgcattgccagattaattagaattatcaatcaagattgtgtaaaatgaaccattatgctcaacgtacttatttagttgacttccccttgacgaaaagatatggcatagtcaggcacctatccagagaaaccaagtaattaatggcatgcaaaagaggaaacattgacattgcagttgttgaaatatagcaaaatataaaagtaccaaaggcttcccagatgacagtcgttcacgggaaatgtttggatccagccgcacagtattatctgggccaactatgacgccctttagatcacgaaagttcgctccctgaaacagaaaaaaaggtaagcaaccaaggtattgaaagtaactggcatgacaatcttaagccttgctaaccttttttacaggtatccgctgcacacgctcataatcatctttgtttagctttagaggttgatgatcaaacaatttaccttcttcagaaggatcatctccacgaaaagagtaatcctgaatgtctgaaaatgaataacaaaacaaagtaacttggcctagaaattcaatcaagaaactacaagtagcaacacttagaattgcataaaccaacgggcaaggcaattgtcaaacccacacactaatgaaaatttaaatagttagaattccacaaatgcagagggaaagagcataacaaacgaacatagccctccatcccataaaaaaataaacctagtaagggatatggatcatcttaatactacgaatctgaacagactgtttcacatcccatattaggtgtgtttttttatgggacggagggagtagatttcatgaacagtatttatcgatatttgttaattcaattagtaacaaatcatggactaccttttacggttgttccggatataccgttgaaattcagttttgggg

SEQ ID NO: 23739 - DNA, 779 bp, Oryza sativa
aaccaggtggcaactaggtacgtcatatggatcagggaatcattttttgaatgaggggaaatgatcctttgggttccactggtcatcaccagctgttgcaaacatctacagcgccatattgtgttaaaacacaccatatttaagaattaaaatagtctagagtaattggaagcacttactgcaaaatcttgatttaagaaatgtctccagcctacaaaatcagttcctccaaatctctgtatctcatccgctgctaatacttgaactgcaacattgaatgtttcttcttgcatttgagtgtctagccgaatagcctgttgtatgtcatgtaggcttaatgacatagggacaggttgggagatgtgaacccagattttcctgttaaatgtgatatctttacaattagtggtgaaagaaaggaacatttcaggtaggtggcttacattagagcttctgcatgagcgattgaagttgtatatgtgtataaatcatcaagtgtttcagataggtggcttacttaagagcttctgcatcagtgattgaaattgcatatgtgtataaatcatcaagtgccttctggtcatgcctgacgaaagagtgttgcttgctcagaaatggtgatttcaccgaatggcttggtttaatcgacctctttggccgatcgaataggatatcagaaggaccgccgataattctcctcttggatttaggtgggagctttgtacatgcgtactcctcacgcatgaaaaatccttgccccactcgtctctttcaacata

SEQ ID NO: 23740 - DNA, 12993 bp, Oryza sativa
  unsure (1)..(12993): unsure at all n locations
ccactcgtctctttcaacatagagtacggagagaaactactaagtttagtttgttggtaacctattatgagacagaacagtaagagtgagacatattatgtgcatgtggttggttatgaatgaaaatgaaaaactgatataggcttgtgggtatcattacctccatgcgaagagggagttttgtgcattgcattaccttctccggatttgtcagaggcatctactgactttgagattggctgatctggggtacgtgctaaaaagttgagttcttgttctttgtcagagtcttcagccacattggagatgtcatgacctggggtacatgccaccatgtttgcttcttcgatatcttgtgttattcctagattaaagcttgggggctcgatgtcagacctggcatcgtaggtacgatccacatggatagcctgtgtacagatatatcaacaattcttatggaaaaatggattctttttatattgaatagattgacaaactacatgagattgcacctctattgcacccgtatgatggccaagattgtatttttcatcatgtttgtttcgcagctgaaacccaaaaaaaatgtcagtagtctgaagtttctgcacaagggaaatttcaacaagaatactctaccggcaggagagttgattttaccttcatctttccatacgcggggaaaggattccggttcttgaaaattacatccctctcaatgaattctgctatcatggagtcattgtccaccccattccttgaaatgttttcttgctcggaagtgtccgtctgaaaacccagattgtccaaaataaaaaagctggaccgtataaaatatagcatgtgaaaagatgttgccagtatattagaaagtaaaagggcaataattcgaacgaataataagataatctcacctgaggtagtataatgcagccattgatgtaaccaatgctttttcgatggcgtattttgtgttgcaatgttgctgctgcatctttgatgtcatgcaaaacaaattccgcccaattgtacttgtgaatattttctacatcaaccaaagccttcatataccttatagatatgtgattgttaacagattgaggagccaagaatttggttacaacgaagattataaaagcagtcttgaatacaatctgttcgtgaacagtcatcgtcctgttaaattttttctccaatatcctctgaattgttacaatggtaagtccatcaaaggaatctttctcaaagatttaacacatataagccttaacatcttttacctcgttttttattgcaggcaaaatctccttccgtccacaagggattcccaaaagtaggctgacatcctcacatgtcaaacaaatttcatgtctagatcnnnnnnnnnnnnnnnnnnnnnnngggtctagcttgcacagaatccatgctccgaattgcttgttcagtttagtcagcctcatggaaagcaacccataaaactccatctgtttcactagctctttttgctaatcaccaaaacctgagaatagatctgagagaatagcaggagtgcacctggtgtaaattttttcttgtactacctttttacccttgatgccacttgtttttttggaatttgatactgcagaaccaggtagctgcttccgctgatgcatctttcttgcttgagcagcatgaagggctctagtgaaaacagaactagagccaccaccacctgaaacattcgcacctgctgcaggactgcaaaggtgctgcaaatgcaaaaacataaacaaaacaaattagtaagagatacgatcaaaaaaagactcaaagattaggaaaaaaaatccatcaatggctgccgcgagcttcgacggcgccggcgttggggcgctcggcgtgcacgcggcacattggggcgctcctctccggcagcctgcagcctgacactgctataccgtaccaatgtcgggttggtgctgttcattgtcgccatggccggcaccacattcactgcaaaataacagatgaatatggcaacaaaccttggaactggagttctccatgctagaccttcaacgttatctgcaacgcagccgccggcgaggctactaatctgagtttagatgggttaagaactctcaaaacgcaaagaacggttttagatcgataatgttctgctcgacgggataatcatcctgctttctcgctttggataagcaaactgaagagcgaaaaaaccaccctgaaatatatctggtcagctgtctccgaacaaaattctatctacaacaaactcaggaatcttgattcaattttcgaatctgctacagaacagaaacaatcttgttgaccccgagggaaaaaaaatacgggtaaaagaaaacgggtaaaagtattcgattcaataaacccgttaatagtcattaccattatctgggcaaacgaattgaattggtggcggacagggagggagtagctactcccggtagtagtatataattttcctatatatatatatatatatatatatatatatatatatatatatatatatattcaatgttagatttaatggaattaagtaggtgttataaatattactaaaattttatataaatttggtcagacctaaagaagtttgactactaaaaaaagccaatacaatttgtagtatgaaatgaattgagtagcattaaaaattcaactttaattcattgaatttaatctctatttaaaagtcgctgatgatggctagttcacgagcttgattcgctccgattttggaaaaaatggaaagaagagattgagtggatcaaaagccctcaaccaattttgagagatcgagaaagattcagccgaatttgatggggagtgtcgacgtttgagatcgtgactacggtattttgcatagtatatatggggatcgttagtacagggtatatgtgatattaaagtaaaagagatggagacaatgatttttatataggttcaagccccttatttgacaggtaatagccctactcctgttgaccgaagcaggtgttgccctttattcatctgaatcacacaagtacaataattgggataacttatctagctgtcgtctatttggcagtatggataaccaacacgtagttgacgacagggtagtcttcctccttgagtatgaactcggcgagatcggcgataacgctagattcctcttgttggcctccgcagacaccatattgggtttgtctaggcttatctctgatgtcgatattcgtcagcttgtcttggcgtgtgttggcttgtgtattgtgtgtctatctatttttgtttttgttgttccctctctccctatggggtcttgtatttatacccatagatgtccacttgttcaagtagaactagggagaccagtatggatacaatccgggtagtccttgtcgtttccgtatagaattatatttgtccttccttatccggaactccttctatatacgagatatgattccgtataagacttggtatgtggtgggctctgccgagtttagtcaactactattaggtatgtgatatccataactatgatagggagtatcggctccggcattgtacgggtatgggaccacctttcggaggttgaagatggcattgtgtgagctgggcctacgagtctacttgttggctggtgcgaagagaggcaggctgagtggagcaaggtagcagactaggctgggactgaaaaggaaaaaaggaatgagctttcggaccaaaaccaaggaaaaaatttcattaacttttttaattacaatgtatagcgatttcaatgaatcaatttattgcttaggtcttaatagttgttgtatcactagaaaaactatttatccgttgcaacacagacatttttttctagtcggcacaaatcttagtaatactacaccgacctctggtcaaataggaccatcctcttatcgagggcctaaatctatagaatagattccctgtatatccttcaaaactcactcaatacctttcatactccttaaatttactcgatcccatttatacccctgaaatttcaacttaatcccttccatgaccttgtcgttacactttcctttatttcactattgcaatgtcttttatgcccttgatgatttagatttgaatataaccttgaaaaatgattgaaaattttgtttgagtgcacaatatgtgcattttatgaaactaacgagactaaataattagcgcagaaatttttgacataaattttgaaaataaaacaaatgtaataaattaaaattttgatttgaaatttttataggacaatggattcttttttatcaggagcattcataaaaaaaatatcatgtgcattggtagtactatctttgtataaatgctccttattttatgactttttttaaaaaataaaataaatacatatttttttactccattatctaaaaataaatttttttcatcaataatgcatcacacaacaaactcataactatagtagtctcatatgacaaacttttacatttttaataatgtaaatttctatgttcatacaaagggtaaaatggtcatttttacagaaattagacggtcaaatgacaggagggatatggaagggatcacaatcaaattttgggggcttacaaggaagtaagcaaaattcaggagtatagaaggaattagcaaaatttacagagatttacaatagatggccataaggcccgctcggcacggcccgaggcgatcgggccggcacggcatggtcggcacttcgggccgtgtcgtgccagcccacgggctgcacctcaggcctaggcatggcccaccagtagtcgggtcgtgccagctcgaaggcacgggtggcccatcgagccttctttaaaataagtatatttcccctcccttcttgggatctggcatatatatagctaataagtctatttcatgtccttagtctttgggccgtgccatataatacgtctatttttccttcctttctttgtgcatatagatggccaaaaggcccgaggcccgacgacccggcccaagcacagcacggcccgacgggagtcgggctcgtgccagcccggcccgaccgctgggccatgcctgggcctccccactagtacgttcgtgccgggccggcacataaagaatagggagtacaaaaagacattatatgccactgtccaaagaataaggatgaaaattagacttattttagctatatatatatgtcaaaccaaagaggagggaggtaaaatatatatatatatatatatatatatatatatatatatatatatatatatatatatatatatatatcacagcccaaagaagagggaggaaaatagacttattttaaaaaggcacgatgggccacgcgttcctttgggccagcatggcacggcccgactgctggtgggtcgtgtctgggccggaggtgcagcccatgggccggctcagcccggcacgaagtgtcgatcgggccgtgcctgggccgggccttgccgggcgggccttatggctatctatatttatacgtgccttacatgtgattgacaataagtctgtttcgcatctctgaacttcgtgccaggtcgtgccagcgcagcgtaccgaagtagcaccccaggcacggcacgactgttgggctggtccggcataggcatgacccaagtcagggcgtgccgtgcattggccaggccaaatcaccatgtcttgggtcgggccatcgggccttaggccatatggccatctatatatgtcactgtgtgtagctttaaccacgacgtataaccccatattcaatattgcagatataaacatcgacaatcgatgcacaagggatcattgcatcaattacagatcgttctaatgctacttacacctaaaatgccatgacaaggacattgattgagttagttcagggagctattcctcagcaggctatttgaggaaggggagctcctatcgctgaaccatctctcctgcacggacacgggggagtcggcgactgcacacttcgtcgtctcttgctttaccactgcgtttgccgcggcctgcctcttgctcttagcggtcccccaagacttgtccgtgcaacgtgatggagccgacgagcaaagcgaggacgtcgttgacatgaatgtggcgtcatccgtggacggcgcccacccgctgacctgaatctgttccagctcgtcggcgacctcagccatggaaggtctcatctcgctgtggaacgccaggcaccgaaacgccagctcggccaccttgtggatggacgtgagagtccaggcgtccctgtgcgggtctaggtaggggtcgacgatgtcgtcgaggctgcctttcccgatcctgtcgacggccagctgcgccaggttgacctcgctgccaacccggctgaagtcgacggccttcatggccgtgatgatctcgacgagcacgacgccgaagctgtacacgtcgctcttgtccgagaggtggaagttctggtggtactgagggtcgacgtaccccggcgtgccctgcggcgcggtggagatgtgcgacgagtcgacggacgtcatgcccatccgcgacagcccgaagtcggcgaccttggagttgtactcgtggtcgagcaggatgttgctggacttgatgtcgcggtggtagatgggcgggtgcacctccgagtgcaggtacgcgatggccttggccgtctcgacggcgatgcggaggcggaccgtccacggcacggccgggccgcgctcccgctgcaggtgctgcgccagcgtgccgttgggcatgaactcgtagacgaggatctgctgcccgtgctcgatgcagcagccgaggaggcggacgaggttgcggtggctcaccgacgacacgagcttcacctcgttcatcacgcggtccagcccggcgttgtcgcgctgcttgatccgcttcacggccacgaggcggttgttgctcagccgccccgcgtacaccgtgccgtacgcgcccgtgccaaggcgctggtcctcggcgaagccgttggtggcgcgatcgatctcgcggtacgtgtagaagggcaccgtgcaggacgcctccgacagcagccgcttcgtgctcttctggctccggagggccgccgaccggcgccgcagcaggtggtacaccaagcaggtgatgcccatcaccatggctccaaaaaagactcctgcattgtgtgagcgcaaagaatccatcatgcaatccaattacaattgcggttaaagcctagtggctttggttggtgtggttgcttagcttcgagcaaataggccgggagatcgttaggaagtgaaaaatagccaaaaatctggcctgctagactaaataaaagataagggactaaggccatttttctagtccggataccagcccaatttgaaatcgcctcaactctactacccaaacaatttaaactttctctaatctgggccttaactctgtctgagttcaaggcccattcgttgctactccctcaattttaataaattataagacattttaactttgttacaagtcaaactatttcaagttcaataaaatttatataaaaacacaccaacatctatgacaccaaattagtttaaatgaaatctacaattttgtgttagaaatgttactctgtttttctatgaacttagtcaaatttgaaaaggtttggtttagaaaaaaaatcaatacattttatcatctgaatatgggagagtagtttggattttgaaacattggaattcttctatttcgacacatgtattgctgcctcaaactaattggttccatacaaatatttgtaggaacttgctacatgggtcctctcgaaagtcttgaaatgttcggcttgaatggtgtctggtttagatatttaggacggtttttagatttttgtaggaattcaggggactttttcttagaacaaaatactaaataatattagcaccatatcctcctaaatatcagtcatgtagccatacgtatgacgagctgtttctctatggatgaagctcaaacctacataaatactctgtctttaatttctgaatgctacttgtaagatcgatgagcaaactgcaacgcatttttactaaaatcaaattccaacctcttttggccaaaagtagatattgttttctctgacaatcagacgagatttataagcaattacctgccacaagaaggccgatctgaaccaacttgccacatgatcctgataggtattttgaaggattacactttggaactgaaaaaaaacaaacattagtgtgagattcaaagggaagaagggaacaaacgaggaactttattatatcaaagttgacttcatacattgagaaaaatcaacataatttatgcagtgatttggaaaattcttcttccagggatgaagccatacaaagaaggtaagcatggcagcacctaaaaaactatgggtggaactacaccccacttggttgatctgtatttttcttagcaactggttcttgtttttatgaataattatgggactcaataccatctatataggatgtcaggcaaaagaaagaaacaaatattcctcagcacataggcaggcaggcaggcaagcatcaaagccaacatgtcagaaaaatatttcttcgagagcttcaaaatatctaatatatcaatggcactacatttcaagcaacttgtcgtagaaaacaaaagttctgatagtacttaaatcgattacatatcctctaataaataaccgaatatactcttatgtcacttgcgcaagtagtacattacggtttgacatcagcgaaccacccaaaaataattagcttgaactgccagtcgctttacatgtgtgacggtatgagaacccagttgacagcacttgcagttgtgcaaggaatgttatagcgaacgctctcgcacctaccagtaacagaggctttttttttttcctttgaaaggccggtaagcagagcctttcgctgttcaatcaagtgatgatcaagttaatcgttcatctttaacgctgattggtcattggtccaatccttggtcttgcgctgctggttagctaggtgtatagtcaacgaagcacaagatatgcttactctactgtgtactgtctactccggacgattaatggttatggtcgagtggctagagtagttagctcgcaggatttgactgaccaaatcaatggacgaaaaaagtagagcaatgaagctaatcagtggatactatccagccaatgtactgagtactgacctctccggcaaccggcgccggcggtgtagccgtcgccctcgaacccctcctggcactcgcaccggaacgcctccttctgcgtagacggcggggtgaacccgtcgcagatggcgtggctcgagcagccgcaccgcccctgcacccaccaatccagctccagcgcggtcagctgcagcgccggccccgccgtgttcgaatagatcgacgccgacacgagcccgcggcagtccgagccgagccgccgcatctcgcttctattcaagaaagggtctgtgacgtttgtcccgtcgacgttggctttggtagaaggtaagacgcagcggatggaattgcagctcttctcgaggtaggcctcgggtgggatgctgcagttgctgaggcgggcggcggcctgcgggtcgcacgagctcacgaccagggcgttctgcgcggtgggcgcgtagttgtcggtgaagagcgcatccagggactcgttgagcgggcgggagcagttggggggcagggtgaggacgatggcgcgcggcgtcacgttgctcacgagcaggcccagcccgcgcgtcccgccgagccacgcggtgccggaggcgtcgtcgcagccgagctgaaccgtgcagcctctggagaagccgaacgggtacggcaccctcatgcggccgcagctctgcgtgcagctgccgttgcctccgccgcccgtcgatcccgctgatccgcgtgctgcgtgcagcagcagcaccaccagtggcaggagtagccgcgccgcgccccgcatctcccacggaaaccggctaccgcgtccgcgcgaggcgtctcatccgagccgagctactgagcaagcgatgcgcgacgaggcgccgggcgcgcgcttggaattggacgggtgggtggcctggtgggctttgccgccgcggctgatgcgatgatgtctttgttttggattctttggcgcagaattccgcattaaaaccaggccaagtcggaccaacgaccaacctactcctgcatctcctccgcttcttacccccatcctgtactgcacaggcagctcatcggtgggccccgcggagtaacgccacggtacaaccgtgcaacgctgccatggaaaccgatcactaaattatccatcgcttcatcctgttactctttggccgtggccatgtcacgtcacggcaaggaatgcggggccgttgtcttctgccggctcatggacacccgttcccacttccctcccgtcgctgtcacggctcagcgttcttccggtcttccctgccgccgtggccgtggaccggcgactctcgcctcgcctcacacccgttccagttccacccttaaaacacgttgcgccacttgcccggtccgcctgccagcgcacgaaaccctcgaactaatccaaatctgaacgacaaacctacggtctgaccaaacggaggacacaaacgaacatggagcggttggacggttttcttcttggtaaatacggcgtagaataatttgttcaagttcgaggtccatgcacatataatgtcgatacggagttaataggtgaaatggtgaattaaggactcaaccagaccaacgtttaaagattagatgaaactaatttagttgtactagtattagtagttagtagtacgctagcacagtaaaggacaccggcattacattaactattccatcaagacaatggagcaaaccaactttttgtaggtctctacttaatacgtttttgttcatagggaagatgtggaattaacttgtactagaggaaacttgaaggtttactgaatcctttcaacgaagttgctgttgatgtaccgcaaagtatccagtcagttaaaattaggagacatgcctaacccaatttcagttctgatttctgaaaggagaaaatgtcataacaggacaaacaagacgtgctcgtggaaattaaggacaccaaaatgattgtcataaaaatgaatggagtaaggccctgtttagtttccaaaaagtttttcccaaaaacatcacatcaaatctttaaacatatgcatgaagcattaaatatagataaaaacaaaaactaattgcttgagcctaattagtccatgattagccataaatgctatagtaacccacatgtgctaatgacggattaattaggctcaaaagattcgtctcgcggtttccatgcgagttatgaaattagttttttcattcgtgtccgaaaaccccttccgacatccggtcaaacgtccgatgtgacacccaaaaattttcatttcgcgaactaaacggggcctaatattcaaccaaacctgtgtaacttgtcaggttgcccctgattagcagcacttatttccaacctgccaaacttcagattttctttccttgctgcagtcaaccactccagctggtccatgcgccaaatcagcgcaaaaaggagcttggatagaactataaggggccacaaggaaagctgaaacaagatcaattataagtgtgcactagtactgaaaatacagaggatacagttaatttggatgctctgcaacttaaaaagagagaaggttatgcaaatggatcgagaaaagacagaaacttaccaatctgcatatgagcaaccgaactgccagtttgactttattggttggcacgttggatgtagttttctagaaaaagcaaatcatatgcatccattttttaagagggtactcatgcattaaaaaaggtggatttataactaaatatccacttgcaaaaggtgcaaagacatacaggagaaacactacgattcaagcagttttacttttacaaagatagaaaaaacattaatacaagagaaacgctatgatacaagagttcagtgaaggtgtaaacaacttcagtaaaagaatttgaaatcacaccttttcgtagcaaatataccccacattgacattgactctataaaagggttctctcattaacatgtatgaagagattgtgaatagacctcagatttctagtatagtccttatctgctcaggcgagtgttttactaaagaccttgggtcagggtagcaattttttggatccaccactgctttatagatcagttcataagcttccgccagagctctagccaaaccatagcatgcatcagaacgcaactttggtacttgcagctgctcaaattcaggcaaggaaccttctgttccagtcactagaccatagaatgccttcaagcattccaacaacatttgcggtgatgtctccacaatatcagccaaaggtcgtgcgtcatccttgctgccagtagagctatagtcctttatgtatggcatcttgtttgatagtccacatttcctaagaatgctatcagcttctttatctactagggtgtgcaaatgtgtttcaatcatagacccgcaggttgttaatataacttgtagcaacatcttggcccatcaatggttcctgaatagctgacaaacagttgatgaggtagattttggatgaagattcaccactctgcacatgttatgacatatatgaggaaaatgataagcaaatgtccaaaaacgatcggcacagcagaagcaaagtctatccagctgaaatgttcgaaagcaaatgggttttagaccaccatcagaaatcatgctttcatcaatcagatttcaaatacaaaaggttgagactcaaagacggtgatgccaatcgttaaattatgtacatgcaattccctccataaagccagcgttagataataaa

SEQ ID NO: 23741 - DNA, 450 bp, Oryza sativa
ctcccttcttgggatctggcatatatatagctaataagtctatttcatgtccttagtctttgggccgtgccatataatacgtctatttttccttcctattctttgtgcatatagatggccaaaaggcccgaggcccgacgacccggcccaagcacagcacggcccgacgggagtcgggctcgtgccagcccggcccgaccgctgggccatgcctgggcctccccactagtacgttcgtgccgggccggcacataaagaatagggagtacaaaaagacattatatgccactgtccaaagaataaggatgaaaattagacttattttagctatatatatatgtcagaccaaagaggagggaggtaaaatagatttattttagctatatatatatatatatatatatatatatatatatatatatatatatatatatatatatatatatatat

SEQ ID NO: 23742 - DNA, 686 bp, Oryza sativa
caccatcaatctgtatggtgtaaaagaaattcttactgcggcattgcatttccctaaaaaaattcagtgtcttctgcacatcattgctacactcatcccttctgatggcatacgccattcttgtcacagccctccttgtaaagggggttaaggacggcccgccgtgcatacctgaaagtaatccatacatagctgtaggtgtcatcccattatctaccatttcctttatgttcctctttgtcccttcatcaatgaaattatgagaccggaagtgtttagtatgctgcaggtcccgtttcatttcatggttgtgctcactaacgaatgcagaaactctccacttttgactttcagaagaacgatttaacctgaccatagccttgcagcctatcctggtcggcggaccagtgacggaattatctctaccctgcataaattacaggaacaccttactacgtaaaacctatgaaatgatgatcctacgcatcacactatagaaccttgccaatcttacaagaatacgaaaccatggttttcaaaaaaaaaaaaagaatacactaaagatttttaccttgcgaatgcagcaaaactcttgcatggacttcacgcctccatctttgtatctgttcttggatctccttataccaaaaccagtgaacctagcgtacagattgtagaacgcatag

SEQ ID NO: 23743 - DNA, 10404 bp, Oryza sativa
tttatgttcctctttgtcccttcatcaatgaaattatgagaccggaagtgtttagtatgctgcaggtcccgtttcatttcatggttgtgctcactaacgaatgcagaaactctccacttttgactttcagaagaacgatttaacctgaccatagccttgcagcctatcctggtcggcggaccagtgacggaattatctctaccctgcataaattacaggaacaccttactacgtaaaacctatgaaatgatgatcctacgcatcacactatagaaccttgccaatcttacaagaatacgaaaccatggttttcaaaaaaaaaaaaagaatacactaaagatttttacctcgcgaatgcagcagaactcttgcatggacttcacgcctccatctttgtatctgttcttggatctccttataccaaaaccagtgaacctagcgtacagattgtagaacgcatagccatcagagtcctcattgaaggtctgcccaattttcggcaacagaatggctgggtcagagagtgaaataggcagcagatcactatcttcctccccctcaaccacgatcctaggatcaaaaaaatgagaattcagctaacaatgcagaaagggaaattgtacactacaatcacactgacataaaaaatacctttccaacggaactacgtccatgggttgtccactatgatcctcgccacctttctccggccagccttcttcctccatagctatcttcgcgaatattgtttctgtccagcacggattctggtagctacccctttcggcaaacagaatttgctatagggcgtcattttttccagctggttggatatatactgacaaataattccggtttattttccattagctgttcaacaacctccccgaaaatcaaggctcctacgtgcgaagcatgttattggactccggaaagtcagccactagcaacattaacgaattctgatgaaaccataccgccacaaaaatagcatctataacaaacattccgagtacgcaacgctacactcacagaaaccaattcgaaatctctgctccattcttgtacaatattctgctcgaagaacttcatcttggtgaaggattgcattcacgatgacaacagggagtttgcagtacacacaacttaaatagataaatgaaaggataacatctcaattttatttcacttcccaaacagcagaagatacagatttctaaacttagatactactcgctttttcctcatagaaaataccatacaaaactagagacagttcgtacgactaatctacgaccgtgcagaaagcaagcccttattacaattttcctgatcatcacactattgtctacatattttcattggacacatgtttgcaaccattactgttgacccgggttgtttcgttgcttctgaaattcatgtcgcaagccgcgcgaatatcacggagtgagcaccaagcgcatctcttcctaggatttctcatgggaagaggatgacatccatcgaaatgaatgacatatttctggagagagtggttcatcacttcactccgagcagcagtatccatgcaacgcacaaaaccattcctgatgaccaaataacgcaataaccagttagagccaaacaaacaaacaagagaaaaaatttcaacagaacataaactaaaactaaacttcaatgtgtacctatctgcggcaggattctgctgcttgtcaccattaattgtaatggttccatcttctgccttcgccatatgatggtgcttgctactactcaccggcgacgacacgcctacggccgccaccgacttctgctgctcgacatcaggcgccgacgagcctccgcctactcgcgccgcggaaggcgacgcaacagacctcgccgacgacattctgccctttccaccggagagtttctgctccatcaaaaacctgcagaacaaaatcttcttcctcacaaatccgaaagataattgtggtcctcattttctgtcctccatcaccgtcaacttaaatagagtatcaatacagcaacctccacactaactactctcctggtcgctcggtcgtgcatgcgtgcgggtaacaaaccatgcatgcagaacattcaaaatgactcaccatgcagaacatagcgcagtgatccgaattttcaaaaaaaaaagaatattcaagtttctgcatcactggtttaatggatcttttctcacaatccgttagtgagttgaagcccgaaaccctgatgtgagttggacaggtgtccgatggttacaataggagtagctactcctgggagtagaatataggcttcctatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatggtgccccatatgagtgtcctatatagtaaatttgtcctatatatatatatatatatatatatgtttgttttgtgttgaaaatatttctaattttttctataaacttgtttggacttaaaaaaaatattgactagaaaaaaattcaaaacaacgtaaagaaaggaagtagaatttagaagttgccctattttggccatgtttctttccataagtcttagggctaaaaattagttctagggctaaaacataagtcatctttagtcataccctgtttgtttggagggactaaaagggactaaaacctcattaaatgacctatcttttagcacttcatccaacacctacatgcttcatccattcaatagtaggtgcgctataggcctttagtctaaattagcacctcccctagagatttatggacctaggtaattttagcctcttttagtccctcctgtttagtattttaggggctaaaatagactaaagtgaagggacttatgattagcccctccaaacaaacaacccgaagggagtactgttacatagtgattgacacatgaactgttgacagatggaactgtcagtacacgttggatccatgctttagacgtctcgacaataactttggatttggatatactagggaaacaacgagggaatacaatcttcgaattctagccttcgaccaagtcacccgcgcgcatgtaccttggacgacgatgttgtccacttgccgtgcgaacgtgtggaggtaaagcgaaaaaagactaggtaaaaccatgcaagcagcacacgcgtgcttatttactgtttagttacatggacggatgcaccaaataatttcagctagacagcaatcattccacacgttctcctctcctgctccagctccccatcccagatgaggtggcaacaacactgcttaaacacgccaccatctcggccgccgtccggccggccgtcttcgcgagtgacgcagctcccatcagcagcaacgagctctgctagctttcgtctcagcgctccgtcctgcggtcttttgggtctcgaatcgcctcatgtggaccccacaatcacgttggcaaatagcagctgccctggtgctgcttctcacgttttagagcaagtttaatagtggccactgctagctccaattcatcaatagccaataaaataattgcttactatactattaatatatggtctcatctgtcatacatatattatgtcttagagtccgcgctgcagctggttacagatctatagcctgctgctcttctctctcatcttttatctcattaaaatatgtttacaggctattagcctgctattgtacctgctcttagagagagtgtgtcgtgggtgactattcagtctcccctctcatttctctgccacctcatcacttttgccatcgtggacacactatcaccaggctccagctaatttttttcaattgtacgtgctcttagtcgacgtacgtccaatttctttctccaagaaagaacgccgaacaagcgccgacgaaaaacggttcctcgttatttctctccaacgcgcgcgcacgggctatttctacccccgccgccgagtagttaggcgtccaaagtttcgggagttcatcgtgaacggtgatcgatccaaagaacaacaactcggagcaaagctagctaacgaagttagttccaaacaaagctagcttatcgcgattagctagctagaagagagttagctaggcgccatggagctaggcgtgccactgccacgacggcccgtgcccggtagctacggcgtgccgttcgtctcggcggtgcgcgaccgcctcgatttctactacttgcaggggcaggacaagtacttcgagtcgcgcgccgagaggtacggctccaccgtcgtccgcatcaacgtcccgcctggcccattcatggcgcgcgacccccgcgtggtggcgctcctcgacgccaagagcttccccgtcctcttcgacgtcgccaaggtcgagaagcgggacgtgttcaccggcacgttcatgccgtccacctccctcaccggcggctaccgcgtctgcgcctacctcgacccgtccgagcccaaccacgccaagatcaagcagctgctcctctccctcctggtctctcgcaaggacgccttcgtcccggtcttccgctccaacttcggcgcgctcctcgacaccgtcgagtcgcagctcgcgagcggcggcggcaagtccgacttcaccgccctcaacgatgccacctccttcgagttcatcggcgaggcgtacttcggcgtgcgtccctccgcgtcgagctccctcggcaccggcgggccgaccaaggccgccctgtggctcctatggcagctcgccccgctcaccacgctcggcctgcccatgatcatcgaggatccgctcctccacacgctgccgctgccacccttcctcatcagctccgactacaaggcgctgtacgcgtacttcgccgccgcggcgtcgcaggcgctcgacgccgccgagggccttggcctgtcgcgggaggaggcctgccacaacctgctgttcgcgacggtgttcaacagctacggcggcttcaagctgctgctcccgcagatcctgtcgcgcgtcgcgcaggccggcgagaagctccacgagaggctcgccgcggagatacggagcgcggtggccgacgccggcggcaacgtgacgctggccgctctggagaagatggagctgaccaggtcggtggtgtgggaggcgctgcggctggacccgccggtcaggttccagtacgggcgcgccaaggccgacctggagatcgagagccacgacgcgtcgttcgcgatcaagaagggggagatgctgttcggctaccagccgtgcgccaccagggacccgcgggtgttcggcgccacggcgagggagttcgtcggcgaccggttcgtcggcgaggaggggaggaagctgctgcaatacgtgtactggtcgaatgggcgagagacggagaaccctagcgttgacaacaagcagtgccccggcaagaacctggtggtgctcgtcggaaggctgttgctcgtcgagctcttcctccggtacgacaccttcaccgccgaggccggcaaaaaggtggtcatcaccggggtcaccaaagcttcaacctccgccgtcaatcgtactgcttaagccggccatcacttcaggcgtgggtcgtcgatcatccactcaaccagctccgtcctacgcatatgcaataagaaatactcgtacctgaattcttgcatggctaaacactactaataagtgtatgtattctgtttatttgttcgattccatatttgtaattttgttgttattgtttgctgttgaattacgattgtgtattttacagggctgacagtgtctttaaacacctctaatatgtatcggatcaatctgccctagtcatgtctaatttgtgaagatccactttctttaattattcaatcatgcatttttttttcttctttgtcgtcgtccttcccccacgtacatagcacttcatatctcttagaataaaacaagtaatctttacctgttgttccaatattattactccctctgtgtttttaaatatatgacgatgttgatttttgacagcgatgttaaatcatttgtcttaattaaaaaaatataaatacttttttattttattgtgacttattttatcatcaaaagaagctatatgtaattttaacttatgcttttacatatttatattaatttttaaataagacgaatggtaaacattataacaagtcaacggcatcataaataaaaaaacagaggtagtatattgtaagttgttttgaattttccctaactcagatttatttatgtttgtccaagtttttttaaaaataaaacaacatttttaaaacagaataaatatggtataaaaatatgatctatactgaatataacgaaactaattcgataatgctcaaaatcgaccctccccccgggcacgtgcatgccaggcccgccacatgtcgcacgccgctcccatcacttgtccccactatgcgcgccattgtaacaaatcacccgtatattaagggaattcgtttcaatttttattccaccaaaaatgtttcacctaatatgtcgacgggggatacctgtagaccggatatagagggtattgtggtccgttagtacgaggatctacgtagtacgatatcaagcaaacaaaagacaaggattatactggttcaggcctcttggtaggtaatagccctaatccagttgatatgggattatatgatggaaaccacagattacaaagggaatagcagaactcgatggtaccgacgagaccgtagtcgagttggttcaactagatctcccagcgacttggctcctgtaggctccgacttcgtagctgtgatggatgtattggcggtgagattcgatgccttatgtcctgcccagggggtcccttttataccgcgggtcagttgatctccaagtaggactcggagatatcggacccctcacgatatggtaacgacccagtctcgtccgagtaggactcctcccatatgtggattctgtttctatcacgtgatagatttccttaacgtgtacaggaactatccgtatacgcgcgggtataccatatcagtatacaacgtatatccaaggatagagggtataccttatccgtaacactgacataatgtactcacaatgtttcactatgtatagattcaatgttgcagtgaattgaaacattcttttgcaacaaaatcacccacatattatggaaaccctctattaaggaaattcgttttattttttttctaccaaaaatgtttcacctagtgtattcgtgatgtttcactatgtatggattaaatgttgcagtgaattgaaacattatttcgctatttgctgaaacattgtttttatataaggtgacacccgatcttaaacgattgaaacattttcgatctacttagtgaaaaaattccaatacacttggtacaacagcgtgcaacatttaaaaatagttcaataataagctaattttttttcatcagaatatatccatgtgtggtctaattttaacgatttaattgcaacaaatttaatggtacaatcgaatcatgatttggataaataatttaaaagaaaaaacagtttaaagtggttttgcatgcatgcatgctgacgtcagctgacgtgggcgcctgatttttttacacccggatcaggcgcccgacacctagtcccttcctatttgatatatattgtacatattactattttataaactttattcaatttaagaaatttgacttatgataaaaaccagaaatatcttattttattggaggagtactacatttgtcacgtgaaatcaaaggctctgattctttaattttatttttgttaagtagtcgtgaggcttcggtatattgggcttctgtatcttccagttgaattaattaatggttggttaattcagtactccacaaagacagcatatatagctatacgtatatagaccagctgttcttcagtcctcatctagaattttctgccatgcatatatatggaacttaatcatccgacgtgcgtgaagtcagtcatctatataataatctacagtagaaacgttgccgccgcgcgccgccgctctggcagccggcgagtacgtcaccaagtcatcatcaccaaccaccgaagcgtgacgccgcgcctgtccggcgtaagatacgtgcaggtacgccagtagtgactgatatggtttcaactttagtacaagcttagatcggtagtacgtccaggactgaacggtatctctcacctctcacccggatcggacttttcccggctgaccagtgaccagaaatgtcaactaaactaatcgcatgcagaaaaggagggttgaagtgagcagatttactacgatagcatggtaatttaattcgtactatcttctattttgtccatttcgaaacataacgtattgtatatgcaaaggcgttctaatttgaaaacattctcaccgcgtccccactaatgcaccttccatactatacatagtagctcagatgtgtgtttgaacagttcaattcaaactcatcacgcatctttgttaactggtgtcacgccccgaactagtaccgaccggaactagcccgtgacgctccaaattaacctgttgatcgataccagtcccaggaaacagtgctggtatcacagggagacagaatatcacagcaacaacggtctctttattatagagtacggatacagtcatgttgggctacggacagatcccgagctcacaactgcattacaaaagggaaacggaagcaggacttggaccaaacaacacaggcgcgacttgggaactaggccgaaaccctaaaactcatcgtagccggcttgctcctgaaagaactcctcatcagcaggatccgcttcatcttcttcagcaactgggggggatttatttatatagagcaagggtgagtacgggagtactcagcaagccaagggaaattagtgtttaatgcaggcttcaaggaaaggctgttgtttttgcaattgattttatttgaactcttttctaaaaacgactaagtgagtgcttctcaaacgacacggatgagacagtgcatctcgtccggtcggagtatgtgcaatgcatcagtctttagaattgaaacaaggttggcacccggccaacagcttttcaatggccacccgggccaacaacttttcaaacggccacctgggccaacaacttttcaaacggccacccgggcctagctgatcccatcagctacagatttttcaaacatcgaatcccttttcacaacagcaatttcacaagcagtagtcaaacaaaactacgctaggaatcacctcacatccgcccatgaccgtgggcacggctgttcgaacagtttgttaacctctgcagagggggtacactttatccacacgacattactaacccggatcaccagcccgtggggatcagccacgtcgggagacctccaagctttcgtgacaaggcatttcgaaagccgacacaggtttaccatatgccgacgacaggggtcccagaccaacaacaggttaggtcccagaccatactgtgccaggaagcccaggggtcctccccgacaccaccccggcgaatccacatgtctctcggcatcaaggctcccctgataagctagttactcagccaggagtgtcccattccacccatgtggtcgtacttgacttatgtttggatgaaattccaaggaaacggtccttaagtgcaagagcgggaaatcgtacacccggtacgttccccggtctgcggttttggaaattcatttagttcgtaagcaccgacccaggtgtcgggttttccaagtcttttgtaaaacccaagttttacccaagatgtttatcatattttaagtttgaaggcgaccgtcgatactcgcacagagtgcacggataccgaggcgcaactgggtggttacaagggaacatggtgtaacgattaacaaaggaaggatcaaatgcaacaagttaggtatgcccactaatctgcctcgcagacggggcaaacatattacgtgcaatcctatcaatgcatgatattttgcaagcaatataattaagtccaaatataggct

SEQ ID NO: 23744 - DNA, 3118 bp, Oryza sativa
acagatcccgagctcacaattgcattacaaaagggaaacggaagcaggacttggaccaaacaacacaggcgcgacttgggaactaggccgaaaccctaaaactcatcgtagccggcttgctcctgaaagaactcctcatcagcaggatccgcttcatcttcttcagcaactgggggggatttatttatatagagcaagggtgagtacgggagtactcagcaagccaagggaaaatagatgtttaatgcaggcttcaaggaaaggctgttgtttttgcaattgattttagttgaacacttttctaaaaacaactaagtgagtgcttctcaaacgacacggctgagacggtgcgtctcgtccggtcggagtatgtgcaatgtatcagtctttaaaatttaaaacaaggttggcacccggccaacagcttttcaaacggacacccgggccaacaactttcaaacggccacccgggcctagctgatcccatcagccgcagatttttcaaacagcgaacccctttccataacagcaatttcacaagcagtagtcaaataaaactacgctaggaatcacctcacatccgcccatgaccgtgggcacgactgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggtgaatccacatgtctctcgacatcaaggctcccctgataagctagttactcagccaggggtgtcccattccacccatgtggtcgtacttgtcttatgtttggatgaaattccaaggaatcggtccttaagtgcgagagcgggaaaaaccatacacccggtacgttccccggtccgcggttttggaaattcatttagttcgcaagcgccgacccaggtgtcgggttttccaagtcttttgtaaaactccagttttacccaagttgttactcagattttaagtttgaaggcgaccgtcgatactcgcacagagtgcacgaatatcgaggcgcaactggatggttacaaggggacatggtatagcaattaacaatggaaggatcaaatgcaacaagttaggtaggtccgccaatctgccttgcagacgggacaacatattaagtgcgatcctattaatgcataatattttgcaagcaacataattaaatttcaagtataggctcaagatgttcaaaggtggcttgccttgctaaaggtctggagcttgatcctcgaaatcctcgcactgcgggtcttcgggctccggaactacacgcgaaacgggacaactcaacaaacggcgaaaatgaagccctaataatgacctcaaagcgtgccattagatagatctcgagatttgagaaattttggaagttgaacggagtcaaacggatttatggttgggaaggtattgaatttctaagattattggatttttggtctaaaggaaaaggatttaattaaatcctttttggaaaagaaaagaaaagagggagggaaaatagacttttctcgggcggctagggcgcggcccaagagaattggggcggtccggccgagctaaatgggccggccagcccaagacggtcgcgcgcgtgggagggaggagagagagccggtggaccgggctcaccgcgcgcggtcccgggtgggacccgcttgtcagcggctcggctcaccgtgcggagggagtacgcggcgcacgcgcgcgggcgggggagggacgcggtgcacgcgcatggtctgcggaggaacggatgcggcgggcccacgcgcagcctcacggctcgcggtggaacgcgcgcacgggaggggctgaccggggtcggcccgtcccaacctcggctgagctggcgccgacgtggcgcctacgtggctgccacgtgggctggcgagaggtagacgacgacgccggccggaacggacggcggacaacagcggcgagcggcggagcgaaccatggcgataccggcgaaaacgagcacaccgggtggttgcacgagacgaggggagacgagccaacggctcggattcgccggaggaagcttgacggcggcaaatcgcggcggcggcaaccggcggtgggaaaaggggaaaacggcgacgaggtcacgaggggccgattcccggcggtgagagcatctacgcggccacgggaatccgatggtagcgtcggattgggcggagctacgccgagcgaggctggcgacgagcgggtgctacgaagctcgagcggcgacggcggcgagcacacagcgagcgatggcaacggtcggggcggcgccggctagctacggggaggctactcgtgctaccaccgaaaactaaggggaggagatggagcgaagaggaagaacggagggaggcatcaccgaggtgaggaggggcgctgtgacgagaggccgacggcgcgggagtatctctccggcctcgggccggggaggaggaaggagagggcgcggccgaagtccccttccgcgtccttgctcgtgccggctcctccgacacgcgcaacgacgaacggcgacggcgaaacagaggggcggcaatggcgcggaggtgaatgggagaggaaaggaaaaagggggggagctcgggtttataggatggcaatgttggtttgggaaccgacttagggcggtcaaaggagagggctagcgctcggcggtcgcggccaaagcggcgacagggagaagggaggaggatgaccccggcgggagggaaaaaggggaaaagagggagagaaaagggggcttgtccccttgcctcttcgggaaaagaaggagggagcgggggcgtcgcggcagagggaggagggaggctctgcctccgtcccttggaggctagcgcgggagtggcggggccgaggcgatgacgacggcaatgacggtggggcggtttggagcggtgcgacgtcacgggcgacaggcgcgggctggcgcggcagagggt

SEQ ID NO: 23745 - DNA, 3603 bp, Oryza sativa
agagggagagcgggagcgcgccgggggagaggagagggccgggggagaggagaagataggccgagagaaattcggcccatcgaccctgggagaggcaaaatagacttttacggaggaattgatttggaaagggtttggattcgggattgaactcgacgatagatcggggatttgagatctgagatggcacggacactagacaacaagcaaagaaacaaatttcgcaattagggtttttaagagataattttcccgctaggcgccacgacggaactccagggttaagcgtgcttggcctggagcaatttgggatgggtgaccgaccgggaaattcttcccgggtgcacacgagtgaggacaaagtgtgcagaaaagacatgtgttggtctgtgagggcagtctatgacctatgaaagctatcagatgtaagtggacccggcctgggggaaggcgggacgttacaaaatggtatcagagccgactctcgcggtttcacaggcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccaggggggtgcacacgagtgaagacaaagtgtgcagaaaagacatgtgttggtctgtgagggcagtctatgacctatgaaagctatcagatgtaagtggacccggcctgggggaaggcgggacgttacaactagcaagccgaactttcgacaaacaatgcatgttaatgttggcgtcgaaaatcgctagcacgcatttaggatgtatttgaggaggaggggattgagaagattgggaagatacacaaaacgaggtgggccattagcgcataattaattgagtattaactattttaaattacaaaaattgattaatatgatttttttaaagtaattttcctatagaattttttacaaaaaacgcaccgtttagtagtttaggaagtgtgcacgcggaaaacgaggtgttttctcacccaatatcactggaacgaacgcacccttagtcaagaacaaattaataaaaagataactatttttttgaaacgaaataaaaaaaaactatgcactttcgtgataacgaccgaccaatttttcaatcaaatcagtaaaggaattagattaatctactcctaaacctagaagaataaattcggcgctgagctacgacaatttggcacttcttcgccgcctcagatagaatctcagcgccaatattagtggcgttgagatgttatagctcagcgccatcggggttggcacaaaggctcatttctacaattagtttttttggtacggttcaatcttcaaataagttttctaaaagagtcattttgtcaaaatttcggagaataaagtgaggtagattatttttttatcgattatattaggggtgtgcagtaggtgtaaaaacgtagctcaaccttgtcgggccaacaatgacggtgctttgggcgtcatttccctcttggggtgttgtctccctctttctttggtggggctgccaggtgaaaacctcatcttggtttttctcgagaccacaacggatggcggtgtttgtgctcatcgctgcttttctccctgaagacttcgtccaggagcccccctcccccgcgccaaaacttctctcatacaacttgtgggcgctctctctatatgtttgtccttttgcggtgtagtcctatctaatacaagctagccatgttggcaggccttatggaggagagcggttacattcttttctctcacctttttccttccaatccatcaggcgtagatgaagttgagtgcggtgcttgatggttagagtttggttttgggtggttcggatgtagtttctttgttggtatagcagcgaccggttcagtgttatccttctctaaggttctatataggtgttgtcggtgatttggctatctatacagaataaaaagaaatggaaaaaaaaaacaaaggcacaaaagaaacgtatatagggaaaaaaaagttcaacccttaactagggagaaaaaaaaggtaacgtgcagaaatgataagtccgagtcaattgggtgcgcggttgtatgcacgactttcaggactgcacgtttgcacggtaacgaacccgggaatttttccgatcaatcaaccagaacggcttgctcacaccccatggaattttttggtgatttcttcggttcttccgctaactatatgcggctcggctaccttcatcgtccacacgaataaatcatttaatccacggagacggagacaggctaagctctcggcccagtcctgcatggactgtagctgggttgctcgccctgtcactcccagtgctctgtgcccgtgcagtggccttttttcattggaatatataagtatattgcttccctcatttcttgtcctcagtagagccacatctctcaactataaaaccgggtacaactccttcacagacttcaaaaaaagtacaaattgactccttcgatagtttaggaagctatttctatcaatgcggcggattaacttggtccaagtgtgctaagtgacagcagcggctagcactagatcctcctcatggcgggtgggacaacagagacattcggggcatacaagatctatcacgacccgaccgtggtggcctggcgccaccgcctcgtacggctaaccacgctgccgcagccttccttaacgcttccatgtcctccgccaacccggcagccctggtggtttccgatctttgattccgtatgcttcgatttggacgagctccccctcaacgtcacatagttggccaagctcgctacctacccccgaggtctccgccatcgtcaccatgtatacagcgccatcacagccgagacactccgcctagttggatccacttcttggcccggcttcagcagtggcgggtgatggcggacggtatgtcgaccgccgatatctcgctcctccccaccccggttttctgggactcactccacgatggcagcaacccctcctcttctccgccccattgccttgctcaatgaccgctcaccgatgatgccacctttgttgctggcaatgtgagatcgaggtgagtcagagccagtgcctcccacccagcttccctccccatgagtggctccccatcgccgtcgcctatctccaccttctcctcaacccaacttcccactgaaattcttcgtcggttgtccaggatggtggccatggcgatgataagtgggcctcaacatttttttttattttaacccctatcaattacacgtcggacctacttctatttttaatttcttatatgatctggactgccacatcaacacacttgaacgaagtcaacctgctatgttagtagaaaccgcttcctaaaccatcaaaggatatagtatagatggccataaggcctgaggcccg

SEQ ID NO: 23746 - DNA, 2699 bp, Oryza sativa
atcaagattggcacccggccaacagctttcaaacggccacccgggcctggctgatcccatcagccgcagattttcaaacatcaaacccattccacaacagcaaatttcacaaggcagtagtcaaacaaaactacgctaggaatcacctcacatccgcccatgaccgtgggcacggctgttcaaacagttttaataacctctgcagaggggggtacactttacccacacgacattactaacccggatcatccagtccgtgcagaatggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtcagcgattttggaaattcatttagttcgcaagcaccgacccaggtgtcgggttttccaagtcttttgtaaaacccaagttttacccaagatgtttctcagattttaagtttgaaggcgaccgttgttacccgtgcagagtgcacgattaccgaggcgcaactagggggtgcaagggaacatggtataacaattacaatgggggggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttagaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcgcggcccgagagaatggggcggctcggccgagcttaatgggccggctggcccaagaaggcagcccaaggcgcgcgcgtgggcggggaggggagagagagagccggtgggccgggtccatcccacgtgggcccgggtgggacccacttgtcggcgacttggctcaccgtgagcgaggtgcacgcggggcgtgctagggtttggggagggaggcgcggcgcatgcgcgcggttcgcggaggacgcggtgcggcgggccacgcgcagcctcacggctcgcggtggaccgcgcgcgcgaggggcggagggaagcggcggaccggggtctacttgacccggtcgcggccgaggtggcgccgacgtggtgcctacgtggctgccacgcgggccggcgggaggtagatgacgacgccggccggaacggactgcggacgacggcggcgagcggcggagcgaatcatggcgatacaggcgaaggcgagcacaccgggatgttgcacaggacgaggggagacgagccaacggctcggattcgccggagggagctcgacggcggcggattgcggcggcggcaaccagcggggagggaagggggaaacggcgatgaggtcacgaggggccgattcccggcggtgagagcatctacgcggctacgggaatccgttgctagtgtcggattgggcggagctacgccgagcgaggccggcgacgagcgggcgctacggagcacgggcggcgacggcggcgagcacacagcgagcggcggcaacggtcggggcggcgccagctagctacgggaagactacacatgctactaccgaaaactaaggggaggagatggaacgaggggagagaacggaggaaggcactaccgagatgaggcggggcgctgtgacgagaggccgacggcacgggagtgatctctccggcctcggccggggaagaggaagaaggcgagcgcccggagtccccttccgcgtccacgaacgcatcggctctcccggtgcttggcgatgaacggcggaggcgagacagagggacggcaatggcgctgtggcggtgagcgaaacgggaggaggaatcgatgggagggcgccttggtttataagacgacgatgtcggtttggaaaccgaccttgggcggtcaaggtgcgagctggcgctcggcgctcgtggccaaaacggcgacagaggcggatgacgccggcggggaggggaaaaggaaaaagaaagggagaaagggagcttaccccttgctactttgggaaaaggaggagggagcgggggcgaccggcagagggaggaggagctctgcctccgtcccttggagactagcacgtagagtggcgggggccgggtcatgacgacggcgatgacggcgggggcggtgtggagcggagcggcgacacgggcggcaggcgtgggcagg

SEQ ID NO: 23747 - DNA, 1973 bp, Oryza sativa
attcggcccatcaaacccgagggaggcgaaatagacttttgcgggagggatttgatttgggaaggatctggattcgggattgaactcgacgatagatcagggatttaagatctgagatggcacggacactagacaacaagcaaagaaacggatttcgcaaatagggtttttaagatatagttttcccgctaggcgccacgacggaacgggcgctacagccgtgcctgggccgatgccttggcacggtgggccggctcggcacggcacggtcaaaaaaataattgagggatccaaaatagaattaatttatccatataagacatggcccaaagtgaagacagatacaaaataagacttattctatccatgtaagacaccagcccagagagatgagggagtaaaaatagatttattctatgtagaagcatgatgggctgtcgtgccttctggctggccgaatacggccctagtcttattgggttgtgcctggaccgttggtgtagcccgtgggtcagcccgactaacatcggcccaagcccggtcttgcttgggccatgctggccggacggcccatttggccatctataggaataggatctattcaatttgctccctttattttacaagaagttggtgggtgggttatatccgtattacggttgagggatgtgattcgaccaagagcaagaaatgagggaggtgaattagactctttcccttttgggtgcaaggcccaaggtaagaatatggcgtgatgggtgtgccactcaacgtccaacccatccagcgaacggcacaccaaactaccgaagttgtacttccgaatgctgcagatcgaagcgcataaacggcatgtagaaaaccatctttatttatgagttatgtatcttacatagaacaaaacagcagttgatttaatcatttggacatacacacaccgacaaaagtcccttttgtggggcgaggaatattgaacgagcacaatgcaacaaagttgatcagcgaggatcatggaggtggagcagtatatatatcactcagcaggcttcatctcctgcttgatggccgcgaccagttggttgtaggcttcgctccacgcgctcttcatcgcggggctccacatgtccaccggaaccgcctccttgatcgtctcaagcagcgcgaacctcgtcacctgtttacgaacgttcgacaaggccacaatcagaacacgatcgatagagttccatgtcgatcgaatggagcaacaactggatatcactctacctcaaagtgggcgtctccgacgccgtacttgaagtgcgtggcgccgagcctcttcagggtgggtctctcacggtgaccttcccggctttccgcagctgcgcggcggcctcacatgtctgcaacatcgatcgatcacgacacacgcacacattctgtcagtgcctactactacaacaaatttactcttgtctgcacatactgatggtagtattaccatgacgaagacggacatggcgtgggtcttgagcttggggttcttctcgagcggcacgtcggagttgcgcaggaacgagaacatctggctcgccgacggcgcgacctcgaagatcctggaatagagatatagtagcaccaatcacgcacaccgaaatgtataatgctcagaaaccaatggttggtgccgtaaactgactctgcgaagaatggcactagtaagtagtagcatgtagtagtacatacttcaagaagaagcggagtccaatgttggcggaatccttcttcatgatggcccacgacttgagcacaagcgcctcctgctcctcgctgaagctgaccgctccccccgacacgccgttgtttccctccacgagagccatggctgcttcgatttgattcctctgtgtggtgaatcgagtacaattcgagctcaattcaactcaactgttggttgcgatctgagtccgaactggagcagagcgaggccgatt

SEQ ID NO: 23748 - DNA, 15238 bp, Oryza sativa
tgcttgcgaactagccgtgagcccatgagttcgatcgggcagtgtacgtgatttgtggacatgccaatcgccaccgtctcctctcctctctccgttcgcgcccccgcgaaacgcggtggtctaccgatgcgtgtttctttcctacctatattaggctcccatttgtgttcccatttgccgccttctccttcttctccgacggcgaacaccgtccatcgcgagaactcttacctcgtcggcgtcggcgtcggcgtcggcgaggaggagcaaacatttacggctggcttgcaatcttaatcgtacgtacttcttcatggcatatcttgtacagtatttattttttttaatccattaaaagcgtggttgtttttcattgtcctgtccgacgaacaaggccttaaaagttgacatgcatctcgtgaaaaggaaaaaaaaagaagcaacgttttctattgatttgttgcggccagcaacaccttttccattccgtgttctatccatgcgcggtttttctctatctgacgctcgtgacaatttcagttttgcagtgttcgtcattcaggaggctcccggccgatccggtggatcggatcggagcgggagcacaaactgcaaattgccacggtccttgcacttgatttccggagccaggaggatgatttgctgcggcggcgaggaggaggagacgtacgctccccgtgcagccagtcgcagtcgcagcaggcgcccgacacctgcgacgcagtacaatgcaggtgaaatcccgccgtttcctcctccggttctgcaggtggttagctgaaacagaggccaaggtgctcaactgtataatgttgcatcgtgatgataattgaattggcagaaagttcagattaaataccgcactgccagctctgtctttcttagtttcagaggcaattttaatctgaactttcagaaagaaaaattgtatagataagcagctgtaattttttgagggaaaataagaagctgtaattcgttatgactaccatccatattctctgttctaattggatacccatctgcacattcagatttaatgctcaagttactcactataccaaacatcagtaggagaaggtcgtagttcaatcgaccaacttgtgttgccttcgcagcatctcattttagagcttactagtacaagattcttcaacaaggccacatcaacttatgtcatcaatacagagagtttagcacggagtatgccacaatccttatgctgaatctgaagactgaaaattgtgcaaatctcctgtttttggttgtgtatcaggccctcgtaagccaagaggaccaaatgcacccaggagcggcggcccgccaccgaaggtgctctccatcgacgtgccagccatctccatgggcgagctgaacaacatcaccggacactttggacagagtgccttgataggagaaggttcgtacggtcgaatctacagggcggtgctgacctccggggagccggttgccataaaaaagcttgatcccagcgtgtcaagcgactctgaagcagacttctctgctcaggttaacgatcagtaaaacaattacacaacggattcgtgttcaacatcaaacttttgtgctgcaaatctacgttgctgattaaaaccatctggttccgtggacatgcagctgtcaatggtttcgaggctcaagaacgagtatttcatccggctgatgggctactacctggatgcaaaccgaagaatcctggtctaccagtttgccacgcacggctccctgcatgacatcctacacggtatacaaattcttcctccattctgatgatctacatgcattaatgaccacaggtttacagcgaattcttcttggcacatgaaacctgacacgacgtgttggtcgatccggaaaccaaaaaaaaaaaaaactgcagggaagaagggcgtgagggacgcggcgccggggccggcgctgaactggagccagcgggtgaaggtggcgtacggcgccgcgagagggctcgagtacctccacgagaaggcccagccgcccatcgtccaccgcgacgtgcggtcgagcaacgttctcctcttcgacggctacgagtccaagctcgccgacttcaacctcaccacccagcctcccgacggcgccgcgcggttgcactccacccgcgtcctcggaaccttcggctaccacgcgcccgagtaatacattctctgtctgaatccacactgtgtttgattggagaaaaacatgatcagaagattagtagattaattgactttcggtaagaaaggtcaaggttaatttttgaccgggcaaatggattctctctttcgctttctgaaggtacgcgatgacgggacagcttaatcagaagagcgatgtgtacagtttcggagtcatcctactggagttactgaccggcaggaagccagtggaccataccatgccgaagagacagcagagtcttgtaacctgggtagtgtagtaggccatgttcttgcacatcttgttggagcttttcatgtgttccaagagccatatgctcttgtggttgtctgaattctggttttttttttttggacaatgctgaatttctgaacattttctactggtgaaatggactaggcgacgccaaggttgagcgaggacaaggtgaggcagtgcgtggatccgaaactcggggatgactatcctccaaaagcagttgccaaggtaatacaagaccatcagtttcttgcaagtttgcaggaacgatctgagatgctatcttgtcgtgcattgtgtgtgttttcagatggcggcggtagcggcgttgtgcgtgcaatacgagtcagatttccggccgaacatgaccatcgtggtgaaggcgctgcagccacttctcagcaagccagccggagcaggagggccctagcagcacatgcatactaacaccagcccatgcatcaaaccaacttagcatccaaaacacattatgtgctctgttcttcttggatgctgagacttgttaaacagctggtgattgtaccatgtactactcacaaatcaatcaaactgctaaaagggtccaagggctcacagagtttcaggtcattggctgtgattctccattgttccttcagtccttacctttgtttaggtttcagatcagtagatatttttgcaatttcgctgtcccgttctgtaggtacgtaagggtccattccactgcatgactgcaagctacgtcgtgttcttatcttaagacatttattgacatcacaccgatgggagacaaactgacaaccgaaggactgtagagaaaataggaggcctccttatcaaagagagaaacattaatagagacaatatctcagtgtagctgcagtttgtgatgactgtggcttgattgttcgcattacgctgtcagctgttatgggttagtagttataactttctcactatgaacagatgatattttcatttcagcgtcagtaatggtcactgaatatgatcggtcttatcacatatcagtgaatgtgagcacttgatgagttgatgttattgttgtggaaaagatcgcctcaactgtcgaaacagtggttttcagggagataatcagaatatcatattagtatactggacttaacaagaatcaggacgcttacttcactgttgaatatttattcctctcagataactaaataccttgtcctgtaagaacaaatagtaagctgcaaacactgcggttcaagatggtgtggctgctagtaattcttggataaggtctggcagaaagtcagtagcaacagacttgcaaaaatgaagttcaccagtactccctacactcccaaaacaagctgattgaagtgcaaaatgatcacactgtaacagcaacaggctaacagcacaattttacaaagaaacaacgaatatcatatcacaattgacaccttctggcgtaaggaccacatggtttcctgtttgtattgctcacttcatttcagtgctcagaaattcatagtttaagaggcccagagcacgctgaaaagctgcacctcatattgtcagtttgtcacacagcaaactcacatgtccctttcagaatttcctaatttccttttggcgtcagaacaaaacgaagagaaagaagcaacaagaggtgtaactgtacgttgctgtacttcgcggcaagcggcgatacctcttgctgataatagcggttacgacgcacaatcgcggtgagaggatgagagcccattcatccacccgttcgggatgatgatcctactcgttttcaactgatctctttcatctccttctccccctttctgttttgcaaggaaagctttcagcgtcgaagagagcggcaggaaatggacaagagaagacgaaccacttagccgaggatcatgtggcgtgcagaatctgatcggtgcagcccgcatctggaattcttgttttgcatttgtttcatcatggcgtcgatctgattccctgttgctttcacaaagaaagaatgatctttttggcaaggaaagcttctacccatagcaatttacaagtgacatttccatagttcacggatcagtatacagaaaaaagaattgcatcattttcatcgggacatcgggtacgctaggtcgtcggagccctaagcatattcaatgtttcatccttgtcgccatgcatacaggcagcatgtagccctgtttagatgggactaaaacttttaagtccctatcacatcggatgtttgaaaattaattataaatattaaacgtagactattaataaaacccatctataatcttggactaatttgcgagacgaatctaatgagcctaattaatccatgattagcctatgtgatgctacagtaaacattctctaattatagattaattaggcttaaaaaatttgtctcgtgaattagcttttatttatgtaattaattttgtaagtagtctatatttaatactctaaattagtgtctaaagacagggactaaagttaagtccctgcatctaaacaccaccgaagggatgggcagcagccatcagcagcaatgccgtgccagttgcagcatagcacagtgagaggcatgtgaggtgccgtcctgacctagcgtagatcccactcatactctgttcatcgagaaaaatctgtgacaatgcgataatgccctaatggtaataaatggaagtactagtatataaataaattttgagcaagctcaagaaaactaaatgtcaagtggccaaattctgattttttattccttgtagtaagatgcctgaacttctcttggatcttacattatttactagcaaaatcctaattgcggttcgccggctcatgccatagtggggctagaaaattatatgcttacctgcaagtctgcaaagtgtgcttctcttttaatgcctgctatatgatgcagaaatgaggcccaatttaaggtcactgtcccagatttggttcctgtcaacaatagctgacgattgtattatactccctccgttccaaaataagtgcagttttttactatttatctccaacgtttgaccgttcgtcttatttgaatttttttataattactatttttattgttattagatgataaaacatgtataatactttatgtgggctaatttttttaaagaaaatcataaattttttaaataagacggacggtcaaacgttggacacgaatttccacggctgcacttattttgggacagaggtagtatatccaaaactgggtcaactgcaatccagaggtgacaactggtaatccatacaaattcaatgtgaaacacaccttgctaatttcgtggatctgaacgggtcctggtcgatccacaccaattgtgcataaaatgatcggagacttcggagttcttattccagaaattgaattttggtgatgccgtcgtgcgattgaagaatggacttgaccttgatcgacctgaacaaaattctaacaaaaaggagggattgacctgaacaaatttttttctatgtttgattggggcgccacgtgatcttaaagaattttgacgggcacatgaccatgaacaacccacaccaacacataacgcaaaatgtaggtcgttcgtttgcataataaacgtgaaaaatttgaggtcaagaattaaactgggcctatgagctatagatgtactacaaaatggagtatcttctttgcattcttgtgaagcttcattcaaacaaacagagttacttgtccaaaagctaggcaagacaaatgtaaatcaaacgaactaaacaatactccctccgtcctattttaaaagcaaccattagtttctatactaaaattttgatcgtctgtcttatttaaattttttataattagtatttttataattatgagatgataaaacataaatagtgctttatacgtgacttatgttttaacttttttaaaaaaaattaaataagacggatggtctaaattgggcacgaaaaatcatgtatgcaaaaaatgagacagagggagtacccaatagtacagcaaaggtaagtcgccggtcgcataagttcataaaataatgaaaagggccgaacacattaagaaattaaggtgactgctccccataaatagggacaagctaaagtgtacaaaaactgctcattcgatatgtacgtacagacacagccaaatttcatgaatgtacattgcaaatatcgcaagtcataagcaaacaaaaaaaaatgtagaccaccataaatgtgcactgagtgtgttcaataaaatgcttcctgtcttctgaaatttattttacacgcccaatatatcgctatgagcatctctaacagaccgggctgacatatcttaagattgacgaagtcaacaccaacgtctcgttgttgatgggtacattgcctaacactaagataattgcaaatgcaagtatctgtattaagtctatggcttaaattcgggtgttttagttccaccgtaagaaagctagccgattgagttaagttcacttcgtaaattcatctttgtatacgtgatgattttttatttgtattttagaaattgacgtaatgatcgtctagatctgtgcatggagtgtgcaagacggcaaatgcatcttaaaaaaaatacatactcctctagcttcgtcttaaaatatgatataacaacaaaaaaaattagatgggatattatctaatactacgtattcatatcaggaaggagttacctaaatacctaatgcaacatgctgtatttgaacaagagaattcgcccagtggaaatcaaagcaattattaactaattattgtgaaattcaagtgttttaaattgtgcccaatgttcaattttgttaaagatgttagtgatatgctctagaggcaatcatagaaatgattgtatcacatactatgtttacatatttatccgacattgttccttgaaatagataactctttattagttaatgaatatgtgattctttcataagactctttatgttgtttgttactatttctaaaggatccctgatcaaatatcatatatggaacaaatatgtttatatgatcagcacatgtattaattgataatcatgtctcatggatcatggtatagagataccaaattaataatgtggacacatgttggtgaatatgttgttggatagacccaacatgagacactgcaagagccatatgtgttgtgtcatcagtgatctcattgagtgttggtgttgaatccttagatctgagattatcatggttctcaacatgtgtagtagcttacttagggactgctaaacactactccgtaattgggtagttataaaagtagttttcgggtatgctatgaaacatgtagtgggatataaataatcaagataggatttgcccctccaattgagagatatctctgggcccctcgatgttgtagattatggaagtgcatggccatgccaaaggtgattgaggagtcaatcacaagttatataatctatcaacaggttcgagtgaatgattgagctattagaggatggcacatatctagccttaagcttaatcgatatcgtgaggcaaaggggttcatacaagtatacactagaggttcagccgatatgatctttatgtatgcccggtgggtcaatacgttctgctagggggccgctgttgacgcgtggaccgaaaatgagttttcaggttatagccgagtatatatgaacctacagggtcgcacgtttaatgggccggaataaggggattggatagagatccaatatgagcttaattcggatagagaccgaataggagtcctacgggccttggaggcccgagtgatggatcctatatattcatgaggggtgtgaccggcggaggcatagcatcacgtgagaaaccctagccatcacttccctccccaagcaaaaccctaaccgcgcgcgggtgctagcacatctgcgcgtggcgttccgtccctgtacgtgtggataccggtagaggcgccgctgatttgcggtgttgatcggcgtgagagtacggcgaggagaacacacgaggaggagaaggtcgagccggtgcgatcgactacttcctctatatcgacgcgcgctacttcgcgagagttccttcgacttctcagcgtcttcttccgctgcacagcgcgtcgagtggtaacgatctataatctaatacttgcatggttcctcgtttacgcgatagaaaattttgttttatgctatcgtagtctacgcgtatcccaacaaaagattctagacgaaaaaaagcatagattgggtataattattatgttaaagtttcttcctatgtactataatttggaactgggtgagtatatgctgagaggcaaactgtacatgattggtctcctttggagtaaagaaaaagtatagcaaatttggaggatcgaattccttggaaataattatcatatggttctttggatcaaggaatggctctttcaaatttctttgaaaattctatgaaatggatcatttcatagaaatgttggaggatggtttctcttgtttgagtcgtagaattcctacattctttcatacggtgttaccaaacaacatgttttgcagactgcacatatccggttggatatatagaccgagtaaaaaaaataccattcttttaaaaaattaacttgttttgctaattcctgtggatttctatgtagggtttatcaatactcggcatatgattcataccctttttttttctatttctatatttttaaaatcttacgtataatcctacgttctaaagaagtccttagttactaaccatgtatactactctatctgtttcatgttataaaacgttttgactttggttaaaattaaattgttttaactttgatcaagtttataaagaaaagtagtaacatttttaatccaagacaaatttattatgaaaatatatttaattattgatttgatgaaactaatttaatattataaatattatatatttatttataaatttactcaaacttaaaacagtttgactttgacaataaccaaaacgtcttattaggacatgaagcgggggagtaggcaatagctgataattccaatttgatgggtggggtacacagccacatcttaccaaagctcagttctcgcgccagcactatgatctgaaccgcacatctcatgatcggtggtctagccctctgtgcacaccactctcacatgcgaaatagtccccttctattttcccctttttcttatcttattattacaaaatcccttttaagagggcgtcccagccgcaccgcagtccgcacgtccgcagcacgccacggtagcgcgacacccggccttccgcccgaacgccaaaaataacaaacaaaccacgacccgatcgcgaatcgcagggagaggagacagggagagaagagagagagagagagagagagagcggaggagagaggcggctcgccggctcgagctcgactgctccccactcgcggccgggagggagggagggggagagaaaggagagaggtgattcgatggaggcgaagggggagaatgacgcgcgggcgccgctcctggcggagcggcggcgcaactcggtcgggtcgatgcgcggggagttcgtgtcgcggctgcccaagaaggtgctcgacgccgtcgaccccgagaggccgtcccacgtcgacttctcccgctccaagggcctccgcgaaggtaccacgctggacagccctccccgcattacttctttgtaaagcgcgttctgatctttcccccgttttcgatctgtcctttgtccttttaggtttggctgtggcaacgttgcatgaaagttgtgattctttttaggctctcctttttgttagtcatcacttgggtgttggtgagtttgtctttggggtttggctgtagtagcttttcagaattacggtggataatgccgttcttgctggtgatcgcgcggtcgatgttgttgtatggatggaaatcgccttctattcttgattcaccatccacttgcgcgtgcttggtagttgtgtgtcgtcctttggtataccgtttgacggtgacggatcaagttcgtgggtttactatcttttggttcgcatttttacggtcttttcatatggttttagcgattgtaacatattgaatgactcctaatagaatgacacgcagatctccttctggttttaaagaataacaggtggcgatttatcccgactataatgttttcatgcatgctcctaggcaaaggtcattcgttatatgttctttaaaaaatgctaagcagctatcaattgtgtacgaaaaatctttcaggacaatgttatttctttcttgctctgatgctctctctaacggacatgctcttttttttttagccaaagggggaagaagagtacatagttcaagagatacaaccaatataaagaaaaggcggtagcttgggtagggggagggctatctcgcagcccatctagagttcttttttttaaaaaaaaaatctcaattgctagaaaggaaactgttgtcgaagttaaaggaattacacatcaaggagaacatctccgtttgatctttctgtctcctctgcatttcttctttgtccaggagaaccaggacttccactgttccacagtctatttcctccaccagaacagtactttttctccggtcctggtcaacgtaatacaaaacatgggtataccggcctttgtttacctgaaattttagctgtgccttttttaattctgcctgcctgccgttcaattcattttagcactatatacttccctttccaactttggtctttatgtcttttgaaattgtagcttagatactaaaacacgtcaagactaaattacagtttgtcaaaccgaggtgatatgtagattatacaaaaaccagccggcgttggctgttaataccaatatatttgtaaggatgttctgcatctaccagtggaaatttttgacttctctaccaatagcatgtactaaaaatttggttacgagatttcattggttgtacatttaattattgtattgccattttgttccctgtctctttctttaaaataagtgaggtgggtgggatgtattttatttatttttaatccacgatttgatgtaaccctgcctagctgtatcaggattgtgagactgtcaattgtcgctaagtggaaaaacatacacctttacttttcataaacgactacaaactgtgttaaaaatggtgggatgaaaacacttaatgcaaatattacgaaataagtaatactctttgtatcagggaaaaaaattttaaaggtttaagggggggttaactctttagtatttcttatgcagtaagttctcagttgtatgaatcaccacatatctttcttgtgttgcattaagtatagagataagatttgcaaatcctggactataataaactagtttttattgttcctatattcacatcattttttagagtttgttcttattaataattttttcactacaaactcttaatataactgttaagataaggtgtgcccaatgtgttatacggcttattcctaatatttcataaccctggacaaactccccatgatccatatgaagggtaacaccaattaaattctctctttttatatgctcaaaagacactgctttccttcatgtgatatggttaccttttgggctaatataggagagaaagaatactatgagaaacaatttgccaccttgagatcctttgaggaagttgattcaatagaagaatccaatgtaatgagtgaagaagatgatattgcggagcaaaagcagagtgagtttgccatgaagatatcaaactatgcaaacatgattcttttggcgttgaaggttgtactttcccgattcattttaatcccttttttaacattcatctaggctgactttattatacttccacaccatcattagatatatgctacaattaaaagtggatcaattgctatagctgcctcgacattggactcgctgcttgatctcatggctggtggtatcctttggttcacacatctctcgatgaagagcatcaacgtctacaagtatcctattggtaaactgagggtgcagcctgttggaatcatcatctttgctgctgtaatggctacattaggtatgcttgcaactttgccaggacaagaatggacaatcaattcatgtctttacttgctttctttgtatatgcaacagtattgttgtcttcaaactacaaaatttattactcaacttagtatggtctttgtgccaaaattatgcattaacacagcaatgtgctttttatttgcatttccaggattccaagtatttgttcaagctgtggaaaagctgatagtgaacgagactccagataaattgactccagtgcagctcacatggctatattctatcatgatttttgcaacagtagttaagctagccctctggctctactgcagaacatctggtaacaagatagtccgtgcctatgctaaggtttagatctttctccatgttttaatttcaatagatgctttgaaaggcaaatgagtgcagtttcccaaagtttgttgggttggtattcacaggatcattattttgacgtcgtcacgaatgttgtgggtttggctgctgctgtccttggtgatatgttctactggtggattgacccagttggtgcaattgcccttgcagtgtacacaattacaaactggtctggaacggtgtgggaaaatgcaggtttgcagtactccagcatctgttgcattcgtttataattggcctacccccctcccacatccattatctgttgtcgtagtaaaaagtttcataccagaactcttgttaggatcaattgctttgataggcctaatggacatggaaatctgatgaactaaacccatgcaagaagcatgattgtagggaacatgtttttccgaaaaaaaatatataaattgactcaccatataagtgtaattcctgcacaattccttatgtgttctgaaagttacttactagattaactggcagatagtcgtatactgaattaatgatgcttattgctatccttgatgcagtgtcactagtgggtgaatcagctccgccagaaatgctgcagaagttgacatatttggccatcagacatcatcctcaaatcaagcgtgtcgatacagttcgagcatacacctttggggttctttactttgttgaggttggtacctcagtttttctgttgccttgctgtttttttcccttttaggtaaatatatatgctcttcccagctaatttgatcaacggactggcaggttgacattgagctgccagaggaattgccccttaaagaggcacatgctattggagaatcacttcaaataaagatcgaggagctcccagaagtcgagcgggcatttgttcacctgatttcgagtgtgaccacaagccaagcacaacattctcagcaagttgcctagcagccaaccatgaccaccaacttgaattccaccgtgaaacgaattagctggcttgttcgcttgccatgcaggatgtgctacagtacgtgccgcattatgctatatgaaacggctgaagacaaatgagattgtctggccatcatttctgaaagtaggcctaagagaatactgtattagttaagtacctatattagagattatgtggactgaacttgtgcatccctctgtttaagagttttgttgtgaggaaagttcagcacaaaggggaaatcacgttctggatgatctcaagcaatttttttgttctgaaattcaggtcagttgtaaatattgtctggtttgcttaacaatggtgtgtaagtgccctacattgctgggaaggtcaaggtgtatgtgctaaaagaaactcattttaacaaatgtggttttgcctttttcagcccaacatcaggcccagcactctttccaaattgagaaaggaaaacagaactggcccagtaggtgtaaactggatgcaaagcaatgcacccggcaaacatccagcaaacaacaagcagtaaaaatttacaacgtaaagcctcttcgatagaccggatattttcatttattgaatttgaaattcttttgaaatttcttcacagtgcaagtacttctattaggattgtaggatgattcttctgcagttgtaccctttgtcactagtggttgtaccattgcagtccgtagtacggccgtgggactgtctgtaagccacgcattattggctgaaatgctgaattttagtagatggaatcgcgcactggcctatacctggtagtatattattattcagtcgatcagatctgtctggagtaatgccatgttaggtgatattttgtgtgctagtgcgtcgaatccaatctgatctactcacctccccgtgaagacgttgacaccctctgatatactccatgtaccatggattgaagttccggacatgtatgaaagtttcggagaattcggcccgattccctcaacttcaccattaataattacatgaaagatgacatgtttaagtgaagggggctgctatacatgtaggtatctgatgatacatgtgagtaaaagggaaagtaccacttcatgcctcacctacgtcgtaaagttggtaccacttgatatctggacgatgacaaatgacgtgctggcctccgagcactcctccccccgctgccgcaccagccaaatgtggccgtctgccatgccccccccccccgactagcc

SEQ ID NO: 23749 - DNA, 2671 bp, Oryza sativa
gcagtccccgccgccgccatcacgatcactcaacccgtggatctgggcaggggtttccgccgtcaacaacgaacgccttcaccacccatcgctagacggcgccgccaccactctgccctgccgccaaccgtcgtcccgccggatctagccggaacggcgcagattgccaacgccgcagcccggccagctccccgggttgtccgagcgtacgctgggcaaagccctgccgtcgtcgtccttgcggccgcgtggctttgccggcacccgctcaggcagtggcgaggcagagaaggaggagggaaggaggaagtcagtggtggcatcacctctcgtgtcgcccatggggagggcgacgtgagctaaaaagtgttctgctgcttttgtgcagcgtcgaggttcggcgcgtagaggcacgtctagtggcagtggaggccggcacgacacgaggaggtgcgaccgggtggcggtggaggccggcttggtgcgaggaggcacgaccagcggcgggaggctggcttggcgcgatggatgttctacatcgtatgctcgtatcagttgcgacgttttaagatgtggagaagtttggtttggtttaatgtctttgtttatgtaacaatcgtctcttatatatataatataatcaacattgtttcgcaagaaaaaacaaacgtatgaaattctcattaaacacatttttatacatatttaccttttactagcttattcataaaaaaataaatactccctccgttttataatgtaagactttctagcattgtccatattcatatagatattgatgaatctaaacatatatgtgtgtctaaattcattaacatctatatgaatgtggacaatgatagaataacttacattatgaaacggaggaagtatgtacttgaaaaaaaaagtagcaagatacatttgatttcttagacatttttttattgataaatgttttagaaattcattcgtttataaaaaaccaatctagtactggatgtgacacatcctagtactatgaatctggacatacctctatccagattcgttgtactagaatatgtcatatccaatcctaaattcatttttttggcggaggagtagaaatcaataataccgaagaatcacattagttagttctgactctaatgtagaaaaaaatagttaagcatgggacggtcttaatcaggcctggcctaggggggtcgagctgtgccatcgtaatgagccctcgaagtcaaaggacccaaccccatatatatatatatatgctatggaaataggagcctataggccataggaacttaagatctaggaagcccacgagaggaaagatatatagcttgtttgataagaatttttttttatacattacatttgttagaaacatcattatattatcagagttgtattaaaggcctatctttttagcaccgctccaagccattaaattgacaggaccgggcctggtttaataggtttagcacctagcagcacggggctacactcctactagtactatctaagaacatctttactcctttaaaaaaggtaatagtggtgacagtgaatctatcacccactaactctgttgtatactacggctgtgttctttgctctgaattcccaacttctcttccctctgtctcgcgcgcacatttttcgaactactaaacggtacgttttttttgcaaaaaggtttatatatgaaagttgctttaaaaattcatattaatcaatttttccccaaaaaaaagtaaatacttaattaatcataagaaaatgcgttgctccgttttccgtatggaggaagtgagttcccaactcaatataacaaacaacatcttccagtattttaattttacaaaacggtccttctacatattgttaatattttatttcatctctacaatttcagtttatcaattatcatcatggaaagacatctacatgaatcagggacgaaattgttccataaactttacaattaacttgttccaaacaatagcacatgtataattcatttttatttgtagccaagcacaggtatttagctagtttgggaaaaatctgacacccatgtacaaactcatcgtagcttagtcagttagattttttatgatgtaacctgtcattttgaaagttcttaacttaacataagtgctcagagttaatgctaattatatttttatttataggtggcatagacagcgggatgtttatggttactatgttaatctcaagatatatcggaacagtcttcgaatgcacttgtgatgatatcgtcaatctctcttaagatatactaatccagtcttcaagacaattttatcaaaactaagatatattggttcaatcttcgaaagtatatgtggtgactttcgtagacgcaaaactaaccgccacatgttcgtactgttgtggctttacatgaaagctcctttacatcattagcgagtcacaaattcacagttatatagaaacacagtgagtcacaattcacagttttatagtaggaataatgaaatctagagttttccagtaaactgcatggtgtaactttaaggatttacatcaacggccaataatttcaaaggaagttctaagattaacgactactcacaccgtaaaaaaaaggacaaaccctagtttccgtcttcaatatttg

SEQ ID NO: 23750 - DNA, 4810 bp, Oryza sativa
  unsure (1)..(4810): unsure at all n locations
ttggaagattgattgaattgggacaatgtgacggaaaagttgtaagtttatgtgcgtaggaaagttttgatatgatgaaaaaaatagaagtttgaataaatattttgaaactaaacacagcttagtagtccctatttatcatcttcacaaggtcagatcaacacgtgacaaaattatatcctctttgggtttgcagcaacagtggatacggtacccacgtacgtcactggtttcctgttctccgattaagcagcacttgcacgaccggacaggcgtacagtatagcatcaggccatcaatccatccatcaccggctgcgctgcacacacatcgtgtcgcgctgcttatgaaacggtgtcatcatcgtcgtctccatatgtcccccccggtccccggatctcgcacatggggacataacgtcgccctcccacggcgaggcgatgacgacacgatggcattccccaccccaccccatccactgcccccctctccgtcgtgcacagcttccgcgcacgcgcacggtgcgctggtggcatgcgcccacggtgcatccaccggcccatcgctggtccgccaggtgcgatgcatcgcgcgcaccgagcggcgaccgctcccgtggcatgatgggtgatggctcaacgattttcttgcgtctcttggaacagttcttctttttttttttctctcttcttatctgcttttgttttcggtgctcagggctgctgttttccggacccaatgtatctggcatgtggatgtggtcgtgagttagtgtcgaatcgtggaaaagtatactttaattgcttagcttgtacgtacatgccgaggaagggacaaatcgatgatcgtttgtgtgtacagctcgcaagttcatcgcatttttagcaaccatacgtttttgctgtagttctgtgtgcccgattggaatttttcattttcgccgtccaacgcgagtagtagaaaactgccaggtggggcccgagggcagtgagcgccggggctttgcgcaccccatcggcagcacgcgatccagaaagcttcgccttttgcttgccctctggcatcgatctgctgtccttagctttcccttttgagtttttcgtggatcttttctcagtcctttccatccttctgcttttttatgtaattgcctgaaaaagtccagagcagaaagtttttgggctctgcttggctattttggttggtgtcttttcagtaaatctggttattttcagttggtgtcttccccatgaatagacgaaaaaccgttgtttagtttttaatgagttttaggattttgggagtgaattgtttattttgcagaaggcaactaaagggtgatttaatcttaaattcaactctgaatgaccgaatttgaatagagtgttgtttcatcatcaccatctcatcctcaaagcgacatgcttaaaatagaaatgaaaacaatatagtaactcatctcatttatatattagaccaactagacataccaaccatacggtttaattaaaaacatacaagaaaaatagctccgatatatagtcaagatagtactagctactcgcacacaccataccaaataccaaaaagaaatcatcccacaaaaggaaataaataaaactaaaataaaaaaaaagaagaaaacaaagacagccacccgaggaaaacgtcacgcgacagcatttgacaccaaattagcgaaccgccgcctcggttaaactgatttttacagcggaaaatcccgctaaaaatcccgaaacagctagaaacccatgttccagacatcgcagctcgcaccgcggggcctaaccgtggcggttaaaaagcgtacggcgtcgtcgcgttccctcccccatttcatccctccccttctcctccccttctcctcgccttttacccccacacctcgcctcgcctcgcctcgtctcgcctcggcgctccgctcccctcctcccatctcgctcgccgctgagccaaaacccactcggctagccaccggcggcggccgatcggacccggggccaagctgcggcgaagcggcgggtcacctccggctgcgtcgtcgctggcggcggccacttggatgggcggtggatcgggggcgagctcgtcgttgtgttgagggcgtctgcgggaggcttgaggggcgtgatgccgggtgtggcggcggagacggcggtggcgtcggcgtcgggatcggggatctggtcgcggcggcgggacgagatcacgttggatcgcctccagaaggtaggctcgcgtgggcaacgactttggtctggtcggggggctgggtttgatgtgagcggtgggaattcggggtgaatcgatggtggtgttatccgaggatcggactgagacagttgcttgcgtgtgggttggattagcgttttttgtttgtgcgtaattcgcagaagagttgtctgcaaatggcgtcggggaaagctaggttgtttggttgatctgtttttgttttatctaagcttgtgagtccatttgagtggtgaattttcatgcttagattcaatcgggttgcacttggtcatgggcatatatcctaattttgacttctgataggctcgattgtactggctttgagctgattctggcggtacattgctctaagctatggtggcaggtagatttgtacgcctggtttggtatataaacgtggggggcaaaatagtgttaccgattacttcctgtatgaattttggaattgaatcagtcattcctcgttttgcaagagcatggggcacttgatttgaaatgaagtaaaaaagttggggactggttttaggtcgttcatgattatttgagtagcctgtaagtgctgttatgctgatgaaatctgatgtatgaaaatgttcttgttaggaaaataaaattctgtcagaataattttaggaaagcaagccattggctcgtgtagaatgttttttttctttctaactctattaagtttttacgagtttctgaccttatcaacaaactatgcatattgtacacactcttcaatcataaatttcatgccttgcatatttgttcaattgctcatcctgttatttattttcttccattggagcaagctgataaactagtatagttgtaaatataatttgattgaagagtaactgctaaataagacataacgatatttgaacttctttccccattttggcacacagatattttgtttgcagctctgttgaagcatctccaatgatgcaccacctctgatgcttaaaatgtgatgctccaatagtcttgattagagttgtggttgattgatactgtcattaaactactgcagagctatctcattttatcgttgaacagtagattatactggattttattgtttttatgactttaaagtagcacttccctttgtgctggaaagcaaaccaaatagcttatttaagtgtgtcttagtgttatggaggtttttgtgatagccatgttgcaaagggaactgagcatgtcatggttgtggattanacttgtttcagttctggaatggcttgcctcctcaagcgcgacaggagcttctcaaattggataagcaaaccctcattgagcaagcacgcaagaatttgtattgttcaaggtgcaatggattgcttctggaaagtttcatgcaaatagtcatgtatgggaagacactgcagcgtgatgcctcggatattaatcgtctgaacacaactggagaaacaaggattaggcaaggggaacaagaagacccatcagttcatccttggggaggccttgtagcaacaaaagatggcatccttacgcttcttgactgctttgtaaatgcaaaatcattgcgggtgcttcagaatgtaagttttcaacttgggattcatgtctctttttgtgtagttcattggcgattgtacaattaataactaatttgctctgatttttatattgatcccttctgttactttttcttaagcaacctccaagtcatgtttgtggagttaagttaacctagaagtttcaatgctagtacaggataggtttacttgattagcttataccttaatgcattcaacattggtttaatcaggtatttgataatgcacgggcaagagaaagggaaagagagatgctttatcctgatgcatgtggtggcagtggcagaggatggattagccaacgcctagctagttatagcagggggtatggaacaagagaaacatgtgctctgcatactgctcgcctttcatgtgatacactggtggatttctggtcagcattgagtgaagaaactagattatctcttctgcggatgaaggaggaggatttcatggaaagacttatgcgtaggtgagcataatgaagttgacctccatatcatgcaaatttaaattagtgataacaagttgttttgacctgaataggcattcagctcatggacattattagtaacatagctgaactagtgagttcataactgacttgcagatattcagtgaatttaattaacgatcatagctatttgatgccaataccattaaggcccggtaattttctttttcatatattaatagctatttatgatctacctagatatgtagggatttttttttttgccaataaggcatctattggttggtatttatccagcaactgccaattgatcagtgtaggattgattttattttttcttaatacaaatgtcaataggtttgagagcaagagattctgtcgagattgccgaaggaatgttatccgtgaattcaaggaactgaaggaactgaaacgcatgcgaagggaacctcgctgcaccagttggttctgt

SEQ ID NO: 23751 - DNA, 675 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatgcgcagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcaaatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatcta

SEQ ID NO: 23752 - DNA, 7553 bp, Oryza sativa
atttaaaggacatgataagatggcatgacaacaaaactgaaaaggaaaaaaagaagatgagaaagatacttacgggcaagggcaaaatattttccttgtgtcctttctctacaaattctttaatacgctcagggcaatcactgaaatttgtaacgattaggcactaacaataaaacaaaaaatgtgaaaggggcataatgaaagagataccaacctgagcccatcaattggctcccatgtatcataacttggatcataccctttccaccgcacctatataaaatataattcacagggtactttttcaataatatagtaccacactagattaatacaaataaatatgaaattaaaggaatgctagttaactagtaaacattaagtctattaccttaaaccacaagccattttttcctgtgttacttggatcaccatagcatatctcaaggagctcctctacatcgaatatatcttctggaagaggctcatttacatcgtcagcatcatttaagggcatatctatactaggttctagtgtatcgtttttgtggacaacatattttctacaaagtgcatcccactgctgaataagggcaagaaaatcctcagttttctcgttccgcacctacaaagtagaggcaaaagcaaacacatgaatttgtctatgtggtggatgtgcaaggtgatactatctagtggcagtacacaagtggaaacaggaatgtactacctgcgagtatgggtgattatgtttgagacaagcacaagcatatttgtttatgtcaacagcccacctctgcacaataaagcaagtattaacattgtcaatagacaaaagagcttagtaggcagttaggagtcacaccaagtacaaaacgtacagtctctaaatttatgccagaaaatgcaaaacccaaacaaagcccagttgacatagcgccacatcctgagtaaagatcaagcagagaagctgtctctgtttgttcactatatggtgccacaatatcagccgacaattttcccttagaagaattgtcagcatcatcgcaggaaatatttgatgttgcctcactccccaatgcaccatcattatctacaagaaaatagctccctcagaagataagacaataaacattgagattgacaatattgaagcaacaagtgtatttttgcatctgtcaaatattcaaaatagtaatataatataaaatatttttctcatacagtttatcataaaaggtctcttatgtaagttaacaacaaagtgaatgatgcccatacacaccttttataattggcatgggaaaagaatcatgtaaaccattacctgctggaagaattgcaaacgtggaatatgcaacagagtaagacatgtcatagtacaggtcacaatcagatatagcatgagctcttgcttgaagcgtcatctgaatttgtttaaatattagcaacaacaaaaaatcatctgtaacatgacaacataataagcattaaataagatatatgcctaatgaatatatcacttacatttggatcaacatgggcaatctttacttttgagactatgcactcaatcaagttgtcattcttctcctttgaaagaaaaacacgcttatggttatgtctatgatcatgcacctttaacaacttttatgacaatgacctgcaaatacatgtctcttataagtgttacatttccattaaaaagcaacaaaaaggtacttcagagttcagacataccgtatctgctgtacggaaaaaccactgacaagagaaatatgatccacggtcgactccttcaaaaaattcagtaatccgtccaatgtaattttcctcatcaggaccagcctgcaaattagttagtttggttcatatggacctagtagacaagacatatgataagcaaatagataacgcatgaataatttacaacgatacaccatagagcatatgcaagccaaacgaaatgatattcttattaatctccacagtcaaatcaagttatgtacccatttcccacacaaaattgatatgcacagaacaatgatatgagaaaatttacgtgcgtacaaaatgagtgccaacaaattaatcgaaaacttaatatctcgtggttaacaaccagtagaacaaatagtaggataataagtttaataacaattataatgaagagcaaaacaaaaatggcacaaagtcaaaggtacattaatcatcccttgctagtcagtcatataacaatgctatcgtaaaagcgatacatcaaactaggacacaacattggttaataaagttctaagaagtgtgaacaagatattcatgactgaccttgacatagacatcatcatcaagatgatagatttcatcatccacattagcagccaggtagtgacatcgagccttcatttcttcatcttcgtcaggcctgcataaatgaaaattctgatcaccattattaaagcagcataagaagagattaagagtactttcagaacaatgttagcgtaaaaacacacatactcgtgcttaagaagcgaatcagacccctgcaacaaaaacaaaagagcatgtcagttttatttttcaaaatcatctcaaaatcgaagtgataacaaactttagtattccaggagataactctagaatagagttagaggtttactagaaattcttacctttctactgtacctcacgggccatcgttgtcgcgcttcatcatccggtactggatcgcccacaaagtggtcatctgagtcctccacccttctcgcagtgcttggccgcgccaccctcttcctcgtcgcagccttctcggctgatccttctccgacacacttacccatcctctcctctgcttccagcacgtcggctgcctcctcctcctcctccatggccatctgttcggcgtccggctcatccgcgcacacgtcttcggccagcgcgccacccgcatcgttcaccttcatcttctcgggcgcctgagccgccgacttctcggtcgtctccttcgtcttctccttggccgtcttcttacgggtacgacgcttgaccttctccaccccgcgctgccgcttgccgcgtgactctgcgggcgacaacccactgtcgagctcggtcccctcgggctcctgcgccgccgccttctccacgtcctccggcttccattcggtcgctccctcatgggcactaggcttctccttcgccgtcctgcgctggcgcttgcgcaactcggggcgcggcatctcgcggtcgatctcgtcgagctcggccaccccctccgccgccgccgccttctccacgtcctccggcttccattcggtcgctcccttacgggcaccaggcttctccttcgccgtcctgcgctggcgcttgcgcgactcggcgcgcgacatctcgcggtcgatctcgtcgaggtcggccaccgcctccgcctcggcctccatcgcggcggccgtcattaggcgcctgcgcgtggagcgcctcggctccgtcgccgccgcgggagccggctccgggaccatggagccgcaccggcgcagccgcagcccgcaaccgaggccgcggagatcggagacggagacggagacgacagcgagagggggggagagagaaggattagctagggttttacggctcagcgagctctcgatcgcagagtgtggttcgccttggataggagcggaagcaggaggcgctttgatggcttgcggcgtcgcgacgggaggaggtctcgagcaggccggattcgcgggaatgcgtgacgtcgtggtctcgtgccgacgcggaagattggaatggaaatcggagagagcaggggcggtgggcggtgggcccgtgctcgccgcagctcatgcaaaagagggggtcgtggcttccgagtgggccccacttgcagtgacggacactttccttcctcaaatcctcagttctgttggtcttctttttctctccggtggggatagcctagagactagtcaatggcttgtccttcccgcgatgtcagcagcatctgtgatctctcagtgggacccacgtgtcattgggcgaagactgatcagcgccgggagggccaagagcgggacgattcaaactttgggctttgagattcgtgtagacccattgtctggcagcggcgatcgtccgatcggctggtcgtgtgggtccgccaggagcagggtgatcacctcgttttctggtcacagtttccttttgtgtgaaaaactgaaaatttccgaaactttctggttaccgtttgaattccatcgtactcgtacgattcccttggcatacgttttgtatgggaaaaaaaggaagcattttcatgcatatctctatgctcaatctgtgattgattatacttactgtttgaattttgaatcaccgtgcagaaaaaaaattttgctcggcatgaactattcatcttcgccatggatggtgattggtcatggactcgcggttcgggggctcgcggcaagagtaccaaacatagttaccgctatttcagaagcccgtaactatttcagaagcccgtaacaaacaggccgtgagatacagtacactatttcagaagcccgtaactctctaaccagcaactagctaattgggccgaattataatggctatggtttcctggcccggcccatagttaccgctactactcactctgccgagactgcattgtctacctttccaccttcccatcctcctcccgttccggccaacaccaccctctcctcccatggcctccgcctccgcctccctctcgctggcgttctcccctctcctcctccctaccccgcgaccccgaccctactcgcgacccatcaacccggggtttcctacccccctacggctcagccttgcgtgctcgccgccctcccgtcgcgccggcccggttgccgcggtcccggacggcgtcgccgtcgcggacgtagtggagaaggactggtccttcctcgatgctgcggcggcggcggcggccgcgggcggcagcctcccccgcgcgctcgcggcgggggccctctcccccgcgtcgcgggtgctggccgtgacccccgcgccgtccttcgtggacgccctcctctcggggcacccctgcgagctcctggtggccgcgcacgagtccctgtacgtgctggcggggatcaaggaggggcacgacgaggtgaggtgcttccacttggagggaggcggaggcgcaggggaggcggagtggtggagggcgtgccggagaggttcgacgcgttcgacgccgtgttcgtctgctacttccccgggatgggtgtctcggccgccgcgctgctcaagtcgctggccaagagatgctccaaaggtgagaagctatcttatctctgttttgctctgttagcttcgcaatcatttgagggttaaaactctgcattcctcgcttaattggagggcctagttgtgggtttgtacataatcagcggaattgctgtgttcactgctcttgaggtggtttgtgatggttaagaaactaggagtacattttgttgtgacaaaatttggtttgtatgactaacagtgacttgagatatcaatgttagtactaggtaacctgttgccttgccatattcatgaaataaattggatacattagtttacaattacatgtggttttgatacagtgtcctacatggtttgaatcgttaatccttgtgtgtgctgatttagtttgcttgaaacaattttgatgcgatttatggaacagacaaacagccgtaggcatgcatatacttgttttgttctgattattttcagttcctgtggttaggtagttttaaatcctaattctacattgtagatggtgtttgtttcatggagtgcattagctcaattcaggcactacttgtatagttgtatgtgcctaaccttgccctctaaagttttaatggggtgatttgcggccttgttgctttatatatgctttatagttcatcttttgcatctgagaattgaatcaagctatcaaaatgtccttgttcttagttcaatagtattcagctgtccttttctcttatatacatttgctccactcctcagctccgacaacccagcttctcacaaagctcttagattagctatcttaacccgttgcttcttattattaacaagacatcatcaaggatcagtcatcaacctttgctacatcccctagtttagccaaatttcatgaacatcgacttgtcagggtgcttcatgtgttgaggtcattctgatatgttgtgattataccacctggatatttcttgtatgcattttgtcttgaattgaaacgctgtatgccgtttgccataggtggaagagttgtcatctttttggatcaaggacggcaaagtttggagcaacatcgcagggaacatcctgaagttgtaactgccgatttgcctaccaggccttctctagagaaggctactgccggtagcaagtttgaaatattagagtttgttgacgagcctactttgtatcttgctgttttgcagtttcaatgatgaacttgttgaaaacaacaaattatatagacagcttgccatccatgccggcgagaatcaactcggctttgtagtttgtagatatgcaagaaattattgcaaagttaatgatccttatggcagccaagttactttgtagtatccctgttgacatatgggaattaccagaagcactggcagttaagggcatttacgattagatgaagccctgcgctttactgtgggatatatggatgaatttatgttaaatgtcgtaggactaatcgatagatttgaccggtttgggttaaatattgtgaaaataatgtgagatgataatttagtatgcttctatattgaggtttagaatataatgaattgtagaagtaattgctatgcatgcatggtgagttttaggtgtttagtgagttgatgtggcatgtttgcatgttattcttttgaatatactaacaactactactatgcttacatatgttgagttttagatgtttagtgggttgtaactttataaaagatataggccttgtttagttggggaaaatttttgggttcggttgtcacatcggatatatggacacatatttgaaatattaaacgtggtctaataacaaaacaaaatacaaattccgtcaggaaaccgcgagacgaatttattaagcctaattaatctgtcattagcaaatgtttactggagcaccacattatcaaatcatggcgtaattagacttaaaattcgtctcgcaatttaatatttcatgcatgtattcaaacattcaatgtgatggatgaaaagtttttgttttggtaactaaacaaggccatagatactgtgacgtagggactagcgagtggcctctccttcacgttggaaccggaaccagggctaggtgaccgttctatttccagtgccctgcaaggcagttcgcacttcacatgaactagaactttaccgcatttctgaaatctatgcctttactaagttttcatacacacgaggaacgtacaaggaggaggctaaaataaagaagacagaggcagccaata

SEQ ID NO: 23753 - DNA, 2292 bp, Oryza sativa
  unsure (1)..(2292): unsure at all n locations
aatcggctccggaggagcataactaaaagcaggagttgggaagtgatgaacattgctgtactgcactggaaaatcaggagactgctttccaggtactccaaatccaagtggattggaatagaagtggctaggctgggcatactgcatgtatccacttgctggagcagcccagggatggttgtggagccccattgtggctgaagaatgtgtaggtacatgcatgctttggtgatgcaacagctgatcttggaaagggggtatgttgaatcccaatctgtcgttgtgaggccggtgcatggcttttggttggtattctctgaaaccttttcctgcacaagcctcaagaaggaccgtgaaacggtctttgttgatggagcttcctcgatgctgttgactctctctggagattcctcagagtcagatgatgatgattcttgatgttgagcgctcaaagaagtcacactgcttgtgctgctttctctatctgcttcactcgtacatgaagacaagccatcaggctggtagagttcatcatcagctcttcatcatgcccagaaccttcatcttttgttgagtagcagtcttgtttatccaccataatagtaccaccgcaagaagtagcttgatttttctcattgttttcacatggtcgatctgtttctgatttacagatatccctggatctttcagaagattgacttagtggctcatgccntgcgtcaaaatttgggcattcactgctatcttgttccactaatttggttggatcaacattacaaactgctcccgacccattgtttttgttgtctaacaaattcttcttttgagaatccattggttccatacttgctttggagcaccatttttctgctgagtattaccagtcggctttcttttgacacaataaagttgtccaaaggatagcacctgcggtactgcaccctagctctctcaactcctgtttttcttgccatctttgtctccctacctgatccagttgatgatgaagaacagctgtcatttattacatagtcatcacgagggtcacagctgaaggaaatgtagttgtgtctatcccttgttctgttatttgtagtaaacactgagttacaacttcgggcactatgtcttgtcctttcctttgattgccactgaaaatcaccaatgcttccattttcatctccgcactcatcatagcaacaagaggactgatcttgagggaaatcttttctcagcctcagattccatcttgatgattttgattgtccagatgtgaaaaggtcactgctatttgttcgagcaaattctgtcaatgtattgcagtagtccatattgttttgcacactaatctccctgcaagctgtttgatcaacaaaggtgtcaggggagcaaagatccaccactgtggaattatcttcttcttcactagctgaatctctagagtcaggagtatttgttgattcatcattagtagatgttgagttctgagagttgaacatgaattatcattgatgatttcaacccaaggatttctttccctttatccctctctttttctttcagcctctcttttctcctgtgtttcttctctctctcttttgttctcctcctcatcctgcgctcttgttcatcttgcttttctttctcttcttcttcaagaagcttgttctgcaagaagtgtgtcaacgaagttgatgtgccccaaaatcatggatgatatgaaatattttatgacttctatgcaatcaccacaagtacctgcttttccaacgtaataatttctttgcatgctacatggactcgctcttccaaaagttctaatgcaagagacacaaaaatactgtgtgcattttgccgagctgtaccttctctgaatgccttctcgacctgcaattaacccatatttagcatatgcttaagcttgtaacataagcatctgaaattttagcaaaaccctcaataaataaatcttgatttgatcttagtaactacagtaaccactactagtaatattacaggataaaagaatatggatccccttatgtacatatctctgtggagaatcgttctttaatttttttattgcattaaatatcttgaataataaaaaaagaaaattgactttgatatgtggaggtccagaactagattggcatgtacttaatggctacaacagtggctagaaaacacaacctcagaagtgactaaagtgactgacaatgctatgatgggggcaagacgggtagaaacaagaacaacaaaaaacaacttttattcatgaaccttaggtaa

SEQ ID NO: 23754 - DNA, 532 bp, Oryza sativa
  unsure (1)..(532): unsure at all n locations
tccagctgttgatgcttatcagaagattctctcgtccattcctgagttctccgggtttggaaggctcttcaaggtctgtagcttctataccattaatgattttgattgagtacacatgctaaacccctctctttttccccagtcctcagaacctgtggagctgacagaggcggagactgaatatgcgattaatgtggttaagcacatatacagtagccatgttgtgttgcagtacaactgtacaaacactatacccgaacaactgctagaaaatgtaagcagcaaacaattaagtacaattaaatatgttcttggaggcacagctgtcaactcacactgaagattttttttcatatatgtatgttgattcttgtaggtgactgtttatgttgatgccactgatgctgaggaattttcagaagtttgttcaaagccacttagaagtttgccttatgattcacctgngcaaatttttgttgcttttgaaaagccagaacatgttcctgctactgggaaattttcaaatgtgctg

SEQ ID NO: 23755 - DNA, 5621 bp, Oryza sativa
tcacttctccaattttggcaacagctaaacggcatgaagggtaccaaacattgtggcagatttgctatgatctcagtgatacaggccttcttcgcagtcttatggtataatcacaataccatatccgcaattatcccatttaatctttctagggggtacagtgttgactatgttctgcaggcgataacatgccatgtgttattgcaatcaaattgttctttctaccaagttttattaagggacatggttctaatgttgaacttgtgttgcagcatgatagtgtaggacctcacgggggattcagtttctttgttttcaaacaactagtcaacaggcgtcaacatgctaagctattaagattaggtgaagaattcccggaagagctagccaattttctgaaagagcgggatgatcttctgtggcttcatgagatatgcttaaatcggttctcttctgcttcgaagactcttcatactctcgtgagtcctgaggaagatgctaaccttacaagcaacaggaaatcactgtcctttgttgaaagaagacgctttctctatctctccaaaattgcagcagcagcaggttagctgtttcttctcttttacttcatggtatacctgaacctgattaccttacgctgtgcactgccctgaaacaacaatttgttgaggttgcactgtgttaactgttgtggttgataaggaagttgtcattctccatatatcatgctggctctgtgcaaaattggctccaaacaattttttgaaagaaaattctgactatttgatgatggataacttgtatcgaatgctgcgtagcttgattttaaatcagttcatatgagctgtgaacataagctatagttcactttgcagttctttttctgtgcaaaaggacaggcaaacaatgctacttgccatgcttctcgccaagaggctcagtctttttcatggttcaaagaattaattatcctttgaattgctgttggcagtgcatatgtctcaaagtcatgaacattcaatttgatgggggcacctacacctaggtcctgaaatcccgaattccggaacatagttcctgcaccattcttttgcactaattcttgtttactttaacatagttattgtttttttcttatttcttcccttggataaatgcattcctgatatattgcaattttaacaagcaggtaaggatgttgattatgaagtgaaggttgcccatatagatgcagatatccgaattctaaatctgcaggtttgtcatatttcatgttgtacatttatttttctagtcatgatatttgctttcaaacttttagtgtgatgttatgttctttcatatttgccttcacatgtgcatcactttggtagggcaagtgaacccaaatctacgtatcgatgatgaaatctacatttgtgttctctcatgacttcatatgttccataagaccctgttcttttgtacattcatccatcattccattccttgaaaaagacattatcaaaaccagcacactagataggtgtttaactgtccaatgtaacagcctgaccatatttacaacttttacataattgtataattctgtcttatttagctttacgaaagtgttcaagcagtaaaaagaaggaaaataacccatgcaagatttgcatttaaagatgcattgtcttttagtatcaaataagtaggaatgaacagctaaataaactaagttctacctttttctctttcttctctttacaggaagagattgttcagcatgacccagagtatgcaccagataaatatactaccaagccatttcgtccattggaactgatcgagatgtgcctgaagggagatcgagagctctctcttaaagcttttgaagtatttgcttggacgagggcctcgttccggagctccaacaaaggccttctagaggcttgctggatgaatgcagccgaccaggacgactgggttagccttcaagaggaatcttcaggaggttggagcgatgaagtcatccaagaatctcttcagggcactgtcctgttcaatgcctccaggctgtgttatagcccagacgccgtggtgtatgacggttcgtttgaggacgtgctgcctgtgaagaaagaagacgtgcatctgagaggcttggagggcagatgtctctcagtggaggaagtgctgatgcagcacaaggatttccctgatgcgggtaaattgatgatgaccgcggtgataatgggcaaggagctaccttatactgtttccacagctgaacctgttgacatggactcttgatactgtcacattctgtcagggagaaagacctgcaggttgggacctccaaatctgaaatcagagtcaattttcttttctttgcagcacggaatgtgtgcagttccagatgtattcatattgcgggcgaaactatttgtagagactgcaagattttgtcagttcgtgcccttttttagcatgagctgtggcttgaaacgagtttttctcccccgatggaacaaagcaagctgatgctgtatcttaaaattttcttattagtaggaaatgcaaaatgcattcttttcttagtaatcaaggtttttcgtttttggtggaggaaatcaaacttttgatagtgaagagtttaggggacgagaggcccccatcgtctgctccatatagaatcagccgttaccaaaatttaaatttttaaatttgattatttgaaactttaaacttgattttgaagtttttttaatcaaagtttactcagaattggcatttaaatcctaagagcacacatataaaagttttatttataaattattacttttttaatacattgtacggcgtattatcagcgtatggctaaaaacggggaccagagattcgtagtttagtggaggagagtttaggacgagcgaaattgtcggcttgatgatgaaatagtgcacatgcgcatccttgtttgggcttccgtggccttcaattcaagtgcgggccatgtatttttgtgggctttcaagttgggccagccttgcagccaacacagctacacggcacggccagccggcacgcgacccgcgacccactcccctctcaccgagatctcagacgagcaaccactcctggcggagggaggaggaaagggggaggagatcgccgactcgacggcgttgagcgcggtgggcgcggcggcgcggagggcatcaggatggcggcggcgctcgctccgggggtgtcccggaagctgaagaaggtgctggagacgcggacggacaacccggatctgctcgcctcgctgggcgcgctctccaccttctacgtgcagaacaccccgcaggcgcgccgcaacctcaagtcctccgtcgagcagcgcggcctcaccatcaaccgccatttcctcgacgcctccctccctgcccacaaggtttgcgctcgctacgctactggcgcgttgctacccaccgcatcgtgagccagtcgtttttggtttgtgagtgattgtaaatttgtaatttctagtcgttttggtttgtgagtgattgcaatttctgtttcaggcgttggatcgcgtcgagggggaggtgcacgcgctcaacgattcctggaagaagtgagtgtaccatccattccgcgctttcattttgttcctttttcctgtttgcctgtgtggaattgtactataatctcagtccaagactttagattcggctaagctttccccgtaaaaagaagtcaaagcttaattgtatgtagatgtaggaacggttggtgtttggatgtaaaatctggtattagcatcttgttatggatcctaaacaatatttgactcgcatgggtgctgaaatgtatttgcagaaggtttttactttctaccatgagccaagctgttaggttggtttagtttggatgatactattataaccagctgctctactacgtggaatttacattttttgttaacatagtttgacacttgctgcctacttgcctagtactcaaaacaattcaagtgtctagccactaggacatcttcaaaaaagaaactgcaaaatctcttacataattggttatattgttacccaaagttggtcctaaagtagttgtgttttcctcttattatgcgcaatgctcgacatggttactttttctactagtgctgattttattctctttcattgtgttaggattgaggaagcattgggcagttgtagtgcaagtacgggggatatcatcagtacaacggagaggctgcaacaagaacttgaggttatcactcagcgccaggaaattgtgtcatgcttcctgagggattaccaactttcaaatgaagaggtaataccccctaatacaatagaatcaatcaaacaaatgaatcaatgatttggttgccaaactgtgatgtcttattcattttttagtgcatgcaacctcgacttttatgtccatcatatttatctattgttcttctattaatagatacatgcactccgggacgaagaaatagatgagaaattcttcaaggcattgttgcatgtccaagaaatacattcaaactgcaaggttctgctgcgaacacaccaccaggtacaggtgctttatccttgaattttgtaaacttaggtaacagatcataaaaactttgttgtttatcttactatgtacattcctgtaacttaggtaacagatcataacattttagtgcatgttatatcctcagaccttcaacccaagcaggaaagttggattttcagctgccagtaaaaacattcatgagtataccaagattatggaatgtttcccctaaaaaaaagattatggaatgttccacaactattttagttgataggatatttcagttacatttttttttttagcttggaatgttccacaattatggatttatattaacccagtttattgataagaattgagcatgctcaaactatgtgagatcaccctaaactataccaagaaagtagtgtttttttttggctacgattataccaaaaaaataaagccaccatccttatatttcatctctgcccagataaagatgctttggcatgcaacgtgttgcttgtactattaatggctgattttaagcaagagaaagtagtgtttacttcgatatcttgttttctctatatttgttcagcgtgctggtttggaacttatggatatgatgtctgtttaccaagaaggagcttacgaaaggttatgcaggtattggctgtccttctatagtaatcttctctccctctccctccctcccctcgcctctctctctctctctctctctctctctctctctctctcgtgtcatttcttttacttaccttgtatctcagtgttcattccacaatactccctccattcctaaatgatcgtcgcattaccaaaaataaaagaaattcaatttgatcgtcctatttcgttaggaagcagcagaaatcacgggcagacgataacggtgcttcgtattacacagcactgcatgcatgcattggctctgcgagagttaagttgggagctgctgcatgcgtggaattaatgcgttacagctgattggctggttcatgcggcatgcaaaattgatggagcgacatgcatggatacgaagcgtt

SEQ ID NO: 23756 - DNA, 626 bp, Oryza sativa
aaaaaaggtctatgtttggatgtaaaaaaaggttaggaagcggtaacacgcaaggataatactcaccttagttggatttttcgctacctgtctcttggcggccagtccacatatatcacaccatatactttagttttcaatgccacattttatatatttaaatatacttaaaaaatgcccgtgcgttgcatcgggtgaagtcttgttaagatggaattcattgtgggggttcgcttggatatatatatatatatatatatatatatatatatatatatatatatatatatatatatatatatatacatatacacatacatatacatatacatacatatatacatatatatatatacatatacacatacatatacatatacacatacacatatagatatatatatatatatatacatatatacatatacatatacatatacacatatacatatacatatatacatatacacatatacatatacatatatacatatacatatatacgtatatgtatatgtgtatatctatgtatatgtgtatatgtatatgtgtatatctatgtatatgtgtatatgtatatgtgtatatgtatatgtgtgtatatatatatatatatatatatatat

SEQ ID NO: 23757 - DNA, 5683 bp, Oryza sativa
ataactccagcatatcatgcatggggctgcagccctcgagcctcatcacagaaatgcaattgagtcaacctaaatgctcaggaaattcaagacgcctttcctgcaaagctccgggggagtgccgacagttcagggaaaattaacctctcttctcctgaccccccgagctacgatgatactgctttactctgcgattctaaccttcttgttcttcttcttggatttctcccctggcgtctgaggaacctccaaggtcgtgccactgtcgccaccacgaacctgggatccttcagccgacttgcccgatacattcgagtgccccaaactgctctcatcctttctcttctgattgtgtttgtgcgcgggctcggcactctgttggcccagcgatagcgctgagccttggctgctgcggttcttcgacccgctagagaaccgagacctcgtcttctttgaagaacctggaagaccggacaaattcagatcagtgacggcaactactgtttaccaaagtgttctatttatgatagaaaaagataaaacacttcagctgttggctggaaaccttattaattgaaagtgcataccttaatcaaaagaaatagaaactacagagatgggcttagtatctctctctcagaacagttcttcgatcttataatacaagggcatgcattgcatcactgacatgagtcttcataatataaatcaggaatttggctaatctcaactttcaacgatgcccaaaaaatcttaagacaaatagtatgttcatcacctcattactgtcaatgcgaaaagattgaacagcaatatgcacttacaaagtttaatctggtgatactggatttctagttaaaacagaaggcctatacatgtctaagttattgactagtccaactggaatggcatatcatgcttgtcaagtctatataatacatttaccatagacagcagaagagtggcatccttacaaaatgatgcccgagaaaattaactcacctgcagacttcttactgctaggagtgagactccccaaacctggcttctccggttcttcagggtcaggataacgaactaagctaactcgacgtgcaatcttcccaactggaatttttttgttatgattaaaaattatgcatacagtaagttaaaagaacaagagtgaagtgcatgagcggtccctaaatttgtgcgggtgtgccatctagatccctactctcaaaatgcattttcgggtcctcgaacttatcttgggtgtcatataggtccaaacgagctccaaaccgctccatgcgttgatgtggcatgccacgatagcatctacgtgttagtcggacccacgtgtcattcacataggaaaaaaataagattaaaaaacatattttctcctctacattagaatttttatctttttttgtctaccttaagaggagaaaatatggcttttaattttattttttatatatgcttcacatgtggattccactgagacgtaggcaccactgtggcaatgtcacgtcagcgcatggagcgggttagaacccgtttgaacctatgtgacacccatgacaagtttagggacctataaagtgtatttttgaagtttatggacctagatgacacccagacataaatttagggaccgcccatatactttactcaaagaacaatattagctgcctctcaggaaaggaagaaatgatagatgaccaaaatcacaaaaatcaaatatgtcaacaaacagctcaatttaacaagaccgataacaagtaaaaacagcatccatgcaaaatagtaaaatactgcagaaataaactgcaaagttggtatttcagcataccagcttttgcttctggtccggatggaaggaaaacagttgcatctggttgctgagcagcaaagctaacaagatcataagatttccctgccaaattaagaacaagtacaactcaaacttttgggagaactttaaattgttattgccacaataatttaaaagcgacaaactgacaatcttaaccaataaaaagaagttagaaaacctagtagcctactgctagtactcttactgatgaatgttatcaatctagcttcaaatcacagataacgaggaagctgcgagcagatttcacttcaccaatcaaacttctgaacataaaaacttctatatgtaaactaaattatagcaccttaattccatttttattgaaaaaaatatttaataagtattaatttgttcatttgttgcctaaagattagcaagcaacttgagctctacaaaacactactagtcatcaacgaaccagcattgacgtcatcttcatacaaaaatgagacgcaagcttgaccatagaaatgcaagcagttccgttgataggattaacattgtttgggattagtaatgagaagtctaggtgccctctttgggaaaaactaatcaataaggtaaaagtgtgattgcatgagctaatacaggttgcgttcaatccaactgtacagaaagcagaaaaaccttcgaaagacataatcgatcaggtgcaacataattcatttaatattatcttacctgaggaactatccaaactgctcaattttccatcacggtgcaacttaagagtaacctcttgaccatgaaaatcagacgcatctaactgcatgcaacacagaaaaacattatattcaagatcccttgtgcagcatgccacatggcacataatgaaaataatatccgtataacctgatttagaggccactgtattagccaaagttctgttgactctgtttgtgatatatcaagcatagcctcttcgctgttctcctcaaatgccggtccaggctcatagctacaatggttggttgcagcaaagttaaaataaattacacacaatacaaaaacttaccaataagtgtataagtgaaacaaaagaagctactgaattcaatccaaaaatccacaactataattttccaaccttccttatctcatatttgaggcataactgttaatctgttattcagagaggaatcagagctaccaaatccacaaatttgatactccctccgtcccaaaatataagcatttttagtatagtgataagtcaaaaaaaataactttgactattaatagcaaaataacaaaaaaattaatcatgtaaaattgatgttactagatttatcattaaacaaactattaaaatatgtaactttttttatttaaaacattttacttttatatagatattgttgatcaaagtagcatctcggagactgtgttagagtcccatgtttgcattatatggtttgaagtttggactttagagatgaatatgttgtttaaccggagacgggttcaccacggggaaaaattcaccgcgtggtgatcggggctggtgaaaatgtagccccgtcgtggttgacgggggcggggacggtgaaattttatcaccgcggtgacggggacgcggaggtgacccccgacggtgaattcaccgttgccgtctctagcacgaaaagggagcaggcagggccagcgaggggcacgaggaggccggcaagctcgcccgcaccgcctgatgcttaggcctgccagtggattgactttgtttggattaagtgggctggatcctcatttggatccttttcggttggattgaaatggcctgggattccattttggatcggactggactgggcttacaaaaaatgtggtttggtttggggtggatgcgggctgagtaaaataactgatccacaaactgaatccatggactgaatccacacgctagggtagactcctcgcatcctccgctcctcctccgccgccgctgccgccgccgccatcgccgccgacgggcgtcgctgctgctgctccttgccactccgccctcgctgcaagcagctgcggccccaccagctccccctcgtcctccgctccggcgtcatctcccggcactgctccgccagattgccatctcctcttcatcggcgccaagaagctgctgctgctctccactttgaactcgctgcaagcggctgcagctccaccggctccccctcgtcctccgctccggcgtcatctcctggcaacgctccgccagatcgccatctccgcaccgtcggcgccaagaagctgctcctctcctccatgcaagatccgctgccgcgtgtccctgcccttaaccccccacaagatccggcaatactctctcccttcaagatccggcaagtactctttcctccatgtattgtggattgtgtgctgaatgccatgcttagaagatttgttctaaattgcatttacaagcagctacctttcattaccatgcatgcataagaatattgatttcatgtatcgagttgccatggccacaactatgaatgacctgtatgttttccaagatcagttgtgctaatttaaccatgggtacctaacaacagtctaaaattatgatctcttttcagcaaactattatatgcacaatagttggatatttatcacggtctcaactactgttgtggaacatcattagattactatgtagcatgtactgaacaaaaatctgatttattttgattttagaatactgactggagtccaaaagaaaatggtagcttgctgctgctgattgtactgcaccaacctcgcctgcttaagcggagaacatgtctatacacaattcagaaagttcaactggccatagttctagtcatgaatcatcttcacacccgcccgcagaagatgacgcgtttggagtagtcaaagcagaaggagctccagaacctgcaagatggcttttcggagcaggagctccttcaactgcaagacgacttttcggcttggctgtggtccttttcgaaggaggagacctgcgaagggcatttgcattggacttgcgagatttgtcagcacccgacccgacgaccgctggggctgcacgcaatgcaacgaccgcaggggcagcacccagcacgacggaggatccggcagtaggcccaacgttgtatcacgtggtggcaagtccaaatccatggcggcgtcccttcgcgtggaccgccggacgtgggttagtgagtcaacgacgtagctatggaagactaataactcgacggagaagaactagaggtaggcgtctatcgagtacagagaagggataagggattgaagcattttctcaccttgcatcgtagcttacgcggggggaggccgaagccatggtcggccgatggcggatggcgtgctcccggcggcgcggcgacagaggctcccggcggatggcgtcctcccggcgacggcggctcccggcggcgcggccgcgacagctcccggccgcgcgacggcggctgctggcgccgcgcccgcgtcgacggcagcaggaggaggcggcggcgcaccgcgcacgcgagaggaggcggcggcgcgcgcgcggcgcgtctggaacaggcgaacggctggcggtggcggcgtgcggcgtgcctgcagcggagagccggaggaagaggagaggaaccagtggcgtgggcgcgtggctgcgcagctgaggtttgactagggttttgctatatatacccctgttaatagggcttcaatactatgggccaaaacatcttaaaaagtctagaatcagccctctatactgtaaagccggatcaccaggaggcggggacggggatggccgtcatc

SEQ ID NO: 23758 - DNA, 19831 bp, Oryza sativa
  unsure (1)..(19831): unsure at all n locations
atccaacgatccaaattaatctgatgagtcgtatcggacggcgtcgacgcctccctcccaatcgcgcccctcccacaccccctccccatgcacctcctcctcccagtcccagatcgtgctcctcccacggccctcccagaaaccgcacctccctcccacgcctccctccgccgtctccgccgctgacgccggaaaccgccccaatctcctcccccttttcattcacacaccctcctcacgcccacatccatcccgtcacccgcccactcgccgtcgcacgagcctccccgtcgtcgatcccctcccttctcaccctcatcctcaggtattgttgccgattgtcctgtctccgctcgtcgccggcccctcgtagcgcaaatcgtcatcctgcatcgtcgattccccacgcctcgatctcccgttggtcttcccgccgctcgccattgaccatcgcccatggctcctccaagagtcaccgccgaatccaccccacgcacccgcgccacctcccacccgcaccctcgcccccgcccactccctcgctctccaaaccctaaccctaacctcccctcctctctccacgactccccgccgcacgccgacagttcgtcgccgcgcgccgcacccgcactccctccccgctcaccggtttcctcatcaccgccttcgtgccgccaccactccgatccccatctcgcgagcagagcaggggagggatctcctccgcggccgctgccgaccgcaccgtcgcctgaattgccgcctccgctccgatccccatcgcgcgagcagagcagggggaggggaggggcgccgtcgtcctgctgcattccggtgagcatacacatcctctctcgttcatctctctgtctctcacccatttttgtctggaattttcttgcgttagcactatcttctcttcaagatctggatgattctcttcgaccgcgattgctccggcgacctcctccacagtccgtcaaagggtttgtcctcattccgtcaccctcgatgacccaggccgcagtagcgacgctggtttcttagccaacaccagggtctacctcgccaattcaggtttgctctgttgcagtccattgaataaatacaatacaaaatactaaatgcagtaaatttgatgttatacaatcgtttccatctatctaaagtgtaaatactgggttgtttcaataacgatacatggattattttctaagaaattgtcagttgaagccacattattttactagatggttaacattgttggcaaaatcaagtttgtttggtttgtaatcactcccgtgacacattgtgatgacgatagagttacagaccatttccactttagtttagtcctttatttctttttcccttttgttgtattggtgggagtccacagaagcagaggtaattcaactatgtgccgctgcagaaatagctattttgtgcataggtgaaaaaaatatgatcatgatattgtggatggtgatagtccagaagaacatgaaggagatgtagtgcaattcaactttgtgtgctgccacgcaaatggctattttctgagaaaggataccatccagtactattttgtacagattcaactgatgaaactggatggcatgtagtatcagtttaagtactatcagtcaattcggttctttcatcttacgatggtttgcctgttctctgcagttcagcttggtagatcagtttagcgttgagaagcaagctgtgaaaacatccacttaatgcagaagaggtcataagctccactcctgaaaattccacattttttagatatcctcacattattcaccctatatatgttttcagttgttcctgtatatttggtacactattctcgtttaagttgtttaaagatgattcaaggtctcaaagacgttattatcatcgaaatgaaggctggaggtactttttatagctgaactacaacatactgaaactctgcatgctaatcaattggctcaatgtttttcagctctgaaaataccacggttgtacattaacgttttccatctcatcacaactttgagtgcaggtaagaggagagctctgatacctcctcaagtagtctacactgatgagagcgtgcggcccataccagaggaggtatatcctaacaaacttttccttgttttttccctattcatcttaggtgtttcttttacctgtatgtcagttcaaatagaatctggagcgatgctaacttatggtgccagcttcgaaatttgattgctcatggagacaggggacagattattattttctctaaacatttctgaaaatataattctgaaactatggtgaaatgaaacactctcatttctgaaaaattcagctgctgtatgggttgctactagcctacggaatacatggttcagttttaacctggcaatgttttcttcgggttctggtcattatggtgtcataagaaatagtcaggccactccattcaaaaaatgggaaagacaataaagctttttcattcaacaagggacaataaaggactatttttgcatgtgctcttttgcttggagtattgtgtgattatatagctgattgagctatgtttagaaaactgaacttcccagaactagaattgaatagtctatggcatgacctaatcattaatcagttctctatttgtgagactgatagttgcaattttatagaggatggtctatcataacaaactaaattacttctatgatttttttcttaaatcaaagttgatacatttgtgactgttcattgtttcaggctgaagggggactcattatttaaaaaatgaaatgaaaactgctatccatgttgactccatcgattcattgatcagatcagggggtttgaatgaataaggatatctatgctgttcatgaagtgcataatggatggtgtgatcctctttaatcatactgcttccttcagagttcagatacaaggtagaatcttttacgctactttcagcttaattgattgattcattttcgtatttgacttgcagggcctaaccatggtaactaatgatgcacagctgctttgctccagggtgaaccctcactctgctggttggatttcagccgtggattagcaactggttcatgttctgaaatttttatactaaccatcctcactctgtagtatttgaaatcaacctttcagtttgttctgaatttttatgcagaatataaccatgccagtattttggaatgagtgcagaatttgatccgtcggttctgaagaaacccggttacttattagaagaagcagagaccacaacctggcagtggctggtcacttcagtggtctccaattgcctttgaatacgacaatggtaatttcagaaatctccaagtagtccactaattttattgcttacattttttttcatcaaaagcaaaattgaaaccctatgttcccttgtaattctaaatttgactgcacatattttgattttcgatgagtactgcttgatatattcagaacggacaggattttgggaactagcaattattgattttgattgttgatgctgaagagttctgactatctacatgggttattttcttgttcaacaaattcaggaaatagtttcagctcatcagaagtttgcattgctgtcatcccttctagccatcctcgagtagttgcaatgaatacattgggcaattcagcaattgtggatcctatatctaagataatattccttggataaaatagagtatatatccgggcagttgcttttgtgactgaaaaattcatagcataaaatggtatgcctgtaggtcatttgaccaggctgttaatttggtaacatgagtctaattttcccaaaaaccatttatctgcctcaaagccctcaactcgtctatgtggaccagaaatgacttcttgaacatacaagaataccaatcacattttagaatgttttgtagtgtacagagctatcgatgaaccaggtgtcggcgtcatatgcatggtcgatgtcatcacatttaagatttataaattgaatattatcagtagaccaattgcatgtacgtcttaaaaaggatgtttggattacaagtatctatggtatagtagaaacctaaaattagatgtacgaaggtacgtaaaaaagcaagaaaaaattgagttgcaacttcgaaagaaatatactgtttcttcaattagggctatctacatcagctgcatttgagagaaatatccgaactgttgtagttcaaggaagcatttgaaataaaaattctggtaacagccttaaattaattgagagaaatatcctaattagggcacacaggatcagttggatctgttgagtttcataaagaagaggtgcttgtgcgttcatcaaatagctcggacgaagcttgtattttcgcttgtctgctagcaagccatctaaaaagtcaaagcgtatcgtcacatatttgaaaatgtgtttataaattttcagtaacttgctttgtaagggaaaaacaccaaagtttctgtgcatttgcttcgaacatttggttctgcagtactgttgactataaaatacagctcaacagaactttattttctcacatttctcataacaagttggatatggaaaaccatcgactctcataaaagactacacacaagtattaaactcaaatctattttaaagcatgtgaataggagacagcaagctttagaatgattctgagatagctccattttttttatcttgtctgaactttggctgtgagcttaaatgattaaatcagtatgttttttttttttttgcagccaccgaatcctttttaatagttttttattcttctatctataatgcttgtgtgcatgcttcttacggattgctaattattttacacgtgcagaataagtgtaattaactgggggagtgcttcttgaagtagatagaaagctttgctacttttgaagaaaacaagttgataatggagaaattgggtgagacatcattcattctacacaactttgagaactgactgagatgtaagcctggaaaatagtcatcccatgtgaataacacaaatgaacatcgaagttatatgtagcgccggaaatatatagaagatagctcatgcaactgtacgtgacatgggttgttcaatccataacactatgcattgttgatcgattggtgattattgttccctatatatgctctgggcattgacacgaaccgcataacattgcagggccatatatcttgagatattcataattgcgtttaaaccaattttttttacagttgcatacgattgtgtctttcagatctatatttgactctacacgcattgtcatgacttatccatcatatcgctttaatgtacttagcattttcacctacataaatgattatagcattgcaatgctcagttatggctctatgtgaatcaagaaaagatggtttattataacgtgattaatcagcagtaaaacgatacggggaaaatgtcaagtgaatagctataatgttcacggacaaagcacaaaacagacctggccttgccggaggttattaaagctcaaatgtacaaatcatatcaatttttttttgctaacatgaaattttaaaaattattgaagacaagtagaattgcaccgtagcgtttagcacgggcatattactagtggtgaatacatattaaccatttcattcacaatgatggatatatattaatcatccccgtcacctaatatgtgaattcaccgcaagaaaacgatgaacggggggccattgccatctctaagcctataagacaccatacgaagtgacttattgtgggaaacattatgtaaatatagaaattcgctcatggacaccgtgctcattaagatattcatttctgattaaataacatgaaagttctgtgggccacttgtcaattctcccatcacatgtctggtttaattatagtttggcactaatagagaaacaattttttcacgtgcgaaacaggattttcgcataaggaacattaagccgcccatctgcaaaatcaaaattaggcaaaaaaattccaaaaaagaaacccaaaaccctaactcctattcccatctttctcgagctcaccgccgcccgccatcgccatcacctctcccagggccgagggcagcgctgccggatctgctgccctcaagttcgccagcgccgacaccctagtcatcgtcgcctttccagggcccagagtggcggatccgtccttctcgaggccagcattgtcagatttgcctcctgagtctgtcacctctgccgccgtcgccatcgcctgagctgccctcgcctaccatccagcccaagcccaaggaggccggatgggagtaggagggagggagaaagaggagggggaagtgggagaaaggaggaggaggaggaggaggaggaggagcgtcgatggtgcttcgtcggtgtttccctcgctggttctgtcgtcgccggccggtaggagttgagaggagaggagatggatgtctcgatgggggagagagagggacatttttacatttacatttatcttccccatcctctcttctattctacccctcatcctctcttcccctcatactctcttctgttcttccaacggagaggacgaggaggggtgacgggcggtcgtcgagcggggagcggcggggtcgccaggcggaggagccgcagcagaggcggcagcatcgcgggccgggagcggcgcgggcggaggagccgtggcagaggcggcggcgtcgcggacggggagcggtgcggcggtcgcatgcggaagagcggcacggaggagccgcggaggagcggcatcgcagacggaggagccgcggcacaggcggcggtgtcgcgggcgaggagcggtgcagcggtcgccgggcggaggagcggcgcggtcggaggggcaacgcggtcgtcggaggagctctgagcggcggggatggtggggatctccaccttcagatccggggatggtggtgatctccacctttagcaccttcctcgctgccagatccgccacctctccacgggcgaggagcggcggcggacgaccggaggcgggtgggcgaggggcggcggcgggcgggcgaggggtggaggaggcaggcggcggcgagcgggcaacagtgtcgggcgagcggcggggacggtggtgcgggcggccagatccagtaagtctcctctcctccgctcccctcccctccgttggccgacggcggtcgaacgacgaaggtagccaccggtgcgtcctctcttccctcttccttcacccttcatgctcaatccggatgggggcgggagaactgcatggagtgggcgtttggggatggtacagtgtctcttctctaggtggcggcagtcaacaagaaggaggactgtagcaccaggaacaaaggccagcaaaggcacagtcccggaggagagagaaatgttggtggtgagcactacgattttcctgcacagggactcgtttagattgcagatggacctgttgatgtgaaaaacacacactagcctgggagatctgcttagctccagtgcaggtccaaaacttgatgagttgcaggcgtgccagttagtttgatcctgcaactgacaagatttgtaaatagtagatcaaacagacgatcggctgacaagccgatggagtagttccagccgatagccgataatagccgatgccgataccagccgatagcgatagggtttaagcaatcggctatatgtccaatgtagataatgatataaaggcaatcgactgatgatgatgtaataaaataacagtataatccagtataaaccaatcggcaaataatgatatgataaataagcatcgatccgaaggttaaagcatacatcggttggaggtccgatgtcataaaatccacaagattagattaaacagtgaaacctttgttgcgatcagctaaatccaatttatatgtatatgcaatccttacaagccgatgcaacgtccagataacttatcggctagcacccgataaaacattagcatgaacctattggtttaacaagacttatattatcaataacaatctaataggtcgaacctaaccgatgcagcacaagattgtatatgataatctaatactcgatgagccaatagatctgtctaatgtgatggatataacaaatctatttagaacaacattatgattgtagagatatatcggctaagacaggagattagacctaaccgagacagtcccaactaaaccgatgcgtctctaaacacaatgcaattagagatagaattgagatatcaggtaggcaaatatatcaaccaaaccagagcgatccaagagatcaaagcgatcactagtaggaaatcgcccatctatgacgtttttctcatgatgttgtataatttcgtcattaaatagggcatatctatgacgaaatttcctatttcgtcatgggtgagtcgtggcaggggtaggttccaaaactctgacgaaattaaaaatagcgtcaaggaacaatggaaaatttcgtcacaaatgatgcacaccgttcatttgttaatacttgttggtcccactgcgcatacgtgacactgtctccactggtcccaccgcatatatgcatatgttggtcccatcgcgcatatgtggcactagccccggtcccaccagtggccactacacgcgccatagtcccactgccccaccacgcatatgtggcactagcccccactggccccaccacgcatacgtggctatccatgtcactggtggctatcaaatttgtccaaaaaaataaatgctgcacctggaatcgaacccacaccacgagcaattacttaacagaagcttaaccactatgctagaaagatccttgtgtggatgcttattttgttattaacttttattggaactcccaaatgtttaacttatacacttcaagcatcagttaaagcattacacttttctgaattgccatactcaattcacatgaaaaaaaataacgcaataatcagtcgtaagtttattcacaatctcaatctgaattcacgaagctgtacaaagaagtagcatttcttctcctgctgttgtcgcccacgtccagcaagcaagctgcataagcaccactgcaccagaagcttgctactcgatcatggaggattaatggaggtgaagtagaagctgttgaacaccgataacgaaatcaggccgcctccatggccagcaccaggtcctcttcgccggcgacgctgggagcatcggtgaaggagatggcggtgggcggcgcctggtccagctgctactgctccggaatggccccgtgttcgccgccgcagccaccagcggcgtcttcgccggtcgcgcgccacaaaatcctcaacaccggcgccatcgccaagcgtcagcgctgctacaacgacgcactgagtgtcggcgccctgaacacgaggtgccccgaacgcccagaggacacgctctgtcttgccactgccgccggcgaccacctcctcgacgcctttctcctcctcgctgacacccagtagggcttccacgaggccctcctcgacctcacccaacatgttgccgaggcccgcgccgtgctgtggaggggtgacgccgccagcgtcgcctccgccgtcaggtcccagcggcggcggccgagaaggacctctcccgcggtggacatgggtgtgtgtttacgatttggtttggtttggatctgaatccctcgttatatgtgtgttgatttacgattgtgcccttgttatatgtgtgttgtaccgataagaatgaggggtaagttggtccaaaccacgccgtttgttcgattaaaaccggttggttcaatgtttttctacaaacaccggccggtttacccagtttaaagtgaatataaaatttttaaaattcaattttcaatcagaattatatttctgtgaatggtaaactgtgccgattttattgccagcctagctcaaattttaaataaaacattgaatttgctggttagaaaaaaaaagtgggattttgagaccatttctaagtggccacaattattattttcacttaaaggtacagcttatattaataaataataaaaaaaatagggacacattcatggtacagcaatttgatgatccctattgagcacagttctaaaaaaaaaatagaacacgcgcacgcgcggtaaaagaaagaaacaaaattgatgctcttcgggggattcgaacccacaaccacaagaacaacagcctatgttcccaccactaagccacacaagtgtttcatcatagggcatgcgcttggtcttatatatcaaaatgttagaaggtaatggacctatatctagccatctactcgtggggttcgtcataaagcgtggtttttctttttaatctctgactaaaacttataggcagtctttctccctcatactaacttcaaatttgattattcttttttctaaaattttctaaattcatgatctatccattttttgtgttattaaaacctttttttttgtcatacttttatgtgactttgttttataaattgaagatttaaatttcaaaaagtgctaactacaaatgacatttttgaagcagtaaatgatttcaactgaaaaagtaatgaacacaaaagttgtagaactgatcaagatctacaaattttattttggtcatttgttcatttgataaagtgatagtaacgttgtgtacaaaatttacacatctctcttataatttatgaaaccatactagagatatgtaaaatttgtgaacaatgttactatcactttgtcggatgaataaatgaccaaaataaaaattgtagatctagatggattatacatctttgttgttgatgactttttcagttgaagtcgttcactaataaaaatttctatttgaagttctcaaactttgaaattcaaatttcaatttgttcaaataaagtcagatggagaaatgactaaaataatttttttttcatctcgatgagttctacaactttggttttggtgacttttccatttgaaatcatttattaaccccaattttgttttaagttgtcaaattttgaaaattcaaaatttgaattgatcaaatgaacttatttgtaaaaaagtccaatacaattgttgtagatctcgatcagttctacaattttgttgtttataatttttgcatttgaaacacaaaaatcggtctaaaattaaatttaaaattttcataaattgatattaaaaaataccacatatattagtaggcctaaaccctgaaatcggcccgttacagtattcggcccataaatttctggccattgattcttgatcgaatggctatcgttgctccaaggaagtataatttgattgttttcgatttatggaaaatgataattactcatagtcatatacggaggatttttcgttcggcgcctaaacctgccgccaatgacagccccaaaatattccattgccgcccatttgccaaatcagaatgggaaatgtcacttttatcctccatctaacgaagagcaaaagaacacccaggggcatttgtgcaaccactatatatttacaaactctctcacccaccaaaccctaatccccaaatccagtcgccagcccatcggggcgccgctgtactagagccgccgccgccgaccgctgcaccggagccttcccccacaacctcgtcgacgacgactgctgcaccagtccttcccccactacctcgtcgacgacggccgccgcaacgaagccttctgctgcaaccccgtcaatgacgaccactgcaccagatccttcccccgcgaccccgtcgacgacggctgccgcaccggagccggtaccccgtcgacgactaccgccgcactgaagcctttccccttacaacatcgtcgacgcctcccgccacaccggagccgggtaccccatcgacaaggaccctgcaccgtcgccgtgcctagccgatgggaagacgtcgacgtccagtagcacgaggtacgcaaaattattttgccgtctcaagatcagatgttcgtgtgtactgtctaaatgaaagccattagatgttatacatcatgaggattgatttgctgtccaaatctctattaagaattttctgtgtgcaatatgattgaggtcactattaacgagaacggttgatgctgttgctagtttgctactgcatatggcattgtttctgtgttttttaggcgcacctttaaattaatcatgctatgttgattctcaaataaatttgtgcctcaagttccataatcatcataactggaagagattccttcagattaagggttggaaatctattatcctttaagaacacaataatgttctctgctcttgttttaattcttttctttcacccgaaggggttctgggagctagatgatggacatctgcaatgcaatatccctttcagtgctcaattaatggtcagtacatatttcttcctttttcttgcctttttatggaactcttgctttactgtttttttcttacataatcaaaattgagaataaaattcctgtgatatgaatatgtcccacaagtctgacatgtaacaaattttggtacatttagtttacaccctgttgtttccatacaagctgtcttgtggatgactgcctatctacgacaggtgcagaagaagaaaactgtcttggttcttcctgctgttcatgactatgcaacaatctctcatgagatttctgtgtacacagggtaagaaatctttgtgcaactatctcccatgaggttatatatatatgggtgctaatatttagtgagtgctaagtagtactgtaatataaattggttacttgtgatagttatcatttgttgtcaacacttgcataatggtgcaaaatttggatttccttggctgaaattttctgacgacaatcaagacagtagtagatacactcttgacgtataatcgtggtctgctcaaactgttgattccagtgtgtactatcttcaaactgtgcagcatttgtttatttttttaatgactgttgctaatttattcacatgcttacagcttctgtatttattattgtagtaccctcgtgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgacacaacctgatcgtcagatctatactacacccggcggattcaaatccccaaacaggagtagggtattacctctcattgagagggcctgaacctgtctaaatcctttgtctccacatccatccacttttaggtctcgtgcgctacccctttttattattgccgaaatcatgtttcgacagttggcgcgccaggtaggggttgcgtcgagttatctatcaagaagcgcgatggaatcaactttacgagtcgccggcttcgtcttcacttcgggagctgcaacttcctcgccgccgacgaattcgctaagcttttcttcaacaacttggatccaatctagccggcaagattaatttaagcgatggatccaatcactgtcgtcgccgagttgtttctctgatcggcatgaccggacgtcagtcgccaagttattttcctgatcatcatgagcatcaacagacagccacgcaagtgcatgtttccatatgatgcacgcgcatgacagattggccaactaattaggagctgctagcagcactttcttccccgattgacataatatatacagtgtcgtttgttgaagcagttattctcctcaaattaaccgtccagtgacagatcaaattccaagcgccaatgttttctcgtcaatatcaaagtttcggcgagattcaactattagcatgaatcggagtcgatgtggaatccgagccgactgatcgaactcagccatgcatactccggactcatatctggccctgcacagtacctattttgccactttaactcaagtcagatgcagtcaacgatgaacgtcaaggctgaccaggttgatacatgtaaagccgatgacgtacatgcatcattaagagtttgggtgacaaacacaaatcaggtttatcgttctaaattttcttatataaattagaattaattcacatgtcactaattattatttaatctattattttatacatgtaccgccggccgccttcgttgctgccgattggtttcatcgcctccacggttggtgtgcgccgctgccgttgcnnnnnnnnnnnnnnnnnnnnnnnccggcctgcctccgtcgccgccgattggtgtctccgcctacacggctggcctattatgccgccgctgttgggcgtctacgacttcaccgccggcttgcctccgtcgccgccgattggtgcctccgcctacacggctggcctattatgccgccgctgttgggcgtctacgacttcaccgccggcctgcctccgtcgccgccgagtggtgcctccgcctacacggctggcatattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacgactggcctattatgccgctgctgttgggcgtctacgacttcaccgccggcctgcctccgtcgccgccgattggtgcctccgcctacacggctggcctattatgccgccgctgttgggcgtttacgacttcaccgccggcctgtctccgtcgccgccgactggtgtcctcgcctatacggttggttggtcacaccaccgttcatgggcgtccacgtcttcaccaccggcctgcctccgtcgccgccgattggtgcctccgcctacacggctggcctattatgccgctgctgttgggcgtctacgtcttcaccgccggcctgcctccgtcgccgccgattggtgcctccgtctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagcggtgcctccgcctacacggctggcctattatgccgctgctgttgggcgtctacgtcttcaccgccggcctgcctccgtcgccgccgactggtgcctccgcctatatggttggttggtcacaccaccgttgttgggcgtctacgtcttcaccaccggcctgcctccgtcgccgccgactggtgcctccgcttacacggttggcctattatgccgccattagtgggcatcttcgctttcaccgtcgaccgccttcgtcgccgccgactggtgtcttcattgttattgatggacgactttgttcccacattggccacttccgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattccgattcgtgaaactttgttctattaatggcgaactcatgtcactcatatgcatgtctgggaagtgcctaggccgactcccgatgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccggatatgcataaaagggattcatggctttcagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacagctggcctttatgccgccgttgttgggcgtctacgtcttcaccgaccggcttgccttcgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgtagttgggcgtctacgtcttcaccgaccggcttgccttcgccgccgccgactggtgtttccgcctgcacggctggcctttatgccgccgttgttgggcgtctacgtcttcaccgaccggcttgcctttgtcgccgccgaccgatgtcctcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaatctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcgtcttccgccgccgactcgtgttatgccgccgccgactggtgcttttatcttcacaactgcgcgtcttcactaccggttcacttcatcacggcaacacaactttgtcatcatgcaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttgaacgagttggacaacaacatcaactctcctccaagtgaagcatctacaacagctataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtcttcttcatcatgtcggttgcgtttgtcgtcgtcaactattttcttcatcttcatgattggtggattttgtcatcacctttgatctacctcgtctgtcaccgactgattattttgctgccatggctacacaattttatcgctgggttccttcatcttcattgttagttgatctgtctgccgccgactggtttcttcgcctccatggctatgcgacttcattactttagattggtatcactatcttcactaccaccagtattgttgccacctctggtgggcaatattatctctatattggtcgtcttgtctatatgccaactgcgtcagctaccatcaatggacgattgtgactacgacagaaggacaagctatatgctcaggggctcatcaactcaagcgtgaggattatatctccaatttggacttgttccggatacattccacatggattcatagtcatgagtctattttctatgctcaaagactggaccaattatattccccgtaagggctatcaaccgaatacttgcgccagtcgggattcaattgttacacctattttggagtatcccataagggataatcattcagatcagaagctattcatatgagctacacttggtctatattacccggaagatttattactcggaagcatgttacatgcgtcatcctttaaagggtgtcgaaggcatattttttggcctaggcctaatatgtctgcagcccatattttcaggtgtggcctgtcacgttcttttagggacttaggcacttttggcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttattcactcggattttacaccacatatgccatatatttccaggtgtggtgaaaccatgtgtcttttagggactaaagcacgtctgttaaagcagtgtgcgcatggcgtatgcccaatactttggaaatttatttattcacaacatacaagcttctttatagctgttttgttatgtgaattttcaatgatgtaaccaactttaggttacactcatcatattttacaaagcggtcggtatatcactcggatcatgttattcagggattcacaccgcatatgctacatattaatatcaggtcgcttggttgactataattattaaaaccactcggttggttggattatttattcgttgactatatgcttggtttgttcaattaaccacatagtcgggggctacacctattaggtgcatctagtcgatgcacctgactttatttttcagccctccacagtcttcatatttggtaaaagtacttcggagaccatggcgaagatgattgaagcactcagctttggagtaatctagttcgagagaagattatcttttcgactgtgaaggtctcaggggctactgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgattccggattgggtaaggattctatcttgaaatcctgcccccc

SEQ ID NO: 23759 - DNA, 1987 bp, Oryza sativa
tttattacctcgacaaactagacgaaagacgttgcgacgaagaagaaacctacccccaagatgccatcaagagtaaggatatcaaagagagtgagggcaggtgctccaaccgaaatgcctcctggaatctcaacaagcaaatcttgcaaatgaagcactggcaaagactcaaaaggagttagcagagttcaagcagcagcaggaagagaacaatttccctttcgacatatcttgagcctttcccagggtaacttaaatatgtcctagtctcctttatgatcttatgcactgtgatgaactccatgtacttatatctgttttgatggttctgggcacttattgtcatgtggtggacttggttatgtgaaatgatgtttagtgctatggtggacttaattaccatcttgtagtaaactttgtggacttaatgtgaacatatgtgtgctagatgaacttatttgtaatatggtgctatgtgaagttggtatctgtgatatatgtgatgttggacctatttgtaatgtgctgtgaagttctgattgtttctccatgtgatcaatcttgatgttgggcctatttctatgtgctacgaagttctgattgttttttgaaatgggtcaatgctaaaaattttgtagacctcatagtgggctgggccacaactatatgtaaagtgtgtgaccaaatgggctggccaagaaaaatgagtgggccttcatccctactgtgtttgaaacgtgtcatccaaacaaatcaacacgtggcaacatcatgtaaagacatgtgtcacaaatcagatccgtacacgtggcacttcaaaacgagagcacgcggtgccccaccttcggccacgtggcgtcagcgtgcaccaccacgtggacatacgaaatgttaacacgtggcactaaatatgaccgccacgtggcgttaaatatgactgccacgtggcattacatatgactgccacttggctctagcgtactggagatgataatccagcgtggcgtacatgtcatccgccacgtcacagccaacgtggactccacgtgtcaaagccacgtggcttggactacgtctgtcagtggccagctggaaagcatttctgtgacgagcaccttcgtcatggatagaagcatttctatgacgaaatctactgtttcgtcgtagagaaacatatgtgacgcgacttctatgacgaatcatatttcgtcataagttcgtcatagaagttactttatgacgatttgcgcgtcttccatgacaaaagtagattgtcatagatgtgcctatctccactagtggatgcagcctcgaacaacaccaacgtagccgacagattcactagggccggcggaacgtaggacttaccccttcgccggagatcgaaagtcgatgcagccccgcgtaaggttccaaattccgccggttgataagtaaaaacctcaggaaagagggtggcgatgcgccgagagtagttgtattgatcgagattgatagattacatagaccctgggtgtacatatttatacccatgggttgataagtccttgtcggacaagaaagaaactatcctaaagataaaaggaaaacataaagtccttatcggacactaaacacactttcctaaagataaaagaaaactaacaaactattactaattaatagataaactgccatgccgcatccttcttgaactcggactcttctggataaattccctttaattgatccaattccatcgagaacatggttgctggcgatttgacaactcccatcggctgattccaggactctaaagccgatattgactctaagacgatgatgactttgggcttaccaaatttcactgttaacatgaccataactggtcgcgtctgggaaaataggacccattttcgcgtgcggaccatttaagagaacctcacggaaaaatggaccgcacgcgaaaatgagcctattttcacgtgtggacatattaaaagagccg

SEQ ID NO: 23760 - DNA, 23943 bp, Oryza sativa
ctatcctctcctctcctccccgcagcaacggctgggcgtaggcggcgacggcggcgcggctacggtgcgcagattcggtagccagccgccctctcccccgcgggatctcgttcccctcccctccccttccttcttccctccccgaatccggcagaggggaggggcatcggtggcggtgcggccggaggggagcgaggaggccgtcgggagtgcagatccggcggcggcccgccctccccccacgggattcggctcccctcccctccccttccttccgtccccagatccggtggaggggaggggcgtcggcggcgggtggcgcggaggccggcgagagggcggatccggcggctggcggcgtggaggccaccgccgacgacgacgagggtgggagcggcgccctctcgacgactacgacgaggaagaggatgaggacgacgacgacaaggaggcggcggctaggagcggcggtgcagcagctggattcgttttttgaaattttatttttttcggaattttgtttttctgtgcgggcgacataagcacccgccggcgaaaatccggcgacgccgcattcgttttttgaaattttattttttttcggatttttgttttttcgtgcgggcgacataagcacccgcatgcgaaaatcggatttttcgcgtgctggtgtgccacccgcacgcaaaaaccgcgattttcgcagacccttggttgcgtgcgggctgtccacccgcacgcgaaaatcacatttgaccgcatgtaaaagtcacgattctagtagtggagcttcggtggcaaacatgatcagatgtgcgcatcgaagcatgtttcaacaggggcttccgttttcatggaacttgttgatagatatggaacggtggtggcaggaaccgatggtgccgatttgggagagggggggggggggggggcatggcgtccatccatggtaaagaaggaggaaatgttgctagcgcgacggagcagcgagagaaggccagggtcgttggagatgcggaggctaaggtgcgggagtgtctcggcaactagcgacaacatttcagaactgaggcttacatatatacggcccgtatatcctatagcaaaacttgcaaaacttcagtgtgaatagtcaacgatcatgctagagcaagtttaatagtataacccactactagctctaatttatctatagccaatgtaatagccaattcatacattagatgcttactatactattagtatatggtcccacctgtcatacacacattacgtcttggagtccgtactgtagctggctacggctacagatctatagcccgctactcttctctctcatcttttatctcattaaaatatggttgtagctagcgaatagtctgctattgtacctgctcttagtatattcacgcaatgatgtattcatgccagtttaattatgcataacaagagccaacagtgatattgaaaatactaatcatgcggttcataacgtaagccgactgtacagttcacttttaaaatttgatttctttttttttttggtctagactcttttgtcatttattgccggctctaaaaaaaatcgtgcaagcagtagcccctttaaattctaagcgatccttacaaaattcataccgaaggataaccatgacacaacatatatagaattaagatttgaaccatggtttgaaaattatacactactgaagagaactgatctttcgtggatcatgtaaaaaccacattatagtcctagttcgtataggaaccgggactaaatatcatttttagtatcggttaaaaagcccaacgagactccaatcgggactaaatatcatttttagacccggttaaaaaaggcgtcaggctataagatgtcgtgtgtcaggccctcattatctttagtcccggttggtagactaaaaatcaacactttacataaaaaaatcgcgccaagccagacgcttttccgcctcgatctccccgcctcatcttatctccttcgcacgcctcctcctccttatctcctctgcacaccttctcctccttatctccttcgtcgctcctcctccactcctcctccaggtctgcttcgcacgcatcccctcctccccttaccctctccgtcggtggcgtgggtggcggcaggtggcagcgagcggcgggagttggcggcaagccgccggggccctcctcctcctcttccccatccgccgccggcgaggaggatgaaaagcaagagcaaggagaggagaataaagaaaaaaattgtggatgattttgttgtagattttttagatgtttgttgtagattttgttattgcatttgatccgtgatgttaattttgatgttgttgcattcaatccgtgccgttggaaaaataattttgatgttgttgcatttgatctttggcgttggaaaaaacaatgaaaaaaaaaacaatacgcaagcaaaaaaatggaaaaaaactatagtcccggttagtaacaccaattaggactaaagatgatagcaacaaccatatggcgttactatctttagttagtctcgggtagtgttactaactgggaacactaaccgggagttcaagagtaaagatatctctttagtcccggattcagggtcccggtttgcaacctgagactaaaggggttgcaaattaaaccggcactaaaaaccacttctccagcagtgatatcaatttatgtagccacactgtaccaccaaaatggttgaggaatttttccgaaggaaaaaataagtagcagatgctttctaagggaaaaaaatgaataaccgacttaattaccatcaatcaatcaataatagtcgcggctttgaccagtggccggagacggagctcattcatatcctctccctctgtaaccgtaaagaaagtcgtttaggatagcgacacggtctccaaaacacaactttgacttttttttataaaaatatttattgaaaagtgatatatgtatacttttatgaaagtatttttcaagacaaatctattcatataatttttatattttcaaactcaacaacttgaaagttattaatgatttatattttcaaggtttgacttaaacactgtgctaaacgatttactttatgagtatggagggagtatatggaaaaccacgtacgaatgctaaattaagttacataggcatgcatgacttaataaccactaaatcagggatgtttccttgctaacggaaatgatcgagtagctgactttgctatcgattgatcaataatcacagctccaacttgaaaaggctaatgcatggtacggtgtttcatgaggagaaatgaactgttgccaacttgccatcaattgatcaataaccacgactttcaactcgagaaaactaaattaagttaattatataccaataatcaaaatttaattgtatacattattctaggagaaatggatgattgtgtataaaaaaaacgtgaactttcgatgctatataaccaattttgcctatttaaaaatagaattatgatcgagaattgacggaagtgctaaaaatgggaacatggtgaactttaggtgctattaaagtgaaccggtatctttcggtgctataaaaccaaaaatgtgaactttcgatgctatataaccaattttgccttttaaacatattgtacccacaaattacagctgtagtatgcatagaaatatatatcgtgtacaaattaaattgtatgcatggaaaaaaaattaggagtccaacactattcagtttcaaatagaaaaccataattatatttatagaaaaaaaccaattgtgaaaaatccaactctacctttatatttatagaaaaaaaccagttgtgaaaaatccaactctaccttttatcaagctctgctaataatggtagcgacttttggttggcgaccggaatcgcatccagggacacgcacctctgtctagcactgggcacatctatgctttctatataagtgagaacacaaacaagcacaacgtttagccacgtcatcaaaatagtttcaactgttggatcgacaagaccttccagtattagccgttagataaaagtcccctccacttcctcaccaattaaacaacaccattaaccaccaccccatctaaatgctatctatttaatcaggtagtcaattgaaccataatacaatcaagatatcagatcatatttactattccaaccatcattcaatcaattatatatatatatatatatatatatatatatatatatatatatatatatatatatatgtatatatatatatatatgtatgtatatgtatatatgtatatatgtacatacaagaaagtagatattttctatttttttaaattgcttagtaatttccgcagtaaaatgcggggtatcacctagtatctgaagataattaagaaaccaaattagtacacctagctctgtctgtctagcttaacgccgtgtgtacgtgtatctgcttaattaataagagtgatcagagaagcaaccagtaagtacgctgtgcagcttgtgctccatccatgctgtacgtacgtatatatagcacgtacaataataatagttccaacttgacatgcatgaacgaacacgtagctagctagctaacttgctggcccctgtataaatacccctatatacctagccctatcatccatccatccagccagccaaacagtagcaacatgagtacttcagctcgccgcctcctcctcctcgccggcgccgctgccgccatcgcactcctgctctcggccactgccccggtggccggagccgaggacgacggctacagctacatccctggctcacccagggggccgcagaactggggcagcctgaagccggaatgggccacctgcagcagcggcaagatgcagtcgccgatcaacctcggcctcctcgacctcaccttggctcccggcctcggcaacctcaactacacctaccagaacgccaacgcctccgtcgtcaaccgtggccacgacatcatggtcaggtttgacggcgacgccggtagcctaaagataaatggcacggcgtaccagctccggcagatgcactggcacacgccgtcggagcacaccatcgatggccggaggtacgacatggagctgcacatggtgcacctcaacgcccagaaccaggccgccgtcattggcatcctctacaccatcggcacccgggacgagtttctgcaaaaggtctgttggattcataattcacatagtttgcacgcatggctaatgcttctaacaaaaatcaacatttgtaacttttaatagtaactcacgtatttgttgtcattaggttcatatttgaaatactatatatatgatgttaatttcatggttatcgacgatactccctccatcccaaaatataaggctcaaccgctactaacacaaagaccaagaaagaatttaatcacctccttgattgaattgcatccatacatgcaagcaatgtgattggaagacttaatggtacatgaattaaaataaatcaaatctaaagaattaagaggtgataggaaatgtattcatacatgcatgccttatattatgagacattggaaaaaaagtggttctgccttatattttgggatggagggagtatatcataaaataaactatttgtatttgttttaacttattagagaccatatagaaaactaatatgccttctattgtagaacaaaggaagcactgataatatcatcaatggtttgtcatgtctattttaatgtgatagtttggagcaactgatgaaccaagatagacatatattcttggtatgctgaacttcttgttgcatgcagctagagccttatataattgagatatcaaagcaagaaggcaaagagagagtgatcattggtggggcggatccaaatgtagccaagggacaggataccgtgtactaccgctacatgggctcctttaccacaccaccttgcactgagggagtcatctggaccgttgtcaggaaggtatgtatacatgcaataagtaggataatttaacattttaaaactatttgtcgcgatctcaaatcaagtgttatttcttgtcaagaattaatctttaaacaggataccgtatgtaccacatttagtttcttagtgacgatatattaaaatccttaaatatagtagaaataataaatatctaagagaattctcaataaatagtgtttatggtaaggtctaataggacaaataagtaataaattggcatccaaggaacaacctactcaatagtagcttctacctatctagctctctcccagagagtacaactttcaagcccaactctacacaagtttctttgtttccttttccaaggccttggataaaattaacccagtttcaatctcttgccaccttttatcccacatatcacattattaaagttgtaaacaatctataacatgaagcaccgggaatgtgctaaggcgaccacgttcagttttagttggtgagggaagttcttttagttatgtacttatgttcctacgctttctgtcttttttcttcttcaggtgcgcaccgtgtcactgtcccaaatcacacttctcaaggcagctgtgctcacggtaagtgaaaaagccattcatgtttaatatctattaatagatgacagtgaacaattatttcatttgttattacttatgatctgcatatgtgcatacatgcagggtaacgagaacaacgcgagaccccttcagggcgtgaacaacagggagattgacctgttccttcctctccctctcatcaacaactgaacagcatgcttgacatacacagctgatttacaacgcatcgcctgacacacgcatggagaatcagcaaacatatgtgtactaataaatatatagtattactcatgtttgtgtaatcttatcctaatggtgtcgcttatatatatatatatatatcgtcttgatcacctagcttcgtaaagagagatcagcatatatgttgttcaatcacatctgcatagcataataatgcatgcatagattttatatgtatctctttccggtgctgctatgtgtatctctatatgattaaataaaaataccaatgttttataattatgtaaatcatcatattcatcttcgtagcatagaaagtatgttgataaaaatttggttgccttggagtaggccaacttaatatatagtactatccagctggaattgtgctatggtaaacttaaaatgagaaaaattctttgtgtacacctgatcatattgagcatatccattttttaagggaaggtcatatatatcccttttgtatacatggtaaccttatctttaatgggtggttaaattgaccaattagatggtgtttggaggaatgacctgttagggcatgtacaacggtgtttattagtggtctctctctattgccatggaagtaaatttgatgacatggaagaaagagaaaggagtatggttgttatgcatgacaacagctcagagtcgactcttagcatttattagagcaaattttgttgcatggtggtgaaagaaaggaaataaaagtaagaaaaagtattttgatacattaatgattagagaccatattgtctctaactgttgtaggatactagtatctaaataacgtagagctcatatccgactctacctttgtacatgcccttagagatgtatgaaccctgcactgtcagtcgacgtcctgtgtttccatagcataacatctggaatgatttgttattacgagatacggtgaatgacacacgtaatgtgtcatttattatgaatcgtttatagatgagggtcttcatctataatggcttataaatatgacacattagagatgagttcttctctctaattggcctggtttttaactgttacatcaatgactaatacctgatccgttcaaatgttaatgtccagcccgcatggcctgctctctctctctctctctctctcctcactagctacatctcagctagctatggcatctgccttgcgttgtgcttagttacatttctaggtgcacaattggctccaatattgtcctcattttttttgttgactttgttcatgcctacaacttaacccttttgccctgtgtgtgctctctgattggtctcaccctttggtcgtcctatacatgccttcctaaaaggtaagcttgtatgtaggccaccttgttcacgagatcacttacttgatcctagtacaatcgtctaatctttcttatttacctcttatctcttttgtcaatattgttgatctttctaaaaactatgttgccaatctttctaatgttcgatcatcaatatatttggagctacctcttgatttagttcatgaaaacacataattagatttttcactcaaaaatctggtttcataaaattacaagcttatatgaaaaatgtcaatgttacggatcaggtatacatcctatacttagattcgtagctaccataaaatacagaaaattatatttaaatatggtacataactagataagaatgaaaactccctccacatgaatagatgttgtcggagtccgacctgaaaaaggcaaggtcttatctacccacattccacaagggctctccgactttaacttggagaggaagttgcctacccatataaatacaatgttccctagaaggggagggcatggaatcacaagccatagctacaagccacaaagcaaattcgtccggtggaagtaaatatagctagcccccaactacaagtcatcggatagttctcggcgcctaacagttgttaggctaatattagctagcttactccaccattgtcatgggccaccaaaatctcaggacaagtccgtgaaatatatagtttttccatctcacctctgtacggtcttcttttcttatctgctctgttgtaaatgtaagccgttatagcacttagtcacttgtcgcttatcttttttttgtcaaatgcccttgttaattaaattctaccactcatacgagacatcatttctatagagaagaatatttgagacattgtgaggcctcagcctgagatgtgcccgtcaaacaactcgaaggcggcgactaaatgtgttacacattcaggagacttgacaaaatggctagagatctacaacatctcaaatattcttaactcgtactcatgtgaatctagttcccaggatatgcactagattcacactttcatcttaagtatggttatacataacaaacacaaataagatgaaagcgattaaaatttgtaactactctagagatacataggccgaccagccaaataaatatatgagagaacagcggaagcttgactacccaatcctcaagcacactgactagggtttaccccattaagttcaagtcctagaagaagcaggcgaagcctaatttatagatttgattgagctatcataaactaatttatagatttgatgtggtatatcacaaagctaatttaacattgaacttaccttgaaactataaatttaagatatactataacaagagcacacatttagtgtaagttttatcacaaaactacaacgcttaattatattttgagctgaacactagaggtctaaactctatagatttatggtaactttgtcagtaaatctgtatttgtgtgatatttcaccttaaaaatatagtttcatcataaatttgctgctaagtatatacttgtgcaatatgattgcccttttatctattttacagatttactctattaaatatgtacgtaagagagaacacatgaaactcttctaagatcacttttagtgtatatgagaatgatttgacatcattttgaggagttttggtttggttattgttctttcttggtgccatgttgcaaaattatgatttgagggggttatagtacatatgaaaagtggttacccacttgaacaattggctttcttctcactatttgatgagtctattcctctccacccctcaatctattggtgccatgcatgctatcctaatttaattggtcttcctccatagctgtcctatccacgccttcataatagataggcctatatgcagtcatcgtgtttgggtggtcacccacatactcatctggtacaatagtccgatctttcccacttctgaccactcttgcccatgtttccaatctttttaaaatttgtcaccaatcttgtaaagttcatgtattggcttagcttcgttttaggcggaagggtttctaggagattttcctcgtggcttgttggcacatttggaaactgcgtattggaaagatttttcagaatattgatatttgatgcttggtggactgccttcagacataagattctcctacatatctataggatgaataaccccctacgacaaatagttgttgattggttacagcttttgtagttctttgatctttatttttgccttttatgtacgtatctctgtcaaactgttttattcccttcagttataaaaatcacactgttaggaaaggcgcctggcagttttccctttttttttctaaagttcatgctttattaatatacatagaatcagctagatttattttatgaaaaacacaaaattagatttgtcactgaacaagcggtttcataatattacaagcttaattattatattaaacatcaatatgaatctatatgaaaaataatagctaaagtcacacccatgaaaagtcaaaaacatccaaagattttgtatatggtaccgtgatcaaatagcctaatatgtaccaatggagattttggatatggtactgtgatcaaattgcctaatacatatatggagcgagtaatgattaattgccactactctaggtaatgttcatttctgactaagatatggattttaccccatttatgttagaatgttttttttcaaactgataaatatggtgtatttcgtgtgaaaacttcctatataaaaactgttgtaaaatatctgatatatattttttcaagttaaaaataattataacttaattaaccatgtgataatagttttctcattttatatacccgtagttaatcttcatccatcacctgttcaatccgatggctcgtatatttttgtgctcttccttaccgtaaaccttttccttttcctttttccatataatcttgacctataatctatatatgtacatcgagtatatttacataaaataatagcccccctaagaaatataaaataataatgagagcttaaatatatgtttggttgtcaggtctcgccagagctacctagcgaagaatccaattaaggcctcgtttagtttccacacaaaaattttatacactatcatattaaatatttgaatagatgtataaagtattaaatatagactaaaaaataactaattgcacatattgtgattaatttgcaaaacgaatcttttaagcctaattgctccataatttaacaatgtggtgctacagtaaacatttgctaatggcgattaattaggcttaataaattcgtctcgctgtttactgacggattctataaatattttttattagtgcccgaataccccacgcgataccctatataatacccgatgtgacacgcaaaaattttacacccctggatctgaacaccccctaagttttctttttactggataaacaccccctaagttgatgattaatttattatccatatgcatgttaccacatatagataggtcagcacaactggccttaattaaccttttttatttgttgttgtcgacacaagcagtcccctacatatataatttggccattagatttctacttatatttttatgaaaactaagaaaacatgcagtaaccttcttttatttgaaagcatttcacatgataaatcaaaaatatttttaactacgcctacacgcgtttggcattctagctaaaactatatccatttgtcggtgatatgggaccgggagtatcatgaccagaggcttgaggcagacgcaaccgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgcgacatatatgggataagtgagcacagctgtgctcacctaacagcatttattgcagtctggtcaagcgtgtcacgctgcatgcagcgcagtatggcgcgttcctttatccggtctgtgaccagtcacagaccggtcagatcacgggttaggtggcgactggcggtctgacgcacgccttgccccgtcccgtcaagacgaaagcctctaggcactcgtctcaagccggagttaagcgcgttatctattagagatgacacgttagccccggacgatatatgccaggcttcatcctaaccattacaggcgagatgttgagtgaagaagggcaaacatgcacgttgccaagattacacgcggtggacaagaatgaccgatttgtgaccggtctgacactgatcatatcgtcagcgcacagccatgctcccacgacgcgctcacccccggcggaagtggaggtaggcgtgggctgtcccatcggagcgtcattcggacagcaaccgtgctgatctccgcccgttcaagagaaaaagaacagtccagtttggaaagagaagggtgcatgtggtatccccttgaagtataaaaggaggaccttgcccatagagaaggggctttttgattcttttccagattgtgagcttagaacgggggagaagtcagctcacacttgtagcccattcatacacagatccaccaaaacacaggagtagggtattacgcttctcagcggcccgaacctgtatagatcgccggtgtctcgtgtttctggctggcagacgatctttccacatacagagagagagcgagagcttgagatttcaccctaagcccccggccgaactggcaaaggggggcctgcgcggtctcccggtgaggagccaccagctccgtcatctggcgcgccaggtagggggctcagcgtgtgctttttgagctctcagactcttccgtgtgccccaagtttttcttgttcagcctaatggccgagcaaggaaaaacacacgacctctcgccgagtgtgagcggcgacgacggggagccgaatccgcgccgtcgagctcgtactcctccacctcctccgcgccaaagccctaagcagggggaggcgcttgagagggtcgacaaatccgcggcgtcaccagccgcaggtgatgcaggagaacggcgagatggggagcgtcgcctcctcgtctacggcgacggcagcacacctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggcgtaatagccggcgtactccccgtgcaacggagggagcctcctcgtccagagtgtcacctcgacatggacgtgaagatcagccctccgtgcccccggccggtggtgttggctgtagagcctttgtggcgagtcttcggaatgtccgttggcccccaaggttccggcccaccatcaccgagaagtatgatgggagtgtcaaccccaccgagtttctccaggtctatacgaccgggattgaggccgctgggggtgacgacagagtcatggcgaacttctttcccatggccctaaaaggacaggcgcggggttggctaatgaatctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaacactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgacaggaggaggaagaagaggccggaccgttccggcgacgagggtcatgtcctcgccgtcgagggcgctccgcgggccactcgaaaggggaggcctgcgagcgacaaaaagaacggggctggtacacccagcagggagcgccccgccggcaggtggtgctccgtccacaacacctccctccacgatctcgcggactgtcgcgcagtcaaaaatttggctgagcgaacgaggaagtgggaggaggacaggaggcaggaacgccgcgaggacaagtccccggcggtcccatccggcaaacggcgaagtgaggccaagcagaaggcccccgctgttgacattgatgatggtgatgatgacctaggtttccaagaacctggggccaccattgccaccgtcgatggaggggcgtgtgctcacgtctctcgccggagcttcaaggctatgaagcgagagcttctggccatggcccctacccatgaggcgatgcgtcgggcgtggtggtcggaggttgctctcacttttgaccagaccgaccacccaccgtgcattgcccggggagggcaggttgcgatggtggtctcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacatcgacctaccggtcaccttcggtggacccgccaacttccgcacggagcgggtgagcttcgatgtggcggacctcagtctgccctacaacgcggtcctggggagacccgcgttggtgaagttcatggcggcggtccactacgcctacctccggatgaagatgccgggccccggtggccccatctctgtccgtggcgaccttaaagtcgcgcttgcttgcatggagcagcgcgcggaccgcctcgctgctgcgtccaagcccgagggtggtgacgagaggcttggcccctctgcccccaccgccccgaggcagcggatggccacatgcgacgaggttccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtctggcagaaagtgcggcggcaagccccggaacgtcaagccttcatccgcgaggaggtggctagacttttggaggccgggttcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgtgcaaccaagaaactttactttcagatctagcggaaacttttgagaatctccgctccgcccgcataaaactgaaccccgataagtgtgtgtttggtgtacctgcgggcaagcttctcgggttcttggtctctgcccgaggcattgaggccaaccccgagaagattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaacatgcccttactcagttaaaggcatatctcagctctcccccggttctagtcgccccggagccaaatgagcccctgctactttatttagcagcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggccctccgcccgcttgtcagacggtgtcgggtgcccccgaccctcaggaaggccccgaggccactgcggggaggccgcacctatcaccctctgaccccgaggctaaccctgtaccgattcgacccgggagagagcagggagaagaggcccccgagccgaacggtggcctaaggcccctgacgaccggagttggccctttgcccgcttgtccgatgacaccaggagcccccaacccccaggacggtcccgaggccactgtgggaaggccgctcctgtcgtcttccgaccccgaggtcatcggcacagaagacgggtgcgccccgaggggccactcggacgaagaacgccccgggggtgcggcccctagcgaagaagatcggcctcgccgaaaggtgcagcggcctgtctactttgttagtgaggccctccgggacgccaagacccgatacccacaggcccagaagatgctttacgctattctgatggcctcgaggaaactgcgccattatttccaggcgcatcgggtcgctgtggttacgtcttaccccctcggtcaaatcttgcataatcgagagggtacaggacgagtggtaaaatgggcaatcgagctttccgagttcgatctgcactttgaaccacgccacgctatcaagagccaggccctcgccgattttgtggcagagtggaccccggctccagagaccgtctcaatacccgaggccagcacgaacccctcacagctgcctcaaaccgcccactgggtgatgcagtttgacggttctctgtctcttcagggcgccggtgcaggggtcacgttgacctctccgaacggagacgtcctcagatatttggtccgtctcgacttccgagcgactaacaatatggcagagtacgagggactccttgccggactcagagtggcggctggactggggatccgccgcctcttggtattaggcgactcccagctagtcgttaaccaggtctgtaaggagtaccggtgctctgacccacagatggacgcctacgtacgccaagtgcggcgtatggagcgccatttcgacgggatagagcttcggcatgtacccagaagggacaacatgatagccgacgaactctcaaggctcgcgtcctcgcgagcccagaccccaccgggcgcctttgaagaaaggcttacccagccgtcggcgcgacccgacccctcaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctgatagaagggaccctctatcggcgcgcggctaacggaatcctcctgaagtgcattcctcaggaacaaggcgttgagcttcttgttgacatccatgagggcgagtgcggagcccattccgcctcgcgcaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcgtggccatttgctgtctgggggcttgatatcctgggaccgttcaaacgggccccaggcgggtttgagtatctgtatgttgcgatcgacaagttcactaagtggcccgaggcttatccggttgtcaagatcgataagcactctgctcttaaattcattaagggtatcacggcccgttttggagtacctaaccgtattattacggataatggcacccaattcactagtgaactcttcggcgactactgtgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccgtggaacatcgaacaccttcgtcgcttctacccctgaagggggggggtcgggtgtcaggtttcggctcgggctaaccccgcaccccccctcgggtgtgcagggttagccgggggctaccacacatgcacatatattcctttcagcatttcaataaaagcagtttcaatttcctaaaggttgtgtctgtgccgtttttttttccttttgaagaatcttgacttgaaataatgtcactcgtactcaaccttgccctcgggggctcggttcggtcggctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactagccccgacccgagccattcgaggaccgggacttgggcgcgagcccttatttcaagctaaggcgcaaaaggaccatggcacagatcatcctcaactcatatatatagcaaaataaaactaacacaaaaatttttcatcatttctcattgcagattaagttagattgtacaaaaaagaggcatgaaggccttagaagaaagaacaagaaaaaagttaagagtggcgggggcctgggggctcattcatatgcgcccgggtcgccggcctcgtcgccaccgccgtcctcgctgctggtgtcgccttcctcgtcggagctgggggcgaacgcgagccgaggggccgagccctcgaagccattgacgatgtggtcagcagcatccccgacccgcacgcgcgcctcgtcctcggtcccgggagggaactcctccagcgccatccatggggagaagttgggatcccgggcctggtaacttgccagcacgagttcgaccgccccccgggcgaggtccctcgaggatgccttaatggtcttctcaagctcctcggggagtcgttcgagaacccaggccatcctgttgaggtgcggagcgaggccttccagattggtggggggcaccgtcgtctggcctccccagaggcctgcttgccgaccggcgcgcttcatgcgggagaccgcgtcccaaagcatgccgggcccaatctcgcccgccaagcgaagggcctcggcctccccagtggaggagtccagcgcgcgctgcatgtcagcgacggtgtgttcggcagccgcgaggcgagcggctaagtcgctttcgcccgcagccgccccaccgatgcgcgcccccgcggccagctctttctcccgtgcctcgaggttggcagcccgctgctccagcgcggctctctcggcacggacgctttcaaggttgcggcgcgcctgctcctcttgcgccgcctcgcggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccaccagcgtcgcctcccggagagcagtggcggcctcgcggtccatcaagcccctctccacggcgccggcatgttcttccagcgccatggcacgggcctcaagggcctcctcgcgccgccgggacgccgcttcggcttccgttgcccgccgctctcgggcggcggcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctctcgggcgatctccgccagcgccgccttgcgggcttcgagctccgagatgtggcggcgatgggccttacggcccacctccaccatggcgtccaccgagcgccgcccctcctcgacgcgcgcccatgcggcctcgagctccgctcgttctgcacgcagggcctccacctgggtgttgaacccatccagcaccgcggtgtttgcggcggccaaggcctgcataatgggctcggcgctcaccggggcgacggaagatgaggaaaaaagccgccttggagaaaaggcgacgcggcttggccccccggaggatacgctgagctcggggatgtcccccgggcccgttcggtcctgggcgtcgcccggtgaggtaggcccaggcgatgcgcccgcggcctcgtcgcgagccgcctcggaggatgtcgcctgagggccgcccgagggagtgggcccaagtgacgctgtcgcctcagcctggcgagcccgggcggcctcctcccgagcagcttcctccgcttggcgaacccgggcggcctcccgggcggcctcttcagcttcccgaaggcgggctgcggcttcacgccggtcagactcccgccttcgctcctctgcggccgctggatcttcggcctcggactggccggacttggggtggcgggaggaatgcgacgggacatcgctgaagcagaagaaaaaaccagaaggcgaacaaaatgagcaagaaaaaacttctttttggagaaagatggttgcaatgagagtgagacgaacctgcgagggggtcggttgaatgaccaccttggaggggaaattaagtttccccgggctggttccgtctcccccatcttgcggaggcgcttcttcttgcgctccccctcgggctgtgacgtcggcgcggccccctccgggcgccgaccgctggtacgcaccgccccgccccctcggggaggagatgggggaggtgttcctcccagcttcctcttccccggggcgtcggcaggacggctgctccccgagcccccgacgcggggcccagaagcacgaccccctcctggggcagatcgtttcccccggcggctctcgcccgcgccatcgtggcccttaggggctctctcctctgaggccccaacccccagcataatggatagaatggagacgcggtcgggatcgatgcagagggggaggatctcctgaggaaggcgagacgcctccgcggagctaagattaagcaccctttggactacgatcttgaagtcctcaggagcccaatcccatctggttccctgatgggtccgcatgtaatcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtactcctcccccagatctgccggcgcccgccagctggagacctgcgccgggggctggcttggaaggcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgatggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggtggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggcagagaaagagttagagctcaggcagcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcttgaagtggatgtgcagttgtggcaatcgaaacggattgtatcgtgcgcgcgttaattacgctcgccaaccgaagcggcgttaccgtatctccgggcgagacaaatctgctcacccagattcgcgcgctgctcaagtggtgtggcagtcttgaatagaccgcccattatggacaaccaaagttaccaataccaatgtgcgtgaattgagaccgttgggtattttgcccaactacggaaaccggtcccacctgtcacagggtggcgtcacacctgaccgcttcccttgggaagggaaattgctctggcataacgccgggggctactgtcggtgatatgggaccgggagtatcatgaccagaggcttgaggcagacgcaaccgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaaggctgcgcgacatatatgggataagtgagcacagctgt

SEQ ID NO: 23761 - DNA, 13750 bp, Oryza sativa
agcgggatagacgaacgcgccacgccgcatttaatgcggcgcagcgcatgcttatccggtccgtgaccagtcgcggtatgtgactggtcacagaccggtcagatcgcgggttaggtggcaacaggcggcctgtcgcacgcctcgccccgtcccgtcggaatgatgagagcttcctggctctcgtccctagccggagccggcgtgctaactcctggagttggtatgtcagtcccggtcagatccattccagacttcggcgcaagcatggcaaggaagtcgctggccattgaatgaaagttgaaacgggcgtccaccgagagagctgatgagcggagcagaagatgtgcgctgtgcttgtcagaggtcacttccggctgtagactagccctctttgtaaaaagtgtgtttcctttcttaggcagctagaggcccatgtggtgacccctgactagataaaaaggaggcccaggcctaagagagagggggttttttggggggactctgggagattgcagagcctgaactctctctcgttctcgagctctgtattccttcacacacagatccaccagaacacaggagtagggtgttacgcttctcagcggcccgaacctgtctacgtcgcccgtgtcttgcgcgcttcctctctcgctgacattcctcagatcgagggcgaagaatctcacttagcgcccccggccgaactggcaaaggggggcctgcgcggtctcccggtgaggagccccacgctccgtcaccattgattttttgtccaacgtttgaccattcattttattaaaacaaatttatgtaattatcatttattttattatgacttgattcgtcatcaattattctttaagcatgacataaatattttcatatttgctcaaaaattttgaataaaacgaatggtcaaacattggtcgaaaagtcaacggcgtaatacattaaaatattaaaatatggagggattattatgcaactatattggaacaggggtgcaaaccatattgggatgaagggagtatatatcattctgtgtgaaaatgcatgaaatctgcaaaccatttttctttcaatcaacaagattcttatcgatcgagtactacgtgcgtaaggtacgtacattttgctgaagtactctcgtggaagagctagctagctcacttttcatgcaacaattcattaacggccatattacagtggtcaacaattcattaacatgccttgcagaggcttactccaagttgctctgcataggaaggccaataatttctttggtacctaaagtggtggcgtgaggtacattacattgtcgacaaatcgtaaatacgtacgtaacccactatcttaaataagtaaattttgtcctaaatagtactatgagttccaggcaatggtgccgtcttatgtgatggtcatacaggacacactaactatctcgatcttatcttatcctatatggctagataacgtcgcacatttcaattttggaacaataactgataaatcttaaaaaatatttgcaatttaattaggtggtcgaaccaaatatatatatacacggtcgtacctcacaaactagacacaagtcgagtgtttctttcgcaaaatacatttgcatatactgtatatatgcgactcaaactagggatgataattttgggcatgggtccgggtatccgtggatacctgacccaatgggcacggatgtgagtgtgatttttacctatgggtaacccatgcccaacccaccgatacatatgtattagttaatttcgacttatctcttaattcttatacccctttctcttggttctttttttatataagttgtgatgtaattcaaattatagttgataactgataatttggtaaattattaattttacttctctttgttaaattatctatctttcgagttattattcatgtgagatccattggatacccaccgagcattcccgtgcccgtcgggtatgggtacgtgcacaaagttttgacagctaaccctagtgggtagggttcaggagggcgacgacaggcatgcggtcgggcattgttttgctctacccgtgtccgacccgacctgttgctatccctgactcaaacctggaactccctcatcacacgtcatcttgccatcttatgtatacgtcatcttgccatcttatgtatagagcaatgttagcatgaaataatttattttgcttccgcgatctttttgtccgaaactctttttgtccgaaacttgtgacaatagggaggcatctaaatgactttaaaaaaaatggtaaatataataattataaattttatctccatcaaaattaagataaatacttgaaggcaaattctactacatgatagagtgacttcacggtttagttgtaggacaccatacgaagtgacttcttgtgggaatccggaagacactacgtaagtgtgaaaattagctaatggatagcatgctgattaagatattcatttctggttaaataagggaaagaaagctgcacgaaagtttggagatacccttgggccacttgtcaattctcccatcatcacatatctagtttaattatagtttggcattagtagagaaataacttttgcatatggtcaaaaggcattttcacaggtggacgcttgactcccttgccccagatgtatatgaaatttaaaatttttccaggcaggcagccacgcaccacatgcgaaaacaggattttcatatatgaagcattaacccacccatatgcaatatctaaattaggaaaaaaaaaccaaaatccaaaaaacccaaaaccctagctcccattcccatccctcttagctcactgccgcccaccgtcgccatcgccccttccggggccgagggcagcgctgccggattatgtagccacactgtaccaccacaattactgaggatttttccgaaagaaaaaaaatgaatagaagatgctctctaaggggttaaaaaaatgaataaccgatttaattaattaccatcgatatatcagcaataatagtcgcagctttgaccagtaactggagctcattcatatggaaacccacgaatgctaaattaagttacatagacatgacttaattcccactaaatcaaggatgtttccttgctaatggaaatgatcgagtagctgactttgctatacattgaccaataatcacagctccaacttgaaaaggctaatgcatggtacagtgtttcttgaggagaaatgaacagttgccgacttgccatcaattgatcaataaccacgacattcaactgagttgaaaagactaaattaagttatatataccaataatcaaaattgaattgaatgcattattctaggagaaatggatgattgtatatttacacaaattattgtatggaaattgttagttttctagtgaccgtgatgatgagctggatttcctcaaatcttagccacctgaatctaatgcccagggagtcatctttaagcttcggatgggaaggagacgaaatggaggagagtaatacaagtcaccagcgacgacttcctagtagcaacaacagtgccggaagtatatatatggtagagaacttacagtttagggtttcggggtgtttttgccgcccaaggggaggggacactagaatggataccctcatctcaatcagacggtaagccccatctcaatcgggcatggcgtccgtcacaggttagaaatcactgatgtgaagagctatctcaatcggacaaacggccgtcacggatgattctatctcaatcgggccctaagtaaagcccgtcaccgatagctttgacccagacgaccagtcaaactatagcccgtcacagatgacctatcttaatcgggccacagacgaccagtcaaactatagcccgtcacagatgacctatctcaatcggaccacaactagcgcccgtcagtcatctgtgacgggcataaattttgtttttttggctagccctcactcgtgtgcacccacttcccagtcggtcacccatcccgaaattgctccagaccaagcacacttaacatcaaagttctttggagattggcttctggaagtgtagttgtaacatgttagtatgagtattctattaatcctattatgccctaggccaggatgtcaaattggggttattaaatgatttcaaatggaaaagtcaccaaaaccaaagttgtagaactcatcgaggtgcaaaatttttatttttgtcatttctccatctgactctatttaaacaatttgaaatttgaaattcaaagtttgaaaagttcaaatagaattttagatcagtgaacgactccaactgaaaaagtcatcaacaacaaaattgtataactcatcaaaatctataacttttattttggccatttttctatataacattttttgaaccgtttgaatttgaatttgaaaatatgacaacttcaaacaacattttcaaatactaaatgatatcaactgaaaaagtcatcaacaacaaagttgaataactcatcaagatctaaaacttttattttggtcatttcttcatacgacaaagtgatagtaacattgttcacaaaattgacatatctcttatctggttctatacactataacacatatatgtaaaatttgtgaataatattaataacgtttcgtcggatgaagaaataacaaaaataaaagttttagaccttgatgagttattcaactttgttgttgatgactttttcagttgatatcatttagtatttaaaaatgttgtttgaagttgtcatatttttaaattcaaattgaaactgttcaaaaaaaagttatattgaaaaatgaccaaactaaaatttgtaaatattgataagttatacaactttgttgttgacattttttccatttgaaatcatttactacccgtaaaattattttgacttataaaatgaattattatacggcactaaattattttgctatagtcaacttacaaatataaacatttcatatgaaaatagaaaatagtcatcggtgacgggttttagttaatgcccgatagagattaagtatatagcccatcactgatgagtcatctgtgacgggcctagttgttatctcaaacgggcctcaagttggtgcacgtcacagatgatggtcattgtgacgggccacaacttgaggcccgtttgagatatggaatgttatctcaatcgggtctaaagttgtggtccgtcactgataggtgtcatccgtgatgggcttaagttttatgcccatctaacatgtctatgcgaccatatctcaatcggacacttttcggcccgattgagatgacttccttgtgacggcccgctatttctaagcatattagagcccgtcacagatagaaggatctgtactagtgggaggagaatttctctaggcttagatcgatgtccgttagtcgtattccttatgtatctattatgttataaagataactagctcttcaatgatatgagccacaaattaagttcacccgagagactagaaaatctcatattaattaacttaagaatgattttttttaccattaaatcatagtgggcctaaattattgaggtgtagattggtcgataattgtataccatccaacaattttatttttaaatatatcgtagacacaaattaccactgtacgcatagaaacataaagagccttctatttttaaaatatataatattgtgtacaaattaaattgtatgcatggacaaaaaattaagactccaacactattcagtttcatataaaaaccataattgtatttatagaaaaaaaggattatgaataaaatccaatttctaccttttatcaagctctgctaatcctatcttcctatatagttggcacccactaaaaggcatttactcctataaaacaaaccatgcaagaagccacatcatcaataattctaagccatcggatcgtatcctatcttattataaaattatcctacactaactccttaaacttaacatgcaaagatgccacatcatcatcgccacatcaccatccactaattaacaagatgccacatatcatccactaacaatcatcacatttaaacatcatgcaagcatactatatctttatagtttttataatttaagagcttttcaaatacaaacatatgaaattatcatccaacataattcacataatgtttcaatgtatatttttattatgttttatgatatcctatatacttatatagttcatcctcacttagttagtgcttaaatgattaatctatagtccaaattatctttctccttttttcctctaattaagtcatatcacatcaattgtttttagcctttagatgattaatctacggtccaaactatctccctacttttcttcttccataaagtcataccaccttactttttacgtttgaatcatcattctacatactatttatatttaaattatcataaaccacattaatttacttaatctgatgttatctagctatcttacacgttattttttttattgttatcgtactaaattcccgcagcaatgcacggggtttcacctagttagtacatagttatcagccgttggataaagaagctactcatccatctaatttaatcattgattacttatccagtcacctccctttagctcataatcgcgcgtgacattgttatccattttgcgcataatactatgttttcccctcccaagtcctccgagataatgcaaattaacttatctttttttaatacaactcaaattattgtataagatgtgagttttgttttgttataaataattggataacataaggtaattagacatcattaacctaaacctatttttgaaacaaccttgagataaagcaaagaggtgcagactactctaattatgacgatatccaaattgtgcatgaaaataactttcgtgcatcataaaaaaacacaatgacatttaaaaaaataaaacatgaattgcattgtaatagcagaggcggctatatatgaagccatattatcatttattttgtatatatacagagttacatctaatcatttaaaacattgattttatttgacgataaaactagcaaatcccacggcaaggcgcggggtgccaactagttattgtatataattaaacaattaatggttgcggctttcggcaggcacacaacaggccaactggggagggctacttgaggtgatgaatgatcttagctacaaatgcacttaccatcattcctatttggtttaggactgcaagcatcaatcatttatgtatttttattcgaaacaaaaaccatttcataatcttcaagagagatgtaatggattaatacgattgatgcaaaacaaactgatttcaaagattgctaccttaagaaatagcctgtgaaaaacgtattttaatgtgcatccagcttcttaatccgcatgtgtaaaaaattttcacgggcattttgtttggtcgttctgtaaaaatatctgaactctcaactagaattgaagcagatcagaaagcgctcatacaaacaggttaattatcagccgtctgtaaaaaataattaccagcagataagaaagcgctcatccacggcagattgatccactgcctcgcaaacttcggtcgtcgggatcgaagaagacgagggagagagggaggagaagcggcgggatccgcgagtagaccgcagccaccaacgtccccatcgctgcagtcacgccacgccatcaccgtagccgtagccatagccgttaccgagggcggcggatccagcactcccgagggcggcgccaccggatccgctgcccgccgtcgccgctcagtcccaccgccaccacctgccgcttccgaggtcgagggcggcggatccgcaagctgccgccactagctccagaggtcggtggcgggtgcatccgcccgctgcccgccaccgcccactgccgcccgccgccgccgctcccgaggttggggtcggtggatccgcgcgtcgatgtcgccaccgaggacggaggcggcgcagtggggggagagaggcggcgcggtgggggggggggagagagaaggtacggatgattggaaagcggaggcagcgcggtggggagagaggcggcggcagcgcagtgaatgggagcgaggcgacgtgcctggtctagggttagggtctaggcgcggtgaattgaagtgcgaggcgaggcttttttccgtggatattttccagcatttttcttttcgtttgtaggtacaaaacattgctgacagataatcaatcactaagttttgctgacatataattggtttctacttataatattgctgacagatattttgatcaaaaaatatttagatttgctgacatataacatgtcatattacatagtattgccaacatataatttaccaaaaacctttactaccaaatagtctaacaataattttttatttttaccggcaatataatttaccaaaaacctttactaccaaatagtctaacaataattgtttatttttaccgacagatgtccgttggcaatcttgtgtcatggtgtagtgtagctagttgtatacatacaatgctttactttgctatatatcgatcgatcaacagttgcggcttaacacattcaagcatccaggcacacgcacgtacgtactatacacacggacacacctctgtctagcactgggcacacatatctgaagataactgagaaaaaccaattaaattaagtacacctagttctgtctatcttaacgccgtgtacgtacgtatctgcttaattataataagagattaagagtgatcagagacgcaaccagtaagtacgttgtgccgcttgtgctccatccatgctgtacgtacgcatagcacgtacaataatagttccaacttgacatgcatgaacgaacacgtagctagctaccttgctggcccctgtataaatacccctatataccctagctctaccagccagccaaacagtagcaacatgagttcagctcgccgcctcctcctcctcgccggcgccgctgccgccatcgcactcctgctctcggccactgccccggtggccggagccgaggacgacggctacagctacatccctggctcgcccagggggccgcagaactggggcagcctgaaaccggaatgggccacctgcagcagcggtaagatgcagtcgccaatcaacctcggcctcctcgacctcaccttggctcccggcctcggcaacctcaactacacctacaagaacgccaacgcctccgtcgtcaaccgtggccacgacatcatggttaggtttgacggcgacgctggtagcctaaagataaatggcacggcgtaccagctccggcaaatgcactggcatacgccgtcggagcacaccatcgatggccggaggtatgacatggagctacatatggtgcacctcaatgcccagaaccaggccgccgtcattggcatcctctacaccatcggcaccaccccggacgagtttctgcaaaaggtctgttaaatacataattcacatagtttgcacacatggctaatgcttctaagaaaaatcaaaatctgtaactttttacagtaacaactaaactagcaatatatatttttattgtcaagctagtatttgttgttattaggttcatatttgaagaactacacatgatgttgaataattcaccgttattgatgatatactaattgttttaacttattagagacgacatagaaaactaatatgtcttatattgtagaacaaaggaagcactgataatatcatcaatggtttgtcatgtctattttaatgtgatagtttggagcaactgatgaccaagatagatatattgtttctttaaccatcacaaacagattattacacatgtatattcttgctatgctgaacttcttgttgcatgcagatggagccttatataattgcgatatcaaaccaagaaggtaaagagaagatggtcgttggtggggcggatccaaatgtagccaagggaaaggataccgtgtactatcgctacatgggctcctttaccacaccaccttgcacggagggggtcatctggaccgttgtcaggaaggtacgtatgtatatcataagtaggttaatttcacattttaaaactattttgttgtttctttttgtcaagaattaatctttaaacaggatactataagttaccatatttagtttcttagtgacgacttactaaaatcttaaatataggagaaatactaaatatctaatagtattctaaataaatagtgtttatggtaaggtctacgagcacaaataagtaataaattggtatccaaggaacaacctactcaacggtagcttctacctgtctagctctcagcgagtacaactttcaagctctcagcaaggaacaacctacacaagttttttggtttcatctgccaaggcctagcttgtataaatttaacccagtttcaatctcttgccacctttaatcctacatatcaccctattaaagctgtaaacaatctataacatgaagcactaggaatgtgctaaggcgaccacattcagttttagttggtgagggaagttcttttagttatgtacttatgttcctatgctatctgtctcttttcttcttcaggtgcacaccgtgtcactgtcccaaatcacacttctcaaggcagctgtgctcatggtaagtgaaaaagtcgttcatgtttaatactctcttcgtctctaaatatttgacgccgttgattttttaaaacatgtttgattgttcgtcctattcaaaaacttttgtaaaatatgtaaaattatatgtatacataaaagtatatttaacaatgaatcaaatgataggaaaataattattaattacttaaatttattgaataagacgaacggtcaaacatatttaaaaaagtcaataacgtcaaatatttagggacggagggagtatctattaatagatgacaatgaacaattatttcgtttgttcttacttgatgatctgcctatgtgcatacatgcagggtaatgagaacaacgcgagacccctccaggatgtgaacaacagggagattgacctgttctttcctcttcctctgatcaataactgaacgacatgcttgacctacacagttgatttacaacgtatcgcctgacacacgcgcatggagaatcatcaaacatatatgtacttataaatatatagtattactcatgtttgtgtaaatctcatcatcatggtgtcactatatatatatatatatatatatatatatatatgtgtgtgtaagtccattgttagtcttgatcacctagcttcataaagagaggagcatatatatgtcgttcaatcatatttgcatagcataataatgcatgcatagtttttatatgtatctctttccggtgctgctatgtatctctatacgattaaataaaaataccaatgttttataattatgtaaatcatcatattcatcttcatagcataaaaagtatgttgataaggatttggccatggcccatggagtaggccaacttaatatatagtactatccagctggaattgtgctatggtaaacttaaaattagaaaaattatttgtgtatacctgatcgtattggccatatcttttttttcagggaatgtcatatcccttttttatacatgataaccttatctttaatgagtggttaaattaaccatacttcatggtgtttggaggaatgagctgttagagatgtataaaccctgccccgtcagtcatgtgtttccatagcataacatctggaatgatttgttattgcgagatatggtgaatggcatatgtaatgtgtcatttattatgaaccgtttatagatgagtcttcatctataatagcttataaatatgacatgttagagatgagttcttctctctaattggcctggtttttaaccgttacatcgatgattaatacctgatccgttcaaatgttaatgtccagcccacatggccttctctctctctctctctctctctggactagctacatctcagctagctatggccgccgccttgcgttgtgcttagttacatttctaagtgcacaattgactccaatattgtcctcactttttgttgactttgttcatgcctacaacttaacccttttaccatgtgcgtgctctcttattggtctcaccctttgaatgtcctatacgtgccttcctaaaaggtaagcttgtatgtaggccaccttgtccacaagatcacttaattgatcctagtacaattgtctagtatttcttattacctcttatctcttttgtcaatatcgttgatctttctaaatattatgttgccattctttctaatgatcttgatttagtttatgaaaacacataattagatttttcactcaaaaatctggtttcataaaactacaagcttatataaaaaatgtcaatgttatggattaggtatatatcctatacttagattcgtagctaccataaataccgcataccgaatatcaaacagaaaagtatatttaaatatggtataagaatgaaaactccttccataggaatagaggttgtcggagtctgatacggaaaaggcaaggtcttatctacctgcattctacaagggctatccgacttttacttggagaggaagttgcctacatgcataaatacaatgttccctagaagaggagggcatggaatcacaagccatagctacaagccacaaagcagatccgtccagagaaagtcaatagctagcccctgactataagtcatcggatagttctcggcaaagatcaattggtaggctagattagctaacttactccactattgttatatgtgagagacatttcataactatacatataaattagattagtgctattacccatgtcgggggcctgaaccagtataaaaatctattatcttccatcttctttaccgcaatctcgcgtatatctacgtaccaacgatccccatactctatatttaaataccgcaggcggctatagcccatcgacaaaaaagtcaacctcaaagtcacatctcaaaccatgaaaagtcaaaacattgcaaattttttggtatattagtcacatagcctaattaatgtatttttggagtgagtaatgattacttgccactgttagcaacttagcaccttaattatctccatgtacaatgatcaaatggttcgtgtattttcatggttagccttactataactttttccttctgccatctaattttgaccgacaccgacgtatccatatatgtgcatcctatctctactattagaaaaattgaagttgtttttgccgatattttggtacgtcatccgtgtatgagtcggtttctaagttcgtttgcttttggaaatacacattcgtatttgggtcggtttttaagatccttcaatttttagtaatacagaaggaattatataatatatctgtcaaaaaaaactcgcatgctaactagatgatcggacttctaactatagctcatgatttttctatatatatatatatatatatatatatatatatatatatatatatatatatatatatatatatatatatatatatatacacacatatacatatatacatacacatatacacatatacatatatatacatatacacatatacacatatatatatatatatatgtatatatatatat

SEQ ID NO: 23762 - DNA, 524 bp, Oryza sativa
  unsure (1)..(524): unsure at all n locations
cggcggcataatatgccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagacgatatcgccatangcaacggcagcggcgcacaccaaccgtggaggcgatgaaaccaatcggcagcaacgaaggcggccggcggtacatgtataaaataatagattaaataataattagtgacatgtgaattaattctaatttatataagaaaatttagaacgataaacctgatttgtgtttgtcacccaactcttaatgatgcatgtacgtcatcggctttacatgtatcaacctggtcagccttgacgttcatcgttgactgcatctgact

SEQ ID NO: 23763 - DNA, 933 bp, Oryza sativa
cttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagtttagtcagggcttagctccagttaccttttgttttccgctgcatttttgtaagacttttatgacgtttgtaagacgtggatctgaatgtcaacattgtcgtttgtgtaccccggctggtcctggacggggattttaatgcacattctgcttggaattctattcgggaatttctgggcgtgacaatcggcccggccgccacggtggcacaatgtcagcgccagtcccgttggcgctgacacggccaacctcagcgccaatgcgcttggcgctgagccgacggcctagttttggttgaagtttttggcaggggttagtttcgaaataagtttttgaaaagggtcaatttgtcaaaaaaaacggttcttactagacataactctagaatgagcgtataatggtgtaaataataaaaatattatgatctatcatgtgaaaatgatattaatatttttttcatatgaagaaatggtattgaaccatatatagttttactagttctcctaaacatataagaagaaaaatctaacaaaatatataagtaacgggtattgataacaacaagcaaaaaaaaggttatgtttggatgtaaaaaaaggttaggaagcggtaacatgcaaggataatactcaacttagttggattcttcgctacctgtcacttggcggccatacaacatatatcataccatatactttagttttcaattcaacatttaatatatttaaatatactgaaaaaatgcc

SEQ ID NO: 23764 - DNA, 1015 bp, Oryza sativa
cgacttcaccgccggcctgcctccgtcggcgccgagtggtgcctccgcctacacgactggcctattatgccgctgctgttgggcgtctacgacttcaccgccggcctgcctccgtcgccgccgattggtgcctccgcctacacggctggcctattatgccgccgctgttgggcgtttacgacttcaccgccggcctgtctccgtcgccgccgactggtgtcctcgcctatacggttggttggtcacaccaccgttcatgggcgtccacgtcttcaccacgggcctgcctccgtcgccgccgattggtgtctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtttacgacttcaccgccggcctgcctccgtcgccgccgactggtgccctcgcctatacggctggttggtcataccaccgttcatgggcgtccacgtcttcaccaccggcctgcctccgtcgccgccgagtggtgcctccgcctacacggctggcctattatgccgctgctgttgggcgtctacgtcttcaccgccgggctgcctccgtcgccgccgattggtgcctccgtctacacgggtggcctattatgccgccgctgttgggcgtctacgaattcaccgccgggctgcctccgttccgccgagtggggcctccgcctacacggctggcctattatgccgctgctgttgggcgttacaactttaccgccgggctgccttcgttgccgccgattggtgcctccgcctacacgggtgggctattatgccaccgctgttgggcgtttacaactttaaccgccggccttgtctccgtcgccgccgac

SEQ ID NO: 23765 - DNA, 458 bp, Oryza sativa
tcggccgggcggtttgccatagattgcttctgcgcggcaggcggcacatgcatgtgtggccgcaaggccccgcaaacggtgtaacccaccaccgttgtcacaggaggcccggccggcttgtcgtgtactgtgtacgtacgtgtccgcggacatttcggccgcttctgaacttgagagaagttgagatcgatgcatgcaacggctgcctcgtcggcttctgaacctgaccactctgggttttctcttttctgtttctcctttcgcaaacttgtgctgatgcgaacgtacgtgcggcccgtgattgtgagcacgaaagtacgcgtcatgcgtgcggcgggttggaccgtgaccgcggcggacgttcagcccgttctaaaatgctcggcccgtttgacgatttgactggctgttcggtagccggtttcggcttttgagccaccgcgcccaggctcgtgctt
